United States Patent 7,867,704 (MYCOBACTERIAL DIAGNOSTICS) - sequence listing, part 3

SEQ ID NO: 1355 - DNA, 4830849 bp, Mycobacterium paratuberculosis (residues 3,220,567-4,830,849 of 4,830,849)
  misc_feature (1)...(4830849): n = A,T,C or G
ctggttggtatttcggcagcctggtctgctcggcgttcctttgcgcgtatctggtaacccggtggatccagctgcccgggctgatcgcggtgaccgcccgatgggacttcgcgccgggaacgttgggcatcgcgttcgcgggggcctttctcgcggtgcataccacggtgttgtcgggcatcaacgtggcctatccgcagcgtcagcagtggtacgactgacggagcgcaggcgatgacggtattggactatccggtatggctgcgcgtcgatcattggctcaacgtgctctttgtgacgctgataattcgcagcggcatcgagatactttccacccacccgaagttgtactggcacgacgacagcaagccgggcaccgagtgggcgcgctttacccgaaaggtgatgccccgcgaccggatctacgacaccctcgatgaggaggaggattatcacctgttgatttccctgcccggccacgcgcagctgggcatgggccggcactggcatttcttcgcggtgatcggctgggtgctggtggggctttcctattacgtcctgctgttcgccaccggccaatggcaccgctactggccctattcctggtcgatcttccccgaggcgttcaacgacatcgtcacctatctgacgttcaatctgccgccggtgctgcccggtgagcccctggacgccatgcagaagctgacgtacgcgggggtggtgttcgtgctggcgccgttccagatcctcaccggcgccgcgcagtccccggcgatcgaggcgcgcttcccgtggtacgtgcggatgtggggcggtcggcaatgggcccgcagcctgcatttcctggggctggtcgcctttgtggtgttcatcgtgatccacctgtcgatgatcttcttctggggctggggaaggctcaccgccgcaatgattttcggctcggtacgcaacacctactgggcgacggcgatctcgctgctgatcatcgccgcgatcgtcgggatccatgtggcggccacgctgtggagtctgcggcatccacgctccgtgcagcgggtgctgggtcgggtggtcaccgcggcccggctgatgctgctgcgcccgcttaattcgcggcagaactacccggcgagcaagatcaccccgcggcatcgcatcaacggaaagccgcccaccagcacggaatacaaggtgatggcggtgcacaacttcgtcgactggcggctgcgggtgggcggactggtggaaaacccggtagtcctcgaccttgccgcgctgcgttcgctggccgagccggaaacccaacgggtgatgcacaattgcgtgcagggctggaccagcatcggggagtggaccggagttcagctgcgccagctggtcgatctggtgcggccgctgccgcaggcgcgttacatttgctttctgaccatgcaggacaacagcaccgacgagccggcctcgcacggcggcggccagttctacgaagtgctcgacctggaattcgccgacaagccgcagaccctgctggcctatgaaatgaacggcgccccactgccgatccagcacggcgcaccgttgcggctgcgggtggaaacgcaggtgggtttcaagatggccaagtggatcaaccagatcgagttcgtcgacgacttcgccgggatcggcatgggcaccggcggttggcgtgaggaccgcgtgtactacgacaaggacgtggagatctgagatgtccgacgcggcggccaacggcatcggggtgcggcccgagctgatcagcttggacgcggcggccgtccatcgggtgcgcgagcaggtcgcggccaagggtgggcactgcgaggcgtgcggcgcaacggatttcgtggtcggtgacgtcctctacctgggtttcctgtttctgaacgaggaggccgacgcctacctggtggcgttgacctgtgccaatccgcaatgccccgcgtcgcggaccgcgatcaggctgtccgagaacgagtttttgaccagcggccgcggcgccgccggccgttagccgaggcgtccgccgctcccgggagtcggggctgggccaagccgaatctgtcgatcaggggtgacaattcgcgcagccgatcgcacaacgcttggaatcggcgctcgtcttgttcgacgagttgtcccagcgcgctgtagtgcgccatgcgcggcagccgcccggcgagcgcggcgccccacctgatgctcaggtcgtaaacccgttcgtcatcgacgtcctcgcgccccccgagtcgttcgagcgcctcgatctgctcaccgacgaacgcaaggtcgtcgtcgatgtcgatccgttcccggccgggggatgccacgctgcggcggataccctgccgcggcgtcggttacacgccgcgccgcggcaggggcgcgagatcaggccgagacgggcttcttggcggccggcgcggacaccttcatcagcttcatcaggttgccgcccatgatcttcgccttgtcctcgtcgctgaaatcggccagctcgtcgacgaagctgatcgggtccttcaaaccctcggggtgcggccagtccgatccgaacaccacccggtcggtgcccaccatgttgacgatctcggcgaatcggtcctcccagaacgggctgacgtagacgcaccgcttgaacgtctcgatcggatcctcggcgaacgcctgcggcatcttcttgtacacgcccttgaggcccttgaacaggtgcggcacccagtctgcgccgttctcgatggacaggatgcgcaggtcggggttgcgggacagcgcgccgtggcagatcaacgcgccgaacgcgtcctcgacgggccggtgccccatggccaggctgcggaaggcggtgggcttgaacggcaggaactcgtcgccgggttcccagatgttgagcagctcggagtagccgctgtccgaggcgtgcatcgagacggggatctcggcccgcacgcaggcctgccagaacgggtcgaactcctcgaagccgaacgagcggctgccgcggtagccgggcaccggcgcgggccggaccagcacggtgcgggcgccgcgctcgaggcaccactcgagctcctcgagcgcgcggtcgacgatcggcaacgtgatcaccggggtggcgaagatgcggtccttgtagttgaacgaccactgctcgtacatccactggttgagcgcgtggatgacgtcgtgcgtcatctccgggtcgtccttcatgcgctcctcgaccaggctggccagggtggggaacatcagcgcgtagtcgatgccgagttcgtccatcacctccagccgggcgccgggttcgcggaaggccggaatggccttcatcggctcgccgaggatttcgcggtagctcttgccacccgagccgttgcggaagtactcctcctgggcgccgggacgggccaccacttcgaacgtcgggttggggatgtattcgctgatgtggccgcgcaccacgatcttggtccggccgcggatctggacgtagtcgatgacgtgcttgcggtggtccggcaggaacttggtcagcgcttcctgcggctcgtacatgtggttgtcggcatcgaacaccgggaagggaagctcgcgagacggcatggcgatctccttgcagaaggctgtaattctcactgtgtggtaatgacgttaccacttgtgcggaacaaggtgtacctgcccgttcggccgtattcgtcgctattcggccgggggtagcccggagctcggcgtgtcgccgttgatgatggcgaagttcacggtggcggtggcgagcagctcgtcgtcgccgtcgccgaagatgtccacctgcattaccatcgcccgccgtcccgagcgcagcatcctgggcaccgcgaaggccgaaccctgccgcaccggccgcaggtagcggacgaacaggtccgcggtggtcatcgtggtgccgggccgcagatagtccagcccgaactgcccgcccgccacatcgaccagcgtggcgatcaggccgccctgcagcgcgccggaggtgttgaccaccgcggggctgaccggcatggtcatcgcgaactgaccgttgcgggtgccggggcgcatgccgatctgcccgaacaactccgccagcgacggcgcgctcgagtcgtcgtcggtgtcccggatgcccagcgcccggctgcagaagtcgtagagctggccggcgtcgacgggggtgccgttcaattccgcacccagccagtgcaatcgctgcgcacccatcatggtctgcatgacgatggcggccgccgccccgacgtccaatccggcgttgaacactccctcggtgatgccctggccgacgatgtcgcggatcagccggtgcagcggggagagcacccgggcgtattcgcgcggacgggtttcggccaggtgctggttgtaaagggtcaacgcccgattgaggctgtcctgggtgctcgattccggttgctggctgacccggtcgatcaccaatttcagcgccgcggtgctgtccagcccggcggtctcggcgcgccaggtctgcgccgactgggcgatggtccggtcgaacagccccagcagcagttcgtccttgctgctgaagtgttggtagaaggcgcgcaacgacgtcttggagcgcgcgaccacctcttggacggtgaagtcggtgcgcccggtttcgcccagtatcgccacggccgtcttgatgaagcggtcgccgcgggtgatctcgacgtcctcgttgggctcggccatgagcggttggtcccttccgtcgcgcgctgccggcgctctgagaatgaggttaccgcgctgggcggcggaaccgcggagcccgtcgacgccggtcagccgccccgggccgcgatcatcgccgagcggttgaccttggtcgccgccgtgcgtgggatggcgtcgacgaattcgacggtcttgggcgccttatacggggccagccggcccttggcgtagtcgatcacctgctgctcggtcagcgacgcgccgtcggcgcgctggaccaccgcatgcacccggcgcccccactgcgggtcggccagcccgatcacgacgacgtcggcgattgcgggatggccggccagggcggactcgacttcggccggaaacacgttggcgccgccgctgatgatcatgtcgacccggcggtcgacgatgtagaggtagccgtcctcgtcgaggtggccgatgtccccggcggagcggaagccgtcctcggtcgacggcagcgggggcgccccacccaggtagcggtaccccgcgctcatcggcgcccgcaggtacacgtcgccgtcctcgccggggcccagcggtcgctgctgggagtcgaggatgcggatctcggtgtcgcggaaaccacgcccgacgctgcccgggtgttcgagccactcgtcgccgcgcagcgcggtcagccccaggttttcggtcatgccgtaggccatcacgatctgctcgggggacagcagctcgaaccaggtgtgcagcagcgatggcggcatcaccgcggcccctgcagaatgaacacgatgctggacaggtcgcgctgccggacatcgggccgggctgcgatgcgggccagcatggtgggtgtggcggtgaagttggtgatccggaagcgctcgatcacgtcgagaaccaatgcggcatcgaacttttcgaggatcaccagatggtcgccgcccagcagcatgagcagcggggcgaagccgttggtgtgatacatcggtgcgggcaccatgatggtctgcggctgggccaccggcgtccagttcgacaggaacggctcaccgtgctgcgggatccacagcgagggcgccaggttgaggatcaccttgggcaccccggtggaaccgctgctgcagatgccgttggcggtgggggagacggcgaccggcagggcggcctcggactcgccggccgcgcgcgcctcgagcccccagcggctcgtttcgtcgacgacgacggcggggtcgatcacctcgcgcacccggtcgcgttcccactcgggaaggtcccagtgcatgggcacgggcaccgcgccgatcttccagcaccccagcgtggccagcaccagatgctgcgagttgggaatggcaagtgcgacaagcgaacccgtttgggcgccggtggcggccagggcccggccccactggttggcgcgggcgtcgagctcggcgaacgtcagcgaggtggcggtgccgtcgagcgcgacgacggtcaccgccgtgtcgtcgccgcgttgcccggcgagctgttgcagcttggcgccgaacgggattccgtcggctaacgggttggccgccagttcggccggagccgactcggtcatgccgacaccggctcgctgaacagcgtctcgaaggcgccgtcggccacgcttgggatcagccgcagcgcgagttcctcggtgctcagcggcagccggatcagcggctgggtgtgccggtcgagcacgctgacgtcggactcgtcgcagaatcccaacgctccgagcaactggtgggaggtgcgcatgacctgccgtgcggtgtcggcggccttgagccgaagcaccagcgcgtcggccgaatagacttgcgccggaagcattttcggccgacagatggtgtacttcgcgagttcgtgcaggccgcggaccatgacggcggcatcggcgacggcgaacctgacggcctgaaagtccgccagcggcttgccgaactggatgcgggcctgcacgtggtcggtgacgatgcgcagcgactgttgcaccgcgcccaggatgcgccacgcccccagcaccaggtgcagattgacgtcggcgcccggcacggtcccctccggggcgctcagggtggccggcaccaggaaggggccgagtttggcgcccgtccgcgatcccggccgcggacggtagcgattgccgtcgatgtcggcggcgatccagtcgccggccaggtcgccgtggtcgatgcggggggcggcggggttcaccagggtcagtcgcgcgccgtcgatcgccagcagctcctcgaccagcgggtagggcagcgcggcggcccccgcggcctggcacagcaccgcggcggccagcagatcgtcgggcgccgtgcgcacgtcgagatcgaaggcgcccacctcggccagcgcggtgcgggccgcctctcgcacggtgtcgtcggtctcggcgcgcagcgccgccggcggcccgcccaatcgggtgaaccgtttggcggcgaccgtggcgaagtcgctgatatcttgcggcagatcggttttcaccggtgccctcccagtacgtctcgggccaccaacatcttctgcacctcgatggtgcccgatgcgacggtggctgcctgtgcgtaacgccaatgatcttcgatggccccgtgcagcggcgcgccggacccggcatccagcgcggtcgggcccagcacgtcgaacaacagctcggcgacctgctgatcgcacgtggtggtggcgatgcgggcggcgctggccgctgcgccggcggccgggtcgtcctgcagcgacacggcgcgataggccagcagccgggcgacccgcaggtcgacgagcgcgcgcacccagcgggcccggatcgattcgggcagttgctcccactcgtcaccgagccggccgcgcatccgctccagcagtgactcgcagcgcgcgtagcgcgcgatccccacccgttcgtaggccagcgcctcgcgcatcacccgccagccgtcgccgacctcgcccagtacgtcgccgggatacgccgggacgtcgtcgaggaacatctcgttgaggtgatgcggccccagcatggacgggatcggccggacggtgaacccgggccggtccatcggtatcagaaagagcgtgagccgcttgtgttttggcgcgtcggggtcggtgcaggccgccagcacgcaccacgatgccatcagcgcgtacgacgtccacaccttctggccggtgatccgccaaccgtcaccgtcggcaacggcgcgggtgcgcaacgacaccagatcggtgccggcctccggctcggagaatccctggcaccagatcacgtcgccggcggcgatggccgccaggtgcttggccttctgctcctcggtgccgtagcgcatcagggccggcccgacccagttgatgcccatgtactgcgggccgcgcggctcgtgctgggcccacatctcctcgcgcagcacggtctgctgccagaccgaaccaccgccgccgccatgctctttcggccacgcaagggccagcagcccctcggcggccagcagtttgcagaacgtctcggtggtggcgaggtcctgcgggttctccgtgcaggcgcccaggaagtcggcgggaatgtggttggcgaccagctcgcgcaggtggcttcgcagttgggcggcgtcgtcgccgaggtcgtagtccatggtcgtcatcccttcggcagcccgagcagccgctcggcgatgatgttgcgctgcacctccgacgttccgccgtagatggtcgcggccagcgcgtcctgacgttcgaacagcagatcggggtcggtggccgaatcggggcccgcggcggccgccgcgagttcccaaacacgctgcagggtaagcgatcccagcagcttcatggtgtcggcttcggggctgggccggcccgcgagttcgttggccagggcccgatacccggtggcgcgcagggcttcggcgtcggccagcagggaaccgagctcggtgtggatgtcgtggcccggccccgcgccgttggcggttcgcaccgcgtcgagtccgcggttgatctcgacccagttcatgatccagatcatctggcgttcgtggtgcagcgacgacagcgcgacgtcccagccgccgtgcagcggccccaacaggttttccgccggcacctcgacgtcgtcgaggaacacctcgcagaatgtttcgtcggagatcgacgccatccggatgggttcgatccgcaccccgggcgaatgcagatccaggatgaggcaggagatgccgcggtgcttgggcgcctcgggatcggtgcgggcatacagcgtgcaccagcgcgactcgtgagcctgggtggtccagatcttgtggccgttgacccggaacacgtcgccgtcccgcacggcgcgggtgcgcagaccggcgaagtccgagccggcttccggttcggacatgcccagcgcccaccactcgtcaccgcgcagcagcggcatcagcagccgctcgatctgggcgggcgtgccgaactggcggatgccgggggcggcgacgttggggccggcgatgttgggcagcttgggcgccgagcgcagggccgcctccagccggacctccatcgcgtcgcgcaggcccagcgaccggccgccgtgctcgcgcggccaggtcggctggatccacccggcctcgaacgcagcccgctgataatcgcggcgcagcgtgaggtcccagcggtaccgccggtagttctcgtaatagtcattcggcaggaacgccgccagccaggccgcgaactcggcgaccacctcggatcgagtgcttaccccgctcgtcacgccgcgcctccgcagaaccggcggcccacctcgtggtagagcgcgcggctgtcgcccagcagggcggcggtctgccaggcatgccggacatagagatgcgcgtcgtgctcccacgtctgcccgagcgcgccgtgcacctggaccgcggtgcgcgcgcaaccggtggccgcctcaccggccgccgccttggccagggccgccgcggtccacgcatcgccgggcgccgtgccgggatcggcgagccgggccgccgcggcgtaggtgaggctgcgggcgcgttccacgctgacgtagttgtcggccagcgcatgtttgacgccctggaacgcgccgatcggcttgccgaattggcggcgcgtcttggcgtgctcgacggagcggcgcagcgccgcgccggccacccccaccaggtcggcggcgcacgccacccacggcgccggcagcgccgactcgaggtcgaccggcgccaccgcgaccggctcggcgtcgatctgcaccccggccaacggctgggcgggatcggtgcactcggccgcgggcagcgcggtgaccccgtcgccgcaccgggcgaccgcggccaccgtgccgccgtcgtcggttcgggccagcgtgacgagaagctccgcgcgcgccaggttgggcaccgcgaccgcgcgaccgcgcagccgcccctgccgcagcgtcatcggcaccccgggcagccgggacttttcggcgtggacggccacggtggcgacggcgccgccggcgatgtcggccaggaccaggtcgaggccgctgccgcgcaacagcccggcggccagaccgacgctgcacaacaacgggatcggcgcgatggcggcaccgcactcctcgagaaccacgaccagttccatcggtccgtagtcgccggtgttcgcggcggccagctcggtccagcccaggtcgacgaccgtcttccacagggcgcgccagcgctccggatcggtgatcgcttgccgggcggcgtcgggcggacattccgtccgtaatatgtcgcgcacggcgtcgcgcagcgacaactgctccgagttcagtccgacatccataagacctctaacatagtaaaaataataaactagccgggcgggtgcaatcgcaccgaatctcacgcttgaggtgacgcgtatggtcgagtggtatctgttcctgccccaggtccggttgtcggccgccgacatcgcggaacgggcgcgccgcgccgaggccagtggtttcgacggcatcgccttcatcgatcacctggaagcgcccggacttcgggacgaaagcatctgggaggcaatgggcatcgccacctgggtggcggccaagaccgagcggctgcggatcggccacctggtgctgtgcgacgcgttccggcatcccgcggtgctggccaaacaggcggtcacgctgtccgaggcgtcggagggcagattcgagttgggcctgggcgccggatcctggccggccgaattcgccagattcgatgtcggccagcaggatccgaaggccagggtggcccagctcgcgcggcacctcgaactcatcaagcggtactggggcgacgacgggcgcggcgaggcgcaggccccgcgacgctcgcatccgataccgctggtgctgggcggaagcggcccgcggatgatggaacttgttcgcactcatgcggattggtggaatctgccggccaacaagctcgacaagttgccggcgctggcgccggccgcgggcagcgcccggctgtccattcagcagatggtgggcttcgtcggtgccggccaggatcccgaaaaggtgcgcgaggtgagcacccggcgcttcggcaacttggggtccggtttggtctgcggggacgccgacgaactcatcgggcacttcagcggcctggccgcccaacgcgtcgagcggttctacgtgtggttcgccgacttcgccgctccggattcgctgcgcgagttcggcgaatcggtgatcacggccttcccggcccggtgagcgtcaaccccgttgggcgcggcggcgggcctcggtgggcaccaccggcgggcgggcgaacgggccgcgctggacggcggacaaccggatctcgggcagatcgaccgacgggtcgacggtgtccagaaagacgaccgcctcggcgacgtcggacaccgcgatcgcatacatctcgaacggcacgtcctgcagcatctcggtggccaccgggcccggcgtgacgaggtgcacgctgatcccgtcgcgatcgacctcgagcgccagcgcccgcgcgaacgcattcatgccggccttcgacgcggagtaggcggtgcgggccggcatcggttcgtgcgccgccgaggacgagatgaacaccagccgggagccggctgtcatcttgggcagcaccgccgaggtcaccacgaagcacgaatccaggttggccgagatgatggcccgccactgctcgaaggtctgcttgcgcgcgtaggttccgcccagcgcgcccgccgcgtggacgacgaggtcgaccgtctccaatgtgcttagggcagaggggaatccgatcggatcggaggcatcggccacgacgtggcgggcaccgatctcctcggccgccgcgcgcaacggggcttcgcggcgggcgcacagcaacacgtcgtagccgcgttcgaccagcttgcgagcgcaccccttaccgatcccgccgctgccaccggtgaccaatgcggttcgcatgaggatcgcaggccgcccttcaggagcgccggaggtcccgcggccgcgccagcgcctgcggggagaacgcgtgaatccgttgatcgggctgaccggagagcacgtaggtctgggtgtcggccagatgccggccggcgatccggcgggcccggtcgacgttgccctcggcgatggtctcggtcagcttgacgtgggtgttgagcaccgcgcggcgctgcgcgagcgaggggtaggtgccgcgggaggagctctcgtcggcccactgccgttcgtgactggtccacagcgtctccaggctgccgaccaccgcgatgatggtgtggtttccgcagccgcggaccacgagatcgtggaattggcggccgatttcggtgaacagccggccgtcgtcgaggtgggtggccatcgactcgttgatcttcgtcagctcgggcaccagcgtgtccgcccggtccggtcgccgcgcggccaacgcggcgcaggcgggctccagttcctgcagcgccatgcccaggtcggccaccgccacggattcactctgcagcagcaggcccagcatgtaggcggcgctggtcttcgccggggcatgcacgacggcgccgccgcggttgccccgtcgcaccgaaaccaggccctcggtctccaaaatccgcaacgcctcgcgcagcgacaccaggctcacgttgaactgctcgaccaggacctcctggcgcggcaacaaatcgccgtcggccagctcgccgctgatgatttgacggcgcagctcgtcggctacgatttcggcgatccgcggcgccgacaaccggcgccgggcgtcggggccaattcccaaggcggtcatccgatcctcgaaacgaacagcaactcgctggcttagctattttaacagtaatgatataaatagcttccctgatcgcgcgtcgatcggaagggcgggtgcacttgagcgagcggtccgacagccggccgacaccgctacgggatttgcgtgtcgtcgagatcagcgaccggatagccggcagctactgcggcaagctgctgctcgacgccggcgcgcaggtgcgcaaaatcgaaccgccgcaaggggattggctgcgccggtattcggcgagcggttcgcccgtcgcccccggcgccgacgcgccgtttttcagctacctcaacgcgggcaaacgcagcgtgacgttcggctccggcggcgacgacaacgctgcgcgctttcgcgccgaactggccggcgccgacgtcatcgtcgtcaccgccggcccgtcgcgggccgcggcgctgggcatcgacccgtcccgactgctgcggcagtcgccgcgcgccatcgtcgtcaccatctccgacttcggctggacgggccccttcgcgcagcgggccgccaccgagttcacgctgcaggcgtgggcgggctcgccggggttccgcggcgacccggccgggccgccgatcgccatcgggggcgatctgggcgagtacatgggcggtgtgttcgccgcgttcggcgtgctggcgctgcgccgccgcgtcgagcgcggcggtcccggcgaacacctcgacctgtccatgctggaggcgttgaccgcgatgcagagcagcgaatggctgcattcgcagctgctgcgtgtcccgccgatccgtcgcaccaccgaagtcccgtcgatcgaacccgccaaggacggctacgtcgggatcaccatggtcaccggtcagcagtggctcgacttcgccgcgatggtcgaatgcccgcaattggaggagatcgaacagttgcggttccagatcggccggtggcaataccgcgacctgatccgcgaactgatccatccctggctggccgaacgcaccgtcgccgaaatcgtggaattggggcagcttttccggctgccgatcgccgcgctgggtaacggttccaccatccgggatctggaatacgtgcgcgagcgccacgtgttcgtcgagaatcccgcgggtttccaccagccccgcccgccctggctgatgtcggcgtgtgcgcccgcgccggtcggggacacccccgccgtcggcgaggccgaccgtgaatcaccttggcgccgagacgattccggttccgctccggacccgacgctgccgccgctgccgctggccggggtgcgcatcgtcgacctcaccgcgttttgggcggggccgtcggcaacacatctgctggccgcgttcggcgccgacgtggtcaagatcgaatcgatccagcgccccgacggcatccggtattccggtggcatgcgcaccgacgtggacgactggtgggagtacggctgggtgttccacgcgatgaacaccaacaagcgttcggtcacactggatttgggctccgagcaaggccgcggtttgttcacccggctggtcgccgacgccgacgtggtgatcgagaacttctcgccgcgggtgatggaccagttcgggctgaccgccgacgtgctgctcgacatcaacccccggctggtgttcgcccggatgcccgcgttcggcgtcgagggcacctggcgggaccgggtcgggttcgctcccaccatggaacagatcgccggcctggcctggatcaccgggctgcccgagggaccgccggtgacgccgcgcggagcgtgcgacccgctggccggtgtgcacgccgcgttcgccgtgctggccgcgctcaatttcgccgaacgcaccggcaccggacaactggtcgagctggcgatgctcgaaacggtgctcaacgccaccgcgatccaggccatcgaggccgaagtcttcggcgtcacgctgagccgccggggcaaccgcgggcacggcgcggcgatccagaacatctatcgctgcgccggagccgaacggggcaaagacgattggatcgcggtcagcgtcggcgacgacgcgcagtggcgggcgctggtggacgtgatggatcggcccgcgtggtgtgcggatccggatctggccaccgtggacgggcgccggcaacgcgccgacgacatcgacgcccggctggcgcagtggttcggccggcaggacctcgactcgacggtggagctgctggccggcgccggcattcccgccgcgccggtggtgtcgccgtcactggtcaccgacaacccgcaactgctcgcgcgcgggttcttcgaagcgctgcaccatcccagcaccggggtgggcctgtatccgtgcccgcccttcgcgctgctcaccggccaggacaagtggctgctgcggcccccgccgaagctgggcgagcacaatgaagagatcctgcgcgatcggtgcgggctgaccgacgaagaactgacccacctcgcggccggcggggtgatcgggacccgacccaagggcctctgagagaagtggagggtagctgatgcgcgtgacggtcgacgaaaacctttgtgaggccaacggcttctgcgaatcgctcgcgcccgacgtgttcgagttgggggacgccgacgtggtgcagatcgccgacgggccggtgccgccgcggctggaaatcgacgtgcgcgccgcggtggaccagtgtcccaaggccgcgctgcggctgatcgattgacctatcgccgccgcagcgagatcggcatctcgtcgtagatcgacatgttggtgatcaggttcggataggcggccttggccggaccgatctcgatgtcgtcgcagcgcagcaacagctcgtcgaacaccgcgcgaagctcggcgcgtgcgagcatggcgcccaggcagtggtgcggcccgccgccgccgaacgccacgtgcgggttgggctgacggccgatgtcgaacgtgaacggggcgtcgaagacctcctcgtcgcggttggccgaccgcagcatcgagaccacccgttcgcccttggcgatgcgctggccgtccatctcgacgtcgaccttggcggtgcgggtccagtacgccaccggcgacgcccagcgcaacacctcctcgacggccgtcggccgcagcgcctcgtcggcgcaatagcgctcgacctgctcggggttggccagaaacgcctgcagcccgatggccagggcgttcttggtggtgtcgcttccggcgaaagccaggacgaagaagaagaattcgagttcgttggcgggcagccggaattcctcgccgtcttccccggtgatcaccgcggtcgcgagcgtgctccagatgtcgccggtggggttgcgccgcttgtcggcggtcagctgcatcgcatagtcgaagaccgaggcgaacagctcgagctccaccccgccgcgcgggtgcgcctcgggtgccagcgccttgaggatgcggtcgaacaggtcgaagattcgcggtcggtcccgctcggggatgccgaggatgtcgccgatcaccgtcatcggcaacgcgtcggcgacgtcctcgatccagtcgccgccgccgtgggcgagcaggctgtcgatcatccgcgccgcacgcgcccggatgccgtcctccagcttggcgatcgcccgcggattgaacgcgttcgagatgagcttgcggcgcttgttcagctccggcgggtccatggtgatgatcgtcggcgacgacgagaacatggcgaccggctggatgagcgggccgtcggccgcggtgaacgactcggtgtcgcggtgcaggcggaccgcatgccggtgcttggtcgccacccagaaatcccggtgcacggtcgccgccacgcccggggtgaggtcgtggtgaaaaagcggccgggtgcggcgcagctcggcgaagagctcgtcgggaaagccgttgcaccacaaggagaaatccgaaaggtcgaccgctgccgtcgtcatcgccgaaccccgttctgccggatcgtcgccgcacgcggcggtggccgcgttgacgttcaatgcttaaaatagtaaaaatagaccttgtcgtcgaaccgcggtgagcgccgggcggcgcccggctcgcctttggtccggacgggatacggagtgcaagtggcgcgtacagtttcggattcggcccccgattcggccgaggatccttcggagcgggagttcgggcaggccggcatcgcattgtcgacctaccggttcccgacgggctggttcatcgtggcgttcggatccgacctggcccccggccaggtcaagcgcgcgcactacttcggcgaggagttggtgctgttccgcaccgcgtcggggcgggtgcacgtgatggacgcctactgtcagcatttgggcgccaacctcggcgtcggcggcaccgtggagggcgagaacatcgtctgcccctggcacgggtggcagtggcgcggcgacggcagcaacgcgctgattccctacagcaagatcggctgcaagaacaacgtccgcatccgcacctacccgagcatggagtggtacggcttcgtgctggcctggcacgagcggcacggccgggccccgtactggcagccgccggtgctgccggagctggaaaccggcgagtactacccgctgcatccgcacacccagatggtcaaccgggtcaaggtgcacccgcagatgatcatcgagaacgccgccgacccctaccacgtccagtacgtgcacaaggcggccaatccggccaccaccgcgtcgttcgaggtggccggctaccacctgcacgcgacggtcaacgcgcatttcggcgggggccgggcgcagacctggctgaccccgaacgggccggtcgacgccaagatcatctacgacaactactcgctgggcctgggcgtggtgcgcttccccagcgagctggtggccaccgtccaggtcaccggtcagacgccggtcgacgaggactacaccgactacttctacacccaggcgtccgtgcgtgaaccgggcgacaccggtgacgtgcccaccggacgtgccgcccggttcctggcgcttcagaaggaagtcatcaagcaggacttcttcacgtgggagaacatgaagtacctggagaagccgaatctggcgccggaagaggcgcatgactatgcggcgcttcgccgttgggcgcaccggttctacccgggaccccaacccgccccgaccgatttcggttacaccgccgacggcgagcccgacccggcagccgcgaaggcctgatgcgggcaccggccgacttcggcgtggaccgtttcaccgtgcccgccgtgctggatcggcgcgccgcgcagcatccggaccgagtgatgatgtcgatcgccggtgtcgatgtgaccttcgcgcagatgcggcagcgatcctgcgcggcggcgaacatgttgagcgacttgggtgttgggcgcggcgaccgggtggcgctgttctccggcacctgccccgagtgggtctacttctggctgggcgcggcgcggatcggggcggtcagcgcggcgatcaacgccgcgcacaagggcgatttcctgctgcacgccctgcggctgtgccggcccgcggtgatcttcaccgaccccgaacatcggtcgcgtgccgaacgggcggccgccgcgctggagggccccccacgcattgtggtgcaaggggattcgctgacggcgacgctgagtcgagccgccgaccgcgcaccggccgaggaccgcccggacgcgggcgagctgggctgcttgttctacacctcgggcaccaccggcccgtccaaggcggtggccaccacctggcactacctgttctcggtcgcggcgaccgtcgcggcggcctgggagttccgccagggcgaggtgctgtggacggcgatgccgttgtttcatctcagcgcggcgcccagcgtgctggcacccatgctggtcggtgcaaccacggtgctggcagcggcttttcatcccgccgaggtgtgggacgacatccgcgcgcacggcgccatcggattcgccggagccggggcgatggtgtcgatgctgcagaacctgcctgccgatccgggcgacgcgcggctgcccttgcggttcatctccgccgcgccgatcgctgcgaggtcctaccgcgacatcgaaaagcgttacggctgccgcattgtcacgatgtacgggctgaccgaggcgtttccgatcgccgtcaaggcgctggccgacgccggcatcccgggcacctcgggccggccgaatcccgatttcgaggtgcgcatcctcgacgcgcacgggaattcactgcctcccgacacggtgggtgagatcgcttgtcgccccagacatccgcacgtgatgagcgaggggtacatcggcgacgacctggctgtgcggccgcacccggaatggtttcgcaccggcgatctcggtcggctggatcgcgaccagaacctgacatacgtggaccgcatcaaagacgcattgcgccggcgcggcgagaacatctcctcggtcgaggtggagacggtggtcatgggtcaccccgcggtggccgaggccgccgccgtcggcgtgcccggcgaactgggcgaggacgacgtgttggtggtcgtgaccctgcggccgggcgccaccctggattgcgcggagttgctcgacttctgcgcggaccggatgccgtacttctgtgtgccgagatacgtggaaacggtgcctgaactcccgaagaacgccatcggccgaatacgtaaagatttgttgcgcgcccgaggattaacgacgaacgtctgggatcgggagaagcatggctatgtcgtccggcgctaagtagagttagcgtcaaccgcgcagttcgccgtcgggtttcccggagagggttcacaagcagatgtccctgacctatcaacaagaacagttccttcaggccgcgacgagccgagccgccatcctgaacctgaacgcccggcacaatcgggcctattcggacggcgaccgcgatggctggatcgccaccttccgccactccggcgccagctacacccgcgacggagaggcgttcaccgatctgcgcgccgcgttcgacggcggcgacgaccagcgcctggtcaccgtcgatcacgagatccacgtcgacggggtgaccgcgacgcagcagtgcgtcgccgtattgttcgcggccatgttcggtgacgcggcgctgcgggccaccggggtgttccgcgacgagctgatctacgagcggggcggctggtatttcacttcccgtgccttgcagtgggattcggtacccagtcggcacccgctcgtcatgtgagcggcgtcggcacgtggatcaggacttcagtcggcggctggccttcggaacctatgaagacgcactgcgcatggtcggcgcgaagggcgaaccccgcaccgcgggcacggcggtcagcgccgcgcgcatccagctgttcgccgcgatggtccgcgacggcaaccgctcgtactgggattccgcgttcgcccaacaccattggggagggctgctggcgccgccggcgctgttgatgggctggctgatagcaccgccctggcagcccgacggccggccatccgcctccttgatcgccctgcgggtgccgctgccgggcaccacgttcatcaacgcggccaacgaggtcgaattcccccaccccatcgtcgagggcgacgtgctgaccgtggtcgacgagctggtgtcggtgtcaccggagaagcggacccggctgggcgtcggccacttcgtcgagacgctggagacctatcggcgccaggacggcacggtggtcgccacctcgcggaacacgttgttccgcttcaccccggggccgtcgtcgtgaccggtgcgggcgtggactggagccggctcagcgtccccgccgagctgccggaagtggtcgaccacatcagctaccagcgggtggtggaaaacgccggagcgacgtgggattacttccccggccatttcgatccggattacgctcgggctcaaggcaatccgacgatctatgtcaacacgatgcacctggccggcttcgccgaccgggtcgccaccgagtgggcgggcccacgcagccgggtggtgcgccgcgcgatgcggctggccgggccgatatatgccggcgacaccatgatcgggcgcggccgggcggtcgccaagcgccgcgacacctcggtggacccgccgagatgcctggtcgacatcgagatcgaagtgaccaatcagcatggcgcgctgtgctgcccggtcgagctgaccgtgcagctgccctgacgcgccgagcgtgcagtggttgcgaaaaatccgccgaattttcgcagtggttgcacgctcggcgctaattcacagcggcggcagctgccccttgcacacgagcgtctgaagctcgacgtactcgtgtagcccctcgggaccgaactcccgcccgatgccggattgcttgaatccaccgaacggggcgccgatgtccagggtgtacatgttgatgccgtacgtgccggtgcgaaccgcggcggcgacctcgaggccgtgggcgacgtcggccgtccacaccgaaccggccaggccgtaatcggtttcgttggcgatgcggatagcgtcgtcctcgtcgcggtaacgcaagacggtcaacaccgggccgaaaatctcctcccgggcgatacgcatgtcgttggtggcgtcggcgaacagcgtcggccgcacataccagccgcgcccggccggactgtcctcgccgccgagcaccatgcgggccccctcactgcggccggacttgatgtactcctggacccggcgctgttgccgttgggcgacaagcggtccgatgtccgtcgactcatcggccggatcgccgacattcagctccgccatcatggcggccagtgcgtcgacgacctcgtcgtgcttgcggtcgctgaccaggatgcgggtctgggcgacgcaggcctgcccgttgttcatcagccccgcactcttcaggccggcgacggtcttgtcgatgtcggcgtcgtcgaggatgatcgccgccgacttgccgcccaactccaggctcacccgcttgagccgctccccgcacagggcggcgatccggcgccccacggcactcgagccggtgaacgcgatcttgtccacccccgggtggcgcaccagcgcctcgcccacgtcggtgccgccgggaagcaccgacaccacgccctgcggcagctccagctgctcgatcatctcggccaaccataaagcgtccaaaggggtttcgggtgctggtttcacgatcaccgtgcaccccgcgatgagcgccgggatcagtttgggcatgatcaggaactgcggcacgttccacggcacgatcgcgcccaccaccccgaccggggcccggtgcaggtgcacctcgccgagcacgccctggcggcgttcggtccagggaaagtcccgggcggcggccagcgtgaggtggatcagcgtcgcggcggccgctccctgacccatccggctgaagctgcgcggcgaccccatctcgtcggtgatcaggtcggccatctcgtccatgtgcgcggcgtagatcgtggcgagctgttcgatcttggccatccgctcggcatggctcatccgcggccatgggccgtgatcgaaggcccggcgggcggcggcgacggcggcgtcgacgtcctcgggaccggccgcctgggcgtggccgatcggctgctcggagtgcggcgagatcacgtcgagctgctgcggattggccggctttcgccactgcccgccgatgaacagttcgtcgtagcaacgatggtcggaattcttcgtcatcgggcgcctcctcgaggcagcgatgggcgctggaccggatccgcaccgtaatttgctattgacgctaacatagcgaaaaaaggacaagtcaggaagccgcggatggatcatcggcgacggtgtcgaggcgagagatgaacagcgactggcgcagttatccattccagctggtgcccggagacggccagctcgaattccccgctgccgaaggcgaacaccgtgaccaggagtcggacacctggttcctcgcgggccagctggaggccgccggggccgaccggtcgttcgccttcctgaccatcttcaacaagaaccggcccggcggcacggtggtcgccgatttctacacgatggcgctgttcgatctcgataccggcgactacggcacctatacggattacgacatgccgccggccaatctcgagccgggggcgccgcgcaagatggggctggccgccggctatctcgacatcagctacgccagtggcgccggcaccgcatcatggaccagctgccgcaacggcgacggcggtttactgccctacacctaccgggtgagcctggtcggcgaggaccattgcggccggcggatgcgcctggacctggccgtaacgccaacgcgcgcaccgactccggtgggcgcgtcggcctacaacggaaagatcgtctgcttcggccaacgcgacacctactcctacttccagaccggcatggcgatgacgggcaccctccgctggggcgagcaggtccaccaggtgtcgggcagcagcggtcatgtcgatcggcagtggttcccgaaatacgccggcggtggcggctccggcggggacccacgggccaggtcgcacgagtggcgcaccatcaacttcgacaacggcgtcgacctgagcatctggcggcagttcgaccgcacgaataacaatgtcctgcaaccgtttaccgggatcacggtcagctatcccgactccgccatggcgccggagtgcgccgaggacgtcgaggtcaccgtcagcagctacgtccgctggccggagagcatgcggcccttggtgcgtccccttgcccctgcccggtacctgcccgatcgtcaccggatcgcctgtcccacattgggactcgacatcaccggcgagccggtggtggcggcgccggcgcacggtctgccgatcgaatacatggaaggcccctaccgttaccgcgggaccctgcagggacaaccggtgaccgcgtttgccttcaacgaacggtccctggcgctctaccgcgattgggaattggtcgaggtgctcgccaccaccgtcacgcataccgaaccgtccgatcccgacctgcgggcgacggtggatcgattggccccgttggtggccgccggccgtcggcgcgaggcggtcgaactgctggccgccgtgcgccccgcccagaccggcgcgctggcaacgttattggacgatctggtgacggtgctgtccaccgagtcagccggttgaggccgccagcgccttggcccaggtgatgtggcggtgctgcaatcccggctcgttgcggccgaacaccaggtggtcgcgcgcgccggactcgaggttggcttgcaggctctcgaccagccggtagtcctcgtcgcgcacggtggcgtgcgcatagtcgaagacggcctggacgcccgcggcgacggattcgtcggaaaggtcttgcggtgttgcgttctggtggacggtgatcgaccggccgggccgatcgccggggtagacgcggaacagctcgccgttggcgatagtcaccgacagcacgatgttggggaacagcgcgtagatcaccaccatgttgtggaacgggttccactggtcctcgggtatgtcgtcgagctccaggatcgtgttgagcgggaagatcagccgatgatgcggcccgtaggagtcgaacaccgtgcagttgctgcgcgcgatcgtggcgaaggtctgccggtgcacggtggcgaaatggtagttctcggcgaacgtgtcgatcgcgagtttccagttgatcgcgcagtcgagcaccttctcgccgagcggggaccagcggccgataccccaggagtcgagttcgtcggcgagcggcccgaggtgggtggccacgtccagcgtcgctcccggatccagtgacacccaaaggaatccggcgaactcggtggccggcagctcggtcaggccggcggagcgcagcgccacgtccgggaatccctcgcggcccggcagtccgaccagccggccggtgttgtcgtaggtccacgcgtggtaggggcaactgaaccggctggcggtgccgcatccggtcgccacctgcgactggcggtgcaggcagacgttgttgaacgccttcaccgagccgtcggaggttcgggtcaacaggacggatcggcccatcaccgtcttggtgcaatacgtcccgggagcgggcagctccgagacgtagcccaccaactgcgggctggccagcagcatggcgcggtcctgctggtgccgctgcacgcaggtgtagtcacgcgcgtcgacgacgtgggcggtgggggcgagatcggttgtcctgtcccgcgccagcttcaaggcacgccgggtcaggtcgatgagctgatcgtgttgcatccgctcagtacagaccttgcgacagttgtaaggtcaaggagtggctgagcagttgctgatcggcgacgtcacggccctgaccggaatcgcctcgggccgtattcgccactacgagaagatcgggctgctgcacgccgaccacctgtccaacggctaccgcgtcttcgacgtggaacaggtgctggacctgttgcgcatcgacctgatgcgcagtctcggcgtcggcatcaacgacattcagcgattgctgcacggcgggcacagcacgctggcggatctgctcgacgagcaccgcgcactgctgatccagcagcgcgaccggttggaccaactgatccgcgccctggacgaatcctgcgcccagtcaagagcggccgccgacggcaccgacgtcagcgagcacctgctgcgccagctggcgaccacgcatcgcgacagcatcggggtgatcgggcggctcagcgccccactgccggcgccggtcgccgcgatgtatgccgacctgttcgacgagtgggacctgccggtccccgccctgttcgggcagatgaggcttccgagcgcggccagcaccctgctggcccgactggccgagaccccggggcgccaggtgctgttcgaccggctgcgccggctggccgccgacgtcatcgcgctcggcgaaagcgtatcggcggcaaccgaactcgcgcacaattggatcgagcagcagctggccgacccgctgcccgacgacgtggtcacggtgctgcggggcgtgcaaccgctgttggggcaggacccggtgatcgtacaggggtttcgggcctgggcgggctcgatcagcccggcagccgcccggttcatcgaggagatcgcgcggcagaccgcgcgccggggcctggcggcggtgagcgtcatcgtgctgcccgcggcggaccgggcccaaaccgtcgatgcgacgccgtgatacaaatgtgactcgtgtgatcagcggggcgcatggggtttatgtcgtaccctgtggcctgtgtcctccgtttcgcggcgcgatctgctgaaattcgcggccgcggcgccggccctgctgggcctgggcgtcgcgggttcgacggtgcacgccgcgccggcgtcggcatcgctgggcaccctgctcgactacgcggccggtgtcatcccgggcagccagttgcgcgcggccggcgccctgggggcgattcggtacgtgtcggaccgccggcccggcgggaactggatgctgggcaagccgatccaggtggccgaggcgcgcgatctcaacgccaacgggctcaagatcgtgtcctgctaccagtacggcaagggcaacaccgcggactggctgggcggcgccagcgccggcctgcagcacgcgcagcgcggcatgcagctgcacgccgcggcgggcgggccggccaccgcacccatttacgcctcgatcgacgacgacccgtcctacgagcagtacaagagccagatcgcgccgtatctgcggtcgtgggagtcggtgatcggccatcagcgcacaggcgtgtacgccaattccaaaaccatcgattgggcgttgcacgacgggctgggctcctatttctggcagcacaactggggatcgcccaaggggttcacccatccggccgcccatctgcaccaggtcgagatcgacaaacgcagcgtgggcggggtcggggtggacatcaacgagatcctcaagccccaattcgggcagtgggtctagccgccgccaggccctcgcgagccgtcaccgcggccgccgggccggccggaaggccgactcttagaaattccagcaaacactcgttcgctcattttctcggcgcgcggccgccggcgatcgccgcacggcgccgccgacgccggctcgacggcgcctcgcggcgcaaaatttttacataacgattcgataacaaaactgctttgatctgcgcagttatagctactcgaccgtaaccacctgcacgcagcaggtttgttcgccgcgtccgagcggccggcgaaacccggtgttacccacaacacggttacccatgcgtagaactcaccagtaaccgatcagcacgcgaaacgagggccgatccttatgacactcttagtgcagccgatgaagtccgccgcgccgcttcgcaccaccggagcggccgccgacgtcacaccggccggccgtttcccggccgcgattcgacgcggaatcgacgggcaccgacgaggccccaaccctctggcggtgaccgccacacgaacttcagacctaaagacgcatatcaggggagacagagaaggtgacgatccacgagcacgaccgggtgtccgccgaccgcgacgggcagggcccgcacggggtcaagcacccaccagccggggacacgcatgctctggtcgaccgcctggcggccggcgagccctacgcggtggccttcggcggccagggcagcgcctggctggagaccctcgaagagctggtctcgtcggccggcatcgagccggagctggcaaccctggtcggtgaggtcgacctgctgctcgagccggtggcaaaagagctcgtcgtggtgcgcccgatcggcttcgagccgctgtcctgggtgcgcgcgctggccgccgaggacccggtcccgtccaacaagcacctgacctcggccgcggtctccatccccggcgtgctgctgacccagatcgcggccgtgcgcgcgctggcacgccagggcatggacctgacggccacgccgccggtggccgtcgccggacattcccagggcgtgctggccgtcgaggcgctcaaaggcgcgggcgctcgcgacgtcgagctgctggcgctggcccagctgatcggtgccgccggcacgctggtggcccgccggcgcggcatctcggtgctcggggaccgtccgccgatggtgtcggtcaccaacgccgaccccgagcggatcagccggctgctcgacgagttcgcccaggacgtacgcaccgtgctgccgcccgtgctgtccatccgcaacggccgccgttcggtcgtcatcaccggcaccccggaacagttgtcccgcttcgagctgtactgccggcagatctcggagaaggaagaggccgagcgcaagaacaagctgcgcggcggcgacgtcttcgcgccggtgttcgatccggtgcaggtcgaggtgggcttccacacgccccggctggccgacggcatcgatatcgtcggcggctgggccgagaaggtcggcctggacgtcgccctggcccgggaactgaccgaggccatcctggtgcgccgggtggactgggtgcaggagatcacccgcgtgcacgagtcgggcgcgcgctggattctggacctgggccccggcgacatcctgacccggctgaccgcgccggtgatccgcggcctcggcgtgggcatcgtgcccgccgcgacccgcgggggacagcgcaacctgttcaccgtcggcgccgtccccgaggtggcgcgggcctggtcgagctacgccccgacgctggttcggctgcccgacggcagggtcaagctgtcgaccaagttcacccgcctgacgggccgctcgccgatcctgttggccggcatgaccccgaccacggtggacgccaagatcgtggccgccgcggccaacgccgggcactgggccgagctggccggcggcgggcaggtcaccgaggagatcttcgccgcccggatcgaggagctgtccgggctgctcgaggagggccgcacctaccagttcaacgcgctgttcttggacccgtacctgtggaagctgcaggtcggcggcaagcggctggtgcagaaggcgcgccagtccggcgcggcgatcgacggcctggtgatcagcgccggcatccccgagctggaggaggccgtcgagctgatcgaggagctgggcgacgtcggcatcagcaacgtcgtgttcaagcccggcaccgtcgaacagatccgttcggtgatccgcatcgccaccgaggtgtccaccaagccggtgatcgtgcacatcgagggcggccgcgccggcggccaccactcctgggaggacctcgacgacctgctgctggcgacctactcggagctgcggtcgcggcccaacatcaccgtctgcgtcggcggcggcatcggcacccccgagcgggcggccgagtacctgtccggtcggtgggccgagaagtacggcttcccgctgatgccgatcgacggcatcctggtcggcaccgcggcgatggcgacgctggagtccaccacctcgccgtcggtcaagcggatgctggtcgaaacccagggcaccgagcactggatcggcgccggaaaagccgtgggcggcatggcatccagccgcagccagctcggcgcggatatccacgagatcgacaacagcgcctcgcggtgcggccggctgctggacgaggtcgccggtgacgccgaggccgtcgcggaacgccgcgacgagatcatcgccgcgatggccaagaccgccaagccgtacttcggcgacgtcggggagatgacctacctgcagtggctgcagcgctatgtcgagctggccatcggcgacggcgactccaccgccgacaccgcgtcaccgggcagcccgtggctggccgacacctggcgcgaccgtttcgaacagatgctgcaacgcgccgaagcacgtttgcacgcaaaggatttcggtcccatcgagacgctgttcgacggctccaccgaggacggcgcgcggctgctggaaaacccggccgaggccatcgccaccctgctggcgcactaccccgacgccgaatccgtgcagctgcacccggccgacgtcccgttcttcgtcacgctgtgcaagacgcccggcaagccggtcaacttcgtgccggtcatcgacaaggacgtccggcgctggtggcgcagcgactcgctgtggcaggcccacgacgcccgctacgacgccgaccaggtgtgcatcatcccgggcaccgccgcggtggccggcatcacccggatggacgaacccgtcggggaactgctggaccgcttcgagcaggccgccatcgaccaggcgctggccgccggggtgcaacccgcggccgtcacgtcgcgccggaccggtcgcgccgacgtgacgggaccgctggccgtggtgctggacgcccccgacgtgcagtgggccggccgcactgcgatcaacccggtccaccgcatcgccgagcccggcgactggctggtgcacgacgggccggacagccgccgcgccacccactcgtccaccggggcgcggctgcaggtcgagggcgaccgcgtcgtcctcagcgtcccggtgtcgggcacctgggtcgagattccattcaccttgccgcccaacaccattgacggcggcaccccggtggtctccactgacgacgcggccacggcgatgcgcgcggtgctggcgatcgccgccggcgtggacgggccggagttcttgccgaaggtcgtcgacggcgcggccaccgtcacggtggactgggatcccgagcgggtcgccgaccacaccggggtcacggccaccttcggtgagccgttggcgcccagcctcaccaccgtgcccgacgcgctggtcggcctgtgctggccggcggtcttcgcggcgatcggtgcggcggccaccgacaccggcgtcccggtcgtggagggactgctgagcctggtgcacctggaccacgccgcgcacatggtcggcaagctgcccaccacgctggcccaattgactgtcaccgcaacggcttcggcggccgccgacaccgacatgggccgcgtcgtcccggtttcggtcaccatcgccgacgccggcggccaggtgatcgccaccctcgacgagcgtttcgcgatcctgggccgcaccggccccgccgaactgaccgaccccgcgcgcgccgggggagcggtgtcggagaacgccaccgacaccccgcgccggcgccgccgcgacgtcaccatcaccgcgccggtcgacatgcgtcccttcgcggtggtgtccggcgaccacaaccccatccacaccgaccgggccgccgcgctgctggccggtctggaaacgccgatcgtgcacggcatgtggctgtccgccgccgcccagcacgcggtgaccgccaccgacggtcaggcccgcccgccggcgcggctgatcggctggaccgcccgcttcctgggcatggtgcgtcccggtgacgaggtcgcgttccgcgtggaccgtgtcggaatcgaccagggcgcagaggttttggaggtggccgcccgcgtcgggtcggacctggtgatgtccgcgaccgcgcgcctggccgccccgcgcaccgtctatgcgttccccggccagggcattcagcacaagggcatgggcatggacgtgcgggcccggtccaaggccgcccgcaaggtgtgggacaaggccgacaagttcacccgcgacacgctgggcttctcggtgctgcgcgtggtgcgcgacaacccgaccagcatcatcgccagcggtgtgcactacaaccaccccgagggcgtgctgtacctgacgcagttcacccaggtcgcgatggccacggtggcggcggcgcaggtcgccgagatgcgtgagcagggcgccttcgtcgaggacgcgatcgcctgcgggcactccgtcggcgagtacaccgcgctggcctgcgtgaccggcatctacgagctggaagccttgctggagacggtgtttcaccgcggctccaaaatgcacgacatcgtgccgcgcgacgagctgggccggtccaactaccggctggcggcgatccgtccgtcgcagatcgacctgccggacgacgaggtgccggcgttcgtcgccggaatcgccgagcgcacaggggaattcctggagatcgtgaacttcaacctgcggggttcgcagtacgcgatcgccggcacggtgcgcgggctggaggcgctcgaggaagaggtggagcggcgtcgcgagatcaccggcggcaagcgctcgttcatcttggtgcccggcatcgacgtgcccttccactcgcgggtgctgcgcgtcggtgtggcggagttccggcgttcgctggaccgggtaatgccgcgcgacaaggatcccgacatcatcatcgggcgctacatccccaacctggtgccgcggccgttcaccctggaccgcgacttcatccaggagatccgcgacctggtgccggccgagccgctcgacccgatcctggccgactacgacacctggctcgccgagcgccggatcgagatggcccgcacggtgttgatcgagctgctggcctggcagttcgccagcccggtgcgctggatcgaaacccaggacctgctgttcaccgaggaggcggccggcggtctgggcgtggagcggttcgtcgagatcggtgtgaagtccgcaccgaccgtcgccgggctggccaccaacaccctcaaactgcccgaatatgcgcacagcacagtcgaagtgctcaatgccgagcgtgacgcggcggtgctgttcgccaccgacaccgaccccgagccggaaccggaggcggacgaggcttccgattcggccgttccggcctcatcggacggtgcacccatgtccgatgtcgccccggctcccgccgcggctccgtccggggctccgcgtcccgaggacatcccgttcgacgccgccgacgccacgctggcgctgatcgcgctgtcggccaagatgcgcatcgaccagatcgaggagctggactccatcgagtccatcaccgacggcgcctcgtcgcggcgcaaccagctgctggtggacctggggtcggagctgaacctgggcgccatcgacggcgcggccgaagccgacctggccgggttgcgcgctcaggtgaccaagctggcgcgcacctacaagccttacggcccagtgctttccgacgcgatcaatgaccagctgcgcacggtgctggggccctcgggtaagcggcccggcgccatcgccgagcgggtcaagaagacctgggacctcggcgagggctgggccaagcacgtcacggtcgaggtggcgctgggcacccgcgagggcaccagtgtccgcggcggcgcgctgggtcatctgcacgagggcgcgctggccgacgccgccgccgtcgacaaggccatcgacgccgcggtcgccgcggtcgccgcgcggcgcggcatcacggtggcgctgccgtccgcgggcggtggcggtgccggtgcgaccatcgacgccgccgcactgggcgaattcaccgaacagatcaccggccgcgacggcgtgctggcctccgcggcgcgcctggtgctcaaccagctgggcctggacgagccggccggcgccgcggccgcgtcagcggccaccgacgccgagctgatcgacctggtgacggccgaactcggcgcggactggccgcgtctggtggcgccggtgttcgaccccaagaaggccgtgctgttcgacgaccggtgggccagcgcccgcgaagacctggtcaagttgtggctcgccgatgagggcgacatcgactcgcagtggctgcacctgtccgaaaggttcgagggcgcaggccatgtcgtggccacccaggccacctggtggcagggcaaagccctgtccgcgggccgcgccgtgcacgcgtcgctgtacggccgcatcgccgccggcgccgagaatcccgacccgggccgctacagccacgaggtcgccgtggtgaccggcgcgtccaagggttcgatcgccgcgtcggtggtcgcgcgactgctcgacggcggcgccaccgtcatcgccaccacgtccaagctggacgacgagcggctggcgttctaccggggcctgtatcgcgaccacgcgcgctacggcgcggcgctgtgggtggtcgcggccaatatggcgtcctactccgacatcgacgcgctggtcgagtggatcggcaccgagcagacggaaagccttgggccccagtcgatccacatcaaggacgcgcagactccgacgctgttgttcccgttcgccgcaccgcgggtggccggcgacctgtccgaggccggctctcgctccgagatggagatgaaggtgctgctgtgggcggtgcagcggctgatcggcgggctgtccaagatcggtgccgagcgcgacatcgcctcccggctgcacgtcgtgctgcccggctcgcccaaccgcggaatgttcggcggcgacggcgcttacggtgaggccaagtcggcgctggacgcgctggtgagtcgttggcacgccgagtcgtcctgggcggcccgggtcagcctggcgcacgcgctgatcggctggacccgcggcaccgggctgatgggccacaacgacgccatcgtcgacgcggtcgaacaggccggcgtcaccacctactccaccgacgagatggcggcgatgctgctggatctgtgcgacgtggagtcgaaggtggccgcggccagcgccccgatcaaggccgacctgaccggcggcctgggcgaggtcgacctggacatggccgagctggccgccaaggcccgcgagcaggccaccggcgcggagccggccgccgacgacggcccgacggcgggcaccatcgccgcgctgccgtcgccgccgcgcgggttcaccccggcaccgccgccggagtgggccgacctggacgtcgacccggccgatctggtggtgatcgtgggcggcgccgaactcggcccgtacggctcgtcgcgcacccgcttcgagatggaggtcgacaacgaactgtcggcggcgggggtgctcgagctggcctggaccaccggcctgatccgctgggaggacgacccccaacccggttggtacgacaccgaatccggtgagctggtcgacgagtccgagctggtcgagcgctaccacgacaccgtcgtggcgcgctgcggcatccgcgagttcgtcgacgacggcgcgatcgaccccgatcacgcgtcgccgctgctggtctcggtgttcctggacaaggacttcaccttcgtggtgtcctcggaggccgacgcccgcgcgttcgtcgagttcgatcccgaacacacgatcatccggccggtgcccgactccagcgactggcaggtcacccgcaaggcgggcaccgagatccgggtgccgcgaaagaccaagctgtcgcgggtggttggcggccagctgcccaccgggttcgacccgacggtctggggcatcagccccgacatggcgagttccattgaccgggtggcggtttggaacatcgtggcgacggtcgacgcattcctgagcgccgggttcagcccggccgaggtgatgcgctacgtgcacccgagcctggtggccaacaccatgggcaccggcatgggcggcggcacctcgatgcagacgctgtatcacggcaacctgctgggccgtaacaagcccaatgacatcttccaggagatcctgccgaatatcgttgccgcacatgtggttcagtcctacatcggcagctacggcgccatgatccacccggtggccgcgtgcgcgacggccgcggtctcggtggaggaaggcgtcgacaagatccggctgggcaaggccgagatggtggtcgccggcggcatcgacgacctgacgctggagggcatcatcgggttcggtgacatggcggccaccgccgacaccgggatgatgcgcggccggggcatctcggacgccaagttctcccggcccaacgaccggcgccggctcggcttcgtcgaggcgcagggcggcggcaccatcctgctggcccgcggcgacctggcgttgaagatgggtctgccggtgctggcggtggtggcctacgcgcagtcgttcgccgacggcgtgcacacctcgatcccggcgccggggctgggtgcgctgggagccggtcgcggcggcaaggattcgccgctggcgcgcgcgctggccaagctcggggtgggcgccgacgacgtcgcggtgatctccaagcacgacacctcgacgctggccaacgatcccaacgagaccgaactgcacgagcggctcgccgactcgctggggcgctcggagggtgctccgctgttcgtggtgtcgcagaagagcctcaccgggcacgccaagggcggcgcggcggtcttccagatgatgggcctgtgccagatgctgcgcgacggggtgatcccgcccaaccgcagcctggattgcgtcgacgacgaactcgccggctcggcccacttcgtctgggtgcgcgagaccttgcggctcggcgacaagttcccgctgaaggcggggatggtgaccagccttggcttcggccatgtttcgggtttggtggcgctggtgcacccgcaggcgttcctcgccgcgctggacccggagcagcgcgcggactaccagcagcgcgccaacgcgcggctgctggccggtcagcggcggctggtctcggcgatcgccgggggcgcgccgatgtaccagcggccaccggaccgtcgcttcgaccatgacgtgccggagaagcgtcaggaggccgcgatgctgctcgatcctgcctcgcggttgggcgacggcgacgcctaccaggtctctgccgggtgacggcggcgatccgttagcctggcgacccatgggaattgtcggtgtggggatcgatctcgtctcgattcccgaattcgccgagcaggtcgaccagccgggaacggtcttctccgagacgttcacgccgggggagcgccgcgacgcgtcggacaagagctcgtcggcggcgcgtcacttggcggcccgctgggccgccaaggaggccgtgatcaaggcctggtcgggttcacggttcgcgcagcggccggtgctgcgcgaggacatccaccgcgacatcgaggtggtcaccgacatgtgggggcgcccgcgggtccggttgagcggtgacatcgccaagcacctggccgacgtgacgattcacgtgtcgctgacgcacgagaaagacaccgccgccgcggtggcgatcctggagactccttgagcgcgagcagacacaatagcgccgcgacacgccgtgaagaaggggcttttgcgtctgctcgcgagataacggagcgggtgcgcgaggtgctgccgtcggtgcggctcgacctggaggagctggtgcgcatcgaatcggtgtgggccgaccccgggcgacggcccgaggtgcagcgcagcgcacgggcggtggcagatctgttggcgcaggccggtttcggcgatgtgcggatcgtcagcgaaggcggcgcgccggcggtcatcgcccgccatcccgcgccgcccggcgcgcccaccgtgctgttatatgcccaccacgacgtgcagcccgaaggcgaccgcgggcaatgggtctcgccgcccttcgagcccaccgaacgcgacggccggctctatggccgcggcagcgccgacgacaaggccggcatcgcaacacatttggcggcgttccgggcgcacggcggccggccgccggtgggggtgacggtcttcgtagagggcgaagaggaatccggctcgccgtcgttgggtcggttgctggccgcgcaccgcgacaccctggccgccgacgtgattgtcattgccgactcggacaactggagcgtcgacacgccggcgttgacggtgtcgctgcgcggcctggtcgactgcgtggtcgaggttgccaccctcgaccacggtctgcactccgggttgtggggtggggtggtgcccgacgcgctgagcgtgctggtgcgcctgctggccagcctgcacgacgacgacggcaacgtggccgtcgccggactgcatgagacagacatcgccacgctgaactatcccgactatccgcccgagcgggtccgcgccgattcgggcttgctgccaggcgtgtccgagatcggctcgggctcagtgccgcaacggctttgggccaaaccggcgatcaccgtgatcggcatcgacgccacacccatcgagcgggcgtccaacacgctgatcccgcgggcccgtgccaagatcagcatgcgggtggcgcccggcggcgacgcggcggcgcacctggacgcgctgaccgcgcacctgcaacagcacgcgccgtggggcgcacaggtcagcgtcacccgcggggacatcggcgaaccctacgcgatcgacgccagcggcagcgtctacgacgccgcccgcgcggccttccgccaggcgtggggcgccgagccgatcgacatgggcatgggcggctccatcccgttcatcgccgaattcgcggccgccttcccggaggcgaagattctggtcaccggcgtggaagacccggcgacccaagcgcacagcatcaacgagagcctgcatctgggcgtgctggaacgcgcggcgattagcgaggcgctgctgctgaccaacctggccaacctggctgacctgctcaacccgggctgactagaccgacaggtcgcggcggagcttggcgacgtgaccggtggccttcacgttgtactgggcgacggcgatcctgcccttctcgtcgaccacgaaggtggagcggatgacgccggtgaccgtcttgccgtacatctgcttttcgccgtaggcgccgtaggccgtcagcaccgtgcggtccgggtcggacagcagcgggaaggtcagcttctcggcgtcgcggaacttggccagcttctcgggcttgtcgggggagatgccgacgacgtccaagccggcgccgttgagctcggccaggctgtcccgaaagtcgcacgcctgcttggtgcatcccggcgtcgacgcggccggatagaagtacacgatcaccttgcggcctttgaagtcggacagcttcacggtcttgccgtcggcgtcgggcaggctgaatgcgggcgctttgtcgcccggtgcgagccgcgtggtctcggtcaaggtgagtccctttctgttcaccggagcgtggggatcgccgccagctgatctagggtagttcgggcaggcgcatgagccagacagcgggcgacttggaggacacagtggcggaccgggacccggaagcgatcaagcgagagatcgacgtcgcccgtgaccagctggcgaccaccgtcgactccctcgccgagcgggccaacccgcgccgcctcgccgacgacctcaaggcccgggtgatcggattcgtgcaaaagccggtagtgctggcgtcgctcgccggggtgggggcgctggtcgtggtggtggcggtgcgccgggtcaggaatcgctgacccggccggtctggacgtacaccggaatgtcgtcggcccacggctgcgcggtggccatgtcgtcgacggtgcagtagccgcgctcgaattcgcccgtcgccgcgtcgaccaaccggtactcctgcgtctggcggtggatgggctgggcgtccaggatcaccacccgcacctcgcccggctcgaacccgcagcgctgctgcagcgcctcgatgaggcattcgttgtgcaggtggccgtcgccgaagttccagcccagcaccatggcgcacagcacttcgccctcgcacaggttgtagtcgtcctcgtcgtagtcggccatcgcccggtgcgccagggtgagcagcgcgcgcccgtgggtgttcatgccccggaaggccagcgccaggtgcagcgggatcagggtctcctccttgctgccgtacagccgctccagctgcaggtgctgcatcgggcccagcgcgcgagcgccgacccggatcttctcgtcggccgacggccgcacgcaccacagcgtggtgtcccagttgcccgcgtagtagcgcatgcccggcaggaaggacaccttgcgcgggtacaggttgccgacgacgacggtgccggccatcaccacgaacagcagggcgatcggccacgggtcggcgacgctcgacaaccccaccggcgcatgcgcgaggaacagccacagcaccccgaagatcatgaacacgttccactccagcggcacgcccatcgggaaggccagcaggatgttgaggtggaacacgatcatcacgaacgcggcgagcgccgtcggccagcccccggttgaacagaagagcaccagcggcaccaggccctcgaccgcggtggagaagtgcgcgatgaacccggccagcgcgctgggccgcaggtcgtcgggatagcgccggaacatcgagcgcttgagcggcccggacgggatgaacgggttgttggccagcatcgtcgagatgacgaacgggaagtgccggttgagcttcgacgtagccgcgcccagccagatcaccatgaaggccaccttcgccccgaccaccacgtccgccccgccgaacaggaacaccagcgccaggggcgcatacacctcgccgcgcgcggccaggaagatgaccttgtcgcgcagggcgatcgcggccagcacgcccaaaatcgcggcagtctgccagcgcggcagcacgccgattgccgtctccagagcgggaatcggcccgctgccgtcggagaccagcgcccccaccagcagcaccagcagggcgccgtacagcgcggcgtccaacggcgtccgggtgctgccccgggtcaacgggattcgattcggccacggcggcaaccgaattgtgccgggccgcaaccagtacaggatggaacccatcggcgggaaatagcgcccggccagcgggccgaagcagcaaccgaggccgacgacctcgaacagcatcgtgtagagcacggccttctggaacacgatcggctccgaccaccaggcgccgacctcggtgaagccgccgatgccccgggtggaccaggcgaacagccagccgccgaggacgtacagcgcgatcttcgcgccgtacatcacgtgcatcaccagcggcgtgccgaacccgttctcggcgatgtggcgtgccatcggcaccagccgttcggcgcggggccgcgcgctccactcggccacatcgacgacgggcagattgggccggatgaatcccattgcggctccttcgacgcggcggatttcacgggtccggccggcctttgggcgccggtcggtgccagcaagaaactacctattcgcgtcgcgatagggcggtaaatggattcccgtaattcgctgcgccggccgccgacggctattcccagcccggcgggtcgtgctcggccatgtaggcctcccacgccgcgcgccgcagggtccgggtgtgcaggtcctggcagataccctgagcctcggcggcactggcggcccggccgagatcgtggtgcacgaagccgtcgtcgacgcgctcggcgcgaaagccgcccgtcgagaccgcgtgaacccggtattcgctgcggtcatcgatgttggcgtggaagtggcccgggtagggttcgatccacttcagctcagttttcacaggaccccttttgagaaatcaccgtcgctgcgatggtaggcgcggggcgcttcgggaaaacccgtggggtcgcggcgggagccgccgaacagacgaaaaattccgcaggtggtgcgccgtcagggtttcgaaccccggacccgctgattaagagtcagctgctctaccaactgagctaacggcgcttgtggtcggccgagaccgcgtaggcgacaataacaggcgttctgccgcggagcgaaatcccgaaccatcacccaggatagccgttcggcgggcggtcgcggcttgctctcaccgacgcggcccggccggcacccgtcgaaccaacgaaacaggctggccgccaaagctttccgggcgatcgtagaacggtctcacagcaccgtgccgcagaacggggcccgctcggcgccgaaggcggcgtccagccggcccagcgcgccctggcgcagctcggtgatgcgcttggcccgggccaactgggcgccccggtgggcgcccatgtacacggtggccaggtcggccagcccgatctcgaggtccgcgggtccgtcgtgcggcgtgcacttgccggcgccgtcgcgcgtctgcagctggaaccgccccccggccagccccagcgggtctgtgacgtcgagcacgatgtcggtgtcggcggcgtagccgcgggcccccaacacctcggggacgtcgttgatccgcacccagaggaagtcgctgatgcctttcgtctcggcggcgcgctggtcgacgagtttgagcggcagcggatcgtcgggcggcacatcgatctcgacgcgatagaacatctccaaaaccagtagcgtctgcagcaactcggtgtgcgcctcgtcggtgatggggcagaagtcctcgaccaccaccgtgcccagcggcggccgaaacgcgtgctggcgcgagccgaccacccgataggtcaggaagccgtccgggtggatggtgtagtgcaacgcagatccgttgccgcgctgggtcgttcggtcttccagatggtcggcccaccaggccttgtcccgggtcaccgcccccggcgtgacggcacaccatcgttcgtagagcccgggcaggtgacgtcgtgccgttgcggcgttgacctcgcgcgcccggtcgtcgccgggtgtgtcccgcagcttcgcgaagcgacggtcgatggcgtaggtgtggctgtagctggacacgccggcgccgaaaccgtcgtacatcgcggtctgggtgggcacgccacagacgatcggatagccgcggtccaacaggattccgagccccttggcgctgagctgcgcccacagccccttgccctgatgcgttgatgcgacggcgatcatcgtcaaccacgcggctcgcaggttggtgccgccgggcacggtcagctgcgccgggtagatgatcgaggttcccaccaggaacgggttcttcggatcggagacgtcctcggcgatgagaatgtcgtcgaggcggacccggcgtttccacgcctcgaggtcttgcgggcccaccggatcgccgaaggtgcgggcctggttctcgaagaccgcctgccagtcatcctcggtgggatgccgaatggcgatgccgtcgtcctgcgtgttcattgcacatccaatccgcttgtagcccaggccaaccggcgctgtgcagctcgaatccgcctcccgagtgtgcttttaggtccgatacccgagtgccggatggtcaaaccacgggcggcccgccggcacggcgccggcgaacgcgggccggtgtgagcaattcggcgggtcaaacaccccggttttgggtaggtgatggccatgctgcgagtaatcacccggctggccatcgccgcgccgcgccgcatcatcgggatcgcggtcctggtcatggtgggcgcggcgatcttcggcctgccggtggtcaacagcctgtccggcggcggcttccaggatccgacgtcggagtccgcccgggccaccgagatcctgcgggaccggttcaaccagaccgatcagcaaatgctgatcgtggtgagcgcccccgacggcgcccgcagcccccaggcgcaccgggtcggcaccgacatcgtcgacaaactgaagaattcgccgtggatgatgagtgtgtcgtcggcctggacgtcgccgtcggccgccgccgcccagctgatcagcaaggacaacaagtccgggatgatcgtcgccggcctgaagggcggcgagaacgacgcgcagaagtacgccagcacgctcacccgtgagctggtgcacgaccgtgacggcgtcaccgtgcgcgccggcggcatggccgtggcgtatgcccagatcaacgcccagaaccagcgggatctgctgttgatggagtccatcgcgatcccgctgagcttcgccgtgctggtgtgggtgctcggcggcgtggtggccgcgacgctgccggtcgtgttgggcgccttggccatcgtcggcaccatgtcggtgctgcggctgatcagcttcgccaccgacgtgtcgacctacgcgctggacctgtccatcgccatgggtctggccctggcgatcgactacaacctgctgatcatcacccgctaccgcgaggagctggcccgcaccgaggaccgggaccgggcgctgtaccggaccatggccaccgccgggcggacggtgctgttctcggccaccaccgtcgggttgtcgatggcggtgatggcggtgttcccgatgtacttcctgaagtcgtcggcctacaccatcgtggccaccgcgatcatcgtcgcgatcgccgccgtggtgatcaccccggcggcgatcgtgttgctcgggccccgactggacacgatggacgcccgccgggtgatgcatcgcatcctgcacgggcagcgttcgttccgggatccggcgcacaagccgctggtggagcagttctggtaccggtcaacgaagtacgtgttgcgccgcgccctgccggtcgggctgagcgtcgtcgcgctgctgctgttgctgggggtgccgttcctgggcgtgaagtggggctttcccgacgagcgggtgctgccccgctcagcgtcggcgcgccaggtcgccgacatgctggacaacgacttccccggcctgggcaccgagctctccgtcgtcgtccccgacgcccgcggcgtcacacccaccgaacttcgcaaatacgccgccgagctgtcccgggtgcccgacgtctccgcggtcagcgcgccgaccggcaccttctcggccggacaccgggtgggtccgcccgccgcggccaccggcctggccaacggcagcgccttcttcaccgtgtcgagcaccgccccgctgtattcaccggcctcgaacgcccagctcgaccggctgcatcaggtcgccgggccgggcggacgcgccgtgctgatgaccgggctggcccagatcaaccgcgacagcgtcgacgcgatcaccaaacgactgccgacggtgttcggcctgatcgccgtcgtcaccttcatgctgcttttcctgctgaccggcagcgcggtgctgccggtgcaggcgctggtgtgcaacgtgttgtcgctgacggcggcgttcggcgcgatggtgtggatcttccaggacggccacctgggtgcgctgggaaccacacccaacgggacgctgaacgccaacatcccggtgctgttgttctgcatcgccttcggcctggccatggattacgaggtgttcctcgtgtcccgtatccatgagtactggctggcctcgcagtccatccgcgagacaccgccgaccgccagggaggcgcgcgccgaaaccgacgagagcaccgcgctgggcatcgccggcatcgggcgggtggtcaccaccgccgccgtggtgatgtcgatttccttcgcggcgctgattcccgcgcacgtgtcgttcatgcggatgctgggcctgggcctgaccctcggcgtgctcgtcgacgccaccctggtgcgcatggtgctggtcccggcgttcatccacctgctgggccgctggacgtggtgggcgccgcgaccgatggtctggctgcgcgaacggtcggcgaccggggaggccggcgaggtgcgggtgggacggcggcgctgggcccgcgacgcgccgcgacccgcgatccgcaggtggcccagccgggccacatcgggtcgcggttgacacgccaatccgcttgtagagcaataactttcggagggagaatcctcgtgccccgaaccgagatcatcgccgcattactcgcgttgagctccgcgctgtgcgtcgcgaccggggacgtgttgcagcagcgggcggcgcattgcatcaccgaccgcgagttgggcccggtcgaattgttcgccggactgctgcgcagccagcggtggtggtggggcgccgtgctgttgctggcgagcatcgggttgcaggccgccgccctgggcggcggctcggtgttgctggtgcaggcgctgctgatgttctcggtgctcttcgccctgcccatcaacgcccggctgtcgcaccgcgccgtgaccgcgggcgaatgggtctgggcggccctgctcaccgcggcggtgaccgtggtcgtcgtcgtgggcaatccgcagaccggtcacgccggcgcgccgctgcgcacctgggcggtggtggccctggtgctggggccgctgctggccggctgcgtggtggccggccgggcccggggcggagccgtggccgcggtgctgttcgccttcgtgtcggggtcgctgtggggcgtgttcgcggtgctcgccaaggaggtgatggcgcggctggggcagggagtcggggtggtgacccggaccccggagctgtatgcctgcatcctggttgcgctggggggcgtggtgtggagtcaggcggcgtttcgggccgggccgttgaccgcgtcgatgccaaccctgcaggtgtcgcagccggtggtggcgtcggtgctgggcgtggtcgtgctgggcgagacgctggacaccggccgggccgggacggtcgcgctgctggtggccgtggtggtgatgacggcggccatcatcaagctcgcccgcgtcgaagccgtcgcgacccgcgaccgggccgaggcgcaactgcaccagcccgcctagtttgctgactcgccggattgcgagtcgatttcggtgccgacaccgaacggccgccgccggcgcggatgcgcacgggacgacgcccgaaacccattagaatgccggcagctacctgtggtcagcggtgaccaactgtgcgacgtgagatggaaggtcactggatgacgcctttgcgtggacgccgatcgtggctggcagctgcgatggctttggttgctgtgggggcagtcgcctgcggcggcggccacacggcagcgccgcccaaggtcatcttcgacaagggcaccccgttcgccgacctgctggtgcccaagctcaccgcctcggtgagcgacggcgccgtcggcgtgacggtggatgcgccggtgacggtcagcgtcgccgacggcgtgctggcctcggtcaccatggtcaacgagaacggcaggtcgatcagcgggcaactgagccccgacggcctgcgctggtcgaccaccgagcagctcggctacaaccggcgttacacgctgaccgcgaaggcgaccggcctgggcggcgcggccagcaagcagatgaccttcgagaccagttcccccgcgcacctgaccatgccctacgtcagcccggccgacggcgaggtggtcggcgtcggcgaaccggtggcgatccgcttcgacgagaacatcgccaaccgggccgcggcccaaaaggccatcaccatcaccaccaatcctccggtggagggcgccttctactggctcaacaaccgcgaagtgcgttggcgcccagagcatttctggaagtccgggaccgtcatcgacgtggccgtcaacacctacggggtggacctgggcgacggcatgttcggcgaggacaacgtcaagacgcacttcaccattggcgacgaggtgatctcgaccgccgacgacaccaccaagacggtgacggtgcgggtcaacggtgaagtggtcaagaccatgccgacctcgatgggcaaggacagcaccccgacggccaacggcatctacatcgtcggggcgcggttcaagcacatcatcatggactcctccacctacggcgttccggtcaactcgcccaacggatatcgcaccgaagtcgactgggccacgcagatgtcctacagcggcgtcttcgtgcactcggcgccgtggtcggtcggtgcccaggggcacaccaacaccagccatggctgtctcaacgtgagccccagcaacgccgaatggttctacgaccacagcaagagcggcgacatcgtcgaggtcgtgcacaccgtggggccgacactgcccggcaccgaggggctgggcgactggaacatcccgtggtcgcagtggaaggcgggcaacgccaacacctgacgccgggtcagtcgatcttgcgccagatcccgcagcttctggtcatgaaggcgacgtcggtcggcaggatccggacgacctgggcgccgtcgccgacgttgttgtcgatgatgtcgttggtgtcgaagctgcgcagccgtgcccaatagcacccgcttttgccgtcggtgcggtaggtgccggccgcgatctccttgttgacgatgaacgtcccgttggtctcgatcgaggtcttcggtcccggcgggggcggcggggtgacggtcacggtgacggttttggtctgcgccggcggtgtcgagatgaccgtcgttgccgtgggggtcgacccgccgcagcccgccaggaataacgccggccccggcgacggcggccgtcttgcccggcgagcgacgccacggggctgcgggccaggcgggacgttgtctgttcactacttttccggttaccggtgcacgagcgtcgtgcgggctccgcacgacctgaacgcgcagtggacggccacgcatggccgacctgtggggtggctgacgggactcgaacccgcgacacccaggatcacaacctggtgctctaccagctgaactacagccaccatggccgccatccgatcccggtgcgggtgaacgcggcgacgtcgatactaaccggtgggcggtgcgctggccgaatcgctaggtcccggtgcgtcttttccctcgtcgagggcggcggccaccgcctcgatttcgctggtagacggtcccggcggggcgacgaacgcggtgcgccggtagaactgcagctcccggatggattcgtggatgtcggccagggcccggtgggtcagccctttgaccggctggccgaagtagatccgcgggtaccagcgccggcagagctccttgatggagctcacatcgatcatgcggtagtgcaggtaggcgtccagggcgggcatgtcgcgcacgatgaacgcgcggtcggtggcaatcgaattcccggccagcggcgccgtcttgggggccttgacgtgagtgcggatgtagtccagcaccatctcctcggcggtggccaggtcgaccgtggatgccttcacctcatcgatcagcccggagcgcgaatgcatttcggtgaccacctcgcccatcgccgccagcgcggcgtcgtcggcgtggatcaccacgtcgacgccgtcgccgagcacattcagttcagcgtcggtgaccagggccgcgatctcgatcagcttgtccgaaccgagatcgagtccggtcatttcgcagtcgatccacaccaattcgtcgcgcacagcgctcaccctaatgcggggcggcgacctccgtgccggccctcgcccccggatcggcccgcgacgtagggtgagcgttggcgaagtgcatgccgaatcacccgggggaagaggggcgcagcacgatgagcaccgattcagcggcaacaccggcgacgcggatcgcggacggctacgccgtcgcgggccaggcattggaattgggcacggtcgtcatcgacggtgcggccgacccgtcggcgcagatccgcatcccgctggcgacggtgaaccggcacggcctggtggccggcgcgacgggcaccggcaagaccaagacgctgcaactgatcgccgagcagctcagcgccgcgggcgtgccggtgttgatggccgacgtcaagggtgacctgtccgggctgtccaaggaaggggagcgcagcgaccgaaccgatgcacgcgccaaggacaccggcgatgattggcaaccctcggggttcccggtggagttcctgtcgttaggtgccaacgggattggcgtgccgatccgcgcgaccgtcgacagcttcgggcccgtattgctgtcaaaagtattggggctcaacgctactcaagaatcgacgcttgggctgatcttccactgggccaaggagcggaactggccgctggtcaccaccgacaatctacgcggtgccatcagccacctcaccagcgacgagggcaaggaagatctgaagtccctgggcggcgtgtcggcgacgacggcgggcgtgatcctgcgggcgctggtgaacctcgatgccgagggcggcgacaccttcttcggcgaacccaagctcgaccccaacgacttgctgcgcaccaacgatcaaggccaaggcgtcatttcgctgctggagttcaccggccagtcggtgcgcccggtcatcttctccaccttcctgatgtggttgctcgccgacctgtacacccaactgcccgaggtcggcgacatcgacaaacccaagctggtcttcttcttcgacgaggcgcacctgctgttcgccgacgcgtccaaggccttcctggaacaggtcgaacagacggtgaagctgatccgctccaagggcgtcggggtgttcttctgcacccagttacccaccgacattcccaacgacgtgctgtcccagttgggtgcgcgaattcagcacgcgctgcgggctttcacgcccgacgaccagaaggcgctgtccaagaccgtgcgcacctacccgaaaaccgatgtctacgacctggagtcggcgttgacgtcgctgggaatcggcgaggccgtcgtgaccgtgctctccgagaagggcgcacccacgccggtggcctggacccggatgcgggtgccccgatcgctgatggcgtcgatcgggacagaggagatcacgaaggcagccaaacgcagtgagctgcaagcgaagtacggccaaacggtgcaacaaccggcccagcccccgccgggcccgcaagcaccgaccggatcgcggtcgccgcaagcccagtccgactacccgcccgtcccgccgaatggcccggttccgccgatgccggaacccgcggagcccaaagggccgggcctgctggaaaggctctggcacgaccgcgacgtacagagcgcggtgaacaccgggatccgggagatcattcggctcaagttcggcggcggaggccgtcgccgcaagtaacgcctacccgccgccgagcttcttgtagaagctgcccacaatgggcgccacgatggcgcgcggggcatacccgctggccaccgacatggccttggacgtcagaccgggcacgacgcgcatcttgttgcggcccaacgcatccagcgacacccgggcggtgtgctcggtggagatccacaagaagtcgggcaccagccgctcgacgatcgaggcctcggcgtcgtcgggcaggtcggtgcgcaccgggccgggcgccaacagcgtcacatgcaccccggagccgcggagttccccgcgcagcgactcgctgaacgtgttgacgaaggccttggtggccgcgtaggtggcgttgtaggggatcggcgagttgccggccgccgaaccggaaatcaggatgccgccggcgcggcgctccaccatgccgggcagcaccgccagcgtaaggtcatgcaccccaaggacattcagttgcacctgggccttctcgccggccgggtcgagggtggcgacgggaccgaaggttgcggtgccggcgttggcgcacaacaccgagatggtccgcgcggccagctcgtcgcacagggtggcgcgctcacccgcgtcggccagatcggccgggcgcacctcgacggtgacccggtacttctcggtcagccgggcggccaggtccttgagcaggtcctcccgtcgcgcggtgacgatcagatggtgcccgcgggcggcgagttcggtggcgagcgcttcaccgatgttctgcgacgctccggtgacaaccgcgcgcgcctcggggctgggagcggggatcggcatgcgccaatcgtagacagcgcgcgaacggcgatcggcaggcgatcgccggcgccgatagagttgccgggcatgagccagccggagtcgcgtgccgccgcccccgtgcgatcgcgggtggtggcgtgggcgctctgggattgcggctcgaccgggctgaacgcgatcgtggccaccttcgtcttcgccgtctatttgaccagcagtgttggcgtgggcatcggcggcagcaccacgccggcgagttggctgggccgggcggcggccatcgccgggttgacggtcgcgctgctggcgcccgccgtcggcgtgtgggtggagtcgccgcatcggcggcgggtggcgctgagcgtgttgaccgcgttggcggtgacgttgaccggctcgatgttcttcatccgcgatcggcccggctatctgtgggcgggcctggtgctgctgggggcgacggcggcttgcggcgatctggccagcgtcccgtacaacgccatgctgcgccagctctcgacgccgcgcaccgccggtcggatctccgggttcggctgggcggcgggctatgtcggcagcgtcctgctgttgctggtgatctacaccggcttcatcgccggatcgggttcgggcccggatgccacgcgcgggctgctgcgagttccgttgcgcgacgggctttatgtccgagaggcgatgctggtggccgcggcctggttggcgctgttcgcgctgccgctgctgttcgtcgcgcaccggctcaccgagtccgccgaggggtatcggccgacgagcatgctgggcggatatcgcaagctgtggaccgaggtccgcgaggaatggcggcgcgatcgcaacctggtgtacttcctgttcgccagcgcgctgttccgggacggactggcggcgatcttcgccttcggcgcggtgctcggcgtcaacgtctacggcatctcccaggccgacgtgctggtgttcggggtggcggccagcgtggtggccgccgtgggtgcggtgctgggcggtttcgtcgaccaccgggtcggatccaagcccgtcatcgtcgcgtccctgctggccatcgtcgtgctggggctgaccctgatggcgttgtccgggccggtggcgttctgggcctgtggcctgctgctgtgcatgttcatcgggccgtcgcaatcgtcgtcgcgcgccctgctgctgcagatggccaagcacggcagagaaggcgtcgcgttcggcctctacaccatgaccgggcgggcggtgtcgttcgtggcgccgtggctgttctcggtgttcgtcgacgcgttcggggcggtgcgcgccggcctcggcgggatctcgctggtgctgaccgccgggctgctggccatgctcgcggtgcgggtcccgcgccgcgcccccgtcgccgtcgaagcggcatgacgccgccacggcgacctgccgccgccgcgccgagtgtgggggatacgtccgcccgcgcgcgggcaaccgtgcataggccccacggtcggcgggccgcgatgtccgctcagccgcgggcgtcgcagatggtcagccccccgccgacgcgtctgctgacctgaaccccgttgacggtcacggtgcaggtgacgctgtgaccgatgttgacgatcgtgacgttggccgggtgcacggcggacttggacaggctgacctgcttgctccacggcaacgcgacattgaattcggtctggatgaggtcgccggtgtcgatgtacatgatgctgatcgcccggccctccccggacacggtgtagacgacgtcctgcatcgcggccgggccggtcgtcgcggtgggcggctcgggctcgctggtgggcggtatcggcgccgggatgagcgagggcgacctgtgcgtcgacgtcgtcggcgtctccgggctcggctccggcatggccggcaacggcggcacggcggtctgcgtcttgatcgcgtcgttggcgagcaccagcgcgatcaccagggcgaccaccagcagcaccgccgcgcccgcggcgatccacagccagcgcggcgatttcggctcgcccggcggcggagccatgcccggggcgtgcgggtcgccgcccgggggaagctcctgctgccagtaggcgggcagctgcttggtcgggttggtttcgttcgcggcgggcgcccagggtgacatcgtcgggccgtaggtgggcgcgtacggagtctggtcggcatacgccggatcgacggacggcgagtaccgcggctgcggcggactgaaccgctcggtgggacgtgaatcgttcatgtccacctcatggcttgcagggtacccgggctcggcgctgacgccctgactcaccttacgacggcgggctcacgggcactggtttccggccgccagcgcagcgaccgtcatggcccgcatgatggcgcgcgatcgggcggcgcgggccggcttgccgcgcccggaaccctgggacttcatgctgtgcggcgtcgaattgagcaggccgaacacggcgtgcgcggtcagccgggcatcggcctcggccagctcggggttcagctcgcgcaacacgcccacccagacctcgacgtactgccgttgcgccttgcgcacctgcctctcggccggcttgggcaggtaggcgaggtcgcggtcctggatccggatcaggtcgggttcgttcagcgcgaagtcgaggtggaagtcgatcaggccgtccagcgcggcggcggcatcggcactgcgggcgcggacctgccgggcgccggcgagcagccgagtgctgatcccgaccagcaattcgaccagcagcgactccttgttggggaagtgccggtagatggccggaccgctgacgccggccgaggcgccgatgtcttccagccgcaccgccaggaaaccgcgctctgcgaacagccgctcggcggcggacagtagctggagccggcggtcagacttcaactggctccgccgatttggcggctgcgcgccgccggcccggctttcggaggcagacgttgtcatgacggacctccgtctgtgtcgatcccgcccaacctagcacgagttattcgcaattaactcgtatcgtgccgcggtgcccgctccctggaccggcaacggcgacgatggtattctcgaccaccgagttaatcagaattaactcaaagctccgaccgcccgacggcaaggaggctgctgcggcgatggacaaggtgatggccgcacccgcgaaggctgacccggtatcgttcgccgacgagcaccgccggctggtcggcgagttgaatgccaagctggccgcggccgcgctaggcggcaacgagcgcgcccgcgaacgccacgtcagccgcggaaagctgctgccccgcgaacgggtggaccgcctgctcgacccgggtagcccgttcctggaactctcgccgctggccgccgacggcatgtacgacgacgaatccccgggagccggaatcatcaccgggatcggccgggtgtccgagcgcgagtgcgtgatcgtcgccaacgacgcgacggtcaagggcggcacctattacccgatgacggtcaaaaaacacctgcgcgcccaggaggtggcgctgcagaaccggctgccgtgcatctacctggtcgactccggtggcgccttcttgccgcgccaagacgaggttttccccgaccgcgagcatttcggccgcatcttctacaaccaggcgaccatgagcgccaagggaattccgcaagtggcggcggtgctgggctcctgcacggccggcggcgcctacgtgccggcgatgagcgacgaagccgtcatcgtgcgcgagcagggcacgatttttctgggcggcccgccgctggtcaaggcggcgaccggagaggtggtgtcggccgaagagctgggcggcggcgacctgcactcgcgtatctccggggtgaccgatcacctcgccgacgacgacgagcacgcgctgcggatcgtccgctcgatcgcggccaccttcggcccgcgcgagcccagcccgtggcaggtgcgcaccccggtcccgcccaaggccgcgcagaacgagctctacgacgtggtgccgcccgacccgcgggtgccctacgacgtgcacgaggtgatcgtgcggttggtcgacggcggcgaattcagcgaattcaaggccaattacggcaagacgctggtgaccgggttcgcccacatccacggccacccggtgggcatcgtcgccaacaacggtgtgctgttcagcgaatccgctttgaagggagcacatttcatcgaactctgcgacaaacgcaaggtgccgctgctgttcctgcagaacatcgccgggttcatggtgggacgcgactacgaggccggcggcatcgccaagcacggcgccaagatggtcaccgccgtcgcctgcgcgcgggtgcccaagctgaccgtggtgatcggcggatcctatggcgcgggcaattattcgatgtgcgggcgggcctactcgccgcgcttcctgtggctgtggcccaacgcccggatctcggtgatgggcggcgagcaggccgcctcggtgctggccaccgtgcgcggtgagcagctcaccgcggccggcaagccctggtcggccgaggaggaagaggcgttcaaggcgcctatccgggcgcagtacgaggaccagggcaacccctactattcgaccgcccggctgtgggacgatgggatcatcgacccggccgacaccagaacctttgtcgggcttgctctttcggtgtgcgcgcaggctccgttggagcccgtcggctacggcgtcttccggatgtgagtgcagtgttcgaaacggtattggtggccaaccgcggcgagatcgcggtgcgggtgatccgcaccctgcaccggctgggcatccggtcggtcgccgtctacagcgatcccgacgccactgcgcggcatgtgctcgaggccgacgaagcggtgcggctggggccggccgcggcgcgggacagctacctgaacatcgacaaggtcgtcgaggcggcgacgcgcaccggggcgcaggcgatccatcccgggtacggattcctctccgagaacgccgatttcgctgcggcatgcgaacgggccggggtggtgttcctcggcccgccggcacgggcgatccaggtgatgggcgacaagatcaccgccaagaacgccgtcgccgaattcgacgtcccggtggtgcccggggtggccaaactggggctgggcgacgacgaattggtggccgccgccgacgagatcggctacccggtgctgatcaagccgtcggcgggcggcggcggcaagggcatgcgcctggtggaagaaccgggcaggctgcgcgaggcgctggtgggcgcgcggcgcgaggccgcctcgtcgttcggcgacgacacgctgtttctggaacggtttatgttgcgccccaggcacatcgaggtgcagatcctggccgacgcgcacggcaacgtcgtgcatctcggcgaacgcgagtgcagcctgcagcggcgccatcaaaaggtcatcgaggaggcgccgtcgccgctgctcgacccggagacgcgggcgcggatcggggcggccgcctgcaataccgcccgcagcgtcgactacgtcggcgccggcacggtggagttcatcgtctccgccgatcggcccgacgagttcttcttcatggagatgaacacccggctgcaggtcgagcatccggtcaccgaggcggtgaccgggctggacctggtggaatggcagctgcgggtggccgccggcgagaagctggtgttcgcccaggacgacatcgaactgcgtgggcacgcgatcgaggcccgggtgtacgccgaggatccggcgcggggcttcctgcccaccggcggccgggtgctcggcgtcttcgagccgtccggtgacggcgtgcgggtcgactcgtcgctgctgcccggcaccgtggtgggcagcgactacgacccgatgctgagcaaggtgatcgcccacggggccgaccgcgacgaggcgctggccagactcgaccgggcgttgagccacaccgcgatcctgggcgtccagaccaacgtcgagttcctgcgcttcctgctggccgacgaacgggtacgcgccggcgatctggacaccgcgctgctcgatgcgcggctggccgacttcgcgccgctgcccgcacccgacgacgtgctcgccgcggccgggctgtaccggcaatcggcgctggccgcccgggcccgccgcttcgccggcaacccctgggcggcgccgacggggtggcgggccggcggtagcccggcgccggtccgcaccgacatgcgcaccgcgctgcgcaccgagacggtgtcggtgtgggggccacccgaggccgccgaagtacaggtcggtgccggcgaaaggctttcggccagcgcgcatctcgggccggaccggatcagtgtgacgctggacggccggcgccgcgactaccgctgggccgaggccgaccggcacctgtggatcgccgacgagcgcggaacctggcacctgcgcgaggccgaacagaccaccattcaccgcgccgccggcccgcagcgggccgagatcctcagcccgatgccgggcagcgtgatcgccgtccaaaccccttcgggcagcgacgtttccgaaggcgacgtggtggtcgtcgtggaggcgatgaagatggagcactcgctggccgcgccggtttccggacgggtggaggtgctggtctgcgtcggcgaccaggtgagcgtggaccaggtgctggcccgggtggtgcccgaggaatccgacccgccggccgattcgagtaaggacgagacatgaccacatccctcaccgcgggaacgctgcccaaggaataccaggacctgcgcgacaccgtcgccgagttcgcgcggaccgtcgtcgcccccgtgtcagccaaacacgatgaggaacacagctttccgtacgaggtcgtcgccaagatgggggagatgggcctgttcggcctgcccttccccgaggagtacggcggcatgggcggcgactacttcgcgctgtcgctggcgctggaggaactgggcaaggtcgaccagtcggtggccatcaccctggaggccggggtcagcctgggcgccatgccgatctaccggttcggcaacgaggaacagaaacgcaagtggctgccggacttgacggccgggcgggcgctggccggcttcgggctcaccgagccgggcgccggttccgacgccggcgccacccgcaccaccgcccggctcgaggacggcgaatgggtgatcaacggcagcaagcaattcatcaccaactcgggaaccgacatcacgtcgctggtcaccgtcaccgccgtcaccggcacggtcggcgcggacaagaaggagatctccaccatcatcgtgcccagcggcacaccgggattcaccgtcgaaccggtctacagcaaggtgggctggaacgcgtcggacacccacccgctgagtttttccgacgcccgggtgccggaagagaacctgctcggggcccgcgggacgggctacgcgaacttcctgtccatcctggacgagggccgcatcgcgatcgccgcactggcgaccggcgccgcgcagggctgcgtcgacgagagcgtcaagtacgccaaggagcgccagtcgttcggtcaaccgatcggtagctatcaggcgatcagcttcaagatcgcccgaatggaggcgcgtgcccacgtggcccgcaccgcgtactacgatgcggctgcaaagatgttggcgggcaagcccttcaagaaggaggcggcgatcgcgaagatgatcgcgtcggaagcggcgatggacaacgcccgcgacgcaactcagatccatggcggctacggcttcatgaacgagtatccggtggcccgtcactaccgcgacagcaagatcctcgaaatcggcgagggcaccaccgaggtgcagctgatgctcatcgcccgctcgctggggctgtcatgagcgaaccagtcaaatcggttgtccaacgcggcttgtggttcgaagagttcgagatcggcaccacctacctgcaccgccccggtcgcacgatcaccgaggccgacaacgtcttgttcaccacgctgaccatgaacacccagtcgctgcacctcgacgcggcctgggccgcgcagcagccgggctttcgcggcgagcggctggtgaactccatgttcaccctgtccaccctggtggggctgtcggtgtcgcagctgacgctcggcaccatcgtggccaacctgggcttctccgaggtgtcgttccccaagcctgtcttccacggcgacaccctctacgccgaaaccgtctgcaccggcaagcgcgagtccaagagccggcccggcgagggcatcgtcaccctcgagcacaccgggcgcaaccagcacggcgacgtcgtggcccgcgccgtgcgcaccacgctggtgcagaagcgcccaagcgaccaggaggctccgtgaacccgcacgccgccggtccggcatggctgttctgcccggccgaccgtcccgagcgtttcgccaaggcagccgcggccgccgacgtggtgatcctcgacctggaggacggcgtggccgaggcggacaagcccgccgcccgcaaggccttgctggagacgccgctggaccccgagcgcaccgtggtgcgggtcaacgccgccgacaccgacgagtacgcccgcgatctggaggcgttggccggtaccgcgtacaccacggtgatgctgtccaagacagaatcggcggcccaggtgcagaccctggcgccgcgcgaggtgatcgcgctgctggaaaccccgcgcggggcggtgttcgcgaccgagatcgcggcggcccagaacacggtggcgctgatgtggggcgccgaggacctggtcgccacgctcggcggcagctcgagccgccgggccgacggcagctaccgggacgtcgcccaccacgtgcgctcgaccgccctgctgaccgcgtcggccttcggccgggccgcgctcgacgccgtccacttggacatccgcgacctcgacgggttgcgggccgaggccgaagacgccgtcgcgctgggctttgccggaacggtgtgcatccacccgagccaggttccggtggtgcgccaggcgtaccgcccgcccgaggagaagctggactgggcgcgacgggtgctggcggccgcccgcagcgaacgcggggtgttcgcgttcgagggacagatggtcgactcgccggtgctcaagcacgcccagatgatgctgcgccgggcgggtgagacggccgccggctgaccgtcccgccgcggccggcccgccccgctgagcggcgacacgtccgggccgtcagtgcaatcaacgcggtctcttctgattcgggcgcataatggtgagtacgccagtgtcgcggcgagcgaagcctttcgtgtagctggcgatcgacttccgctcgcggtatgcaccgagcaagggaggcggtatggcgcagacatctcagccgccgatgaccgtcgacttgcaaccggtgcaactcgtcgccgccgacggcaccccgacccccgaacatcgctacagccgtgagcttcccgcggagacgctgagctggctctacgagatgatggtgctcacccgcgagctcgacggcgaattcgtgaacctcaaacgccaaggccagttggcgctgttcgcgtcctgccgcggccaggaagccgctcaggtgggcgcgactgcctgcctgcgcaaaaccgactggttgttcccccaataccgggaactcggcgcctttttggtgcgcggcatcccgcccggcaacgtcggggcggtgtggcgcggaacgtggcacggcggactgggattcaccgacaagtgctgcgctccgctgtccatcccgatcggcacccaaagcctgcacgcggtgggcgcggcgatggccgcccaacggctgggcgaagattcggtgacgatcgcgttcctgggcgacggagccaccagtgtgggcgacgtgcacgaggcgctgaacttcgccgccgtgttccgcacaccctgcgtgttcttcgtgcagaacaaccagtgggcgatctccctgccggtcgccaaacagaccgccgccccgtcgttggcgcacaaggcaattggctacgggatgcccggcatccgggtggacggcaatgacgtgctggcctgctacgcggtgacggccgaggccgccgcccgggcccgcgccgggcgcggcccgacgttgatcgaggcgatcacctaccggctggggccgcacaccacctccgatgacccgacccggtaccggacacaggacgaggtcgaccactgggccgcgctggacccgatcccgcgctaccgcagctacctgcagggccagggcctgtggtcggagcgcttggaggagcgggtgatcgggcgcgccacgcggatgcgcgccgagctgcgcgacgcggtgttcgatgcgcccgatctcgacgtcgacgaggtgttcaccgcggtgtacgccgaaatcacgccggagctgcaggcgcagcgccgtgcgctgcggaccgaactcgagaaaagtgattgagagatgacccagctcgctgatcgcccgaccggccacggcgaaaccctcaccgcggcagtgcaggatgtcgcgctgcacgcgcaggcgttgaccatggtgcaggcgctcaaccgcgccctgcacgacgcgatggccgccgacgagcgggtgctggtgttcggtgaagacgtcgcggtccagggcggtgtcttccgggtgaccgaagggctggcggaggcgttcggcgagagtcgttgcttcgatacgccgttggcggaatccgcgatcatcggcatcgcggtggggctggcgctgcgcggcttcgtgccggtgccggagatccagttcgacgggttctcctacccggcgttcgaccaagtggtcagccatctggcgaagtaccgcacccggacccgcggcgcgatcgacatgccggtgacggtccgggtaccgtcgttcggcggaatcggtgccgccgaacatcattcggaatccaccgagtcgtactgggcgcacaccgccggcctgaaggtggtggtgccgtccaacccggccgacgcgtactggctgctgcgccacgccatcgcctgcccggacccggtgatgtacctggagcccaagcgtcgctaccaaggccgcggcctggtggacgccggccggcccgaaccgccgatcgggcgggcgatggtgcgccgggcggggaccgacgtgaccgtcgtgacctacggcagtctggtcggcacggcggtcggagccgccgaagaggctcagcgccaacgcggttggagcctggaggtcatcgacctgcggtcgttggtgccgctggacttcgacaccatcgcgacatccatccaccggaccggtcggtgcgtggtgatgcacgaggggccgcggaccctgggttacggagccgagctggccgcccgcatccaggaggagttgttctacgaactggaggcgccggtgttgcgcgcgtgcggattcgacaccccctacccgccggcccggctggagaagtggtggctgccgggcccggaccggctgctggactgcgtcgagcgcacgttggagctgccgtgagcgacgagcgcgtcaaaccgtttctggtcccggatctcggcgagggactcgaagaggtgaccgtgacgcactggaacgtcgcggtgggcgacgacgtcgagctcaaccaggtgttgtgcacggtggaaacggccaaggccgaggtggagctgcccagcccgtacgccgggcggatcgtcgaaatgaacggcgccgagggcgatgtgctcaaggtgggcgcggtgctggtgcggctggacaccgcccccgagagcggcgagccgccggcggccgagacggcgcccacactggtcggttacggcgccgatgccgggatcgacaccagccggcggaccggccgcccgctggccgccccaccggtgcgcaagctggccaaggagctgatggtcgacctcggctcgctgcggccccgctccggtgccgtcatcacccgcgaggatgtgctctcggcggctcacggcaccggcaacggggccgaggtccggccggttcagggcgtccaggcccggatggccgacaaaatgaccttgtcgcacaaggagattccggccgcgacggttagcgtgcaggtcgactgcaccgcactggtccggctgtccgagcggcttggtccggcggagcagaggataacgccgttcgtgctgacgctgcggctgctggtcatcgcgttgcgccgcaacgagatcatgaactcgacctgggtcgacaccccgcaggggccgcaggtgcgcatcgagcatcgggtgcacctgggcgtcgcggtggccaccgaacggggcctgctggtgccggtcattgccgacgcacacaccaagacgactcgtgaattggcaagtcgggcagcagaattgatctccggcgcgcgtgccggctcgctcacgccgggggagctgcggggatcgacgttcaccgtgtcgaacttcggggcgctgggcgtggacgacggtgtgcccgtgatcaaccaccccgaagcggccatcctggggatgggtgcgatcaagccacgcccggtggccatcggcacggaggtcgtggtgcgcccgaccatgtcgctcagcgccgtgttcgaccaccgcatcgccgacggcgcgcaggcggctcgattcgtttgcgagctgcgggatttgatcgaatcgccggaaaccgcgctgctggatttgtgagcctacttgcgttgcgcggcggccaatcgctgtgcgaactccggtgattgaatggaatgtgcctgcgggcccagctcggtgcgcatggcgtgctgatgctgttcgttgtcgagcgagccgagactgatggtggcgcgcatcgtggctttggtcgccagcaccacctcgcgcggggcggccgccgggccggcggccagttcgagcgccgcggccaccgggtcgtccgcgacgctgagcgccaggccatggcgcaccgcggcctcggcgtcgaagcgcatgccgaacaacagggccgcgcgggcgacctgcgggcccaccgcgcgctgcagcatccaggtggcgcctccgcccgggtgcaggcccagctgctggaatcgcggatcgaacagggcggcgggcccggcgatgcgcacgtcggccgccagggccaggttcaggcccgcgccgacggccgcgccgttgaccgcggcgatggtgggcagccggcaactcccgatcgccatgaagccccgtctcggccgagcctccgccggcggcgcccagggcgctgaggtcggcgccggcgcaaaacgccttgccggcgccggtgatcaccacggcgtgcacgtcggagtcggcctcgacccgctcgacggcctcgcgcaaccgccccgacatctcggcggtcaccgcgttgcgccggtcgggatcgttgacggtgatgagcgcgacgtggttctcgatgtcgagcaggacgagatttgactgggccatcgggcacctccggttcgggtgtgggctgcggtctcggctcgtcgccaggagtgacgcggcgacagggcgaggtaagggtactgctaggccttgccgggccccagcgcgagcagtcacctcgcccggtcccagcgcgagcagtcacaaaagcgccctgaagcccggcgtgtcgggtgcttttgcgtctgctcgcggggcgacgggcgggcggcccggtcgccccgtcacggcgcgccggcgcggtcaggcctcgggtttcgccaatttcttggccagctcatcgagttcggcctggcgttcgcgcaccgcacaggcccgggagtcgctgcgtgagccgtacgtcatcgtcggcggcagagcatcgttgcgcaatctggtgttggcgtaatggattgcggcatcgatcatttcgatgtagcgctcggcgtcgtgttcggcgcaggaaccctcgatgcgctggatctcgtcccaacacggatacgacgtgtaccgcgcgtcgagttgttgttgtgagacttgcgatccgaagtagcaacgccagtcgcggctcagccagcccctggtcttgacttcgactttaattcgattgccaactccggctatgaacctcggtttcccaacccggaccaccggctgccagtcactcgacgccatgtttcgccaacccctcgaagagaagacgctctaagtaatgatctccccgtgagcgtcatctgctcgtcttgacacgctgttcccagaatgctgaaaccgcaaacttttcacaacacttgatttttcggcgcaggtgcggtccgtttagcgtgcccgaaacgccatgaccggcggttcggcgtgcgttttccgcggtgcttgatcccggtcgtgaccgcgccggacccgacgagcgcggccctggtgtgccgttccggcgccgcggcgtccatagttgaagtggcgcaacgtgtttcggctgcggccgatcggctcagaggtgggccgccacgaaagtcgcggcctgggccggcatgccggactgtcggtaggacaggtgcgcgggggagaccatctcgtcgtgcgacggcagcgccagcggtccgccaggagtgcacaccggatcgccgggtgcgcacaagtcaatggatttggccccgtaccacgggctgaccacgctgaccggcgcgcccagataccggtcggacggattgccgaacaaggccagcgctgatacgtgctcggcctggtcggcgttcagcgtctgcggaatcaaccccgccaccggcgcctgggcgatggtgatcaggtcgatcaccatggcgccctgggaatatccgccgagcaccagcttggtgttggggcagtcggccaccatggactggacgtgagcgctggcgtcgccggcgccggcggatgccgaggcggcgaaatcgtcgtcggcggggtagttgaccggatacacgcccagcgaccgggcgccggcctggctgcgcagcgcctcgacgaatgcctgcccaaccccgcccaccccgggcggctcggcggtgccgcgggcgaacgtcacctcgatgtcggggcacggcgcggcggatgcgggtagcggcgcgcccagcagcgtcgccccggccgtcatcgccccggtgcccagcaaacccgcccatcggcgtgcgttcacccgcccatgctgacatatcgggagcgtggcgcgccgggaattcgccgccgcgatccaccctggtgccccgttgacccaggtccggcgtctcgccgctgggccgaagaacggggcgatgcgacgctgccctgctgacttccattgtggcacaacggttttagatgtgcgccggctgggcgcttggcgtgctgagttcggcggccgattcgcggcgctccgccaattgatggctaccggcaaagcggcttcgtattgtcgtctttgcagtgaatacaatactcgtcgtcttgattttgtgtttcgtgtatcgaatgacatccagggcactcctgaatgtatttgtggttcggattcaagcacggcgtcatcagcgcttgtttttgccggaatcggtttgctgaacttcgacttctactggctggcatcccgatcgattttcctgttcagtgcgtgagaagcggttcctgtgaccgcagccacaagcctttgcgcctgtcaaatttctgttccccgccgcgcccggttcaaacccccgcgtgccgggtgccgcgaaaataccgcacgccgcctgcgggcgcgacgccacgggtccacttacccgcgcgcgcgaaaatggcgtagtcggctactctagacgactcgttccgcagcgccggagacttttagagtccctgtcccctctcgcggaaggttctgctcatgaccatccttgctaccaccctcgtccatcccaaccccggggtcgcgtgggacgacatccaaaagcaactcaagcgcgccagcgggcttgcccgcaaacacggcgcggagaacgtcacggtgctggtcaacatggtcggaggccagggcaccaactccatcggcttcctgaccaccgccaaggactgggccacctacggccagatccagcagagcctcagcagtgacccggattaccagggcctgctcgtggactcggcacagatcgccacctgggagaactacgtcagccagacgatcgaggtctagccacccgctgtcacgtcgtcgctgacaagcgtcggcatgctcctgtcatcgaccgcctaggtagtcctcgcgactacctaggcgacaggggccgtcccgccaccgggcaatcgctcgccaccgaggggttggcgcgacgcccggtcgcggaggccaaggtcatacgcctggctcggtgccccctgttcagagtcggttgatcggtgacatttctatgtcggttgatcggtgacactctgggttgtgttttaggccggtgcgttggtgcgcagggcctgtttgtttcgtacctcgccgcggctggtgcgcgcggcggttttgaccagattgtcgccgacccaaaacctcagcaggtccccatcgacgtggacatcgcagcgggcgccggcatagtggcgcccgatacagacctgctgccaggacacgcacacgatgccgttggagcacacccgccgactcacccagtcatcaccactgcggtcgacgtgtcgggcacacgagttcgacggtggtgatgccggcgcaccggcgtgaaaccgttgagccggtgtgatcatctttagggcttggtgcggccgggtggtgttgtagtcctcgacccactcatcgagcgcctgctgagcgaccttgaggttggtgaaaggctcacggccgctaaggaactcagcgcgcagactgcggtgaaactgctcgattttgccggtcgtggtcgggctgcgcggctgggtcaacagatgttcgatgccgtgctcgcggcagatcgcatcaaagagcacctcgaccggtggatgacaaaaccgctcggtgaacaccttgccgttatcggtcaagatctgctcaggcaccccgtaagcggccagcgccgcccgtaatccgtcgcagaccgcgcgggtgcgctcacgggccatcagcttggcgcacacacacatccgggaatgatcatcgatgccggtcagggctttggcgctggtgccatcggccagcgggaacccgccgacgatgtcgagctgccacaactccatcggcgccccgcgctcccagcgcttccatttgcgcgaccgtcgatctcgcatcgcggggtcgatcagaccggcccgcaccagcgctcgatacaccgccgactccgacggcaccggatggacacctcgcttggccaactcgaacaccaaccgccgcggcccccaatagggccgcgagcggcgcaactccaacaccgccgcctccactaccgccagcatctgatgcggacaactcaccggccgatgcgaccgatccaccagcccctccaggcccgcggcttcataccgggccagccatcggtgcagcgtctgacgcgccaccccgaacttctctgcggcctgcgacaccgacaacccgtcactgattaccgccatcacggcctgataccgctgctcagccacacttaactccctcatctagggagtgtcaccgatcagccgaaacaactgtcacgcatcaaccgaaacaccgtcacacatcaaccgaagacaaaacgtcacacatcaaccgacgtcatacaacgggctcggtgcccccggcacgactcgaacgtgcgacctagggattagaaggcccttgctctatccacctgagctacggaggcaatacgcaggtcagtctatccaaccgcgcgcagctacccgattagcccgcgccacgcgcctgaaaagccttcccgcgccgtgggtatcggttatcgtgtggacctcgacacacgttcatcatcggtcggcaacgggccgttaaccgaacgaggcgtgtgcatgacgtcgaggggtgacgtggcaatgagcgtggccggcgatctcacttcgcgctgctcctgggccggcgcccaggcggcccgcctggcggccgaggcccgggacgtctatcagctcggcaatctggtgctgcgcggcgggccgttcgcgctgggctgtttcgccggttggcttttcacggagtttccgccgcacgtgctcaccggacacgcgctgtcgcgggtctcgcatccctccatcggccgggtgggcaaaacactggccacgcagcgcgccgatcacaccctgaccgcggcgctgcaggagtcgctcggccccgatttccgggaccaggtatgccacccgaccagcgtggcgtcggtgtgcgcccggcggggtggcctgctggggcggccggggccgcaccgccgctacgcggcgcagacttccgacatctcctacggtccgggcgggcgcgacaacctgctggacatctggcggcgcgacgacctggcgcccggctgccgcgcaccggtgctgatccaggtgcccggcggcgcgtgggcgctcaacggccggcgcccgcaggcctacacgttgatgagccggatggtgctgctcggctggatctgcgtctcgatcgactacagcaagagtccgcgcagcaccttcccggcgcacctgatcgacgtcaaacgggcgatcgcctgggtgcgggagaacatcgccgactacggcggggaccccgacttcatcgcgatcaccggcggttcggccggcgggcacctggcctcgctggccgcgctcacccccaacgacccggcctttcagcccggcttcgaaaacgccgacaccgccgtgcaggccgtcgcgccctattacggcgtctacgacttcaccgacttcgagaacatgcacccgctgatggtcccgttcctcgagcagttcgtgctcaaggcccgctacgccgacgacccgcagcggttcgccgccgcctcgccgatctcctacgtgcacgccgacgcgccgccgttcttcgtgttgcacggccagaaggacgaattggtgcccagtggccaggcccgggcgttctgcgcggcgctgcgcgcggccggcgcccgcacggtgggccacgccgaactgagcaacgcgcaccacgccttcgacatcacccccaccgtccggtcccggctggccgccgacgccgtcgccgatttcctgggcgtggtctacgggcggcgcgtcagctcgctggtggattcgctgccgctgtcggcgacttccgccagttgaacgccggctgagccgcagtcgagcgccggttgagccacagtcttcgccgcttctttcaccagcgcggcaacccgactagcgttgtggagaccaccgcggcggacgggcgcaaggcaggaggcttgatcgacggtgacaaggttggcgcgtcgagctgatgaccatgactgagtccgtcgagacgatcaaattgtccgacgagctcgggccggtcgactacctcatgcatcggggcgaggcgaatccccgaacccggtcgggcatcatggcgctggagctcctcgacaccaccccggactggcagcagttccgggcgcgattcgaaaacgcctcccggcgggtgctgcggcttcggcagaaggtggtggtgccgaccctgcccaccgccgcgccgcgctgggtcatcgatcccgacttcaacctcgatttccacgtgcgccgggtgcgggtcgccgaacccggcacgctgcgtgaggtattcgacctcgccgagctcatcctgcagtcgccgatggacatctcccggccgctgtggacggccaccctggtcgacggtctggccgacgggaaagccgcgacgctgctgcacgtcagccacgccgtcaccgacggtgtcggcggggtccagatgttcgccgaaatctatgacctggaacgcaatccaccgcccaagccgccgccgccgctgcccgtcccgcaagacctgtcgcccaatgacctgatgcggcaaggcattaaccacctgccgttcgcggtggtgggcggtgtcgtgagcgcgctgtccggggcggtgtcggtggccggtcgggcggtgctggagccggcgtccaccgtgtcggggatcgtcgggtacgccatgtcgggcatgcgggtgctcaaccgggccgccgagccgtcgccgctgctgcgccggcgcagcctggccacccgcagcgaagcgatcgacatcccgctcgccgacctgcacaaggccgccaaggccggcggcggatcgatcaacgacgcctacctcgccgggctgtgcggcgccttgcggcgctaccacgaggtgttcggggtgccgatcagcacgctgccgatggcggtgccggtcaacctgcgcgccgaggccgacaccgtcggcggcaaccggttcaccggggtcaacctggccgcgccgatcggcaccgtcgacccggtctcccggatgaagaagatccgcgcccagatgacccagcgccgcgacgagcccgcgatgaacatcatcggctcgctggcgccggtgctcagcgtgttgcccaccgcggtgctggaagggatcaccggctcggtgatcggctccgacgtgcaggccagcaacgttcccgtcttccccggagacacctacatcgccggtgcaaaggtgttgcgccagtacgggatcggaccgctgcccggggtggcgatgatggtggtgctgatctcccggggcgggtggtgcaccatcacggtgcgctacgaccgggcctcggtgcgcgacgaggcgttgttcgcccagtgcctgctggagggtttcgacgagatcctggccctggccggtgacggcgcgccgcgcgcggtgcccgcctcgttcacggagtccgccgtgtcggcgcgatcggccagcggctcatgagcgattcgcgtcagctgtcaccgcagcgcggcaccgaggattccgggccgcgggagaccgacatgcggctgccgggctcggtcgccgagatcatggcgagtccccccgggcccaggatcggcgcgttcttcgacctggacggcaccctggtcgccgggttcaccgcggtgatcctgacgcaggagcggctgctgcgccgcgacatgggggtgggggagctgctgggcatggtgcaggccggcctcagccacaccctgggccgtatcgagttcgaggacctgatcggcaaggccgcggcggccctggccggacggctgatcgacgacctggaagagatcggcgagcggatgttcgtccagcggatcgaatcccggatctacccggagatgcgcgagctggtgcgcgcccacatggcgcgcggccacaccgtggtgctcagctcgtcggcgctgaccatccaggtgaacccggttgcgcggttcctcggcatccccaacaccctcaccaacaaattcgagaccaccgaagacggcatcctgaccggcggtctgcaaaagccgattctgtggggaccgggcaaagccgctgcggtgcaacgctttgcggccgagcacgacatcgatctcaaagagagctacttctacgccgacggtgacgaggacgtcgccctgatgtatctggtcggcaatccgcggccgaccaatcccgagggcaagatggccgccgtcgccaagcgccgcggttggccgatcctgcggttcagcagccgcggcccggtgggtctgcggcggcagttgcgcaccctcgccggattcgggtcgatgttcccggtcgcggccggtgcggtgggcgtcggtgtgctgacccgcaaccggcgccgcggcgtcaacttcttcacctccacgttctcccagttgtcgctggccatcgccggggtgcatctcaacgtcatcggcaaggagaacctgaccgcccaacgccccgcggtcttcatcttcaaccaccgcaaccaggtcgacccggtgatcgccggggcgctggtgcgcgacaactgggttgcggtgggcaagaaggaactcgagaaggacccggtgatgggcacgctgggcaagttgctggacggcgtgttcatcgaccgcgacgaccccgccgccgcggtggagacgctgcacacggtcgaagaccgggcccgcaacggcctgtcgatcctgattgcccccgagggcacccgggtcgacaccaccgaggtcggcccattcaagaaggggcccttcaggattgcgatggccgccgggatcccgatcgtgccgatcgtgatccgcaacgccgaactcgtcgccgcccggaactcgaccgtcatcaaccccggcaccgtcgacgtggccgtctttccgccgatctcggtgcaggactggacacttgacacgctgccggagcgcatcgccgaggtgcgccagctctatctggacaccctggccaactggccggtcggcgaactgcccgaggtcgacctgtacgcggagaagaaagcggcgcaaaaggcgcgcggccgggccgccaaaagccccgcgacaagccctgccaaaccccccgccaagagccccgcgaaacgccccgccaagaaatcggcggcgaagaagaccgcggccacctcggcggccaagacgcgcgcgaaaaagactgtggtcgaaccgaagtcgcgcaccaccccggccgcaccgaacccggaagtcgccgcgtcgcacaacggggaagtgagcccctcccgcgcggccgacccgatcggcgccgaaccacccgaagcgccgccccgagggcgtccgtgaccgaaccggcggcagacgccagcgcgctgctcaccgaacaagactcgctggtgttggcgtccatggcctctgcggtcgaggtggacctggtcaccgtctggctggagcagcagcgcgccggccacccgggtgcgcaattcgagctggtcaaactgcccgcgctggacgcgccgccggcggagatgaccgcgctggccgagcggctcgaggccggcgacgaccgctcggtggtgccggtgcgggtgttctggctgccgccaccggatcgcgggcgaatcgccaagctggccgggctggttcccggccgtgacccctaccaccccaaccagcgtctgcaagcacagatcctgcgccgcgccccgcagcgggcccgggtggtggccggtgaggcggccaccgtctccgaactgcgccgccagtggcgcgacaccaccgtcggcgacgaccagcgcgacttcgcccaattcgtcatccgccgcgccatcttggcgatggagcgggtcgaataccggatactgggaccgcaatacaagtcgccgcggctggtgaagccggagatcttggcgtccaacaggtttcgagccgggctggccaagatcccgggcgccaccgtcgaggaagccgggaagatgctcgacgagctcgccaccgggtggagccgggcatcggtcgatttggtctcggtgctcggccggttgatcagccgcggcttcgaccgcgagatcgactacgacgaataccaggtggcggcgatgcgcaccgccctggaagcccaccccgcggtgctgctgttctcgcaccggtcctacatcgacggcgcggtggtgccggtggccatgcaggagaaccggttaccgccggtgcacgtcttcgccggcatcaacctgtcgttcggggcgatggggccgctgctgcggcgctccggtgtcatcttcatccgccgcaacatcggcaacgaccagctctacaagtacgtcctgcgagaatacgtcggctacatcgtcgagaagcggttcaacctgagctggtccatcgagggcacccgctcgcgcaccggcaagatgctgccgcccaaactcggcctgctgtcctacgttgccgacgcctacctggatggccgcagcgaagacattctgctgcaaccggtttcgatcagcttcgatcagctgcacgagaccgcggagtacgccgcctacgcccgcggtggtgagaagacgcccgaaggcgtgggctggctgtacaacttcatccgggcgcagggcgaacgcaactacggcaagatctacgtccgattccccgaggccgtgtcgatgcgccaatacctgggtgcgccgcacggcccgctggcgcaggaccccgacgccaaacgccttgcgctgcagaagatgtccttcgaagtcgcctggcggatcctgcaggcgacgccggtgacggcgaccgggctggtgtgcgcgctgctgctgaccacccgcggcgcggcgttgaccctgcgccaactgcatcacaccctgcaggactcgctggattacctggaacgcaaacagaatccgatgtcgaccagtgccctgcggctgcgctcgccggacggtgtgcgggcggcggtggacgcgctgtccaacgggcaccccgtcactcggatcgacggcggccgggagccggtgtggcagatcacgcccgaacaccagcacgccgcggcgttctaccgcaactcggtgatccatgcctttctggagacctccatcgtcgaactggcgctggcacacgccaagcacgtcgacggcgaccgcatgcaggccttctgggaccaggcgatgcggctgcgcgatctgctcaagttcgacttctacttcgcggactcggcgacgttccgggacaacatcgccgaagagatggcctggcacgacaattgggaggaccacgtcgccgccggcggcgacgagatcgacgcgctgctgttcgccaagcggccgctgatggccgaagcgatgctgcgggtgttcttcgaggcctacgagatcgtcgccgacgtgctgcgcgacgccccggcggacatcgggaacaaggaactgacgcggctggccctgggggtgggccggcagtatgtggcacaaacccggatccgcagcagcgaatcggtgtcgaccctgctgttcgccaccgcgcgtcaggtcgtcgaggaccaggacctgatagcggccgcgcctgacctggccgaacgacgggacgcgttcctgcgcgagctgcgcgccatcctgcgggacttcgactacgtcggccgcgtcgcgcgcgagcagttcgtggcccgggaggccaaggcgcgccgggagagcctggacagtcgaccgggatagccgaccgccccgccaataccctggggggatgaccgtcgccccgccggccggcaccgcctcgaccgaggcggtcccgcagcaccgcacgctggtgtggccggtgctggccggcgtcgccgtgctggccggctgcacggccgcagggatcggcacgctgtcgctggcgagcgcgttgaccgcgaccgggctgcccgacccgggcccggtgaccaccgtgggattgcccttcctgcgcgcggccggcgagatcgccgcggtgctcgcggtcggctccttcctgttcgccgccttcctggtgccgccgcaacccagcggtgtgctcgacgccgacggctaccgggcgctgcgactgggcaccgtcgcgtccggggtgtgggcggtgtgcgccgccctgctggtcccgctcaccctgtcggacgtgtccggtcaccccgtcgccgacctgcgccccgcccagatgtggtcgctggccggtctcatcaccaccgcctcggcctggcgctggacggccatcctggccgcggccatcacgctggccagcctgccggtgctgcgctggtcgtgggccccggtgctgctggccgcgtcgctgacgacgctgatcccgctcggcctgaccgggcattcgtccgccggcggctcccacgacctggccaccaacggcctgctgatccacctggtcgccgccgccctgtgggccggcggcttgctggccctgctggcctatgcgctgcgcggcggtcagggcggcgatcacctgggcctggcgacgcggcgcttctcggccatcgcgctgtggtgttgggtcgcgatggcgctgagcggactggtcaacgccgcggtgcgggtccagccgagcgacctgctggccaccggctacggccggctggtgctggccaaagccgcggcgctgtgcctgctgggcggcgtgggttggcgtcagcggcgggtgaatgtggcggcgctgcaagcggtttcgactctcgcgcgggcgcgccgcgcgctgctgcggctgaccctgatcgaggccgcgctgttcggcctgaccttcggcatcgccgtcgggctgggccgcaccgcgcccccatcgccgccggcccggttgccctcgatcgccgaggccgagatcggctacgacttcgacggaccgccgacgctgacgcgcatcctgttcgactggcgcttcgacctgatcttcggcaccgccgccatcgtcctggccgggctgtatgtcgccggtgtggtgcggctgcgccgccgcggcgaccgctggccaccgggccgcacgtcgtcctggctgctcggctgcctggtgttgctgttcgtcacgtcgtcgggggtcggccgctacatgccggccatgttcagcatgcacatggtggtgcacatgtgcctgtccatgctggtgccgatcctgctggcgctgggcgccccggtcaccctggcgttacgcgcgctgcccgccgccggccgcggcgatccgccgggaccgcgcgaatggctgttggccgcgctgcacagccggttctcccggttgctcaccaaccccgtggtggccaccgtgctgttcgtggccggtttctacgggctgtatctgtccaacctgttcgacaccaccgcgagcagtcatgccgggcacctgctgatgaacctgcacttcctgctcagcggctacctcttctactgggtggtgatcggggtggacccgacgccgcggccgatcccgccgctggccaagctggccgtcgtgttcgcctcgctgccgctgcacgccttcttcggggtggtgctgatgggcacccggaaggtgctgggcgccgactactaccgctcgctgggcttcagctggcacaccgatctgctcggcgatcaacggctgggcggcggcatcgcctggtcggcgggcgaattcccgctggtgatcgtcatgctggcgctgctggtgcagtgggcgcgcagcgaccggcgcaccgccaagcggctggaccgggccgccgaccgcgacgacgacgccgaactggcggcctacaacgcgatgctcgcccagctcgccgggcgggacaagccgggcgaagggtccgcgaccggtcaggcgtagtgataccggacctgcaggatctgcaggtcgtgaactcgccgatccatccacagtcgccgttccttccacaggttcgcggcccgggacgcgtcgggccctcgcctcgtcggtgccgccgggcttactggcggccatgagaacggtgacgcgctcaggagcccgtcgccacgccagagaaacaccaggaagggatcagcccatgttcgaaaccccgctgaccgtggtcggccacatcgtcaacaaccccgaacgacgccaggtcggcgcccaggaggtcatcaagtttcgcgtcgcgagcaattcgcgccgccgcaccgccgacggcggctgggagccgggcaactcgctgttcatcaacgtcaattgctggggccggctggtcaccggggtgggcgccgcgctgggcaagggcgcaccggtgatcgtggtgggccacgtctacaccagcgaatacgaggaccgcgacggcaaccgtcgctcgtcgctggagatgcgggcaacctccgtcgggcccgatgtgtcccgcgcgatcgtgcgcatcgagaagcccggctacaccggtcccagcaccgacgaggccaccccggccgcggcggaggcggccgacgccgctggtgaggacgccgatcgcggcgacaccgtcgagcccgtcgacacgggcccggtgccactgtccgcttagctgcgggatccgcccaccgcgcgatgcctaggatggtccgcgagatcactcgctaaatcagaaaggcacaaccgcggcatggctgagttcatctacacgatgaagaaggtccgcaaggcgcacggcgacaaggtgatcctggacgacgtcacgttgagcttctatccaggcgccaagatcggtgtcgtcggccccaacggcgccggtaagtcgagcgtcttgcggatcatggcgggcctggacaagccgaacaacggtgaagccttcctggccaccgacgccaccgtcggcatcctgcaacaggagccgccgctgaacgaggagaaaaccgttcgcggcaacgtcgaggagggcctgggcgagatcaaggtcaagctcgaccgcttcaacgaggtcgccgagttgatggccaccgactactccgacgagttgatggaggagatgggccggctgcaggaggagctcgaccacgccgacgcctgggacctcgattcgcagctcgagcaggcgatggacgcgctgcgttgcccgccgcccgacgacccggtgacgaacctgtccggtggcgaacgccgccgggtggcgctgtgcaagctgctgctgtccaagcccgacctgctgttgctggacgagcccaccaaccacctggacgccgaaagcgtgcagtggctcgaacagcacctggcggcctacgcgggcgcggtgctggcggtcacccacgaccgctacttcctggacaacgtcgcgcaatggattctcgaactcgaccgcggccgcgcctacccctacgagggcaactattcgacctatctggagaagaaggccgaccgcctggcggtgcagggccgcaaggacgccaagctgcagaagcggctgagcgaggagctggcctgggtgcgttccggggccaaggcgcgtcaggccaagagcaaggcccgcctgcagcgctacgaggagatggcggccgaggcggagaagacgcgcaagctcgacttcgaggagatccagataccggtcgggccccggctgggcaacgtggtggtcgaggtcgaacacctggacaagggctacgacgggcgcaccctgatcaaggacctgtccttcaccctgccgcgcaacggcatcgtcggcgtcatcggccccaacggggtcggcaagaccacgctgttcaagaccatcgtcgggctggaacaacccgacagcggcaccgtcaaggtcggcgaaacggtcaagctcagctacgtcgaccaggcccgcgccgggatcgacccgaaaaagacggtgtgggaggtcgtctcggacgggctggactacatcgaggtcggccagaacgaagtgccgtcgcgcgcctacgtgtcggcgttcgggttcaaggggccggatcagcagaagccggccggcgtgctgtccggcggcgaacgcaaccggctcaacctggcgctcaccctcaagcagggcggcaacctgatcctgctggacgagccgaccaacgacctggacgtcgagaccctgggctcgctggagaacgcgctggtgaatttcccgggctgcgcggtggtcatctcgcacgaccgctggttcctggaccgcacctgcacgcacatcctggcctgggagggtgacgacgacaacgaggccaagtggttctggttcgagggcaacttcggagcgtacgaggagaacaagatcgaacggctcggcgccgaagcggcccggccgcaccgagtgacccaccggaagctgacgcgcgactagtgtcagctctgccccgcgccgtcgagaagcggggtattcgagcgcattgacaaccgtcggcagttgggagcaatcggcatgacgatcgatcccagagctcagcaggatctcaagccgtggacgaccttcacccgacagcaggacatccccgagtggatctcgaaagcctatgtggagagctatcgcggtccgcatagcgacgaatccgggggcgccgaggccgggcccatcgacctgacggtcccgacggcgctcgtcaccccggccatgctcagcgcgcactaccggctcgggctgcatcgccccgacggcgaaagccgggtcgccgtctacccggccgacgatcccgccgggttcgggccggcgctgcaggtcgtcaccgaccacggcggcatgctgatggactcggtcacggtgctgctgcaccgcctcggcgtgccctacacggccatcatgacgccggtgttcgacgtgcaccgcagtcccgacggcgacctgctcagcctcgaacccaagccgcagggcgccccgcaatacgccggcgaggcctggatccacgtgcagctgctgccgtccgtcgacagcaagggcctcaccgaggcggagcggctgctgcccaaggtgctggccgacgtccagcaggtggccagcgacgcctcggccctgatcgccgtgctcgacgagctggccgccgcggtggaagccaaccgcgacaaccatttttcggcgccggaccgcgacgacgtggccgcgctgctgcgctggctgggcaacggcaatttcctgctgctgggttatcagcgctgccgggtgcacgacggcctggtctccggcgacggctcaccggggttgggcgtgctgcgcacccgcaccgggtcacggccccggctcaccgacgacgaccggctgctggtgttggcgcaatccgtggtgggcagctacctgcgctacggcgcctacccgtatgcgatcgcggtccgcgagtacgtcgacgccgcggtgatcgagcaccgcttcgtcgggctgttcaccgttgccgccatgaacgccgacgtgctggagattcccaccatctcccgccgcgtccgcgaggcgctggccatggccgacagcgacccgatccatcccggccagctgctgctcgacgtcatccaaaccgtgccccgctcggaactgttcacgctgagctccgagcggctgctggcgatggccaaagcggtggtggacctcgggccgcaacgaaacgcgttgctgttcctgcgcgccgacagcctgcagtacttcgtctcctgcctggtctacctgccccgcgaccgctacacgaccgcggtgcggctgcagatcgaagacatcctggtccgcgaattcggcggcacccgactggaattcaccgcccgggtcagcgaatcaccttgggcgctcatgcatttcatggttcgcctgcccaccgacgatcccgccgccaagcccgtggacgtctccgaggacaaccgggtccgcatccagggcctgctgagcgaagcggcccgcacctggaccgaccggctggtcgcggccgccgccgagggcgcggtggggcacgccgacgcggagtactacgcggacgctttccccgaggtctacaagcaagccatcagcccggccgatgcgatcggtcacatcgccatcatcaaagagctgcaagacaattcggtcaagctggtgttcaccgagggcgaggacggatcggcgcagctgacctggttcctgggcgggcgcaccgcctcgctgagccagctgctgccgatgctgcaaagcatgggtgtggtggtgctcgaagagcggccgttcaccgtcacccgctccgacgggctgccggtgtggatctaccagttcaggatctcaccgcacccgaccatcgagctggcgtccaccccggacgagcgcgacgcgatggccgagcgattcgccgacgccgtcaccgcgatctggcagggccgcctcgaggtcgaccgcttcaacgaactggtgatgcgcgccggcctgcgctggcagcaggtggtgctgctgcgcgcctacgcaaagtacttgcgccaggccaactttccctacagccagtcctacatcgaggcggtgctcaacgagcatccgtccaccgcccgctccttggtggcgctgttcgaggcgctgttcgacccccaccccgactcctcggcgggtcgcgacgcgcaggcggccgccgcggcggtggccgccgacatcgacgcgctggtcagcctggacactgaccgcatcctgcgggcgttcgcgtcgctggtgcaggccacgctgcggaccaattactttgtcacccgcgagggttcggcccgtgcgcgcaacgtgttggcgatcaagctggacgcccagctgatcgacgagctgcccctgccgcgccccaagtacgagatcttcgtctactcgccccgggtcgagggcgtgcacctacggttcgggccggtggcccgcggcgggctgcgctggtcggaccgccgcgacgacttccgcaccgaaatcctgggcctggtcaaggcgcaagccgtcaagaacgccgtcatcgtgccggtcggggccaagggcggcttcgtcgtcaagcggccgccgctgcccagcggggacggcgccgccgaccgcgacgccacccgcgccgagggggtggcctgctatcagctgttcatctcgggcctgctcgacgtcaccgacaatgtcgaccacgcgaccggaaaggtcagcccgccaccggaagtggtgcgccgcgacggcgacgacgcctacctggtggtggcggccgacaagggcaccgccaccttctccgacatcgccaacgacgtcgccaagtcctacggattctggctgggtgacgcgttcgcctccggcgggtcggtcggctacgaccacaaggccatgggcatcaccgcccggggcgcctgggaggcggtcaaacggcacttccgggagatgggcgtcgacacccagaccgaggacttcaccgtggtgggaatcggcgacatgagcggcgacgtgttcggcaacggcatgctgctgtccaagcacatccggctgctggccgccttcgaccaccgacacatcttcctcgacccgaaccccgacgccgcggcgtcctgggaggaacgccgccgcatgttcgagctgccccggtccagctgggatgactacgacaagtccctgatcagcgagggcggcggggtgtatagccgcgagcacaaatccattccggtcagcccccaggtccgcgacgcgctgggcttggacggctcaggcggcgacgtcaccgagatgactccgcccaacctgatcaaggcgatcctgcaggcgccggtggacctgctgttcaacggcggcatcggcacctacatcaaggccgagtccgagtcggacgccgacgtcggcgaccgcgccaacgatccggtgcgggtcaacggatcctcggtgcgcgccaaggtgatcggcgaaggcggcaacctcggggtgacggcgctgggccgcgtcgagttcgacctgtccggcggccggatcaacaccgacgcgatggacaactccgccggcgtggactgctccgaccacgaggtcaacatcaagatcctgatcgactcgctggtcaccgcgggcaaggtcaagccgcaggagcgcaaaccgctgctggagtcgatgaccgacgaggtcgccgcgctggtgctcaccgacaacgaggaccagaacgacctgatcggcaccagccgggccaacgcgcccagcctgctgccggtgcacgcccggcagatccagtacctggtcgacgagcgcggcctcaaccgcgagctggaagcgctgccgtcggagaaggagattcagcgccgcgccgaggccgggatcggcctcacctcacccgaactgtgcacgctgatggcgcacgtgaaactggacctcaaagaacagatgctgcagaccgagctcaccgagcaggatgtgttcgcgtcccggttgccgctgtacttcccgacgccgctgcggcaccggttcaccccggagatccgcgcgcatcagctgcgccgcgagatcgtggccaccatgctgatcaacgagctggtggacgccgccggcatcagctacgccttccggatcgtcgaggacgtcggcgtatcggcggtggacgcggtgcgcacctacgtcgccaccgatgccatcttcggtgtgggggagatctggcgccgcatccgcgccgcgaatctgcctgtggcgctgtcggatcggctcaccctggatacccggcggctgatcgaccgggccggccgctggctgctcaactaccgtccccagccgttggcggtgggcgccgagatcaaccgattcgccgccaaggtcaaggcgctgacaccgcgcatgtcggaatggctgcgcggggacgacaaggccatcgtcgaaaaggaagccgccgagttcgagtcccagggcgccccccgtgacctggcctacctggtggccgccgggctctaccggttcagcctgctcgacatcatcgacatcggcgacatcaacgacatcgacgccgccgaggtcgccgacacctatttcgccctgatggaccggctcggcaccgacggcctgctgaccgcggtgtccgagctgccgcgcaacgaccggtggcactctttggcgcgcttggcgattcgcgacgacatctacgcctcgctgcgctcgctgtgcttcgacgtgctggcggtgggcgagcccgacgagagcggcgaagagaagatcgccgagtgggaacacctgtccgcctcccggggtcgagcgggcccgccgcacactgatcgagatccaggaaagcggggccaaggatctcgcgacgctgtccgtcgccgcgcgacaaatccgtcgcatgacccgcaccagcggaagaggttcatcgagttgagcgtcggattcgtcgcggccgtgccagtgcgctggtcggatatcgacatgtaccagcacgtcaaccacgccaccatggtcaccatcctggaggaggcgcggggttcagttcctgcgggaggcgttcgaggtcgacatcctgaccatcgggctgctcatcgccgaggtcaaggtgacctacaaaggccaactgcggcttgtggattcgccgctgcaggtgaccatgtggaccaagcggctgcgggcggtcgacttcacgctgggctacgaggtgcgctcggtcaacgccgaccccgagtcccggccggccgtcatcgccgaatcgcaactggccgccgtgcacatcgaagaggagcggctggtgcggctcacaccgcaacatcgagagtatctgcagcggtggattcggtagccgagcgcgggctgtggctggacgcccagtcacgggccgcccaccgcgccgacctggccgcgttcgtcgaccgcgcgctgcggctcgacgacgccgcgatcatccgtctgcgcacccgctccccggggcttctcaccgcctgggtggcaacgggtttcgacgtcctggccagcagggtggtggccggcgaggtgcggcccgcggatctgtcggtcggggcggacgcgctcgcgcgcggcctggccgcgatggacgactcgggctacgtcgatccgggcttcgcgatggactccgcgtggcgcggggcgctgccgccggaatccggcttcacccacctcgaggacatacccgcccgggtgatgctcgacctggcccagcagggcgcgcgacttgccaagcagcacagcagttctcacggcccaccggtttccctgctggatcaggaggtcatccaggtgagctccggcgacgtagaggtgggcttgccgatgcggtgcgtgttcgcgttgaccgccatgggttttctgccccaatcgcccgacgcggtcgacgccggcgagttgatccgggtgcgcatcctgccgacctggttgcggctggacgcgcggttcggttcggtgtaccggcgccgcggcgatcccgggctgctgctgggctgagcggcgcggagccggcgccggaaaacggatcaggctgagtttaatgccgaccgacctgcggtcgcgcggatcaggggccgtagcgcagccacagcggcagcaccgcgtccaggtagtccatgaacttcttcagccccacccggaattgcccatagccgtacgggtcttcggcgtactgggggaacgcgatgcccaccccgaacaggccgggagcaagtatcccggtggtcgggttgtagtccagccggccccattgcggcgtctcgggcaacgttctgcgctcgaagccgacggtgtagaccacccggtcgcagcgtgccagattctcggcgaactccgggctggacaccagacaccggtgcagccgttccggcagcaccccgtcgatgttctcccgcgcccacaccgcggcctggcccttcaggccggtgtcgtcgaagagaatccaatcatcgaagtagacagcgtatttcagcgggctccggtagaagttgatcaccttttcgaccggctggcgcagcaggttgggcagcacgatcatcgacgagtgcgatgaaccgaacacgcccaccgtcgccccggaaagcgattggcgcgcgagcttttcgggatccagcgcgacttccaccggaatctcctccaggccggggtggcaaagctttttgggcaccgccccgacggccaggatcacgttccgggagaagatctcgcgctgctcggtctcgatccgccaccgccggtccgacaggtacagcgcggtggcggtggtggtgacggtgtcgacccgctcgcgcagctgcccggtgacccacagcaggggttcggccaccagcgccagcgcgcaggtttcgccggcgtcgatttcccgcagcggcatgggcggtgcctcggagaaccgaaatgacttgcagccgttgaaatattcgagaaacagcccggcgtgcgtgttgctggacaccgatcgccacttctggccgatgtctccggcggcgaaggcggggtcgatccaggcgatgctgtccgccccgtgatcgagcagccggcccaccgccgcgatgcccgccgggccggcgccgatcactgtccactcgtagcaagccatgggtcaacatatagagcagcgggcggcgaaacgctcgccccggtcgcgccgctaggccagccaggccgccgcgtccgggggcagcttcccgtccagcagcggcgcgctcgccagcaccagttcgcccggcggcagcggcacgggctgctcgccgctgttgagggcgcacaccagcccgccgggacgccggaacgtcaccgcatcggcggtcgcctccagccaattcgacgccgtcgccgtcgaattccacacggcgccttcgcaattcgagggcccgccggaagaacgacaacgtcgagtcggggtcgtcgcgctgcttttgcacggtcagcgccgcccactccttcggcatcggcagccaggtgtcggtgcgcgaggagaacccgaacgggggagcctggcccgaccagggcatcggcacccggcatttgtcccggccccgctcggtgtgtcccgagcgctcccaggtggggtcctgcaacacctcgtcgggcaactcgacgtcgggcaggcccagctcctcgccgttgtagatgaacaccgcgccgggcagggcgagcatcaccatcgccatcgcacgggcccggcgcagcccgacctcgccgccgccgtagcgggtgacctcccggccgacgtcgtggttggacagcgtccaggtcggggtggcctcctgcagggcggtggcggccagcgagttctggatcgcgtcgtggatctggacggcgtcgaagtcgatcttggtcagccggaagttgaaccccagatgcagttcgtcgggccgcaggtactccgcccagcgggcgttgtcggtgacccacacctcgccgacggtcaccgcgccggggtagtcgttgaccaccttgcggatgtcgcggtggatgtcgtgcacgctcgggtggttgaagcgcgggtcgtcgtcgctgtggtgcaacaccttggactcgaggtccggcgaatccggcaggccggccggtttggccatgccgtgcgccacgtcgatgcggaagccgtccacgccgcgctccagccagaaccgcagcgtcttctcgaagtcgtcgaagacgtccgggtgctcccagttcaggtcgggctgctcggtgtcgaacaggtgcagataccactggccgggattgccgtcgggttcgagcacccgggtccaggccgacccgccgaacaccgaggtccagttgttcggcggcagctcgccgtccgcgccgcggccgtcccggaagaagtagcgctgccgggcgtcggaacccggtccggcggccagcgccgcctggaaccacggatgcgccgagctggtgtggttgggcaccacgtccatggtgatcttgatgccccgccggtgcgccgcggcgatcagccgttcgatcgcggccatcccgccgaacagcgggtcgatgtcgcgcgggtcggcgacgtcgtagccgtggtcggccatcggggagacggtgaccggattgagccagatcgcgtcgacccccagttgctcgaggtggtccagatgcgccgtcaccccgtcgatgtcgcccacgccgtcgccgtcgctgtcggcgaacgacctcggatacacctgatagaacaccgcgctcgaccaccacggcttggattgcattgcaccccgctcggtttcgtgggctgacatcacttcgtgggctgacatcacaacggagaattcaccagcgagtgcgcggccatctccagatagtcgagcagctcgcgacggtgctcgtcgtccagagtcttcgagtcgatcgacgccaccgccgtgtgcatgcagcgcagccaggcgtcgcgggccaggggagtgatccggaacggcacgtgacgcatccgcagccgcggatgcccgcgccggtcggagtaggtgcgcgggccgccccaatactgctcgaggaacatccgcagccgttcctcggcgccctcgaggtcatcgagcggatacagctcgcgcaggatctcgtcctcgggcacctgggcgtaaaaccgcgacacgatcgcctgaaacgtctcggcaccgccgaccgcgtcgtagaagctcacctgatccatcgccgtccattgtggtgcatccgcgccgtcacgcaccggagcggcccgagcccactccggctgttcaccggatcgacacggcgttcacctgcaataggcgtgcgattggcggcgaatcatggtggactgttcgcggaggatctatggcgcagggcaagaagcgccgccgccaccgcagccaggtggccgcggcagggttgaccgggcccccgaccgcgtcctcactgcacagtgttgaaacccacccgcccacccgcccggacagcacgtccatctggagtcgccggcgggtgctgctgctgaattccacctacgagccgctgaccgcgctgccgatgcggcgcgccatcgtcatggtgatctgcggaaaggccgacgtggtgcatcacgatccggcgggcccggtcatccactcggcgaccagctcgatcgtgatgccgtcggtgatccagctgcgcagctacgtccgggtgccctaccgggcgcgggtcccgatgacccgcgccgcgctgatgcaccgcgaccggttctgctgcgcctactgcggggccaaggccgacaccgtcgaccacgtggtgccgcgcagccgcgggggtgatcactcctgggagaactgcgtcgcctgctgctcgacgtgcaaccaccgcaagggcgacaaactgctcaacgagctcggctggacgctgcgccggccgccgctgccgcccaccggccaacactggcggctgctgtcgaccgtcaaggagctggacccggcctgggcgcgatatctcggtgaaggtgcggcctgagccacattccggtgtccggacgagtgcagcccggtgcgtgggatacggtttgcgtcgtgagtcctatgcagatgcacctgttcatcgtcggaataccgctgttgctggtgatcgtcttgtcggtgctgatctggtcccacaagggaccgcacccggcgacctacaagctgggcgagaagtggacccacccgccgatcctgtgggcggccgtcgatgaggacgtcggccacgccggtcacggtggacacggcacgtcggaattcacagtcggaggtggcgccagtggcacgtggtgaggtagcgacgagggagcccgccgagctgcccaacggctgggtgatcaccaccagcggccggatctccggggtgaccgagcccggtgagctgtccgtgcactacccgttcccgatcaaggacctggtggccatcgacgacgcgctgaagttcgggtcgcgggcgtccaagacgcggtttgcgatctatctgggcgacctgggcaccgacaccgccgcgcgggcccgcgagatcctggccgacgtgcccaccccggacaacgcggtgctgctggccgtctcacccgatcagaaggtcatcgaggtggtctacggttccgcggtccggggtcgcggcgccgaatcggccgcgccgctgggtgtcgccgcggcctcctcggcgttccagcggggcgatctggtggacggcctggtcagcgcgatccgcgtgctgagcgcagggatctcgccggcctagtcagctgtcgcgtcgaagcgacgcgcccgcagcgcacgcttcaccccggcctggccctcgagcaccagccgccgcagcgccgccggcacctgggggtccgacaagaacctgtccgccgccgcgatgccctcgtcgctgatgtcccaggccggatacaggccgaccaccaccgtctgggccacttcgctggatcgccgcgcccacacgcccgggatcgcctcgaagtagcgcggggtgaacggcttgagcagctcgtgctgcccgggctgggcgatgcccgcgatcatcgagcgggccgtgatgttggccagggtgtcgtcctcgaccaccgtcgtccacgcctgctccttgaccggcagctgcggccgcgccgccgcggcctgcgcggcgtgccgcttgccggcggccgtcgggtcacgctgcacctcggcatcgatgaacggcgtcgcgggcccgtcggcgtcgatctcaccggcggcggccagggcggtgacgatccgccaccgcaggtcggtgtcgatctccaggccggccagccccaactcggccgggtcatggtcgagcagatccgccagcgtcaccacatggcgcgtcgacaacagcgacgagcacagcgcgttgacgaaggccagctggtgatccgacccgggctcggcggcgcgcgccaactccaacagccggtcggcgaactgcggccaaccgtggtcgcgcgcccatcccggctcggcgtaggagcccagcgccgtctgcgcctgcagcagcagccgctgcgccacgccgacctcggtttcgccctgcacgccgcccgccaccagggccacgaagtcgcgggcccgcagttcggcctcgcgggtcatctcccaggctgccgaccagaccagcgagcgcggcaacggctcggcgatgtcggcgatgcgatccagcgcggtgcccagcgactcggcatccagccgcacggagcagtaggtcaggtcgtcgtcgttgaccagaaccagtttgcctcgcgaaacaccaaccagcgcaggcacttccgtgacgggaccctcgacgtcgagttcctcccggtgcactcgcaccagcttccccgacccgtcgtcgtcgtagatgccgatcgccagccggtgcacccgggtctccccggcgcccggggcggcaccactctgggtcaccgcgaaccgggtgaagcggccgcggtcgtcgacgtcgaaatccggccgcagcgtgttcagcccggtggtcttcagccactgccgaccccagtcggacaggtcgcggccggatgccttctccagcgcggcgaccagatcgtcgaaggtggcgttgccgaacgcgtgggtgcggaagtaatcgcgcagcccggccaaaaagtgctccagcccgacgtaggcgacgagttgtttgagcaccgaagcgcccttggcgtaggtgatcccgtcgaagttcacctcgaccgcggccaggtccgggatgtcggcggcgatcggatgcgtcgacggcagttgatcctggcggtaggcccacgacttctccaccgtcgcgaacgtcgtccacgcctcggtgaattccgttgcctcgctttggcacagcaccgacgcgaaggtggcgaacgactcgttcagccacagatcgtcccaccaggccatggtgaccaggtccccgaaccacatgtgcgccatctcgtgcagcaccgtctcggcgcgccgctcgtaggaggcccgggtgaccttgctgcggaacacgtaatcctcgaggaaggtcaccgcgcccgcgttttccattgcgccggcgttgaattcgggcacgaacagctgatcgtatttgccgaacgcgtagggcatcccgaagttcttgtggtagaagccgaatccctgcttggtctgggtgaagagccgttcggcgtccatgtaccgcgccagcgaggcccggcagtagatgcccagcgggatctccccgtgctcgtcgacgtagctgtccttccactcggcgtacgggccggcgatcagggcgaccagataggtgctcatccgcggcgtggtggcaaacgtgtgcacccggtgttgcgccgcgtcgttcaccgacaccgccgcgctgttggagatcaccttccagtgccggggcgcggtcacccgcacgtcgaaggtggccttgaggtcgggctggtcgaagcaggcgaacatccgcttggcgtcggcggtttcgaattgcgagtacaggtagacctcgtcgtcgaccgggtcgacgaagcgatgcagaccctcgccggtgttggagtagcggcagtccgcgtcgaccacgacgacattgcggtcggccagcccctgcaacgagatcccggtggattcgtcgtagccggagacgtcgatgtcgcgaccgttgagcgtggcgctgcgcacggtgtcggcggcaatgtcgatgacggtgtcggcgccggccagcgcgtcgaacaccaccgtggtgatcgagcggaaggttcggtcgccgggaccgcccttcccgtcggtgaggtcgaggtcgatccggtagccggcgacggtgaccagcgcggcgcgctcgacggcttgttcgcgggtgagattgggaagtaccacgtgtccaacttacggggcgggcaaaccgggaacaggatgcagacgcctacggttgtgcagatcagtctttcaactccacgagcaactcccacacgagaggatccgccatggcgcagcaggcccccgcgaagaacaaagccgatttctggttcgacccgctgtgcccgtgggcatggatcacctcacgctggatcctcgaggtggaaaaggtccgcgacatcgaggtgaacttccacgtgatgagcctggcggtgctcaacgagaaccgcgagggcctgcccgacgaataccgggagcggttggccaaggcgttcggcccggtgcgggtggccatcgccgccgagcaggcgcacggcgccaaggtgcttgcgccgctgtacacggcgatgggcacccgcatccacaacgagggcaacaaggacctcaccgacgtgatcaagcagtcgctggccgaggtgggcctgccggccgagctggccgaggccgccgacaccgacgcctacgacgacgcgctgcgcaagagccaccacgccggcatggacccggtcggcgacgacgtcggcacccccaccatccacgtcaacgacgtggcgttcttcgggccggtgctgtcccggatcccgcgcggcgaggaagcgggcaagctgtgggacgcctcggtgacgttcgcgtcctacccgcacttcttcgaactcaagcgaacccgcgacgagaagcccgaattcgactagcctgccgcacacagccgcgggcccggcggcccgcggctgtgtaaggattgcgggcatgcgcgtctacctcggctctgaccacgccggattcgagctcaagcagcagatcatcgcccacctcgagcagtccggccaccagccgatcgactgcggcgccttcagctacgacgccgacgacgactacccggcgttctgcatcgccgccgcgacgcgcaccgtggccgacccggacagcctcggcatcgtgctcggggggtcgggcaacggcgagcagatcgccgccaacaaggtccccggcgcccgctgtgcgttggcctggagcgtggaaacggcgcagctggcgcgcgagcacaacaacgcccagctgatcggcatcggcggtcgcatgcacaccgtggccgaggcgctggccatcgtcgacgccttcgtgaccacgccgtggtcgaaagccccacgccaccaacggcgtatcgacatactggccgaatacgaacgcacccaccaagccccgccggtacccggcgccgtgggctgaggtcggcagggtccgcgcgtgcccgaaggccataccctgcaccggctggcccggctgcatcaacgccgatacgccggcgcgccggtggcggtgtccagcccgcagggccgcttcgccgaggcggccgcggtggtcgacggccgggtgttgcggcgcaccagcgcctggggcaaacacctgtttcaccactacgcgggcggcccgatcgtgcacgtgcacctgggactgtacggctccttcagcgaatgggaacgtcccggcgacgggccgttgcccgacccggtcgggcaggtgcggatgcgcatggtcggcgccggccacggcaccgacctgcgcggcccgacggtctgcgaggtcatcgacgaggggcaggtcagtgacgtgctggccaggctgggccccgacccgttgcgcgacgacgccgacccgtcctgggcctggcagcgaattgccaagtcgcgcagacctattggcgcgctgctgatggaccagaccgtgatggccggggtgggcaacgtgtaccgcagcgagttgttgttccggcacggcatcgacccgtaccgggcgggccgcgacgtgggcgaggccgagttcgatgcggcctggaccgatctggtggcgctgatgaaggtgggcctgcggcgcggcaagatcatcgtggtgcggcccgaacacgaccgcggcgccccgtcctatcgccccgaccggccgcgcacctacgtgtaccggcgggccggcgaggcctgccgggtgtgcggcgagcccgtccggaccgcggtgctggagggccgaaacgtgttctggtgccccacctgtcaaaagtgagcccgcccgctcgattgcctcggttggcaggaagctcacagcacgaaacgccggggccattgtttagccaaagcatctatgcgggtatgagtgttcttcgtgaaaactcttccacgtttggccgcaacggccctcgcgatcggtgggctgggcctggccggcttgggcatcgcgacgcaagtccaggcccatcccgggcccttcccgcaatggtgccccggcgaattctgggatccgggctggggaaacaactgggactggaacaactgccatgactggcgtggggcccgcccccgccgcctccgggtccgccgggaccgccacccccgggctggggccaccctggtccgggcggaccgccgccgccgcacggctggcacccctgacgccgcgcgcgtccacgtaacccgaacgcgccccgccgatcccggcggggcgcgttcgcgtcgcagttagcggacgcccagcacggagtagacctcgttggacagcgccaggctgcgcggatcggcgttggccttggtggcgtcgaagcgattcatcacgtacgcgtagccgatccggtgttccaggtcgacgaatccgaacgagccgcccagcccgccgtggccgaagatccgcgggttgggtccgttgacgcaccgctggttgagcatgtaccccaggccccagccgtggtcggcgacccgcggtcccagcaccaggtcggtgtccagcccgccctggcacacccgcacccggtccatgtgctcgcggctgagcaacttctcctgggccagcgcgttatagaaggtcgccaagccgagcgccgacacctgcccgttggtgcccgggaactccagttcgcgccacaggttcagatcgtgcgagcccagctcgtcgtcgggggcgaaacccatcgagatggacagcccggccttggggtgctcggcaaggctcctcgggtcggtgggggcgttggcgtcggccagcaggtcgcgggcgtgcggcttgttgacccgctcggcgcagcggtgttgttcggccagcggcaacccgatgtggacgtcggcgccgaacggtccggcgatctcggtgcgcaggtagtggccgatggttcggccggtgacccggcggaacacctcgcccatgatgaaaccgaaggtggtcatgtggtagccctgggcggtgcccggctcccaccacggctcggcggcggccagctgttcgcagacgtagtcccagtcggcgacctgttcccagcgcatccgggtgcgcggcccgatcaccccggatcggtggctcatcaccatcgccagggtgatgtcttgtttgcccgcctgggcgaactcgggccagtagcgggccaccggcgcctgcaggtccagctgcccgcggtcggccagttggtgcacacaggtggcggacaggcccttggtgccggacagcaccgtggtcagggtgttctgctgccaggggcgggtgcgcgcggcgtcggcccagccgccccacagattgacgaccagcgacccgtccacccagacggcgacggccgcgccgacctcaccgccgtgggtgaaattgcgctcgaaggcgtcgcgtaccccgacgaagtccggcgcacatgagccatgaatcggcgcgtccgtcttcaggtcgctcatggcgcctctctagcgagaagatagttagcccgagcgggcgacgggaatcgaacccgcgtagctagtttggaagactagggctctaccattgagctacgcccgcatgtgtctagtcgagcgtgactgtagctggcgacgaagatcaaatctaatcgacgcggctttgtgaccaccccgtgaggtccgcgcggtcgctgcgaagcctgtggcggacctggcttcgaggggccttaggatcatcgaggtcagcgcggggtgtagcgcagcttggtagcgcatccgctttgggagcggaaggccgcaggttcaaatcctgtcaccccgaccagcacgaccggccccgtgccccgcgcacggcccaccgagcgccagcaacgagtaccgaggagcacacccgtgaagagcaccgtcgagcagttgagccctacccgggtgcgcatcaacgtggaggtccccttcgccgaactcgagcccgacttccagcgggcctacaaggaactggccaagcaggtgcggctgcccggcttccggcccggcaaggcgccggcgaagttgctggaggcccgcttcggccgggaggcgatgctcgaccaggtcgtcaccgaggcgctgcccgcccggtacggacaggccgtggccgagtcggaagtgcacccgctgggccagcccgagatcgaggtcaccaagaaggagtacgggcaggagctggccttcaccgccgaggtcgacgtccgccccgagctgaacctgccggacccgggcgccctgaagatctcggtggacccgatcgaggtcaccgacgaggacgtcgacgccgaactgcagtcgctgcgcgcccgcttcggcaccctgaccggggtggagcgcccggtggccgagggggacttcgtctcgatcgacctgtcggccaccatcgacgggcaggaggtgcccggcgccaccgcccaggggctgtcgcacgaggtcggctccggccggctcatcgaggggctggacgaggccctgatcgggatgtccgtcgacgaatcccgggagttcaccaccaagctggtgtcgggcgagcacgccggccaggacgcccaggtgacggtcacggtcaagtcggtcaaggagcgcgagctgcccgagcccgacgacgagttcgcccaactggccagcgaattcgacaccatcgacgagctgcgggccaacctgcgcgagcaggtcggccgggtcaagcgggcgcagcaggccgaacgcatccgcgacgccgcgatcgacaccctgctcgagcaggtcgacatcccgttgccggaagcaatcgtcaaggcccaggtggacagcgccctgcacggcgcgctgcacagcctcaaccacgacgagtccaaactcgaggaagtgcttgcccagcaagggaagtcccgcgaggagttcgagaacgagacgcgcaccgccgccgagacggacgtcaagaagcagttgttgctcgacgcactggccgacaagctgcaggtccaggtcggccaggaagacctgaccgagcggctggtggcgacctcgcggcagtacggcatcgagccgcagcagttgctggcctaccttcaggagaacaaccagctgccggccatgttcgccgatgtgcgacgggcgctggccatcgccgaggtgatccgggcggcgacggtcaccgacaccgccggcaacaccatcgacaccagtgagttcttcggcaagcgcccgtcgggcgacggcgccgccgatgaggacgccgatcaggccgacgaatccaccacggccgacgccggcgaatgaccttgccgatgacgctgtgagcgaacgcgccccgtttccggggtgcgtggccgcgaaacggcgggcccggttggttagtgtcggtgcagagaagaactcgagaaagcaggtaacccagtcgtgtctgacatgcgttcgccctcgcagggtctcaacctcacggactcggtctatgagcgcttgctgtccgagcgcatcatcttcctgggttcggaggtcaacgacgacgtcgccaaccggctgtgcgcgcagatcctgctgctcgccgccgaagaccccaccaaggacatctcgctctacatcaactccccgggcggttcgatcagcgccggcatggccatctacgacaccatggtgctggcgccctgcgacatcgccacctacgcgatgggcatggccgcctcgatgggcgagttcttgttggcggcgggcaccaagggcaagcgctacgcgctgccgcacgcccgcatcctgatgcaccagccgctcggcggggtcaccggcagcgcggccgacatcgccatccaggccgagcagttccacgtcatcaaaaaggagatgttccggctcaacgccgaattcaccggacagtcgatcgaacgcatcgaggccgactccgaccgcgaccgctggttcaccgcccaggaagccctcgagtacgggttcgtcgaccacatcatcacccgcgccgccaccatcaccaacggagaagcacagtgaaccctcagatccagccccaggcgcgctacatcctgccgtcgttcatcgagcactccagcttcgggatcaaggaatccaacccgtacaacaagctgttcgaggagcgcatcatcttcctcggcgtccaggtggacgacgcgtcggcgaacgacatcatggcgcagctgctggtgctggagtcgctggacccggaccgcgacatcaccatgtacatcaattcgcccggcggcggattcacctcgctgatggccatttacgacaccatgcagtacgtgcgcgccgacattcagacggtgtgcctcggtcaggccgcctcggcggcggcggtgctgctggccgccggcaccccgggcaagcggatggcgctgcccaacgcgcgggtgctgatccaccagccgtcgctgcagggcgtgatccaggggcagttctccgacctggagatccaggccgccgagatcgagcggatgcgcacgctgatggagaccaccctggcccgtcacaccggcaaggacgccgcgaccatccgcaaggacaccgaccgggacaagatcctgaccgccgaagaggccaaggactacgggatcatcgacaccgtgctggagtaccgcaagctgtcggcgcagacggcctaactcgctgcgccgaacgtgcactcagggcgattttttggcggaattttcgccgtcactgcacgcacggcgaacggccgcgatgtcggtgggccgcacctggcagcatccgccgacgatacgtgctcccgccgagatccaccgcgcggccagcggcgccgaaaaacgcgacggcccggtccagttgtgccgcaaggcattccagtgctctccgctgttcgggtagacgatcaccggcttgccgatcgccgcggcgatctcgatcgtgggcaacacgtcgtccggcgcgcagcaattgacgccgacagcgacaatctcgggcacccctgccgccaccgcgaaagcgtcggctagcggctgacccgcccgggtgtgggcgccgtcaatggtgtagctcagccacgccggcacaccgagcgagcgcaccagattcaccagcgcctcggcctcgtcgacgtcggggatggtttccactgccaagacgtccgcgtcggcgccggccaacacctccagccgcggccggtgccagtcctccagctgcctcacgctgatcccgtagcggccgcggtattcggagccgtccgcaagtgcggcgccgtacgggccgaccgacgcggccacgtggcccgcaacacctgcctcatcccgcgcggccttggcgagttcgacactgcgccgaagcaatccggcggtgtcggaacggctgattccgcgggccgcgaagccctcgaaggacgcctggtagctggccgtcgtcgcgatcatcgccccggcgcggaagtaggcggcgtgcaccgcgacgatctcctgcggggcgtcggccagcagccgcgccgaccacaacgggtcggagaggtcgtgaccgcgcgcttccagctcggtggccaggccgccgtcgagcagcacgggatcgctgggccaggtgaagccccgggctgaacccacctggccactgtagggtgatttcgtgggggttcgcccacgcctcgagccggccgccagcctcggtcgcatcacgaccgcgacacgccaaagacacgcaaagcgcgtctatcgcgagtcacggccaccgtgtggctatatgtttcatccatacggaaagaggcacgaaccccgcaaataccatgagcgcgattcggcgtttatggtcgcggcgggcccgatcaagcgggtagcgtcggtgaatacatgcgggacaggcaagaccaacggcgaacaggaagtaggccctcagcaccatggcgcgcatcggagacggcggtgacctgctgaagtgctcgttctgcggaaagagccagaaacaggtcaagaaactcattgctggccccggcgtgtacatctgcgatgagtgcatcgacctctgcaacgagatcatcgaagaggagctcgccgacgccgacgacgtcaagctcgacgagctgcccaagccgatcgagatccgggagttcctcgagggatacgtcatcgggcaggacaccgccaagcggacgctggccgtggcggtctacaaccactacaagcgcatccaggccggcgagaagggccgcgactcgcgccacgaaccggtcgagctgaccaagtccaacatcttgatgctggggccgaccggatgcggcaagacctacctggcccagacgctggccaagatgctcaacgtgccgttcgccatcgccgacgccaccgcgctcaccgaggccggatacgtcggtgaggacgtggagaacatcctgctgaagctgatccaggccgccgactacgacgtcaagcgcgccgagaccggcatcatctacatcgacgaggtggacaagatcgcgcgcaagagcgagaacccgtcgatcacccgcgacgtgtcgggggagggcgtgcagcaggccctgctgaagatcctggagggcacccaggcgtcggtgccgccgcagggcggccgcaagcacccgcaccaggagttcatccagatcgacaccaccaacgtgttgttcatcgtcgcgggcgccttcgccgggctggagaagatcatctacgagcgcgtcggcaagcggggcctgggttttggcgccgaggtgcgctccaaggccgagatcgacaccaccgatcacttcgccgaggtcatgcccgaggacctgatcaagttcggtctgatccccgagttcatcggccggttgcccgtggtcgcctcggtcaccaacctggaccgcgagtcgctggtcaagatcctgtccgagccgaagaacgctctggtcaagcagtacacccggctgttcgagatggacggcgtggagctggagttcaccgacgacgcgctggaggcgatcgccgatcaggccatccaccgcggcaccggggcccgcggcctgcgcgcgatcatggaagaagtgctgctgccggtgatgtacgacatcccgagccgcgacgacgtcgccaaggtcgtggtgaccaaggagaccgtgcaggacaacgtgttgccgacgatcgtgccgcgcaagccgtcgcgcaccgagcgtcgcgacaagagcgcctgacgcgacgccgcgctcctggctaagcgcggcggttaacgctcacgacgtgaccaataacacagtttggtgcggttcgcgtcggcgccaccaccctgacttgggcttttggtgagttaacgcccgcgtgtggcgggtatcaggtgaccatgtacgcgcgaaatgagtgccataattggtaccgccagtgacataaaaccgtgatggccggagactcacttcgccggcgcgtaatctgaagctgcgcgaactgtctgtccggtgaacaaatggagggcaacgacgtggatccgaacggcagcggagccggatcagactcacagaatggggcttcccccaacggatctagccgtcagcgcctggaacaggtcgtcatccgcttcgccggtgactcgggtgacggcatgcagctcaccggcgaccggttcacctccgaggcagcgcttttcggcaacgacctggcgacccagccgaactaccctgccgagatccgcgcgcccgcaggcactctgcccggtgtctcgtcgttccagattcagatcgccgactacgacatcctgaccgccggcgaccggcccgacgtcctcgtcgcgatgaatcccgctgcgctgaaggccaatatcggcgacctaccccgcggcggcatggtgatcgcgaactccgacgagttcaccaagcgcaacctgaccaaggtgggttacgtcaccaacccgctggagaccgacgagttgtccgactacgtggtgcattccgtcgcgatgaccaccctgacgctcggtgccgtcgaatccatcggcgcgtcgaagaaggacggccagcgggccaagaacatgttcgcgctgggcctactgtcgtggatgtacggtcggccgatcgaaaccagcgagaagttcatccgggagaagttcgcccgcaagcccgaggtcgccgagaccaacgtgctggcgctcaaggccggctggaactacggcgagacgaccgaggcgttcggcaccacgtacgaggtttcccgcgcgacgctgccggccggtgaataccggcagatctccggcaacaccgcgctggcctacggcatcgtcgcggccggtcagctggccgacattccggtcgtgctgggcagctacccgatcacgccggcctccgacatcctgcacgagctgtccaagcacaagaacttcaacgtcatcaccttccaggcggaggacgagatcggcgggatctgcgccgcgatcggcgcctcctacggcggcgcgctgggcgtcaccaccacgtccgggccgggcatctcgctgaagtccgaagcgctcgggctggccgtgatgaccgaactgcctctgctcgtcgtcgacgtgcagcgcggcgggccgtcgaccgggctgcccaccaagaccgagcaggccgacctgctgcaggcgttgttcggccgcaacggcgagtcgccggtcgcggtgctggcgccgcgctcgccgtcggactgcttcgaaaccgcgctggaggcggcgcgcatcgcggtgtcgtaccacaccccggtgatcgtgttgtccgacggcgcgatcgccaacggctcggagccgtggcgcattccggacgtcagcactctgccgcgcatcacgcacgccttcgccaagccggacgaaccgttccagccctacgcccgcgaccccgagacgctggcgcggcaattcgccgttccgggcacgccgggcctcgagcaccgcatcggcgggctggaagccgcgaacggctcgggcaacatctcctacgagccggtcaaccacgacctgatggtgcggttgcgccaggccaagatcgacggcatctcggtgcccgatctcgaggtcgacgaccccacgggcgacgccgagctgctgctgatcgggtggggcagctcctacggcccgatcggtgaggcctgccggcgcgcgcggcgcaagggcatcaaggtggcgcacgcccacctgcgctacctcaacccgttcccggccaacctgggcgaggtgttgcggcggtacccgcaggtggtgtgcccggagatgaacctggggcagctggccctgctgctgcgcggcaagtacctggtcgacgtgcaatcggtcagcaaggtacagggcgtggcgttcctggccgacgagatcggtcgcgtcattcgcgccgcgctgggcgggacgctggccgaggtcgagaacgacaagacgatggtcgcccggatggcggcggcaacggttggagccagcgcatgagcgcactggtgacggccggttcgatgcagagcgaagcgatgaggaggagcggcgctcgtgactgacgtggtcggcaacttggcgggtaaggacctcggtctgaccgcgaagttgaccaagaacgacggggttcccacaacggaccagccgcagaaggccaaggacttcaccagtgaccaggaggtccgctggtgcccgggctgcggggactacgtcatcctcaacaccatccgcaacttcctgccggacctggggctgcgccgcgagaacatcgtgttcatcagcggcatcggctgctcgagccgcttcccgtactacctggaaacctacggcttccactccatccacggccgcgcgccggccatcgccactggattggcgctggcccgcgaggacctgtcggtgtgggtggtcaccggtgacggcgacgcattgtcgatcggcggcaaccacctgatccacgcgctgcgccgcaacgtcaacatcacgatcctgttgttcaacaaccggatctacgggctgaccaaggggcagtactcgcccacgtcggaggtcggcaagatcaccaagtcgaccccgatgggatcgctggaccacccgttcaatccggtgtcgttggccctgggcgccgaggcgaccttcgtcggccgcgcactggactccgaccgggccggtctgaccgaggtgctgcaggcggcggccgggcaccggggcgccgccgtcgtcgagatcctgcaggactgcccgatcttcaacgacggctcgttcgacgtcctgcgcaaggagggcgccgaggagcgggtcatcagcgtccggcacggcgaaccaattgtgttcggcgccaacggcgaatactgcgtggtgaagtccggcttcggcctggaggtcgccaagaccgccgacgtgtcggtcgacgagaccgtggtgcacgacgcgcacaccgacaactcggcatacgccttcgcgttgtcgcggctgtcggaccagaacctcgagcacaccgtgctgggcatcttccgcgacatcagccggcccacctacgacgacgccgcgcgcgcccaggtccaggccgcccagtcggccaaggcgttcgactccgcggcgctgcagtcgctgctgcgtggccgcgacacctggaccgtcgactgacgtggccgactcgatgcaactggcagggatcgtgcttgccggcggtgaatcgcggcgaatgggccgcgacaaggccaccctgccggggccccgcggggccgcgacgctcctcgagtacgtcgtcggggtgctcatccagcgctgcgacccgatcttcgtgatggccgccccggggcaaccgttgcccgaggtgacggcgcgcatcattcgcgacgagatacgcggccaggggccgctcccggcgaccggccggggcctgcgcgccgccgccgaggcgggcgcccggtacgcgttcgtctgcgccgtcgacatgccgctgctgtcccccgaattgatcgacgacctggtgcatttggccaccgaaaccaatgccgaggtggtgctgccgtgggatggccgcagtcattaccttgcctcgctgtaccgcaccgatctggccgagcggatcgaccggctggtcgccggcggcgcccgatcgatgcgagccctgatcgacgcctccgacgcccagcagatcgtgctgccggaatcgcggttcctggccaacgtcaacaccgaggccgacctgcgcgccctggcgcaggcgcgggcctgacaatcggccggcgaattcagcgaattcccctctgccgccgaattcgcggccggcatcaatgcggtagcgcaagcgaatgcggcgttattgttccctttcgaatcggtctggcgcgtccataccagtgtcccatcgtgatctgttggggcagcggcgatttgaatgcacgtgtcggaatcggtgccggtgtcccacggttttgcaagtggcccgcccacccatgacgccgtcgggcgtggcaaattcgaatcggtgaattcccgcgaccccggtgtgcacggtgggtatcgcgcggtgcctgtgaaagacgctgcagcactgtccgtttggtgaaagctattgcgggcgtcggtaatacgatgacgacgggaccgcggcatcggtgtacccggtgcgggtggacaatttattttccgaaaaaccatgcagcacagcgctactcgacgtacgggcgcacgatgtgctgctactcggcgtggcgcgcgctgttgcggcgcccgccgcgttatcctcccgaacccccatcggcgcgggtcgaatgcgttgaagcgccaccggatcgggctgtgcacccggcaaacgatggtgcgccagctcacaaaatacgcgtgattcggctcaccatttgtttgcccgggcaatccgcgagctcccgccgaaaatgcccggttgtgccccgtgaagtggtgtaaagccgatcggcgtttcgcctgaggctctgcgagtttccactatgccgtgatggcggcggggacggcaacggattggtcggctgaatcggagcggggatgtaatagggccagggtggtctcggagagatagcgcttttcggcgacttgccattcgtcgtgggcttcgacgagaacggagccggccagccgtagcagcgcggcggggttggggaagacgccgacgacgtcggtgcggcgtttgatctccttgttgagtcgttcgagggggttggtgctccagatctttttccagtgcaggacagggaaatcggcgaatgcggtgatgtcgtcggcggcctcgcgcagcatcgtttcgaccttgggcagttggcggccgagcatgccggcgatggtgtcgagttgctctcgcacatgttcggcgtcgggttgggcgaagatggtgcggatcgctgcggcgaccatctcggctgatcccttgggcacctgggcgagcacgttgcgcaggaagtgcacccggcatcgttgccaagatgcgccgatgaggatggcctcgatggcgctgcgcaacccggtgtgggcatcagagatcaccagctgcaccccggacaggccgcgggttttcagtgagcgcagaaacgccgtccaaaacgcgccgtcctcggagtcaccgacgtcgaagccgagcacttcacggcgtccgtcagccgcgacaccggtggcgatgacgaccgcttgggagaccacccgatggttgacccgagccttgcagtaagtggcgtcgaggaacacatacgggaagtgctgttcggatagaggccggtcccgaaaggcgcctacctcggtgtccagatcggcgcaaatccgggagacctcgcttttggagatgccggcgtccgcgccgagggctttgaccaaatcgtcgactttgcgggtggaggtgccgtgcaaataggcctccatcaccaccgcgaacaagcactgatcgacccggcggcgccgctccagcagcgccgggaagaacgagcccgaccgaagcttgggaatccgcaactccaaatcgccagcgatcgtcgacagtgtgcgcggccgagacccgttgcgctggttgattcgtgatgcgctccgttcatgcggaccggcgccgatcaccgccgtcagctccgcatcgatgagtgcctgataaatcgtctcggcggcctgcttgatccgatcagcggcatcggcattgcgtaatgcgtccagcacctccagcaaggcagactggtccagggccatcgcgatgttcctctcggtagtgatccttggtcgtttcaccacagagactcacgcgatggccctctacatcagtaccgacacgccgccactatttacaccacgccccggcacgttcccaaatgcccgcacgacctgcgaaaatgcccgcgctatcacggcgtgatcggctcgttaccgaaacgagatatccagtttccgaagatgacgaatgcagcggcgtcttctacggtccgtgttagcccacaacgggttacggaagagtaatcgaaaattgaatccacggacccgcgtgtgagcggcggcacggacggcgacagcccgcccgtgaccggtgggtgaagcccgccggcagacctggcccgccgctgtcgtgcccgacccagacggcacgtcccgaagcaggcattcaaccaacagcctcagcccaccttcgtgggcttgctttggcgcgcgcgcaccgcgaaaggaaggatattgaggaacgtccgcaagacgctcattctcgccgcggtcacgggcacgctcgtgaccatcccgtccgctactgctcacgcagacgcggagcaggtgggcttcgacccgaacgtgccggccgccggccccgccccggacgcgccaccgcccccggccccggatgctccgccggccccggctccggacgccccgccggccccggacgctccgccgcccccggctccggacgccccgccgccggccccggatgcgccgccggccccgggcccggacgtcccgccgcctcccgctcccaaggcgtacagcgtgaactgggacgccatcgcgcagtgcgagtcgggcggcaactgggggatcaacaccggtaacggctacgccggtggcctgcagttcacctcgagcacctggcacgccaacggcggcagtggctccccggccggcgccagccgcgaggagcagatccgggtcgccgagaacgtgctgcactcgcagggcatcggcgcgtggccggtgtgcggccgccgcggctgatcgcagccatccaagaagtgccgggcctagtgcccggcacttcttggctccaggggtagcgtcgggccggtgaccgcaacaccgcgcgaattcgacattgtcttgtatggggctaccggcttcgtcggcaagctcaccgccgagtacctggccggggcggcaccggacaagcgggttgcgctggccggcaggtccaccgagaagctgcgtgccgtccgcgactcgctcggcgacgccgcgcagtcctggcccgtcctgcaggccgacgccagctcgcccgccaccctcaacgagatggcggcccgcacccaggtcgtcatcaccacggtcggcccgtacacccgctacgggctgccgctggtggccgcgtgcgcggccgccggcaccgactacgccgacctgaccggagaggcgatgttcgtccgggacagcatcgactcctatcacaagcaggccgcggataccggcgcccgcatcgtgcacgcctgcggattcgattcggtgccgtcggacctcagcgtgtacgcgctgtaccgggcggcgcgcgatgacggcgccggcgagctcgtcgacaccgacctggtggtgcgttccttctccggcggggtgtccggcggcaccgtcgcctcgatgctcgaagtgctcgacaccgcatcccgcgatcccgaggcccggcgccagctcgccgacccctacacgttgagcagcgaccgcggcgccgaacccgacgtcgggccgcagcccgatctgccgtggcgacggggtcgccagatcgcgccggaactggccggggtgtggaccgcgggcttcgtcatggcgccctacaacacccggatcgtgcggcgcagcaacgcattgctcgactgggcgtacggccggtcgttgcgttacagcgaaagcatgagcctgggctcgtcgccgctggcgccggtggcctccgcggtggtgggcggaacggccgccgcgacgttcgggttgggcagccgctatttccggttcctgccgcgccggctggtggagcgcatcgtgcccaagccgggaaccggccccagcccggcggcccgcgagcgcggttactaccggatcgagacctacaccacgaccaccagcggcgcccgctacgtggcccggatggaacagcgcggggaccccggctacaaggcgacctcggtgctgttgggggagagcgggctggcgctggccttcgaccgcgacaagctgccgcagctgtacggggttctcacccccgcggccgcaatgggcgacgcgctgctggaccgattccccggcgcgggcgtgttcttgcaggtcgaccggctcgccgggtgacccggctcacggttcgggcacttacatgaaggtaaacgtcgctccctagaattgacgggtgaccgccagccgcagccccgccaccgacctgcccaagtcgtgggacccgcccgcggccgaatacgcgatctaccgccagtgggtggacgccgggtacttcaccgcgaacccggccagcgacaaacccggctactcgatcgtgttgccgccgcccaacgtcaccggcagcctgcacatgggccacgcgctggagcacaccatgatggacgccctgacccggcgcaagcggatgcagggctacgaggtgctctggcagcccggcatggatcacgccggcatcgcgacccagagcgtggtggaaaagcagctcgccgtcgacggcaagaccaaagaggacttcggtcgcgagctgttcatcgagaaggtgtgggactggaagcgcgagtccggcggcgccatcggcggccagatgcgccggctgggcgacggggtggactggagccgcgaccggttcaccatggacgagggcctgtcccgggccgtgcgcaccatcttcaaaaggctctacgacgccgggctgatctaccgcgccgagcggctggtcaactggtcgccggtgctgcagacggccctctccgacatcgaggtcaactacgaggaggtcgagggcgagctggtgtcgttccgctacggctcgctcgacgactcgggccctcacatcgtggtggccaccacccgggtcgagacgatgctgggcgacaccgccatcgcggtgcatcccgacgacgagcgctaccggcacctggtcggcagcagcctgccgcacccgttcgtggaccggcagctgctgatcgtcgccgacgagcacgtcgaccccgaattcggcaccggcgcagtcaaagtcacgcccgcgcacgaccccaacgacttcgagatcgggctgcgccaccagttgccgatgatctcgatcatggacaccaggggtcgaatcgccgacaccggaacacaattcgacggcatggaccggttcgcggcccgggtcgcggtgcgcgaggcgctggccgcgcagggccgcatcgtcgaggagaagcgaccctacctgcacagcgtcgggcattccgagcgcagcggcgagccgatcgagccgcggctgtcgctgcaatggtgggtccgagtggaatcgctggccaaggccgccggtgacgcggtccgcaacggcgacacggtgattcacccgaccagcatggaaccgcgctggttcgcctgggtggacgacatgcacgactggtgcgtctcgcggcagctgtggtggggccaccgcatcccgatctggtacgggcccaacggcgaacaacgctgcgtcggcccggacgaaacaccgcccgagggctgggagcaggaccccgacgtgctggacacctggttctcctcggcgctgtggccgttctccaccctgggctggccggagaagacgccggagctggaaaagttctatccgacaagcgttctggtcaccggctacgacatcctcttcttctgggtggccagaatgatgatgttcggcaccttcgtcggcgacgacgacgccatcaccctggacggccggcgcggcccgcaggtgccgttcaccgacgtcttcctgcacgggctgatccgcgacgagtccggtcgcaagatgagcaagtccaagggcaacgtcatcgacccgctggactgggtggacatgttcggtgccgacgccctgcggttcaccctggcccgcggcgccagccctggcggcgacctggcgatcggggaggatcacgtccgggcgtcgcgcaacttctgcaccaagctgttcaacgccacccgctatgcgctgctcaacggcgcgcagctggcggagctgccgccgctcgacgagctgaccgacgccgaccgatggatcctggggcggctggaagaggttcgcgcggaagtcgattcggcgttcgacaactacgagttcagccgggcctgtgaatcgctctaccacttcgcctgggacgaattctgcgactggtacgtcgaattggccaaaacacaactggccgaagggattacgcataccacggcggtgctggcaacaacactggacacgctgctgcggctgctgcacccggtgatcccgttcatcaccgaggcgctgtggcaggccctgaccggcaacgagtccctggtgatcgccgactggccgcggtcgtccggcatcgacctggatcaggttgccacgcaacggatcaccgacatgcagaagctggtgaccgaggtccgccggttccgcagcgaccaggggctggcggaccggcagaaggtgccggcccgactggccggtgtcacggaatccgacctggacacccaggtgagcgcggtgacctcgctggcctggctcaccgacgcggggcccgacttccgcccgtcggcgtcggtggaggtgcggctgcgcggcggcaccgtggtcgtcgagctcgacacctcgggcagcatcgacgtcgccgccgagcggcgccggctggaaaaggatctggccgccgcccacaaggagctggcgtcgaccaccgccaaactggccaacgaggacttcctggccaaggcgcccccgcacgtcgtcgacaagatccgggaccgacagcggctggcgcaggaggaaagcgagcggatcaacgcgcggctggccgtgctgcaatgagcgagccgcccgactgggcgccggagcacgacgttcccgacccggtccccaccccggacgagatcgccgcgctgctgcaggtcgaacacctgctggaccagcgctggccggagaccaagatcgagcccagcctgacccggatcagcgcactgctggacctgttgggctcgccgcagcgcgcctacccgtccatccacgtcgcgggcaccaacggcaagacctcggtggcccggatgatcgacgcgctggtcaccgcgctgcaccggcgcaccgggcgcaccaccagcccgcacctgcaatccgcggtggagcgcatctcgatcgacgccaagccgatcagcccggcccggtatgtcgacacctaccgcgaaatcgagccgttcgtgcagatggtcgatcagcaatcgcaagccgccgggggaccggcgatgagcaagttcgaggtgctcaccgcgatggcgttcgccgcgttcgccgacgccccggtcgacgtcgccgtggtcgaggtgggcatggggggacgctgggacgccaccaacgtggtcaacgccccggtcgcggtcatcaccccgatctccatcgaccacgtcgactacctgggccacgatctcgccgggatcgccggggagaaggccggcatcatcacccgggcgcccgcgggggcacccgacaccgtcgcggtcatcgcccagcagccgccggaggtgatggaggtgctgttggcgcagtgcgtgcaggccgacgccgcggtggcccgcgcgggctcggagttcgcggtgctgggccggcaggtcgcgatcggcgggcagctgctgcagctgcaggggctgggcggggtgtattccgacgtctacctgcccctgcacggcgagcaccaggcgcacaacgccgcgctggccctggcggcggtcgaggcgttcttcggcgccggcgcccagcgccagctcgacgtcgacgccgttcgtgccggtttcgccgccgtcacaagccccggccggcttgagcgaatgcgcagcgccccaacggttttcatcgacgccgcgcacaatcccgccggcgcggcggcactggcgcgcacgctggccgacgaattcgacttccgcttcctggtcggcgtgctcagcgtcctcgccgacaaggacgtcgacggcatcctggccgcgctgcagccggtgttccactccgtggtggtcacccacaacgggtccccgcgggcgctcgacgtcgagtcgctggccctggcggcgcgcgagcagttcggccccgatcgggtgagcaccgccgagaacctcagcgacgccatcgacgtcgcgaccgcgctggtcgacgacgccgtccgggacgggttggtggacgggcaggccgaggacttcgccgggaccgggatcgtcatcaccggctcggtggtcaccgccggcgcggcgcgaaccctgttcggtcgtgatccgcaatgacccggcccgacccacccgaaggcccgcagcagcgcggcgcggccgacccgtggcgcagcttcggcgcggtgatggccgccaccctgatcctggaggccatcgtcgtgctgctggcgatcccggtggtgggcgcggtcggcggcgggctgacgcgggtgtcgctgggctatctgatcgggctggccgttctgctggtgctgctggccggggtgcagcgcagaccgtgggcgatctgggtcaacctgggcgcgcaggcgatcctgctggccggcttcgccgtgtacccgggggtggggttcatcggtgtgctgttcaccgggctgtgggcgctgatcgcctacttccgcgccgaggtccgccgccggcagggatgacgcccggcgtctggccagctggttatgtacgctgtccgccgtgaccgaacggacattggtactgatcaagccggacggcgtccagcggcagctggtgggggagatcatcggccggatcgagcggaagggcctcaccctcgtcgcgctggagctgcggcacgtcagccaagatctggccgcccagcattacgcggagcacgagggcaagccgttcttcgcgtcgttgctggagttcatcacctccggtccggtggtggcggccatcgtcgagggaccgcgggcgatcgcggcgttccggcagctcgccgggggcaccgatccggtggagaaggcgattcccggcaccatccggggcgatttcgggttggagacgcagttcaacctggtgcacgggtccgattcggtcgagtcggcgaaacgggaaatcgggctctggtttcccgacgcctagagctgcggcgatgccgccgcctgccgggggcgggcggttccgcccgagccggcggcctcaggtgcgggtggaccggtgccgtgatgtgggatactgatctcgggtgaacgtcgccggaccggcgtcagacacccgaatgaagacttggacaagcgcgaccatagccccgtcgccttggttcgctgcatgtcaggccgtcattcagcacggcgccgagtgggttctaccgagccgctcggggcgagaccatcacaagcccgggagaagtgacccgggcccatagcgaagccctcgcgtggccgcgtcgcaacgacgcgcccgggggcttgaggagaatacgtggtagacggtgcaccgactgcagacccatcagaagaatcgacccggtccggggacctgcccgaccgtttgagagttcattcgctggcccgaacgctgggaaccaccagcaagcgggtgctggacgcgctcagcgagctggacggccgcgtgcgcagcgcgcactccacggtggaccgcgaggacgcggtccgggtgcgtgacctgctcgccgcccagccgtcggcagaaccggagccggctgccgaggacgcggcgagcggcggaccggacgccgggatcgccggcgaacccgaatcccggctgctgctggaaacccccgacgctaccgagcggccgcattacatgccgctgttcgtcgcgccgcagccgctggaaagcagcgacgacgacggcgatgccgacgagaccgccgactccgacgactcggacggcgacgacgacgagcaggccgaccggccgtccagccggcggcgccgccgcggccgtcgcggacgcgggcgaggccgcggcgagcagggcggatccgacgggccgggcgacggcgacgacgacgagccgcaaaaccggggcaagaagggcggccagtcggacggcgacgacgactccgacggccaggacgccgaggacgccgacgactccgacaccggtgacgacggctcggccgacggcggcaatcgccgccgccgccggcgccggcgccgcaaatccgggtccggcgacgacaacgaggacggaccctcgcccgacgatccgcccaacaccgtcgtgcacgagcggcctccccgcaacggcaaaaacggcggggacgacggcaacggcagctcgagcagcgagatcaagggcatcgacggctcgacccggttggaggccaagcggcaacgacgccgggacggccgcgacgccggccggcgccgccccccggtgctgaccgaggccgaattcctggcgcgtcgcgaggccgtcgaacgggtcatggtggtgcgcgaccggatccgcaccgagccgccgcatcagggctcgcggtacacccagatcgcggtgctcgaggacggcatcgtggtcgagcacttcgtcacctcggccgcttcggcgtccctggtgggcaacatctacctgggcatcgtccagaacgtgctgccctcgatggaggcggccttcgtcgacatcggccgcggccgcaacggcgtgctctacgcgggcgaggtcaactgggaggccgccgggttgggcggatccgaccgcaagatcgagcaggcgctcaaacccggcgactacgtcgtcgtccaggtcagcaaggatccggtcgggcacaagggcgcccggctcaccacgcaggtgtcgttggcgggccgctacctggtttacgtgccgggggcgtcgtcgacgggcatcagccgcaagctgcccgacaccgaacgccagcggctcaaggagatcctgcgcgaggtggtgccgtcggacgccggggtgatcatccggaccgcgtccgaaggggtcaaggaagacgacatccgcggcgacgtcacccggctgcaggagcgctggaagcagatcgaggccaaggcgatcgagatcaaggagaaggcggccggcgcggcggtggcgctctacgaagagcccgacgtgttggtcaaggtcatccgcgacctgttcaacgaggacttcgccggcctgatcgtctccggcgacgacgcctggaacaccatcaacgaatacgtgaattccgttgcgcccgacctggtttcgaaggtcaccaagtacgagccggccaccggcccggacggcacgccggggccggacgtgttcgcggtgcaccgcatcgacgaacaactcgccaaggcgatggaccgcaaggtgtggctgccgtcgggcggcacgctggtgatcgaccggaccgaggccatgacggtgatcgacgtcaacaccggcaagttcaccggctcggggggcaacctggagcagacggtgaccaagaacaacctcgaggcggccgaggagatcgtgcgccagctgcggctgcgcgacatcggcggcatcgtggtcatcgacttcatcgacatggtgctggagtccaaccgcgacctggtgctgcgccggctgaccgaggcgctggcccgcgaccgcacccgtcatcaggtgtcggaggtgacgtcgctcgggttggtgcagctgacccgcaagcggttgggcaccgggctggtggaggccttctcgacgtcctgcccgaactgcggcggccgcggcatcctgctgcacgccgacccggtggactcggccccgtcgaacgggcggaagtccgagtccggggggcgccgcggccggcgcaagaagagcaaggccgaggagccggtggtggccaaggtgccggtccactcgcccggcgagcatccgatgttcaaggcgatggccgcgggctcgtccacgcaggcggcttccgacgaggacgaatccgccgccgaggaggccggtgacgagctcgagcggaagaaggcggcgcgcgccgaggagctcgaagcggccgaggacaccgaggacctcgaggacaccgaggacgacgacgaggactccgacgactccgacgatgaggacctcgatgacgaggacatcgacgacgaggaagacctgggcgacgacgacgaggacctcgagctggacgacgacgacctggacaccgaggactccgacgattccgacgattccgacgactcggaggattccgacgattccgaagaccagcgggacccggcggccgagcgcccgggcgtttcggccctcggccggccacggcgtcggcgcgcggccggccggccggccggaccgccgatccacgcggactgagcgccgcgccgggggtgcccggtttgaccctgtagccgctggtcacgtacccttggacagttgtcgtcgggccgggtggctactttggccggcggcagcgggacttccccgggaaacggcgcaggcccgcaacccagacccaccacgtgcaccgcggctggttcgcgcgcgacgcgccgagcggcggctacaagaaggagcaggagcaacgatggcgacctacgcaatcgtcaagacgggcggcaagcagtacaaggtcgccgtcggggacgtggtcaaagtcgagaagctcgactccgagccgggttcgaacgtgtcgctgccggtcgccctggtggtcgacggcgccaaggtgaccagcgacgccgccgcgctggccaaggtcgcggtcaccggcgaggtgctcgagcacaccaagggccccaagatccgcattcacaagttcaggaacaagaccggctaccacaagcgtcagggacaccgtcagcagctgacggtcctcaaggtcaccggtatcaagtagctcgggaggcgacagacatggcacacaagaagggcgcttccagctcgcgcaacggccgggattccgccgcgcagcggctcggggtgaagcggttcggcggccagatcgtcaaggccggcgagatcatcgtccgccagcgcggcaccaagttccacccgggcaccggcgtcggccgcggcggcgacgacacgttgttcgccaagcaggccggcgccgtcgaattcggcatcaagcgcggccgcaagaccgtcaacatcgtggcggccgggcaagccgccgactgagcgccgcgagcgtgcactcaccgcgataattcgaggcaattctcgcggtagctgcacgctcggcgaacgagacggctgagaggatccacgatgcctcggttcgtcgaccgcgtcgtcatccatgcgcgcgccgggtccgggggcaacggctgcgcctcggtccatcgcgagaagttcaagccgctgggcggcccggacgggggcaacggcggccgcggcggcagcatcgtcttcgtcgtcgacccccaggtgcacaccctgctggacttccacttccatccgcacatcagcgcgccgtccggcaaacagggcatgggcaacaaccgcgacggcgccgccggcgccgacctggaagtcaaggtgcccgacggcaccgtcgtgctcgacgagaacggccggctgctggccgatctggtgggcgcgggcacccgcttcgaggccgccgcgggcggacgcggcggcctgggcaacgccgcgctggcgtcgcgggcccgcaaggcccccgggtttgcgctgctgggcgagccgggcgaaacccgtgagctgacactggaactcaagaccgtcgcggacgtcggcttgatcggcttcccctcggccggcaaatcgtcgttggtgtcggcgatctcggcggccaagcccaagatcgccgactacccgttcaccacgctggtgcccaacctgggcgtggtgtcggccggcgagcacaccttcaccgtcgccgacgtgcccggcctgatcccgggcgcatcggcgggccgcggcctgggcctggacttcctgcggcacatcgagcgctgcgcggtgctggtgcacgtcatcgactgcgccaccgccgatccgggccgtgacccgatctccgacatcgacgcgctggaagccgaactcgccgcctacacgcccaccctgcaaggcgacgtgacgctgggtgatctcaccgagcggccccgcgcggtggtgctcaacaagatcgacgtgcccgaggcgcgcgagctggccgagttcgtccgtgacgagatcgccgagcgcggctggccggtgttcctggtgtcgacggtggctcgagaagggttgcagcccttgatcttcgggctgtggcagatgatctccgagtatcagtccgcccagccggagatcgtgccgcggcgcccggtgatccgcccggttcccgtcgacgacagcggttttcgggtggaacccgatccgcggcagccgggcgcgttcgtggtcagcggtgcgcggcccgaacgctgggtgcgccagaccaacttcgacaacgacgaggcggtggggtatctcgccgaccggctggcccgcctcggcgtcgaagaggagttgctgcggctgggcgcgcgacccggctgcgcggtcaccatcggggacatgacgttcgactgggagccgcaaacgcctgccggacaacaggttgtgctgtccggccgcggtaccgacgcgcggctggagcgcaccgagcgggtcggcgccgccgagcgcaaggccgcccgcaggcagcgccgcaccggcgacgatgcagagcgcggaaccacagaacgcggtgagaacacgtgaccgcccaccgcgacgccatccgcacggcgcgcagcatggtggtcaaggtgggcaccaacgcgttgaccaccccggccggggtgttcgacgccggccggctggccgggctcgccgacgccatcgaggcgcggatgaaggccggcaccgacgtcgtcatcgtctcgtcgggtgccatcgccgcgggcatcgagccgctcggattgtcccgtcgccccagggatctggcgaccaagcaggccgcggccagcgtcggtcaggtggcactggtgaattcctggagcgcggcgttcgcccgctacggccgcaccgtcgggcaggtgctgctgagcgcgcacgacatctcgatgcgcgcccagcacaccaacgcccagcgcaccctggatcggctgcgcgccctgcatgcggtggcgatcgtcaacgagaacgacaccgtggccaccaacgagatccggttcggcgacaacgaccggctctcggcgctggtggcccacctggtcggcgccgaggcgctggtcttgctgtccgacatcgacggcctttacgactcggacccgcgaaagaccaagggagccaagttcattccggaggtgacgggcgcggaggatctggccggcgtggtcgccggcccgggcagcgacctgggcaccggcggcatgacgtcgaagatgtcctcggcgctgctggccgccgacgccggggtgcccgtgctgctggccgccgcggccgacgccgccagcgcgctcaccgacgcttcggtcggcacggtgttcgccgcccggccggtgcggatgtcggcccggcggttctgggtgcgctacgccgccgaggcggccggcgcgctgaccctggacgagggcgcggtgcgcgccgtggtgcatcagcgccgctcgctgctgcccgcgggcatcaccgcggtgtccggccggttctacgccggcgacgtcgtggaactgcgcgggccggacgcggtgccggtggcccgcggcgtggtggcctacgacaccaccgaactggcgaccatgatggggcgctcgaccagtgagctgcccggcgagctgcgcaggcccgcggtgcacgccgacgacctggtggcggtgtgagcggtgccgtgcggtcagatcccggaggcgggcttgagatacagtgcgccccaaacgatttcggccagcgtgtcggccagctccgcgtcgtaggcgggcagctgggccggtaggttctgctggcaggcccgctcgaccatccaggtcaacgcgctcgcggtggtggccgcggccagccgcgggcggatcgacccgtcggcctgaccgtcttcgatgacccgggtgagctggccggagatgccggtcagtatctcgcggtaggtctgcgccgtcagcgggtcgtagccggacatctcgttgagcgccaccagcaccgcctgatgccggcgataggtggcgatgatgcgggtcatcgccgcccgcacgtcgtcggggtcgtgccgcccggccacactccaccagcgccgcgcgccgtcggtgagctcgccgaacacccggctggccagccggcgcagcagatggcccttgtcctcgaagtagatgtagaagctggcccgcgagatgccggccgcaccggcgagccgatccacgctgagctcggtgaagctggcgccgtcacgcatcagccgttcggtggcgtccaacagccggcgctccagctgctcgcggcgctgctcgcggcccgggctgcggcggcccggcggcgtgcgggtcaccgacggcatgcggccagcctagccgactattcgacatattgactagacacactgtctaggaatatcgtcgccgatgtgctgtgaccggtgtcatagcggagaggatcggcatcatggccgtgctgacgggcgagtccgggaccgatcgatcgggccgcccctacgacgagatcgacctgtcgtcgcgggcgttctggtccggcaccgccgcggagcgagaacgctcgttcgcggtgctgcgcgccgagcggccggtgagctggcatccgccggtcgaagactcgttgctgcccgatcccaccgatcccggcttctgggcggtcacccggcgcgccgacatcgtgacggtcagccgcaacaacgacgtcttcctgtccgggcacggggtgatgttcgagagcattcccgcggagctgctcgaggcgtcgcagtcgttcctggcgatggacccgccgcggcacaccaagttgcgcaagctcgcgcacgccgcgctcagtccccgccaggtgcgccgcatcgaggactcgatcaaggccaacgccaaggccatcgtcgaggaactgcgctccgccggcagcggctgtgacttcgtcgaccactgcgccaaggagctacccatccgcacgctttcggacatgatgggcattcccgaatccgagcgggaacgcatggcgcacgccaccgacgccctggtctcgtgggccgacccggagttcctcaacgggcgcccggcgctggaagtcctgctggaaaaccagatgtatctgcaccaggtcgtcggcgacctggccacccagcgccgcgagcggcccggcgacgacctgatcagcagcctggtcaccgccgaggtcgacggcgaccgcctggaggacgcggaggtggcggcgttcttcgtgctgctgtcggtggccgggaacgacaccacccggcagaccatcagccacaccctcagggcgctcaccgtattccctgacgaaaagttttggctgctcgaggatttcggccaccgcatcggcaccgcggtcgaggagttcatccgctgggcgagcccggtgatgaccttccgccgcaccgcggcagccgatgtcgaactcggcggtcagaccatcctggcgggggagaaggtggtcatgttctatccgtccggcaactgggacaccgaggcgttcgaccatcccgaacgtctgaacctgggccgtgaccccaacccgcacgtcggcttcggcggcggcgggctgcacttctgcctcggcgcgcacgtggcccgggcgcagctgcgggccatcttctccgagttgttccggcagctgcccggcatccaggccggcgagcccacctacctggcgggcaatttcgtgcacgccatccgcgccatgccctgcaccttctgacgcgtgtggcgctaatgcgttggcagcggcgataactcgtcggcgagcagggtcagtaactccgaacacccgccgtcgatcttgacggtggccaagtggtcgccccgggtgtcgccgcggttgacgatcgcgatagggatgccccgggcggcggcatgacgcacgaaccggtagccggagaacacggtcagcgacgaccccgcgaccagcagcgcatcggactcgtcgatgagccgataggcagctgccacaacatctttgggcacgctctcgccgaaatagacgatgtcgggcttgagcatgccggcgcagcgcgcgcagtccagataacggaacgacgcggtgtcggcgacgaccgcgtcggcgtcgggggccaccgccagcccgccgatcgcctcggtgcgctcgatgaaccccgggttgagcgcttccagccgctcggccaacgcggcgcggctcgtggtgtcaccgcagcccaggcagatcacccgcgcgtagctgccgtgcaggtcgatgacgtttcggctgcccgccttggtatgcagcaggtcgacgttctgggtgatcacgccggtgaccaccgctgcatcctcgagcgtggccagcgcccggtggccggcgttgggcagcgtgtcgtccatgtgccgccagccgacgtggttgcgcgcccagtaccgctgccggaacgccggatcgccggtgaactggcggatcgtcatcggattgctgggcggcgactcgggcccgcggtagtccggaatgcccgagtcggtggagatgcccgcaccggtcagtaccgcgatccgccgaccggccagcaccgccaccagttccggggattccgcgcggccgaccgtcacgttgttcagggtacgagtcagccgaggcagcccgccgccgtcgtcagctcggcggacatgttctgctccatcatcttgcaggccgccgcgcccagctcggggtcgatgtgtgcgaccgcatccgtcgggatgacgacggggaagtgccgcacgtaggcgtccagggccgtgtagaggatgcactgctcggtgacctgcccggtgatgatcagccgcttggtgcccaaccggctcagcaggtaagccagcgcggtcgaatagaacgcgctgtgacggaccttggtcaggctggcggcttcgcccgagaccggggcgatcggcttcaccaggtccggccgggcgccgtcgagcgccgagcggaccagatcggagaactgggcggtgaaatcgccgtagttgtcgttgacgtacaccaggtcgacgccggcggattcgcgggcccggcgcaccagaccggtcaacggctcgatgatcttctcgacgttgggtattagattttcagcgtcgggatgctgatacgaattcatcatgtcgaccaccaacacagcagtgtcgctcatgccgtccgggatacccggcggccagcagttgacacgcctggggcgacaatggaagggcgatggacttttacaacgcttacagccagggcttcgcccgcgtcgccgcgtgcacgcatcgcaccgtcatcggtgaccccgccgcgaacgccgagtcggtgctgcggctggcccgcgcctgccacgacgacagcgcggcgctggccgtcttcccggaactgacgctgtccgggtattccatcgaagacatcgtgctgcaggacctgttgctcgacgacgtggagcaggccatcgccgcgatcgtggcggcctcggccgatctgttgccggtcttggtggtcggggccccggtgcggcaccggcaccggatctacaacgccgcgctggtgatccatcgcggcgcgctgctcggtgtggtgccgaagtcctacctgcccacctatcgggagttctacgagcgccgtcagatcgcgccgggcgacgacgagcgcggcaccgtccgcgtcgccggcctcgaggcgccgttcggcccggatctgctcttcgccgcctccgacctgcccggtttcgtgctgcacgtggagatctccgaggacatgttcgtgccgattccgcccagcgcgcaggccgcgctggccggcgcgacggtgctggccaacctgtccggcagccccatcacgatcggacgtgccgaggaccgttgcctgctggcgcgttccgcgtcctcgcggtgcttggccgcctacgtgtattccgctgccggcgaaggggaatccaccaccgatctggcctgggacggtcagaccatggtgtgggaaaacggtgtgctgctggcgatgtcggagcggttcccgaagggggagcggcgcagcatcgccgacatcgacaccgaattgcttcgctcggaacgacttcggatgggcaccttcgacgacaaccggcgccatcaccggatcgcgtcggagtcgttccggcgcatcgagttccggctcgacccaccggccggtgacatcggcttgcggcgtgagatcgagcgctttcccttcgtgcccgccgatcgcgaacggctgcaacaggattgcttcgaggcctacaacattcaggtcgccgggctggaacagcggctgcgcgccctggactaccccaagctcgtcatcgggatttccggcgggctggactcgacacacgcgttgatcgtcgccgcccgggccatggaccgcgaacaacggccgcgcagcgacattctggcgttcacgttgcccggcttcgccactggggaccgcaccaaacgcaacgcgatcgagctgtgccgcgcactcggggtgacgttctccgagatcgacatccgcgagaccgcccagctgatgctcaaggagatggaccatcccttcgcgcgcggcgaaaaggtgtacgacgtcaccttcgaaaacgtgcaggccggcttgcgcaccgattatctgttccggctggccaaccagcgcggcggcatcgtgctgggcaccggcgatctctccgaactggggctgggctggtcgacctacggtgtcggcgaccagatgtcgcactacaacgtcaacgccggggtgcccaagacgctgatccagcacctgatccgctgggtcatctcgtcggaggagttcgcgccggaggtcggcgcggtgctgcagtcggtgctcgacaccgagatcaccccggagctggtgcccagcggcgaggaggaggaactgcagagcagcgaggccaaggtgggtccgtttgcgctgcaggacttttcgctgttccatgtgctgcgctacgggttcaggccgtccaagatcgcgttcctggcctggcatgcgtggagcgatcccgagcagggcaactggccgcccggcttccccgaggacaagcgaccgtcctactcgctcaaggaaatccggcactggctgcaggtcttcgtacagcggttctattcgttcagccagttcaagcgctcggcgctgcccaacggccccaaggtgtcgcacggcggtgcgctctcgccgcgcggcgactggcgtgccccgtcggacatgtcggcgcgcatctggctcgacgagatcgaacgcgaaatccccgaggactagcaacggcggcggtgggcccgcccgggttcgccgagcgggccccgaacctcacgccctggcgcgccgccagccaaagtattgcagctcggcgaacaccagcgtgtagacgccggccgccaggttcaacaccacacccgtcgacgtcaacgggaacacgtcggcgagcaccagcaccacggcggccgcggtgtaaagcaggttgccgatgatgacggccatgccggcgcggcgcaccgagggcagcgcggccagcccgaacaccagcacgccgtaaccgatcaagaacgcggacatgccgtactcgaaggccgtggtggtgccggacacctcggcgagccagccgaccagcgggataccggccaggccgaccagcccgctgatggcggcgtcggcgcgcatggccaggcggagcaaaccgtcccggccggtggtgcggtcaatcgtggtggcggacatgattttcctttccgatggctgacaggtcaccaccgaggctgctcgcccaccactgccagatcgacgcgctacgctgccaaacactgccaaccgcaggtcagcggggttgcgcgcggtgtcggcaacggcggcgtcgagcgctcatgcgccgctgcccgcgccgcgcatcgccaccgtgggcgagcgcagcaggtcggccagctcgccgggcaggtatccctgccgggcaagccggggcagcacaccgccgctgtcgatgatgtcgaggatcaggtcgggaagtttcgggacggtgcccgaggcgccggtggtgtcgttgcgccagctgccctcggcgaggtcgaaggtgccggtgtcgccgtcgcggaacaccgcggtggcgtcggggacggtgatggccggcagcccggagttgacggcgttgcggaagaacagcgagttgaattcctcggcgaccagccccgcgacgccgagttcgacgaacaacgccgccactggtcgcgacgaacccagcccgaagttcttgccggccagcacgatatcgcccggcgacacctcgtcggtccagcccggccgcacctggtagaacacgtgtttggcggcttcggcgggctgcatcttcatcgcgaacgccgggtacatggcgtcggtgttcaggttgtcgccgaacacccagaccttgccgcggaacattagcgagcgcagcgtcatgcggtcacactcctcgggtcggtgatgtagccggcgaccgcggacgccgcgacggtggccggcgaggccatgaagatttcggcttcggtgctgcccatccggccggtgaagttgcgggtgctcgcggtgatgcacacctcgccggcccccagcaggcccatgtggtagccgaagcaggccccgcaggtggaattggtgacgacggcgccggcgtcggcgaggtcctgaaggtagccgcgccgcaaggcctctcgatacacggcctgcgaggcgggggtgatcagcagccgcacgcccggcgcgacggtcttgccgcgcagcacctcggcggcgatgcgcaggtcctccagctgcccgttggcgcaggagccgatgaaggcctggtcgatcttctgcctgcccaaccgcgacaccggtgaaccgttgcggctcacggtgcccggccgtgccacgtagggttccagcgtcgccaggtcgacgcgtcggacgtcgtggtatgccgcgtcggaatccggtgtgacggcctcgtattcgacgacaccgcgttcggccaggaacgacgtcagcacgtcgtcgggctcgaaggtgctgaaatcggcggacacctccgcgccctgggtggcgatggtccgccggtcgtgcatcgggatgctggccaggcccggcccgccgaactcgaggttccggttgggggcgtcaccgtactcgtcggcgatgtgcaggaagatgtcctttccgctcaccacctccggcttggcgccgtggaattcgtagcggatggtcggcgcgacctggaaccaggtggtgccggtgcacatgatcgagtagatttcggcgggccccagaccacgggcggcgttgttgtaggcgccggccgcgcaggtatgagagtcggtgcaggccagcacttctcccggacgggccagcccgttctcggcgatcacctggtggcagatgccgtgccggccgacgtcgtagaagcgctcgatgccgaagtcggccacgaacctgcgggcctgccggccgccgtcggcgtccttgatggtgggcgcgggcaccgcgtggtccatgatcaccgcgagcctgtcggggtcgtgaatccgggtgggggatatccacatggtggcgaattgcaggtcgatcaggacggtcatgtcgacgtctacgacgacggtgtcgcccgatgacacggagtccagcccggccttgcgggccaagatcttctcgatgacggtcatgcccatgtgcggcccccggtgtgtgcgtacttctcgtcgagggcccgccagtgcgccatgcccaccaggtcgaagaaatcgcccggagacgccggcagatgggcggccgggtcggtgccgttgaggccgcacaggctgtgcagcatcgcgaacgtcgtgtgcatcagcaggtcgccggggtggatggcgatggcgtaacccagctcgtgcagccgcgccgccgactgcagcggcgtcaggccgccgagcaccaggttgatcagcaggggtgcgtcgacttcggttgcgatgcgctcgatttcgccggcgtcgtgcggcgcctccacgaagacgatgtcggcccccgcgcgcgcgtaccggttggcgcgctcgatcgccgcgtccagcccgagcgggccgcgcgcgtcggtgcgggccaccaccagcaggtcgtcgtcggatcggacgtccagcgcggcggccagcgtctgttcgaacaccgcggcgtcgacgacctgcttgtcgggcaggtgaccgcagcgtttgggaaacacctggtcctccagttggatggcggccaccccggccgcgtcgtaggcgcgaaccgtgcgcaccacgttcatggggccgccgtaaccggtgtcggcgtcggcgatcagcgggacatcccccaatgcggccgcgatcatcgccgcccgatccgccatctcggtcgcggtgaccaggccgatgtcgggcagcccgaaccccgatgccgccacgccggcgccggtcaggtacgccgcaacgtggccggtccggcgggccaggtgcgccgatagcccgtcgaaaacgcctggggcgacgatgagttcgccgttgtccagcaattgcctgagccgcctgcgggcgggtgtggtggccatcttcgttccttgtcagtccagtgccccagcgacggggtcggccagcaggtccatcaggttctcgacgtcggtcaggtcgtcgagtcggatcactgcgcgttcgatcgccgcggcgcggccgcggctggtcacccggtcggccagcgcgtggaacttcgccactacttcgtcgttggtgaccggatcgttgggcgcgccgtgcggcagcgtcacccgggcgcggtgcacggttccctcgcgggtggtgacagcgaggtcggtgcggaacttctcggtgatgtcggcgtcggccagtgattcgtcgagatgcactcgggtggccgagatcagcgcccagatgtcgtcggcatcgaggcgggccgcggtgaattgctcgggcagcacgttgccgtcgagcagtgcggccacggtggcgtacccgatgttcatctgagcgccgatcggggtcagcggccgctccggtagccaccagccgtgcttgtacacggtctccccgacggtgatgtcgaccgaggagatgttttgcggggcaaccgaattccgcaacctccgggccgcgtcgatggccccgtgcagcccgcccatcgcggcgtaggacttgaccatgatgagcgaggtctcccagcgctggcccaggtcggcggtcagtgcggcggcgtcgggatcgtggccttcaccgaatacactgaggaaacccccgtattcgcgttcgaacacccgcttgatgccggtgtagccggcggccgccaggccggccgcgtaaaagccgttgcgcgccgccaggccgtggtgcatccgcttactcatcgcctcgtactgcgcggccatcagaccggccgactgggtgccggccagccccagggcgtcttccagttgcgccggcggcagcccgcgcagcttgccggacgccatcgccgccgcgtgcgtgccgaagaccggaccggaatgccatccgcggtccagcatttgggtgccgtgcagggcgtggccgacgcggggaccgacttcgaacccggctatcgcggccagcagcagctcgcggccggtcgtcgtcgccgaccgcgtcgccgccgtggacagcagcgccgggatcagcagcgagcaactgtgcagcggggccaacggatgaaagtcgtcgagctcgaagccctggatgaacgtgccgttgaggaccgcggccgcgggtgcgctggtccgccggccggttccgatgacgatgctgtcgccgcttccctccagggcgaggacggcgtcggtggcgatgcgcgaccacggcagctgcgcacccaccagggcgcagccgatgccgtccagcagcaggtgcttggcgcggtcgacgacgggcgcggggacgtcgtcgagggtcagctcggcgacccaggtggcgagcagcccggtgggcccgaccggatcggtgactgtctcctgctgcagggcggtcatggctccccctcggaccgtgtggtgatttgttatatgtttataacaacaaatcgaatcccgcaagcaaggtggtgtggaagcattgggcatcgtgcagcagcgcagcgacaaggccggcccggtgacggcggccgccggtgtgccgttgcaccgccagctgtttctggtgttgcacgacgaaatcgaccgcggcgtcatcgccccgggtgaggcgttgcccaccgagcagacgctgtgcgatcagttcggggtctctcgcatcacggtgcgacgggcgctggcggacctggccgcgcagggctacatcgagcgccggcagggcgtgggttcctttgtacgccagcatgatccggccgatgtgccgacagggcgctcatacctgcagggactgcggcagacccagttcgaaaccgaggccgaagtcgtcgagctgggggtgcggtccgcgccccgggcggtcgccgaggccctggggcgctccggcgagttgttacacatcgtgcgggtgcgccggcagcgccgcacccgcgagccgctgatggtgaccaacgcctggctgccgccggagttggccccggtgctgaccgagcgcgcgctgcggcgcgcgccgctgtatgagctgctgtcggcgaacggggtcgccgtggatcgggtgcggcacgagatcacggccgaaatcgccggtccgcgcaacgcgcaactgctcgacgtgccgatcggtgccgccctgctgagggtcaaccggctcgtctacgtcggcgaccgtccgcaccaccacgtctcggcgctgttgtcgccgagccgaagtcgggtgctgctcagccagtccgccgacgacatggagaccggcgacggcctgcggatcgcccacgacgtcggcggcccgcgcggctaagacttaccacgcaaggccctttcgatttcctcggcccgcggcgcgcaatccccggccccgggcaccagggtggccagcgcacccgcggcgcaggcccgtcgcaacgccagccgccgctgatccggcgaaccgggctcgagtggccagttcgccgccagcaccccggcgaacacgtcgccggcacctgtggtgtccaccgcatcgacgtcgggggagggcaccgagtactcgccgtcggcgccgacgtaacgggcaccgtgcgatcccagggtgaccaccaagtgccttggccgccaaggccattcgctggcctcctcctcgttggtgatcaccacgtcggcggcggcggccagctcgctcaacgagtcggggtcccggcctgccggcgacgcgttcaccacgaccaccgctccgccggaccgggcgtgccgcgccgccgcgaccgcggtggcgacaggaatctcgagctgggtgagcatcacgtcgcagcccgcgagcaccgcgcgggcacgctcgtcgttcagcgtgaaccgcccgttggcgcccggggcgaccacgatggtgttctcggcgttggcgtcgacgaccacgatcgcggtgccgctgggcccggggatctcgacggccccgtccagcccgaccccgttggcctgcaggtgcgcccgcaactgcccggcggccgcgtcgtcgccgaccgcgccgacgaactgcacccgcgcgcccgcccgcgccgccgccaccgcctggttgccccccttgccgccgggggcctgccgcaacgacgacgccagcaccgtctcgccgggccgcggcagcgcgtcgacggccagcgacagatcgaggttcacactgcccaccacacagacgtctgtcatgggcgccgaggttagtcgccgccccggcggccaaaccaggccaggggcgcgggccttttgccgcggatccgcgtcacggcaaacggtcaatatccgcgtgtcggcacgctagtctgctgcgttaggcgcgcttctcccgcgagaaaagggcagacgattgaccacgagcgaactcaccgacgccgaatcggacatcgcgcccgccccggcgccgcaacccgcaaagcgcacccggcgaaccccgctgcgcagccggttccggttcggcatccagtccaaaatcctgatcaccatgctgctgtcgagcatcctgggggtcgcggtgatcgggctcatcggcgcggtgtcggggcgcaacgcgttgcgccaggtcgagtccgagcggttgatcgagctgcgcgaggggcagaagcgcgcggtgcaggcgctgtttcgggaggtgacgaactcactgatcgtctggagcggtggtttcaccatcaacgaggcgactgcggcgctcactgccggcttcgcccgactggccaatgcgaccatcacgccggcccaacagcagcagctggtcaactactacgacaaccagatgctcaaaccgatcaaacacgccacgggcgacagcatcgacatcaatgcggtgctgccgaattccaatgcgcagaaatacgttcaggcgtactacactgccgcgccccggcccacccccgattcgctgccggtgcaggacgccggggacggcagcgcatggtcggcggccaacgtccgcttcgatttctacgtccgcgacatcgccacccgcttcgactaccgcgacgcgctgctgctcgacacgcagggcaacgtcgtctacagcgtcatgaagggccccgatctcgggaccaacatcctcaccggcccgtaccgcgaatcgaagctgcgcgaggcctaccagaaagccttggcctccaacgacgtcgacttcgtgtggatcaccgacttccagccctaccagccgcaactcgacgccccgaccgcatgggtggtgtccccggtcgggatgaacgggaggatcgagggcgtgatggccctgccggtgccggccgccaagatcaacaagatcatgaccgccggcggtcactgggaagccgccgggatgggcccggccaccgagacctacctggccggcccggacgatctgatgcgttccgactcgcgggttttcgtcgaggatccgcaacaataccggcgcgacgccatcgacgcgggcaccccgccggacgtcgtggaccgcgcgatccacctgggcggcaccacgctggtgcagcccgtcgcgaccgcgggcctgcgcgcggcccagcgcggcgagacgggcgtggtcaccgccaccgactacatgggcaaccgggagttggaggcctacgccccgctgaacatccccaactccgacctgcactggtcgatcctggccacgcgggacaactccgatgcgttcgcgcggctgggccggttcagcaagaacctggtgatcgcggtcaccgcaatgattttcgtgatctgcgtggcgtcgatgttcgtcgcccaggcggcggtgcgcccggtccggcgactggaggagggcacccgcaagatcagctccggcgactacgacatcaacattcccgtccgggcccgcgacgagatcggtgatctgacagcggctttcaacgagatgagccgaaacctcgcgatcaaggaagagctgctcaacgagcagcgccgggagaacgaccgcctgctgctggcgctgatgcccgagtcggtgctgcaacgctatcgggagggcgaggagaccatcgcccagaagcaccaggacgtcgccatcatctacgccgacatcgtgggcctggacgagctgttcaccgagatgccggaggcccagctggtcggcaccgtcgacgaactcttccgccagttcgactcggcggcggaaacccttggcgtggaacgtattcgcaccttccacaacggctatctggccagctgcggggtggtcacaccgcgactggacagcattcaccgcgccgtcgacttcgcgctggagatcggccgcatcatcgaccggttcaacagccagaccggccaccagctgggcctgcgggtcggcgtcaacaccggcaacgtcgtcagcggtctggtgggccgctccggcctggtctacgacatgtggggcggtgcggtcagcctggcctaccaaatgcacagcggctcaccgcaacccgggaactacgtcagctcgcaggtgtacgaggcgatgcgcgacgttcggcagttcgccccggcgggcaccatctcggtcggcgggactgaccaggccatctaccggttgctggagcgctgatgaacgccttcggctcgtcgtggttctactgggcgatcggaatcgcgatcggattgccgatcgggatgatcgcgctcaccgagatccacgacgccctgctgcgcaggcaaagcccgctggcccggcaggtgggcctgctgcgcaactacctgctgccgctgggtgcgctgctgctgtttttggttcaggcgtccgggattccggccggccacatcccggtgcggatcctcaccacggccttcggcctgctggtgttggtgctgctgctgtccgggctcaacgcgaccgtgttcgaacgcgcacccgaaaagagttggcgcaaaaggcttcccaccatcttcatcgacgtcgcacggctggccctgatctgcgtcgggctggcggtgatgtcgtcctacatctgggagtgcggatcggcgggctgttcaccgcgctgggcatcacctcggtcgtcatcggcctgatgctgcagaactccgtcggccagatcgtctcgggcttgttcatgttgttcgagcagccgttccggatcgacgactggctggacaccgggaccaccagcgggcgcgtcgtcgaggtgaactggcgttcggtgcacatcgacaccggcgccgggatccgcatcatgccgaactcgatgctggcgaccacgtcgttcatcaacctcagccggccgcccggaccgcacaaggtggcgatcgacaccacgttctccaccgccgacgcgcccgaccgggtgtgcgcgacgctgtcccgggtcgcccgcgcgttgccgcaagtcaaacccggcaccgtcgcccgcacggtgcccgtcggcgccgccgggtaccgcaccgtcatctggctggactcacccgccgacgccggcgccgcgaaggccaccttcctgcgctgggcctggtacgccgcccggcgcgaggagctgcacctcgacggcgccgacgacgatttctccacggtgcaacgcgtggagcacgcgttggacacggtcgtcgcggcggccttgcggctcagcgccgaggagcagcggtcgctgcggtcggcggccaggatcgtgcggtacggcgccgacgagatcgtggaggacgccggtcaggtgccgtcggcgatgacgtttctggtgtcgggccgggtgcagctgaccgcgacggccgaggacgggaccgtcgttcccgtcagcaccctggccgaaggcgagttcctggggctgaccgcgctgacccggcaacccaacctggccagcgcctacgcgctggaggaggtcaccgccctggagatcgaccgggaacacatcgagcatctggggacgcgggccccggcgctgctgcagaacttcggccgcatcctcgaggagcgccgcagcaaggtgcgcggcgcccggcgcggcgagcgggtcggctaggggccggccgggcccggcagcgggccgcctcacccgggcgtttgcggcccgataccctggttcaatgggtctgcaagcaccattccgcagcggtggcggcacctcgcgcccgcagggccgggccgcaccccgcgcggtcgacctgcgccgggaggtgcacgacgcggcgcggcgcgcccgggtggcttcccgggtgctggcgctgttgcccgccgtcgccaaggaccaggcgctgcgctcggccgcggacgcgatcgccggccacgccgaattgattctgtcggccaacgccgaggacctcgagacggcccgggctgccggcacgcccagcgccatgctggaccgattggcgttggacaccaagcgggtcgagggcatcgccgccgggctgcgccaggtggccgggctgcccgacccggtcggggaggtgctccgcggctacacgttgccgaacgggctgcagctgcgccagcagcgggttccgctcggcgtggtcggaatgatctacgagggccggcccaacgtgaccgtggatgcgttcggtttggcgctcaagtccggcaacgcagtgctgttgcggggcagctcctcggcgacgcggtccaaccaggcgctggtccaggtgttgcgggcctcgctggtcagcgaggacctgcccgccgacgcggtgcagctgctgtcggccgacgaccgcgccacggtgacgcacctgatccaggcccgcggcttggtggacgtggtgattccgcgcggcggggcgaacctgatcaacgcggtggtgcgcgacgcccaggtgcccaccatcgagaccggggtgggcaactgccacgtgtacgtgcacgaaggcgccgacctggaggtggcggagcgcgtgctgctgaattccaagacgcgccggcccagcgtctgcaatgcggccgagacgctgctggtggacgccgccatcgccgaggaggcgttgccccggctggtgaccgcgctgcaggacgccggggtgactgtgcacggcggcttcgcccgcgacgccaccgaggacgacctgcggcgcgagtacctgtcgatggacatcgcggtggcggtagtcgacggcgtcgacgccgcgatcgcccacatcaacgagtacggcaccgggcacaccgaggccattgtcacgacgaatatggctgcggcgcaacggtttaccgacggcgtcgatgccgccgcggtgatggtgaacgcgtccaccgcgttcaccgacggcgagcagttcgggttcggcgccgagatcggcatctccacccagaaattgcacgcccgcggtcccatggggctgcccgaattgacgtcgaccaaatggattgcgtggggagacggacagacccgtccggcctgatccgcatccgaaagtgcttgaggagaaccgattgtgagtgtgcccgcccggcccaggccgctgttcgccgacatcgacgacgtctcgcggcggttggccgagaccggctacctgcccgataccgccaccgcgacggcggtgttcctggccgacaggctcggcaagccgttgttggtcgagggcccggccggggtgggcaagaccgagttggcccgcgcggtggcccaggccaccggctcgggtctggtgcgcctgcagtgctacgagggcgtggacgaggcgcgcgcgctctacgagtggaaccacgccaagcagatacttcgtattcaggccggctccggggactgggaccaaaccaagaccgacgtgttcagcgaggaattcctgctgcagcgcccgttgctgaccgccatccgccgcaccgagcccaccgtgctgctcatcgacgagaccgacaaggccgacatcgagatcgagggcctgctgctcgaggtgctctccgatttcgccgtcaccgtcccggaattgggcacgctgaccgccgagcggcccccgttcgtggtgctgacctcgaatgccacccgcgaactctcggaggcgctcaagcggcgctgcctgttcctgcacatcgactttcccagtcccgacctggaacgccgcatcctgctgtcccgggtccccgagctgcccgcgcatctggccgacgagctcgtccggatcatcggggtgctgcgcggcatgcagctcaagaaggtgccgtccatcgccgagaccatcgactggggacgcacgctgctggcgctgggattggacaccatcgacgacgccgtcgtcgccgccacgctgggagtggtcctcaagcatcaatccgaccagcagcgcgcaactggcgagctgcggctgaattaggaacaccgccatggccacccgccgcatccgaccatcccggccgctcgccccgcacgggctgcccggccacctggtcgggttcgtggaagcccttcgcggagcggggatttcagtcggcccgtcggagacggtggacgccggccgggtgatggccacgctcggcctgggcaaccgcgaggtgctgcgcgagggcctggcgtgcgcggtgctgcgccggccggatcaccgcgaaacctatgacgccatgttcgacctgtggttcccggcggcgctgggcgcccgcgcggtggtcaccgacgaggacgccggcccgggctccggcgaggacgcgttgccgcccgacgacgtcgaggcgatgcgccagatgctgctcgacctgctgaccgagaacccggatctggccgacatggacgagcgtctggtcgcgatgatcgcccggatcgtggaggcctacggcaaatacagctccagccgcggcccgtcgttctcgtcgtaccaggcgctcaaggcgatggcgctggacgaactcgagggcaagctgttggccgggctgctcgccccgtacggcgacgaacccactcccacccaggaggagatcgccaaagcccttgccgcgcagcggatcacccagctgcgcaagctggtcgacgcggaaaccaagcggcgcaccgccgagcagctgggccgcgatcacgtccagatgtacggcatcccacagctttccgagaacgtcgagttcctgcgcgcctccggtgagcagctgcgccagatgcaacgggtcgtcgccccgctggcccgcaccctggccacccggctggcggcccgccgccggcgcagccgggccgggacgatcgacctgcgcaagacgctgcgcaagtcgatgtccaccggcggggtgccgatcgacgtggtgctggccaagccccgcccggcccgcccggagctggtggtgctgtgcgacgtgtccggctcggtcgccgggttcagccacttcaccctgctgctggtgcacgccctgcgccaacagttctcccgggtgcgggtgttcgcgttcatcgacaccaccgacgaggtcacccacatgttcggcccgcaagccgacctggccgtggccatccagcggatcacccgggaggccggcgtctacagccgcgacggccattccgactacggcaacgcgttcgcgtcgttcgagcagaagttccccaacgtgctatccccgcgcacctcgctgctggtgctcggcgatggccgcaccaactaccgcaacccggaggtcgagctgctgagccacatggtgaccgccagccggcacgcgcactggctcaatcccgagcccaagcatctgtggggcagcggcgactcggccgtgccgcgctaccaagaggtcatcccgatgcacgaatgccggtccgccaagcagctcgccgcggtgatcgaccagctgttgccggtgtgaggcgccgttcccgcccggcgtcacgctggcgtgacgctcggcggcgccggtcacgccagcgtgacgctcggcagccgagggcggcgggctgggaaatcgggccaggtcaccggctcaagtaagctggcacatcgtgcaaaagcagcttcgcaggttgggagtgatgggtgggacgttcgatcccatccattacggccacctggttgccgccagcgaggtcgccgacttgttcggcctcgaccaagtggtgttcgtgcccagcgggcagccctggcagaaggaccggcacgtctcggcggccgaggatcgctatctgatgacggtgatcgcgaccgcgtccaatccccggttctcggtgagccgggtcgacatcgaccgcgccggccccacctacacccgggacaccctgcgcgacctgcacgcgctcaacccggactccgagctgttcttcatcaccggcgccgacgcgctggcctcgatcctgtcctggcagggctgggagacgctgttcgagctcgcccacttcgtcggggtcagccgacccggctacgagctgtgccgcgaacacatcaccggtgtgctgggtgagctgcccgacgacgcgctgaccctggtcgagatccccgcgctggccatctcgtccaccgattgccgtcagcgcgccgcgcagcgccgcccgctgtggtacctgatgcccgacggcgtggtgcagtacgtgtccaagcgccggctctaccgcgccgagccggggcccgcggtggccgtcaccgaaaccaggctgagcacaggggatcacccatgagcgccacgcaggaagccatcgacatggccacggtggccgccggcgccgccgccgccaagctcgccgacgacgtcgtcgtcatcgacgtctcggcccaactggccatcaccgactgcttcgtgatcgcctcggcgtccaacgagcgacaggtcaacgcgatcgtcgacgaggtcgaggagaagatgcgcaaggccggctacaagcccgcccgccgcgagggcgctcgggagggacgctggacgctgctggactatcgcgacatcgtcgtccacatccagcaccgggacgaccgcgacttctacgccctggaccggctgtggagtgactgcccggtggtgccggtgaacctggacgaggatcggcaaaaccccggcgacgcgggcacgccatgaagattcgtcggctgatcatgttgcggcacgggcaaaccgagttcaacgccggcagccgcatgcagggccaattggattccgagctcagtgaactcgggcgggcgcaggcggtcgcggccgccgaggtgctcggcaaggcgcagcccctgctgatcgtgtcgtcggacctgcaccgcgcctacgacacggcggtccggctgggggagcggaccggcctgcccatccgggtggatcggcggctgcgggaaacccacctcggcgactggcagggcctgacccacacccaggtggacacccaagcccccggcgcccgcctggcctggcgcgaagacgccacctgggcgccgcacggcggggaaagccgggtcgacgtcgcggcccgcagcgtgccggtggtggccgaactggtggccggcgaaccggaatggggcgatcccgacggcccggatcggccggtggtgctggtggcccacggcggtctgatcgccgccctgtcggcggcgctgctgaagcttccggtgcccaactggccgatgctgggcggcatgggcaacgccagctgggtgcagctgtccggccattccgatgatgccgccgacgaattcgacgacatccgttggcgtttggacgtgtggaacgcctcggcgcaggttgccaacgatgtcctctgaacagcggccgcggcccaccctgctgatcttcgccgactcgctggcctactacgggcccaccggggggctgcccgccgacgacccccgaatctggccgaacatcgttgccgcccaactcgattgggatgtggaactgatcggccgcatcggctggacgtgccgcgacgtgtggtgggcggcgacccaggacccgcgggcgtgggcggcgctgccccgggccggtgcggtcatcttcgccaccggcggcatggactcgctgccttcggtgctgcccaccgcgctgcgcgagctgatccgctacgtgcgtccgccgcggctgcggcgctgggtccgcgacggctacgggtggctgcagcccaggctctccccggtggcccgctcagccctgcccccgcacctgagcgtcgactacctcgaacagacccgcggcgcaatcgatttcaaccgtcccggcatcccgatcgtggcgtcgctgccctcggtgcacatcgcggacacctacggcagggcccaccacggccgcgccgccaccgcggccgcgatcaccgaatgggcgcaaagccacgacatcccgctggtggatctgaaagctgctgtggcagaacacatcatgagcgggcggggaaaccccgacggcattcactggaacttcgaggcccaccaggcggtggcggagttgatgctcaaggcgctggccgaggccctgccgaagaccgtgccgcccaccgagaaacggtagcggcgctcgtggctgtcgtggtggtcaccgactcgtcggcgcgtctgccggccgacctgctcgggcagtgggggatacgcgtcgtcccgctgcacatcctgctcgacggcaccgatctgcgcgacggtgtggacgaggtgcccgccgacattcaccagcgcgcggcgacgaccgcggcggccaccccggccgaactcgccgacgcctaccagcaggcgctggccgacagcggcggcgacggcgtggtggcggtgcacatctcgtcggcgctgtccgggacctgccgggccgccgaacgtaccgcggccgacctggaccccaacctacgcgtcgtcgactccaagtcggccgcgatgggcaccggcttcgtcgcgttggccgccgcgcgggcggcggccgccggcgcgcagctggacgccgtcgccgacgccgcccgcgccgccgtgtcccgcgggcacggcttcatcgtggtgcaccggctggacaacctgcgccgcagcgggcgcatcggcggcccggcggcctggctgggcaccgcgctggcgctcaagccgctgctgcgcatcgacgacgggaaactcgttctggcccaacgggtccgcaccgccggtcacgcgaccgaggcgatgatcgatcgggtctgtcaggtgatcggcgacggcgccgccgcgctggcggtgcaccacgtcgacaacccgggcggtgccgccgaggtggccgccgcgctgggcgagcggctaccggcgtgcgacccggcgatcatcaccgagctgggcccggtgctggcgctgcacgtcggggcgggcgccgtcgcggtcgtcgtgcagcagccggggtcctaggcccgcgcgctacgacgccgccggcaccggccgccgcgcgttgtcaccccgcgggtgcaccaccatcggccaccagaaccagcggcccaacagggtggcgatcgacggcatcaacagcgtgcgcacgatcagcgtgtccagcagcagaccgatgcacaccgtggacccgaactggccgagcacccgcagctcgctgcccagcatggccgccatggtgaaggcgaacaccaggccggcggccgtcaccaccccgccggtgccggccatcgaccggatgatgccggtcttgagcccgccgtgtatctcctcgcggaaccgggagaccagcagcaggttgtagtccgatccgacggccagcaggatgatcaccgacagcgccgccacgatccagtggatccggatgccgaacaggtcctgccaaatcagcacggacagaccgaaagacgccgcgatcgagctggccgcggtgccgacgatcaccagcgcggccaccacgcttcgggtcagcagcagcatgatcatgaagatcagcgtcagcgccgacaccacggcgatcatcaggtcgtacttctcgccgtcggccatgtccttgaacgtcgcggcggtaccgccgagatacacccgggcatccgacagcgaggactgtttcagcccctcctgcgcggcggtgcgttcggcgtcgacccgcttgatcccctccggcgacatcggatcgccctgatgggtgatgaagaaccgcgccgacttaccgtcgggcgacaggaacatccgcagacccgtctggaagtcggggttgtcgaacgcctcgggcggcaggtagaagaagtcgtcgttcttcgacgcgtcgaagctctgacccatcacgacggcggtgttgctcatcgcctccatctggtcgatcatcgccttgaacgtctgatacagcgtcagggtgatgccccgcgtcgtcttcagcgtggtgatcagggtggggaacagcgcggtcaggtcgcgcgaggccttggccgtgtgcgcgatgtcggtcgtcaaatagtggaactgctcggccaattggtcgaacccgtcgaatgtgtcgaacagcgaccgcagcccgatgcacaccggaatgtcgtagcagtgcttctcccagtagaagtaggtgcggatcggccggaaggtgtcgtcgaagtccgcgatgtggtcgcgcaggctgtcggtgatctgtgacgtcaccgccgtggttttcgcgctgtcgtcggcggcgttggccagatccatcgacacctcgtattggcgctgcgtggtgtcgatctgggtctgcaggtcgtcggccatcttgaggatgtcgttcatgcgctccttgaggaagcccatgttctgcatcgtcgtctgactttgcacgctgttctggaacggaatcgagctgtgctggatcgggattcccagggggcgggtgatgtcctgcaccatggcgatgcccagcgtgcgcatctcgttcttggccacccggtccagcaccagcatgtcggccgggttgcgcatgtcgtggtcggattcgatcatcaacaggtccgggttcatccgcgcctcggagaaatgccgattcgcggcctcctgtccctgattggacggggccgacagcggcaggtagtgccggtcgttgtagctggtgtgaaagctcggcagggcgatcatgccgaccagcaccaccgcggcgctgaccgccaaaaccggtgccggccaacgcactacggccgtgcctacccggcgccacagccgaccccgcttggcctgccgttcgaagaagtggaaccggctgccgacgaagaccaccgcggggcccagcgtgacgtcggccagcaccaccaccagcatgccgatcgccaccggcgcacccatggtgttgaaccacggcagccgcgaaaaactcaggcagtaggtggcgccggcgatcgtcaggcccgaccccaacacgaccggggcgacgcccttgaacgtggtgtagtacgccgattcccggtcctcgccggcggccagcgcctcctgatagcggccgatcaggaagatgccgtagtcggttcccgcggcgatcgccagcatggtgaggatgttggcggcgaaggtggtgagcccgaatgcgttgtgatacgccagaaccgcgaccacaccccgtgagcacgccaacgcgacgaaggtcatgaacagctgcaccagcgtggtcacgatggaccggtagaccagcagcagcatgatcgcgatggcgcccagggtgaacagcgtgatcttggccaggctggcgttaccgatgatgtgcatgtcgtcggacagcgccgccgggccggtgacgtaggccttgacgccgggcggcgccttgttctcgtcgatcaccttgcggacggcgtcgacggattcgttggccagcgtggtgccctggttgccggcgaggttcacctgcacataggcgcccttggcgtcggcgctctgcgcccccgcggccgtcagccggtcgccccagaagtcctggatgtgctggatgtgcttggggtcctggcgcagctggcgaatgaggttgtcgtagtacttgtgtgcgtcggggcccagcggctgctgaccctccagcacgatcatcacggtgctgttggagtcgaactcgtggaagttgtggcccagccgcatcatcgccttcatcgacggcgcgtccagcggtgtcatcggcgccgagtgcgcctcgccgaccttttccagcgtcggcacgatgacgttcaccagcaccgtgacgaacaaccagcccaggatgatgggcaccgcgaagatgcggatcgcatgcggaaggtagggccggtggccccgctcggccttggacagccccttgacgttgatcggaccggtgtcggccgcgctcaggtcgggttgggtcttgttgctcgcgtcgctcatgcggacttcaccaggcagaaggtttgggcgttatggccgtcggagttctggttgtcgcggacgacgccgtccacggtgatcttgcagctgatggtgctgccgtcgctttgggccatgatgttggcgctcaccgagggcagcgtggtcgagatcgtggtcgaccagggcagcggggcgttgttgacctgatgggtgttggcgttctcgtcccagtagttgatgttggccgtgctgcccggcgcgccggagatttcgtagacgacgaccttcgggttgaactgcacgatttcgatccccttgcccgcgttcgcgttgagatcctccgacccgaagatcttgtgcaaccgcgacacgatcagcgccgagacggccagcacgaccaccaacaccagcggtatccacgcttgtttgcgcgcgcggctcaggacgcctgggcggctctctgagtttggaccagccaccacctgaccgccttccgcaaagctcaccaaccgtcgccgacgacaccaatgtcaacggaacatttgctcagctaggcatcctaaccttagtgcacgcaagcgttcctcccgggggccgtccggtgtggcgaacggcataggcgtcagcccagccggccggtgaccggcggtagatccgccagcgtcacgatccccggtctggccgccaccaccgccggcaccgcgttggtgaccggcatcgcggtgtagatcatgccgagccccatgaatccgggttcggtccagtccttgggcggcaggcagtgcagcacggtgcgcatgttgggcagcccgaacacctggatgacgtggccgtgctcgagcggtttgggcggcaccacgtgatcgcccatggtccagttgaacccgacgctgacgacgttgcgctcgccgacccagccgcggtgatagccgtagacgctgccgaccgtgccggccggaatcttcatgaagcccaggtcggagtcgccggtggccgcggtgaaggtgacgtcgaaggtcatcttgtccagcttcgccccgatcgcgtcggccatcatcgccgccgactcggcgaacacctcgctttcccgccgcacgctttccgccaggcccggggtgtcggggtcttgcgaaaaccccatggccgtctgggtttccgccgattcgtaggtggagcagtccaccgactcggtgatccggatctcgtcgacccgctcgcaggacgcggacagcaccatgccgaccatgttggtcatgcccggatgtgcgccgctgccgaagatcgtcgaattgcccttccggcaggcctcttcgatgcgccgacggtcttcgggcgtctgcttgccgccggtgatccaggccgcgctggtgcacacgttgacgcccgactccagcagccgcaccagctcatcgacgttgggccacaacgggttatagcaacacgcgtcggcgcccagggacagcagcgcgtcgatgtcgttggtggccgccaccccggtcggctccggccagcccgccagctcggcggcgtcgacgccgaccttctcggcgccgtgcgcatagaccccgaccagttccatgtcgggccggccgatgatggcgtgcagcgaacgccgcccgatgttgccggtggtccactggatcacccgcagcggacgggtggtgcttggcttgctcatcggggctcctttgccgtgcgattgcctcattatgttcatcccggctccgcgcccgcgcgccgggcctcaaagtccggtcacgccgaccgtgaggaacacacagccggccgcggccagcaggacggcgacctgaggtctgcggcgcgatcgaatccagttgtgcaacgccgtcatcgacgcggcggttctggcgggcgccaccagataggccagcagcggaatctcgacgagggcgaaggccacgacgttgaacagcagcagcgcgccgacctgcgtcgcggccgccgcgcccgaggccacgatgacggcgagcgcggcgagatagtcgaccgagggcaacgcgatgccgaggccggcgaggcccgcgaccgacaacgagtcgccgttcagcaatcgttgggccggccgcgccatcgcggcgggccgcgaacccaaccggcgggggacgtccaccgccagcgccgccgcgaccagcagcgccagcacaccgatcagcagctgaaccttcggcacggtgaagtaactggaccccagcagcacccgccgcagcaggaacagcaccaccaggcccaccgtcatgcccatggcgaaaccgccggccaggaacgcgagcaactgcagcaccggtctgggccgcgtcatcatcagcacggccataccgatgcggaacggttcgacgctgacggccgcggccatgaccagcacggtgatcaacatcgatatgcctgtgaggcggcccgatcggcgagcgcctccctcagctgtccaaccgggtgaattgccgctgacggtactgctcgatacagccggcgcggcggatcttgccgctcgtcgtggtgggaatggatccgggcgataccagcacgacgtcgtcgacgttcaggccgtgcgcgttggatatcgccgccgtgacatcgcttttgacgctcgcgattcggtgcgacgtgtccgccgaatcgctgcgctctttgaattcgatgatggtgaccagcttttcggtgccgttcgccgggaccgatatcgccgcgacccggccgcgggtgatctcgtgcacggtcgcctcgatgtcctcgggatagtgattgcggccgttgatgatcagcaggtccttgatgcggccgacgatgaaaagcgcgccgtcgaaaaggaaaccctgatcgccggttttcagccagggcccgccgggcgtgccgggcgagggatcccgcagcgtggcgccgaagcaggactgttcgtgcggcagcttgcgccagtagccgtcggccacgttttcgccatgcacccagatctcgccgaccacgccgggcgggcactcccgctgggtgtcgccgtcgacgatgcgcagcgtcggtgactgcggcacttggtatttgaccaacgcggtgccggacccggccgcgcaccgccgggcgcgtccggcggacagttcgtcggtatcgaagcggaccgctcccgacgactcattccaggtgccggccgccgcgaagacggtcgcctccgccaagccgtacgacggacgcaccatctcgtcgcgaaaattgaagtgcgcgaaccgatcaacgaagcgttgcaaggtggccggctccacccgttcggcgccgctgatgatgcccagcaccccaccgaggtccaggccggccaggtcgccgtcggttgtcttgcgggccgctaagtcgaaggcgaagttaggtgccgccgaccacgcgtgcgggctgctggccagggcctgcacccatcgggccggccgctccaaaaacgaaagcggactgctcaactcgccccggtagccacccaggaccggggcgcagaccccgagcaccaaacccatgtcgtggtagaagggcagccaggacacgatggttagatccgagggggccttgacgtgggcgtcggcgaaaaagccgcgcatcaactgttcgaaattcaccttgaggttgcggtgcgagatcatcaccccggtgggctgccgcgtcgaacccgagctgtactgcagataggcgacgctgggcaggtcggccgcccgcacgtgtggtccgccgtcgacgtcgaggttcagcgaatcgatctcgacgatcttcggaaccgcgtccaggcaggccttgtccacgtattcggtgatgtcttcggcgaccgcggacgtcgtcaggacgacggacggcgaggtgtcggcaagcaccgcgctgacccgctcatgactcgagccgcggtgcggcaacgggagtggaaccgcgacgagcccggcctgcatcgagccgaggaacgccgcgatgtagtcgaggctttggggcgcaaggattaccgcccggtctcccaccgaaccatgaaggtgaagctcacgcgccacgttgatggttctgcgcgacaactgcgaccaggtgaggctctcccgaacacccgcccagtcgcgctcgtaatcggtgaaggtgaacgcgatgtcagcgggacgcaggctggcccgtgcgtgcagcatcgacagaatagatgactgggacataggcatcacatcacgtccgtactgatagtcggtttttcgtgctcggagtcagtggtcggcttcgcccgcgccgtgcgacaacacggacatggccccggccatgatctgcgacagcgggtcggcgccgccgccgaacgtcgcctggttggccggcgcggtgacctcggccgggtcgaagccgtgcaccgggtccacctgcaccggggcggtcgccgggtcgtcgttgcgtgaatagcccgcgttcacccggggggtcaggatcgcatcgagcttgttcagcgtgttttcgtcgatcccgatgtatctcagcggcatcaccagcggaaggtgcttttccgggatcatgatcgtggtgtctttggcgccacgggagttgatcgtggttctgatgttctgcggcggcaccatgctcggattggtgaaggccaccgcggtgtgacccgtcgccagccccatcagcgtgttggcgagcgcgaacatgttgtccggccgatcgggaaagtccgcaatcgagtcgtatgcggcgacgaacctgttggtgtcgtactggctctcgtacggcggcggcatggtgtagtccagtgcgggaacgacgctgccgactccgaacatggcggtcagaaagctctgaccgaaggcgtgccgcccgatcgggtcgccgaacgtggcgaagttcagcgtgttcggcgggggagcggtggggtcgttcgccaatcgggcctgctcgccgtcgaccacgaacgcgccctccgacaggccgatcgcggtgccggggcgcccggtggtgcgaatcgccgcatcgagattgtcgatcccctcggcgaccgattcgcccacgctcgggccgttcatgcccaggccggggaaggattcgtcgagcttgccgatgcccgggaagagtcgctcgagcacgtgtccctgcacctgcccggccgggtagcgaacgatttggcgctgctggccgggaaaccagtccgcgccctccatacggatgtattggtcgtaggggatgcccaacacatgcgcgccgccaagagcgtaggcggtctggtcgcccggcgcgccgggggtgggcggtccgccgatgggcccgccgtcggccgctgccgtaccgatgccgaaataccctgcggtactgacacttaacagcgccgtcactcctgcgagtagttgcttcatccctactcctgacccgtcggcttctctagtctcacatacgtcatggctgctcgctaaccgggttccgccggacggccatgcgtgacggccaccagttggcccgcccggccagcgccgcgatggcgggaacggtgacggtgcgcaccaggaaggtgtccagcaggatccccaccccgatcaccacaccgccctggaccacggtgccgatgctggagaacagcagaccggacatcgaggccgcgaagatcagacccgcggcggtaatcactccacccgtggaactcagggtgcggatgatgccgtagcgcatgctgtgcggcgactcgtcacgcatccgggagaccagcagcatgttgtagtcggctcccaccgcgaccagcaccacgaacgccagtggcggcacgctccaatgcaattgctggccgagcaaaaattggaataccaacacgccgacccccaccgccgacaaatacgaaatgaccacggtggcaaccagatacagcggcgcgacgatcgcgcgcagcagcgccatcaacgtcaggagcaccaccagcaggtgaccgcgatgatgaatttgatgtcgtgctggtagtagtcccgggtgtctttgaggccgacggtgtatccggccatcgacacctcggcatcggccaaggcggtattgggctgggcgccccgggccgtggccgtgatcgcgtcgacctgatccatggcttgggtgctgaacggactcagtttgctttgcaccaggtagcgcaccgagtggccgtcgggtgagatgaacaccttggcggcctcctgaaactgcggcagacgcagcagctgcgccgggatgttgaacccggccatcgccgggtgggccgcgtcgtgcttcaacgacaacaaaaacgccgccgactcgctgagccccgcgcccagctgcttgaccttgtcgacgagttgggccaccgcgtcggccacctgccggctgccgccggcgaattggtcggcgccgttttgcagggtggtcaggttggactgcaggccgccgggccgatccattcccatcgcccgcagcacgtcgttgagtttggcgaaggcgttgcgcagccggtcggtggatgctttcagggcccgtttgtcgggataggcctgcagttggtgagacaggtcatcgatcgcgtcgaggtcggcctgaccgcgcggacccaccaattgctcgaacgtcgcgcgggtggcgctgcacgacgagtcggcgtcgcagaccgggttgccctgcagcgccgccagcaccgggccgatccaggcgaacatgttcttggcggcggtgaagttccaccccatggcgttgctgagcgagttgacgtggtcgaccaggcgggccgcgatgtcgacctggttgaccagcgcgtcgccgctgtactggtttttcgtcgacgagaacgcattctccagttcgcgcacgctggcggcgagctggttgacctggccgcggacgtcgccgaggttgtcggccagggtgccggccccccgggccaggcggttgaggtcgtcggtttggtcgttgatcatggtggacccgccggccagcatgctgccgatcgctccggcctgatacgtggcccggaattgttccggcacgttcccggtggggcgggtgatgccgctgaccacgctgacgttcggcagttggctgactcgatcggccagctgttccaggtcggcgagggcctgcggggtgcgaaggtcgtgcggtgaccggatgaggatgtactccgggatggactgattcaccgggaagtggcgctccagcgcggcgtagccgaccgaactcggggccgacggccgcaacgccttgcgatcgtcgtagttgtagcgcaccaggcccgcgcagctggccaggatgatcagcaccagcacgctggccaccaggtgggtccgcggccggcgcacaatgcggatgcccgaacgccgccacagcccggtggtcagttcgcgccgcggcctgatccaaccccgcggcccggcgagcaccatgatggccggcagcaacgtcacggcggcgagaaaggccacgccgatcccgatcgccgacgagatcccgaccgtcttgaacacgcccatccgggcgaagccgatcagcagaaacgtgatcccgaccgtactggccgacgcggtgatcaccttgccgatcgagatcagggccttcctgaccgcctgatcgaaatcgtccccccggcgcagatagtcgtgatagcggctgatgagaaagacggcgtaatccgtcccggcgccggccatgatcgcgctcaggaacacgatggactggttggatacgcccgagcccgtcaattgcgagtagcccgccacggccgcctgcgcgatcaccagcgacaacaggatcgtcaccaacggcagcagcatcgtgaccgcactgcggtaaacgaccagcaggacgacgagcaccagaacggcgatcgccagctcgatcggcagtcgatcccgctcgcccgcgacggtgaggtcggcgacggtcgccgcggggccggtgaggctcaccgtcaaagacgttgcggccggaccgttttcatgtttttccagggtctgtttgacgatgccggcgatccggttgaacgccgcgtatgactgcggggtgcccaactcgcccgcgacgccgacgggcagtacccaggctttgcggtccttgctggtcacggccgaacgcagcggcggcgcgctgatgaagtcctgcaccatcaccacgtcacgggtgtcccggcgcagcgcgtccaccagcctgcggtagacggcttcgtcggcggggcccagacccttctcgtcggtcaacgccaccaacagcaggtcatccgagctcgattcgtggaacgcctcggtcatctggcgggcggcgacattggacggtgcgttgccgggcaagatcgccagcggatgcttctgggccatctcggccagggacgggaaggccagcggcagggcgaccgccaatgccgcccagaacccgatcaccagccagggccagcgcaccacgaaatcggctatccggcgcatctcgacctcatccccggccggcgcggtcggggacacccggcggcacccgccgacgccgcagccgagccgcgcgattttccacgcgatctttcaggagccatcgaactaacccacgctacgcaacgcgcccccaatgcccggtgtcggcgacccgcccgcatacggacctcatcgtctccgtgtagcgggcaaccgacttgtgagcgaccggattgtccgggtacatcatggccatggccgtgccatcgccgtaccggaacacgtaaatggtgagctgataggaataccggccgtcggagtagatcccgatgttgttggcatagccgaggtcggccgcggcgagcacggcattaaggggagcggcgccggcgtggaagaaattcgagaccggaaagttgggttgcggccacttcagccagggcgccaattccaatacccggtaatagggcaccttcgccaattgctggcccgaatcgaacgaggtctgtgccgtccacgcggcatcggcgaacgaggccgccgcgatgggcacggtgatcgggaccaggccggtgaaccagccctgcgtcatgaaattgtccgtggttcggcgggtgtcccggggggtgaggccgtaatacgtgagggcgccggtgagctcgtgctccaccagggcgatgcaggcgaacaagccgccgatgaaccgcacgccgacggcggtgcaggccgattcgaatcgctccgtctgttcggcgtccatcaccagctcggagaccatggcgctggcggtcgcctcggacgggttgcccagcggcagcggaaattccggaaagctgccattgttgttctccgcgaagtcgatccacgcgcgcacttcgggcgaatccacggtcaacgccgacgtgtactcccgctcgcgggcgcaaaagtcgtcgaagctgccggcatcgggcagctcgaggggttcgccgcccgcgctcgccgccgcatacatgccgttggcctcgagcatcgtcgtgccgatcagcgtcgcgtccccgtgcacgtgatccatggcggcgaagaaagtgaaatattcctcgttttgcacgaccccgaacgtgaagcagccccactccagcggatttggtatcgccacgacatgagcgcgtatttcctccgccgtcatttcgccgtggtggatcggggcgaattcgatgtcagcggggttgctgacggtgtgcctgacgaactccccatcgccgctgtggtggaaccagctgcggaatgtgtcatggcgccgcaagtaggcgttgacggcgtaattcatcgccgagatatcgcaacggcccggcacgtcacaggtagcgatgatttgacgggaaaaatcgagccccgccgcggtccgctcgtgataattgcgcaaatgctggccctgcatgtagctgaccggaacgggactggccggcgcttggcgcaccttctcggccgccgcggcggtcgggtgccaggaggtgaccggtcccggggtcggtgtccaatcaccgagcgagccgatcgtgattttcccgatgcgcaatctgttctcctcggtccggacggccgcggttcggccccgctggcggcaccaacataaccccggcggcaatggccgtcgccgcgaagcgcggatatgcgtgcaacagccgaccggcacggcggtgttggcgggacggatccggccccgcgccggacacaggccggcgcggacacttgacgatacccgcgcgattacccgacgatactgatgcaacgctccgcggagaagacccgtactcgttgaccttgcagatgcgcaaccggaacggcatgcgtacattcgctgtacgacttgttcgttcgctgccacaggtttgcgtcggtgatccagcagcggctgggccgcggtaaagacccttgagcttgctgggagtgtcgagatgtcggacgaacgccgtgtgggagcgggctgatcatcgcacctctgaacgcgtccggacgcatgcattacgttgcgggacaaggcattccgcgtgacggtcgaaatcgatcggatccgatgaggcgaccctgtggttgcggagcggacgggcgggagacgtcgcgctcggttggttgtctgcggtgggatggacaagggcccctcgggcaggcggctgtcagcggcccggcggcggcatccgcccgccggtccggtcccgcgctcgtgttgtatcatcgccgcctataccgaaagccttcctgcagtccattcgattggcggaaagcgcgaatttggatgcggtgcttgaggatatcgacggcgtctcggggtgttggcactccgagcaggggccggtgagtgtgcggcaaggagcacgacggttgccggaggcaggacctggtacggaacaccacggcggtggtgctgaaaggccggcccgcgaccatgggtccttcgctggctgagggagagaggacaaccgcatgtcgaccgtcgagggtctgagggacccggcgtccagtttcgcgatcgttggctatgcggcgcgttttcccgacgccgcggacgccgatgaattctggcgggtgctggccgaaggccgggacgcggtatcggaggtgcccaaggaccggtgggacgccgacgagttcttcgacccggatcccgacgcgcccggcaaagttgtcacccgccgggccggtttcgtcgacgacgtaaccgggttcgacgcgccgtttttcggcatgtcggcgcgcgaggccaggctgctggacccgcagcatcggctgctgctcgagacggcgtggcgggcggtggaacattgcggcaccgcgccaacggatttggcgaacaccaacaccggtgtgttcatcggaatatccacccacgactacctggggatggcctccgacgagctgacctacgaccagatcgaggcttacacggcgatcgggacatcgtctgccgccgccgcgggacggatcagctatcggttgggactgcagggcccggcggtcgcggtggacaccgcgtgcagctcgtcgttggtggcgatccatcaggcgtgccaagcgctgcgtctgggggagtgcgacctcgcgctggccggcggcgcgaacgtcctgctcaccccggcgaccatgatcaccttttcccaggcacacatgctcgcgcccgacgggcgatgcaagaccttcgacgcggccgccgacggctacgtccgtggtgagggatgtggcgtcctcgttgtgaagcggctcgaggacgcgatccgcgacggcgaccggatccgggcggtaatccggggcagcgccatcaaccaggacggcgcatcgggcggtttgaccgtgccgaacggcgttgcccagcaacgagttatcgccgaggcgctgcagcgcgccggcatcgcacccggcgacgtcgactacctggaggcgcacggcaccggcacctcgctgggcgatccgatcgaggtccaggccgcaggtgcggtgctcggcgcggggcgcgaggccagcagaccgctgctgatcggctcggtcaaaaccaacatcggacacctggaagcggccgccggcatcgcgggcgtgatcaaggtgatcctggcgctcgagcacgggatgctgccgcaacatctgcactttcgcgatccgtcgccgcacattccctgggatcggcttgcggtgcaggtcgtcaaggaggcgaccgcgtggcaacgcaacggccggccccgcgtggcgggcgtcagctcattcgggttcgccggaaccaacgcgcacgtcatcctcgaggaagcacccgacgggacgggtcgggccgcggtaccaccggccgccgtccggccgcccggtcagcgccggttccacgtacttccgctgtcggcgcgaacgcccgccgcgttggtgcagatcgccggcgagtaccgcgactggttgagcgcgcatcccgacaccgccctggccgacctgtgcttgaccgccggggcgggccgggcacacttcgagcaccgggccgcgctggtggtggattcgacggggtccgccggtgagttgctcgcggcgctggccgacgaccggccggccccgggactgctgcgcggggtttgcgaggacgcgccgaaaacggcgtggctgttcaccggtcagggcagccagtacgccggcatggccagagagttgttcgacaccgagccggtgttcgccgagacgctgacccgctgcgccacggtgctcgccgatgttctcgaaaagccgttgctggacgtaattttcgatacggatgacccggccagcgaagagacgttgcggcagaccagctacgcccagcccgccttgttcgccgtggagatgggtctggcccggctctggcagtcgtggggcttcgaacccgacgtggtgctgggccacagcgtcggccagtattcggcggcctgcgttgccggcgtgctgcgcctcgaggatggggcgcggctgatcgccgagcgcggccggctgttcggcagtttgcccgcgggcggtcggatggtggcggcgttcgccgccgccgcccgcgtcgagagcctcaccgacgagttcccgagcttgtcggttgccgcgtacaacggtgccaacaccgtgttgtcgggaccggggcaggagctggagcaggcggtggcccggttgaccgccgagaaagtccggtgcgactggctcgacaccagccacgcgttccactcggcgctgcgggatccgattctcgacgagttcgagtcgtatgcgaaccagttcgatttcggtccgccccaacggatcttgatctgcaaccgaaccggctccgccctgggcaggagcgtgaaactcgatggggcctattggcgtcgccatgcccgccaaccggtcgagttcgccaagagcgttcgcaccctcgccgacctgggctgcaaggtgttgctggagatcggcccccaaccggtgctcaccgccgcggccctgcgggcctggcccgacccggcgaccgcgccccgggcgatcgcatccttgcgccgcaacaccgccgaccaccgccagatcaccgaagcgcttgccgaggcctacattgtcggccacctcccggacttcggtgccgccgtcggtccggcgcgaaagcttgacctgcccacctatccgttccagcaccgccagtactggttcagcgagcagcgggtcccgcccggcagccaacaaacctcgacccagaccacggccgtccggcttctcgaggacggccggatcgccgaactcgcggagttgctcgacggcgcgagcgtcgatcagcacaccctcgatgtgctgacgaagcttgccgcacaacacaatcaacagcgcaagagtcggtccatcgccgaggaccgctacgagatccgctgggagaagtccacggtccctggccccgaagccgaagccacctggctcgtcgtcggcgatgacgacgacgccgtcgcgccgctggtcgacgcgctcaccgcgcgcgggcaccagcaccggattctcgtgttgcccgcctccgacgcggacgaggaaagggtcgagatcgtattgcgcgccgcggcggcggaggaagcgccgctacgcatcgcgctggtggcggcgctggattccggcaccgcaccatcgatgcggtcgctgctgcggatgcagcaccgggtactggccggaacacggcggctcttccgcgccgcggccgccgctgaactgcgccaaccgatttggttggtcacccgcggcgcgcaacgagtcaccgacgccgacaccgtgttcccggatcaaagctgcctgtggggattcggccgggcggcgtccctggaatatccgcaattgtggggcgggctggccgacctggcgcagggcagcgccgaggaatggtcccggttggtcagggtcgcgtcggcgccgcgcgacccggccgtcggggaggaccagatcgcgctgcgcggctcggacatctacgttccccggctgacgcgacgaagcgggcagccggccgcggctgcgctgacattgcgtgccgacgcaacgtatctggtgaccggcgggctgggttcgatcggactggagatcgccggccacctggctgcgcagggcgcccggcacctggtgctgaccggccgccgcgcgccgggcgaagccgcacagcggcgcatcgacgccctcagccaacagcacggatgcgaagtccgggtgatcgcggccgatgtcgccgacgcccaccacgttgcgcggctgctcggcgccgtgcgggccgaactgccgccggtggccggcatagtccatgccgcgggtgagatcggcaccaccccgctgagcgacctggaagacgccgaaatagatcgggttttcgccgggaaggtctggggcgcttggcatttgagcgaagccgccgccgacctgcggttggacttcttcgtcagcacgtcctcgatcgcctcggtatggggtggtctgggtcagacggcgtacggcgcggccaacgccttcctcgacgggctggcgtggcggctgcgtgagcagggcgtcaacgggatcagcgtcaacttcggtccctgggcggcgggcatggccgacgagaacgcccgggcgcgactggctcagcgcggcatcaagacactctcgcccgccgacgcgctggcgggtctggccgatgtcatggcgaccgccgccgcgcagggggtggtggcccggatcgactggacccgcttcctgccgctctaccagcaagcggggcagcggtcgttgctggcggaattggcccgggaggtacccgatttcgccccggcaccaacgccttccgggaagacggggctggtcgagcggctcgccggcgctccggtacagcagcgcaggaaactcatgacggagtttttgcgcaacgcggtcgccgaggtgacgcgcgtcgatgccgcggagatccgcgaggacgcgggattcttcgacctcggcatggattcgctgatggccatcgaactgcgccgccacatcgagcaaggcgtgggcaagcagatacccgcaaccctggcgatggattacccgcggctgtccgacgtcgccgagtacttgctcggcgacgtgctcgacctgcgcgggcagccggacgccaaacccgcaccgccggcgggcaccccagcgccggccggccgcacggacgagccgatcgcgatcgtctccatggcatgccgtttcccgggcgccgctgatccggaagccttctgggagttgctgtccggcggtgtcgacgccatccgggaagtcccggaagaccgattcgacatcgacgagttctacgacccggatccggaaacccccggcaagatgtacagccgattcggcggatacctggaccaaatcgacgaattcgaaccggagttcttcggtatctcgccgcgcgaagcggtgtggatcgacccgcagcagcggctggcgctggaaaccgtgtgggagggcttggagcgtgccgggtattccccggccgcgctgcgcggcagccgaagcggcatcttcgtgggggtcggcgccaacgagtattcgcatctgctgtccgccgagtcggtggacaagatcgagccacacttcatcactggcaacgcgctcaacgccatctccggccgggtcgccttcgcgctgggtctggaaggacccgcggtggccgtcgacaccgcatgcagctcgtcgctggtggccgtgcatcaggcctgccaggcattgcattccggtgactgcgatttggcgttggccggcggtgtcaacgtgttgctgagtccggtgtccaacatcgccgcgtcgcgcgcccggatgctttcacccgtcgggcgatgcaagaccttcgatgccaccgccgacggttatgtgcgcagcgaaggctgcgggatcctggtgctcaagcggatgagcgacgccgtgcgcgacggagaccgggtgtgcgcggtcatcccggccagcgcggtcaaccaggacggcgcgtccagcggtctcacggtgcccaatggtggtgcacagcaacggcttatcgccacggcactgagccgcgccggcctctccggcgacgatgtcgactacctcgaggcgcacgggacgggcaccgcgctgggggatccgatcgaagtgcaggcggccggggccgtctacggcgccacccgggacaccgaccggccgctgctgatcggatcggtgaagaccaacatcggccacctcgaggcggcctccggggtcgccggcctgatcaaggtcgtgttgtcgctgcagcacgaaatgctcccgcagagcctgcatttcgagacaccgtcgccgcatatcccgtgggactcgctgccactgcgggtggtggacaaggcggttccctggcagaccaacggccggccgcggcgagccggggtgagctcgttcgggttcaccggcaccaacgcacacgtgttgatcgaggaggcgccgcaaccggtaacgacgcaacacgccaccccggcagccgaatccgacgcacgcccggtcgacgtgctgccgctgtccgcgcggtcaccggaggcgctgctggcgctggcgcagcggtacggggaatggttgcacgctcatcccgacgcggacatcggcgatctgtgcttcaccgtcggggccgggcgtgcgcatttcgagcaccgggccgcgctggtggtggattcggtgcgcagcgcacgcgaggcgctggccgacctcgccgacaaccggacccggccgggagtggcgcgcggcgagtgcaccgacccgccgacgacggcgtggttgttcaccggacagggcagccaatacccggggatggcgcgcgagttgttcgacgccgagccggttttcgccgaaacggtgacgcgctgcgcggacgccgtcgacgggctgctgccgcgtccgttgaccgaggtgatcttcgcgaccgacaaggacaccggtggtgaggcaggaaaaaccctgcgaaataccgcttttgcgcagcccgcgttgttcgccgtcgagatgggcctggccaggctgtggcaatcctggggtgtcgagcccgacgtggtgctggggcacagcgtgggccaatacgcggcggcttgtgtcgcaggcgttttcagcctcgaggacggggcgcggctgatggccgagcgcggccggctgttcggcggcctgcccgacggcggccggatggtggcggtgttcgccgacgcccaatacgtcgaggagctcgccaacgactgcccccgggtgtcggtggccgcctacaacggtcccaacacggtgctctcgggtcccggcgcggatctcgaacagatcgtggcccgcggtgccagtgacgggatccggtgcagctggctggaaaccagccacgccttccactcggagctgctggacccggtgctcgatgaattcgagtcgtatgcggcgcatctggacttcgccgtacccacgctgccgctggtctgcaaccgcaccggcacggtgctcaccaccgaaaccccgctcgacgcgcgctattggcggcggcattcccgccagccggtgcagttcgccgaaagcgtgcgcaccgtcgcggcgctgggctgcaccgtgttgatggagatcggtccgcaaccggtgctgacgggggccgcggtgcaggtctggccggaacacctggccgcgccacgcgcgatcgtttccctgcgcaagggcgtcggcgatcggcgacagatcgccgaagggctggccgcggcatacgtcagcggtcatcgtcccgagttcgccgcgctgcatcgtcgaccgcgccgcaaactcgaactgcccacctacccgttccagcggcggcgcttctggcccaaggcttccggcatcgccggcatcgatggacagggcgccgcggcatccgggctgctgggcagcgcgaaggagctcgcctccggcgactgtgtctacaccagtaggttgtcggtgaagtcgcagccctggcttgccgatcacgtgatctacggcaccgtcgtcgtcccgggcgcgacatatgcggcgatggccctggccgccgtcgggccgccggcacgtgtgcaaaacgtctacttctatgagccgatcatcctgcccgacaaggcttctcgtgaagtgcagctgagtctgcatccgctgcaggagggcggctggagcttccgggtcgacagccgcccgtacggcgtccccgatgccgaatggtcgttgaacgccgatggcaccgtcgtcgccggcatcgaggacgagccggcggccgacccggcggaccacatcgacgccgtgatcgagaggttggaccgcagtcgcccgcaactgctgttcgacagcttcgccgaaagcgaactggagtgggggaccacgtggtccacctcgctgaagtcgctgtggatgggcgacggtgaggcggtcggcgacgtcaccgtgggtgacgaactcgccgagcacctcgggacggagcccatgcatccggtgctgctcgacctgtgcaccggagtcgtcttcccggcgtttcccgcccttctcgccgccgaacagggcttcaatgatctgttgctgccgttgcggtacgggcaggtgtccctgcgggagaagatgccgcggcggttctattgccgcgggaaatggcggcccagcgcgctggacagcgaaacccaagtcttcgacatcgatttcatcgatcgggacggtcgccacctgggtgggatacgcgagttcacggtcaagcgcgcgccccgcgaggcgttgttgcggggactgggcggcgatgccacccggctgctgtacacccttggctggcatgaggttccaccccagccgtcgaacgatggtggcgcaaatccaagcgggacatggctgatcgccggcttcgacgaactggcggctcaactgccgggctgcatcccattcgaccgcaacaccgatccggagtccttcgggcagctgttggcgcgcgccgaggaccgcggcggcccggtcaccggcatcgtctggcgcgcaacgcaatccggtggacaggagtcgagcgccgaatccgtggcgcggctggaaaccgagatcgccgggctcctcaccgccgtgcacgccttgcagaacgcggatggctcggcggtcaagcttcccggtggcctgtggatcgtcaccgaacggggcgtggcgaccgagtccggcgaaccggtcgacccggtgcaggcggcgctgtggggacttgggcgcaccatcgtcaacgaggaaccggcgctgcggtgcaggctggtcgattccgacgggtcggagcaggccgtgcggtcgctggccggtctgctcggcgcaccgctggacgaaccggaactggcggtgcggcaagggaaactcctggcatcccggttactgccgtgggcgcgcagcggtcatctcgcggtacctcgcggcaccgactacgtccttgcccccaccgaacgcggcgcgatcgacaacctgcggctgatcgagcaggaggcgccgcccccggccgagggctgtgtgcaggtgcgtgtcgaggccggcggtttgaacttccgggaggtgctcaacgtgctgggcctctacccgggcgacccggggccgctcggcggcgacttcgccggcaccgtcacccaattgggcagcggcgtcaccggactcgaggtcggcacgcgcgtctacggtttcatgcagggcgcgttcgccagccggttcaatgtgccggtccagttgctggcgccgattcccgacggcgtgagcgcggtggatgccgcgaccattcccgccgcggcgctcaccgcccggctcgcgttcgactgggcccagctgaaacccggtgaccgcgtgctcattcatgcggcaagcggtggcgtcggattggccgccatccagctggcgcagcgacacggtgcgaccgtgttcgccaccgcgagcacctacaaacgcgcgacgctgcgcaagctgggtgtggaatacgtctacgattcgcgcagcaccgatttcgccgaccagatcctcgccgacaccgacggcgccggcgtcgacgtggtgctcaacagcctgaccaatgagggattcatcgaggcgaccgtgcgggccaccgcccaacacggccgtttcgtcgagatcgccaagcgagacatctggacccgcgagcagatggcggcggcccgccccgatatcgcctacgagatcgtcgcgttggactgggcctgcgtggaacagccggagcacattcatgccctgctgaccgaggtgtcggacgggctggccagcggcgagtggaggccgttgcccgccgagatctatccgctggccgaggcgaagacggcgtttcgccgcatgcagcaagcaaggcacatcggcaagatcgtgctgcagatgccgaaaccgctgcaaccgcgcggtgatcgcagctatctgatcaccggtgggctcggcgcgatcggcctgcacctggcggcctatctggcccagctcggcgccggcgagatcgtgctgaccagccggcgtgcacccgacgccgcggcgcggcgggccatcgacgacatcaccgagcgctaccggtgccgcgtccacaccttcgccgccgacgtcggtgacgccgcgcaggtcgagcagctgctggcccggatccgcgccgaactgcctccgctggcgggagtggcgcatctggcgggcgtgctcgacgacgcgctgctgtcccagcagagcccggagcgtttccgggtggcgttggcgcccaaggcattcggagccagctacctggaccatgcgacgaggaccgacgatctcgacttcttcatcgtgtcgtcctcggtgtccagcctgctcggttcacccggccaggccaactattcgaccgccaacgcgtggctcgacgggctggtcgcagcgcgacaggcgcgcggcttgccggcgaccggggtcaacctcgggccgtgggcccaaggggggatggcgtcgtcggaggccgcgcgcgccaatatcggtgcgcagggactcattccgctggaaccgacggccgcgctggccgcgctcgccgaggtcgtcgccaacggcaccgggcaggcgactgtcatcaaggccaactggcagcgcgcggcgaagctgctgggcgatgctcgcccaccgattctcgatctcgtgctgccgagcgccgtcggggaggcaagtggggacagcgaattactcaagcagttgcaggagatcccggtggcgcagcgcgccgccttcatcaccgaattcctgcagcgcgaggtgcagggcttcctgcggctcgcgcagccacccgccgcgacgagccgattcctggacctgggcacggattccctgatggcggtcgaactccgcaaccggttgcacagccaattcggtggcgcgttcacgatcaacgcgaccgcggtcttcgactatccgacgatcggtgggctggccgagtatctggcaggccaactgcccgacgcggaaccggagccgggtgcggcggtggccgccaacccgaatccgggctcggaaaccggcaccggtgaggccgaaccggaacgtgaggcggcgcccgagccgagctgatccgggcggggattcagtcggcgacgtcgaaggcggagttcaccttcgtcggccgaatccgcaccaccaactcgccggggacggcgttacgccggccgaactcgtcggcccggtcggcgcccatgtaccgtgcgccggtccgggtggcgatgtccaacacctcggcggggtcctcgctcaccgcggccacgccctgcacctggacgaacgaatagggcggatgcggatcgtcgacgcagatgaccacccgcgaatcacgcgctatcgcacgggctttcgccgtgccacggccggtgttgaaggccagctcgccgtcgtcgaccacgaaccagatcggcgcgaccagcggccggccgtcggcggcgacatagccgagcatcccggtgcgggtgccggcggacaggaactcgacgacctcggcggacagcgcggccatggggttagaggcggaccaggtcgtagtcgccgaggtggtcgatcaggttgtgcagatgctcacccgaggtgcccagggtgtgctcgatcgcggtgagccgggcggcgtagtggctgatcgggtactccgcggtcaccccgatcccgccgtgcatctggatggactcctgcgcaatgtgccggccggagcggccgatctgcagcttggcccgcgaggcgatcaccgggtcgatattgccgtcggcgatcgacatcgccgcatacaggctcatgctgcgggccaattccagcgagacgtacatgtcggcggcgcgctgggtgagcgcctggaatttgttcagggtgaccccgaactgcttgcgggtcttgaggtagtcggtggtcaggcgcagcgattcctccatcgccccaagcgcttcggagcacaacgcggactggatgcggatgatggccgcctcgatgccgcccgacgcgtcggtcgcctcgcccagcggttcggccggggtggcgtccagatcgatttgggcgccccgctgcccgtcgaaggtgcggtacgggtgccgggtgacggcgcccgcgtcgaccaggaacagcccggtgccgccgtccggcaacgcggcgctgaccaccagggtgtcggcgcagtcgccggccagcaccgggttcttctgaccgctcagcgtccacgaatcaccttgccgcgcagccttggtgcccacctcggcggtcggtttgcgctgccccggctccaggtgggcgaacgccagcagccgctggccggccgcgacctcgtccagcagttccttctgggccgcgctgcccagctcggcgatcagcgcgccgggccccagcgcggcgtgcagcaccggctcgggggccagccggcgcccgatctcggtgagcaccaccatgatctcgatctgtcccgactcgtcggggtcgaagcccaggcccaggatcccggtgtcggcgagctggctccacacctcgcggctccagcccagctcggagccgatgaccttgttgcggctctccgggtcgtaactgcgcgacagcagatcgcgggtggtgtcgcgcagcagggcctgctcgtcgctcaactgaaagtccatggctgcctcacaatcccagaatggtggacgcgatgatgttgcgctgtacttcgctgctgccgccgtagatcgacgtcttgcgatagttcaggtagtgcggcgcgctggattgcgcccaggacggggaggcgatgtcgtcggccttggccggcaacgcatccgggccggccacctcgacgagcagttcggtggccacctgctgcagttggctgccccgcagcttgagcaccgacgacgccgggttgggctgcccgttcgccgagtcggtggtcacccgcgactgcgtgagttccagtgccagcagctcgttttcggcctcggcgagccgggcggcgaacagcggatcgtcgagcaccccggtggccgcggcgtgcttcttcacctcggccaggcgcaccttggtgcggcccactccggcgatgccggtgcgttcgttgcccagcaggaacttcgcgtacgtccagccctgattctcttctccgacaagctgatcggcgggcacccggacgtcctcgaagaagacctcgttgatctcgtggccgccgtcgatcgtcttgatgggccgcagcgtgatgcccgggcttttcatgtcgaagagcaggaacgagatgccggcctggcgcttgggcgcctgcgggtcggtgcgcaccaggcagaagatccagtcggcgtactggcccagcgtggtccaggtcttctggccgttgacgatgtagtggtcgccgtcgcgcaccgcggtggtgcgcagcgacgccaggtccgaaccggcgtccggctcggagaatccctggcaccaccagatgtcgaggctggcggtcgggggcaggaagcgttgtttgacctcctccgaaccgaattcggcgatcaccgggcccaccatcttggtgttgaagttcaacggctccgggacgcaggccagctgcatctcgtcggcccagatctggtgctgggtgggcgtccagtccttgccgccccactccaccggccagttcggtaccgcaaggccgtgctcgtgcaggatcttgtggctggtgacgatgtcgtcgcggttcacttccgccgatccccggcgcacccgctcgcgcagctcctcgggaatcttggtcgtgtagatggtgcgaagctcgtcgcggaacgcggcttcctccggtgtgagcgccagttgcatggcagcctcctgtcgtttcggggtgaacgtggcgacccatcgccctggtcgttcgctcggcttccatcttgacccatcgggtgcgggccctgtgcacagcctcgggttagtccacagatcggcccggcggcgccgcgcagcgggccgtcgcgccggtgggcggacctacggtcgggccatgcagacagaacttccggccgagcgcccgcaacggcggctgcgcgccgaaccggatgccgatgccgcggtgcagcccgaggagcccgggccaatcgcgggcgaggactccccggatgacgaccagaattcgctgctgccgcggtggcttcccggcgcgccggagcaccggggctgggtggcccggattcgtgccgacccgggacgtgccggcgccatcgggttggccatcgtggcggcgctggccgtgctggtcacggttttcacgctgatccgcgaccggccggcgccggtgatgtcggccaagctgccgccggtggagaaggtgtcgaccgcgagcccgcgctcgtcggcaagcccgagcggcggcccggaccgcccggtggtggtcagcgtggtcggcctggtgcacacgcccggcctggtcacgctggcgccgggggcgcggatcgccgatgcggtgcaggcggccggcggcgcggtgaacggcgccgacaccgccgggttgaacatggcccggccgctggacgacggcgagcagatcgtggtgggcttggccccggtgccgggacagccgccggtgctgggcagttcggtggccgcggggtcgacaccggccccgaaaccgccgccgggtcccggggcggccaaggccaagccgaagaccggcgacgcggtcgacctgaacaccgcgacggtgcaggagctcgacgccctgcccggcgtcgggccggtcaccgccgccgcgatcgtggcgtggcggcagaccaacggcaggttcaccagcgtcgaccagctcgccgacgtggagggcatcggccccgcgcggctggagaagctgcgcgctctggtccgtgtctgagcgcggtgcatcccggcgggccgtcgcccgagggccgcgtcgatgtgcggctggtgccgtccgcgctgacctgctgggcggtgacggccggcggaatctggtggccgatcggccgggagctcgcctggtgctgcgtcgggttgctcgcgatcgccggcgccctgcggtggcgtgcggcgcgccggccccgccacccgcggctgtcgtcggtcagcgccgggctggcggcgatcggtgtggtgggggcggggttcgggttcgccgtggcgctgcgcgccgacgcggtcgatcaccacccgatcgccgcggacttcggcgccagcgccccggtcaccgtcaccccctccgagagcccggtgtcgttgggctccgggaaccagggccggctgatgtttcgggccaccttgcaacagctgcgttccgaccaaatgtccgggcgggtcgttgttttcgcgcgcggcccggatttcggcgggctgatggtgggccagccggtgcggttcaccgcccggatcggccggcccacccggcgcgacctgacggtcgcggtgctcaccgcgtcgggccggccgaccctgggcagcgcgagtgccgtgcagcgggccgcgcacgaggtacgccgccgcttcgccgccgcggtgcgtgacacgctgcccgccgaccaggccgcgctgctgcccgcgctggtgctcggggacacctcggcggtgcccaccccaaccggccgggacttccgggcggccggcatgacgcacctgatggccgtgtcgggcgccaatgtgacgatcgtgtgtgcggccgtgctgttttcggcgcggctgatcggcccgcgggcggcggtcctgctggcggcgctggcgctggtggccttcgtcgtcgtggtgcagccgacggcaagcgtgttgcgggcggccgtgatgggcgccatcgcgttggcgggcatgctgacttcgcgtcggcggcaagcgattccggccctggccgccacggtgctggtgttgttggccgtcgcgccgcagctgtcggtggacgtcgggttcgcgctgtcggtgcttgccacagccgcgctggtcgttctcgcgccggcctggtcgcggcggttggcggaccggggctggcccaagccgttggccgatgcggtcgccgtcgcttgggccgcgcagctggtgaccgcgcctttggtcgcggccatctccggccggttcagcgtggtcgccgccgccgcaaatctgctggtggcggccgtgatcgcaccgatcacggtgctgggcaccgcggcggcggcactgtgcccgatctggccggccggcgcgcggctgctgatccgtttcaccggccccgagttgtggtgggtgggcggggtggcccaccgggccgcgggcgtgcccggcgccacggtgcccgtcccggacgggacggcgggcacgttgatcgtcggcggcgtcacgctgctggcggtggtggcgtggcggtggtggcgtggcggtggcgccggttccgcgccgcggccgccgcggcgttgctggtcggcctggcctgggtgctgtccgggctggcgtagtacccggcgagcgccgatccccgcgcgaggtcgtcggtcggtcgtgacaccatcgtggagtgagcgaggtttcgccgttacacctggtcctcggggacgaggaactgctggtcgagcgggcggtggccgaggtgctggccgaggcgcgcaaacgcgccggcgcctccggcgacgccgacgttccgatcaaccggatgcgggccggcgacgtgagcacctacgaactcgccgagctgctcagcccgtcgctgttcgccgacgagcgcatcgtcgtgctggaggccgccggcgaagcggggaaagacgctgcggccgtgatcctttcggcggccgccgagatgccggccggggtggtgttggtggtggtgcactccggcggtggccgggccaaggcgctggccaccgagctgcagtcgctcggcgccgtggtgcacccgtgcgcgcggatcaccaaactgagcgaacgcatcgatttcgtccgcaaggagttccggcggctgcgggtcaaggccgacgaagagaccgtgaccgcgatgctggacgcggtcggctccgatcttcgcgagttggcctcggcctgctcgcaattggtcgccgacaccggcggggcggtcgacgccgccgcggtacgccgctatcacagcggcaaggccgaggtgaagggcttcgacatcgccgacaaggcggtcgccggcgacatcgaaggggccgccgaggcgctgcgctgggcgatgatgcgcggcgagccgttggtggtgctggccgacgcgctggccgaagcgatccacaccatcggccgggtcggcccgctgtccggcgatccgtaccggctggcggcccagctggggatgccgccatggcgggtgcaaaaggcgcagaaacaggcccggtactggtcgcgcgactcggtggcgacggcgatgaaggtggtggcgacgctcaacgcgaacgtcaaaggcgcggtggccgacgccgactacgcgctggaatccgcggtgcgcagggtggcggagctggccggcggccgcaatcgctgagcggcggtcctcagagcttgttgagcgcctgggccagcgccgacttcttgttggcggcctggttcttgtggatcacgcccttgctggccgccttgtccagcttgcggttggtcgacaccagcaactcggcggccttttccttgtcgccggcgtgggcggcctcgcggaacgcgcggacggcggtgcgcagcgaggacttcaccgacttgttgcgcagccgggcgcgctcgttggtcttgttgcgcttctgctgcgacttgatgttggccacgctcgagttcccttttcgatcagacgtttgcttgggcgccggatatctccacagcgactgcccaggttatcagtgagttacgttttctcccaaaacgggaagacgtgggctgccgggacgtcgatttgaggcagcatctaaacagtgagtctttcgaaccagcttgaggacaccgggcggggttttcgcgctgcgcgttcggagcgcatattcggcggctacaacgtggcgtcggacgcctacgacatggccttcgacgaaatgttcgacgccgcgggcgccgtgcgcggcccctacaagggcatttacgccgagctggcgccgtcggacgcctcggagctgaaggctcgcgccgaagcgctgtcccgcgccttcctggatcaaggcatcaccttctcgctgtccgggcaggagcggcccttcccgctggacctggtgccgcgggtcatctcggccgccgagtgggcccggctggaacgcgggatcacccagcgggtcaaggcccttgagatgtacctcgacgacatctacggcgaccaggaaatcctcaacgacggggtgatcccgcgccggttggtcacctcctgcgagcacttccaccgccaggcggtgggcatcgtcccgcccaacggggtgcggatccacgtcgccggcatcgatttgatccgcgacgaggagggcaatttccgggtcctcgaggacaacctgcgctcgccgtcgggcgtgtcctacgtgatggagaaccgccgcaccatggcgcgggtgttcccgaacctgttcgccacccaccgggtgcgggcggtcgacgactacgccgcgcatctgctgcgggcgctgcgcaactcggcggccaccaacgaggccgaccccaccgtggtggtgctcaccccgggcgtctacaactcggcgtacttcgagcattcgctgctggcccgccagatgggcgtcgagctggtcgagggccgcgacctgttctgccgcgacaaccaggtgtacatgcgcaccaccgagggtgagcgccaggtcgacgtcatctaccggcgcatcgacgacgcgttcctggatccgctgcagttccgcgccgactcggtgctcggggtggccggcctggtcaacgccgcccgcgccggcaacgtcgtcatctccagcgcgatcggcaacggggtgggcgacgacaaactcgtctacacctacgtgcccaccatgatcgagtactacctgggcgagaagccgctgctggccaacgtggagacgctgcggtgctggctcgacgacgagcgcgaggaggtgctcgaccgcatcgacgagctggtgctcaagccggtcgaggggtcgggcggctacggcatcgtgttcggcccggaagcctccgacaaggagctggccgccgtcgccaagaagatccgcgacgacccgcgcagctggatcgcgcagccgatgatggagctctccacggtgccgacgcaggtcggcagctcgctggcgccccgctacgtcgacctgcggccgttcgcggtcaacgacggcgaggacgtgtgggtgttgcccggcgggctgacccgggtggccctggtcgagggttcgcgggtggtcaactccagccagggcggcggctccaaggacacctgggtgctggcctcgcgcgcgtcgtccggcgaccatgaactcggtgccgccgaggtggtgcgctcgttgccgacggcgatgcccgacccgctggtggacgacgcgccgcggtcgatggcccagcagccgcaacccaccgggccgccccagcgcgagcagctcgagcaacagcagcagcaacgggcggggcgctgatgctggcacgcaacgccgaggcgctctactggatcggccgctacgtcgagcgcgccgacgacaccgcacggatcctggacgtcgccctgcaccaactgctggaagactccagcgtcgacccggaccaggcgtcccgggtgctgctgcgggtggtcggcatcgacccgccggaccacgacctggacgtgtggtcgctgaccgacctggtggcctacagcaccggcgcccagggcggctgctcgatcgtggacgccgtcaccgccgcgcgggagaacgcgaaatcggcgcgggaggtgacgtccagcgagatctgggagtgcctcaacaccacctaccacgccctgccggaacgggaacgagccgccaaacgccttgggccgcatgattttctgtcgttcatcgaacgacgggcggcgatgttcgccgggttggccgactcgacgttgtcccgcgacgacgggtaccggttcatggtgctgggccgggcgatcgagcgggtcgatatgacggtgcggctgctgctgtcccgggtcggcgacagcgcctcgtcgccggcgtgggtgacgctgctgcgctcggccggcgcgcacgacacctacctgcgcacctaccgcggcgtgctcgacgccggccgggtggtcgaattcatgttgctggacaggctgtttccccgctcggtgttctactcgctgcggctggccgaacacaacctcgacgaactgatgcacaaccggcagagccgggtcggggccaccgccgaggcgcaacggttgctcgggcaggcccgcagcgaactggagttcgtccagcccggtgtgctgctggagtcgctggagtcccggttggcgggactgcagcgaacctgccgcgacgtttcagacgcgttggcgctgcagtactttcacgtcaccccgtgggtggcctggtcggacgccagccagcgcgcccggctggtcagccgcaaaggggacggctgatgtggcggctgcgggtggtgcacaccacggggtacgcctaccagtcgccggtgacggcgtcttacaacgaagcccggctgaccccgcggtcgaacaatcggcagaacgtcatcctcaaccgcgtcgagaccatcccggcgacccggtcctaccgctacatcgactactgggggaccgcggtcacagcgttcgacctgcacgcgccgcacaccgacctcacggtgatgtcctcgtcggtcgtagagaccgagcgggccgaacggccggcgaccgagctgggctggggtgatctgcactcggaggcggtgatcgaccgctttgacgagctgctgcgccccaccgggcacgtccccgccagcaagcgggtggcgtcggtcgccaagaagatcgccaaatcgcatgacccggccgaagccgttgtcgccgtgggtgattgggtgcgcggcgagctcgaatacctgcccggcaccaccagcgtgcactcgtccgggctggacgcgctgaaggagggcaggggagtctgccaggacttcgtgcacctgtcgttgatgttgttgcgcagcatgggaattccgtcgcactacgtgtcgggttacttgcaccccaaacgcgacgccgtggtcggcgacaccgtggacgggcgcagtcacgcctggatcgaggcgtggacgggcgcgtggtggagctacgaccccaccaacgacgccgagatcaccgagcagtacgtcggggtgggcgcgggccgcgactacgccgatgtctccccgctcaagggcatctattcgggggagggcgccaccgacctcgacgtgatcgtcgaggtgacccgctcgcctgaccaacggaggagccggcggcgatcaggagaaacgcatggacgacaccgcgcgccgcgcctccgggttgccgctgctgtcgctgctctgcgtcggcctgctggccggcgggctcgccgtcggggtcgggatgggcggcgtcatgccgctgccgtacggcccggtggccgcggtggcggcctatgttcgcgcccagccggatgccgtgcgggtgatcgccgtcgcgacgttcgcgtcgtcggtcccgctggcgctctacgcggcgacggccgccgcccggttgcgccgcctcggggccggcccgacgaccgccgcgatcacgctcaccggcggaaccctggcggccggattgctcgccctggccggattgctcggctggacgctgtcccggccggcggtcaccgcggacacggcggtggtggcggcgctgtacctgctggtgtttctcaccggcgggccggggcacatcgtggcgctgggcgtgttggtcgccgcgatggcggtgcccggcctgacccggggggtgctgccccggcccgtcgcgcgggccggtctggccacggccgcactcgccgggtcggcgaccgcggtgctgatctggcccgcgctgggcgtgatcttgccggtcgcgcgggtggcggcgctggcctggctggtggtcgcgggaattgctttgcgggacaagggttatggtgaccggggcggtcgagctcaggagggcgcgtcgacctgaacccggtgcaggtcgtcgccgagttcgacgcgtccggcgaactcgcgggccgccagcgcccgccactgttcttcctggcccgccaccagcgcgggcacgtagtgcgtcatgacgagggtgcccaccccggcgcgggccgcggtcgccgcggcctcctcgaccgaggagtggtagtcgcagatgtcctgcagccgctgctgcgggatggtggccacgatgtccttgcggatcacggtgtgcaccagcgcgccggcgccggccgccagctcgtcgagcccggcgcacggcacggtgtcgccggccagcaccaccgacgcaccctggtattcgacgcggaacccgatggtcggggccaccggccggtggtcggtgggggccacccggatcgacacgccgtcgcggtcccacaccgggccgtcggtgtgctcgcgcacatccaccgccgggggcgcgttgagatcagcgtgatgggcgatccggtaaccgatgtcgtgccgcagcgcgttcagcgtcgccgccaccagctcggccgtgccgggcggcccgatgatgggcagcggcaccgggtcgggggtgaaggtgctgatccaccgcgtgatcaggacgtcgcccaggtcgccgacgtggtcgctgtgcaggtgggtgagcagcagcgccgacaatccggccgcgcccaccccccccgccgcggcgcgctgcagcaccccgcgtccgcagtcgaccaggaacacctgcccgccggcgcgcaccagggtcgacggcccggcgcggttggggtcggggatcgggcttccggtgcccagcagggtgacctcgatcatggggcctatcttgcagggcctggagcttggacacgatctgtttgcaggttctcctggtggcttttgcgccgcgcgagttcgccgtagcctggtgtgaagcggctcacaaacccggctggaggcctcgatgcggattgcggacgtgttgcggaacaagggcgcggcggtggtcaccatcaatcccgacgccacggttcgtgagctgatcgccggcctgaccgaacagaacatcggcgccatggtggtggtcggcgccgagggtgtgctgggcattgtgtcggagcgcgacgtcgtgcgccagttacacgttcacggcgccagcgtgctgtcccgcccggtgtccaagatcatgaccaccacgctggccacctgcaccaagaccgacaccgtcgacgagatcagcgtgctgatgacgcgcaaccgggtgcggcacgtgccggtgctggacggcaagaagctgatcggcatcgtcagcatcggcgacgtggtcaagacccggatggaagaactcgaggccgaacagcagcagctgcagtcctacatcacgcagggctgatcgcccccggttcgccgaccgtgcagacctagctccaggcgtactgcgcgcgcagccgcgcggccaccacgtcgaagacctcgcgatccaggatggcaccctcgcggcggatgccctcttcgggcaccaccagcacccggtccagccggacccagctcggcctgccctcgtaatcccaactgccggaaccgattccgacccattccggatcggcggcatgacgctcctggctggacaccatcaaccccagcagggtgctgcggtcgcgtcccaccaccaggacgggccggtccttgccgcggctgggatcgtcctcgtaaaccacccaggtccacacgatctcgccgggatcggcccggccgtccagtttgggcgcgtacaccagcttgcgggcccgctgcgcggtgggcaggctgctgcgggtcaccggccggcccaacacggcggtgtccggcggcgggggtgcggcggcggcgatgacgttcgcggtgatcttcacggcctgctgcagctcgcgcagcacggtctgcgagttctgcacatgccgcaccagccgcggcgcgcgatcgaaaaccaggttctccgcgaaccgctgaaacgcccttccactgcgacttccggccggacgccatattcgcagcatagacgcgccgattgtgccgcagtccggccgcgccgatacgctggacacacttgcgaaccgccgtctagcaggcccggaccaggagatacccatcagcagtttcgccgacaagaccttcaccgcgccggcgcagattcgcaacttctgcatcatcgcccacatcgatcacggcaagtcgacgctggccgaccggatgctgcagctcaccggcgtcgtcgacgagcggtcgatgcgcgcccagtacctggaccggatggacatcgagcgggagcgcggcatcaccatcaaggcgcagaacgtgcggctgccctggcaggtctccggcggcgaggacgccggcaaagaatttgtcctgcacctgatcgacaccccgggccacgtcgacttcacctacgaggtgtcgcgcgcactggaggcctgcgaaggtgccgtgctgctggtcgacgccgcgcagggcatcgaggcccagacgctggccaacctctacctggcgctggaccgcgatctgaccatcatcccggtcctcaacaagatcgacctgccggccgccgacccggatcgctacgccggcgagctcgcccacatcatcgggtgcgaacccgacgacgtgctgtgggtgtccggcaaaaccggggagggcgtggcgcggctgctcgacgaggtggtgcgccaggtgccgccgccgcaggggcaggccgatgcgccgctgcgcgcgatgatcttcgactcggtctacgacatctaccgcggcgtggtgacctacgtgcgggtggtcgacggcaagatcaccccgcgcgaacgcatcgcgatgatgtccaccggcgccacccacgaactgctcgaggtcggcatcgtctcacccgagccgaaggccagcgacggccttggcgtcggcgaggtgggctacctgatcaccggggtgaaggacgtccgccagtccaaagtgggcgacaccgtcaccagcgcgcgccacggcgcgcaagaggcgctgaccggataccgcgaacccaagccgatggtctattcgggtctgtatccggtggacggctcggactatccggatctgcgcgacgcgctggaccggctgcggctcaacgacgccgcgctcacctacgaaccggagacatcggtggcgctgggctgcggattccgttgtggctttttgggtttgctgcacatggagatcacccgcgagcgcctggagcgcgagttcgacctcgacctgatctcgacgtcgcccaacgtggtgtaccgggtgatcaaagaggacggcaccgagatcgtggtgaccaacccgtcggactggcccgagggcaaggtgcgcacggtgtacgagccggtggtcaagaccaccatcatcgcgcccagcgaattcatcggcaccatcatggagctgtgccagtcccgccgcggcgagctgggcggcatggattacctgtcgccggaacgggttgagctgcgctacaccatgccgttgggcgagatcatcttcgacttcttcgactcgctgaagtcgcggacccgcggctacgccagcctggactacgaggaggccggcgagcaggaggcccagctggtcaaggtggacatcctgttgcagggggaggccgtcgacgcgttcagcgcgatcgtgcacaaggatgcggcgttcgcgtacggcaacaagatgaccaccaagctcaaggagctgatcccgcgccagcagttcgaggtgcccgtccaggccgcgatcggctcgaaaatcattgcccgcgagaacattcgggccatccgcaaggacgtgctgtccaagtgttacggcggtgacatcacccgcaagcgcaaacttctggaaaagcagaaggagggcaagaagcggatgaagaccatcggccgggtcgacgtgccgcaggaggcgttcgtcgccgcgctgtccgccgacgccgcgggcgacaaatccaagaagtaaggcaacgaatagcgatgcggattttcacggcggcgacgctgctcacggcggtcgccgcgctggcggcgggctgcggcggggtggtgtcgggcacggccaaacccgcgcccaacctcaaaccgcgaccgctcagcggcgccaccgtccagcaggtgctgctcgacggcccgaccctgtcgcgaatgctcaaccagcccttcgtcgcccgggatccggcccaggtcggcggcccggaaaagctctaccggggccgccggtcggcgtcgcagagcggctgcttgggcgtgacggcgatgctgcagaagagcgtctaccccgccgccgatgtccgcgacgtcgcggccgaatcctggtggaacaacggcgaacccgcgcaggtgatcaccgtgatggagggcgtggtgacgttgccgtcggccgcgcaggcccaggcgctgttcgcgcagttctcccggcaatggcagcagtgcaacggcatgacgacctccgaacagagcggcccgatcagcaccaccaacgtcatcagcgacgtgcgggccaccgacaccaccgtcgcggcgaccaagaccgccaccgcggtgctgcccaacatgccggccctgcggccaacccctcaggggcgtgccctcggtgtccggtccaactgcctggtcgaggtcgaggtggtgttcttcggcgggcgacggtcctccgaccccggctcggccgacctcaacaccagcgcgctcgacatcgcgcacgcgatgatggaccgggtcagcgcgctgggctgaccccggtgcggctcacatgggcgcgttggccggctggaacatcccggagccgtcggcttcctcctcggcgcggatgacgtgcaccaccgcgttgatcagcgccaggtgggtgaacgcctgcgggaagttgcccaactggcgaccggtccgcggttcgatctcctcggcgtagaggtgcagcgggctggcgtaggacagcagccgctcacacagccgcttggcgcgccgcacctcgccgatctcgaccagcgccgagaccagccagaacgaacagatggtgaaggtgccctcctcgccggagagcccgtcgtcggtctcttcgacccggtagcgcagcaccaggccctcctgggtgagttcgtcggcgatcgccagcacggtgttgcgcacccgcgggtcgtcgggcggcaggaaccgggtcagcaccaccaacagcagcgaggcgtccagcgcgtcgctgccgtagcgctgggtgaacaccccgcgggagtccacgccgtgcgccaaaatgtcggccttgatctcctcggcgatgttgcgccactgctgggcgtagctcttctcgccctgccgctcggccagcttggcgccgcggtccagcgccacccagcacatcaccttcgacgaggtgaagtgctgcggttccccgcgcacctcccagatgccgcggtccggctcccgccagtgcttgatcgcctcttccacctgcttcttcagcaccggccacaacgtctcgggaacctgttcgcgcgacttggcgtgcaggtagaacgagtccaggatggagccccagatgtcgtgctggacctggtcgtaggcgccgttgccgatgcgcaccggccgggcgtggtcgtagccggacaggtggtgcagctcctcttcgaccaggctgcgctcgccgcccaccccgtacatgacctgcagcggatgccgctcgttgttgttggcgccggagacgtcggcgatgaaggcgaagaagtcgtcggcctcccggtccagccccagcgtgtacaggccccacaacgcgaaggtcgagtcgcgcacccaggcgtagcggtaatcccaattgcgttcgccctgaggggtttccggtagcgacgtggtgctggcggccagcagcgcaccggtgggggagtaggtcaaccccttcagggtgagcgcgctgcgctgcaggtatgcccgccacgggtggtcggggaagttgccgatgttgatccactgccgccagcactcggtggtctgccacatcttgtcggcggcttcctggtaggtctgcggcggcggatgcttggtccagctcagcgcgacgaacacgtcgtcgccctctttcatccgggtgcgggcccgggcttcccggccttccagcccgatgcgcaggttggtggtgagccgcagcgtcgggtgggcgtcgggctgcttggtggcgcgggcgatggcctcgccgtaggcgttggcggagtactcccaggtggcgccgacgcggtggtagtcgaacgccggctcgcagctcatcatcagctcgacggtgccgctgacgcagcgcaccgtgcgcagcaggatgtgctcggcgtcccagtccatcggggtgcggcggtgggtgcgcgagcgtcgctccaggtcgtgccaggggcccatgaccagcgcgtcccgcacgatcagccatcccgtgtgggtctgccaggtggtttccatgatcaggctgccgggcaggtagcggcgggccgacgggacggacacgccgtagggtcccagccggaaatggccggcgctgcggtccaggatcgccccgaacacgctcggggagtccggtcggggcacacacatccattccaccgacccggccggagagatcaggcaggtggtttcccagtcggacaggaatgcgtagtcggcgatcggggggaacgggttccgcagggctgcgttgggagcaagcggcccgggtgtgcgcaggtcgatcgacgactccatcgacgtcgcgggggctgcgcggaagggttcctcgggcatggtgtcggccggttggtcgtcgggttgagcgtgcagaaccatctggacatcatcgactgcgcggcggcccttcgtccaacgtttcggccgcgcggcaaagtcggcgtgctttttccctcaccgtgactttgacgccggcgcgggccggcacgcccgtcttcacacattggtcttcggccgccgggcgcaatagggtgagctccgtgaacgcgttcctcaactggtgggacggcaacgagctgtggctttccgggttggccttcgtgcttcaggccatggtggtgatgccgatcgtgctggcggtggcctacgtgacggcggcgttgctggacggcctgctcggcaagggcatcgccctgatgcgccgcgcccggcaggccggcgggacctccggataacgcggatgcctcgctcgcatgtgacgctggtgctcgccatcctggtggctctggtgatcatcacctggctggtcacccatctgatgcaccggtaaggcgccggcgcgatccccgcaacggccagccgtgcggcggtccggtggcggccccgtcaattcctgttaggcttccggccatgcgtgcggcgttcggcattccggggtgctatgccttcatgcactgttgtcgctgactcccaagcccgtgtgcggtctggttccggagttctcgaattctcctgacgttctagttgcctttccgccgagacgggacaccgagatccgctaagttctcccaccggaaggccatcgatggacatcaggaccgcagcgcgctggcggcctgttctcgcccttgttctcaccgccggtgtcgtggccggatgccacggcggcgccagcgatgccgtcggcggcaccgggccggccgacgcgcgcaccagcatcacgctggtcgcctactcggtcccagaacccggatggagcaagataattccggcgttcaacgcctccgacgagggcaagggcatccaggtggtcacctcctacggggcctccggtgaccaatcccgcggcgtggtggacggcaaacccgccgacgtggtgaacttctccgtcgaacccgacatcgctcgcctggtcaaggccggcaaggtcgccaaggattggaacaccgacgccaccaaggggatcccgttcggctcggtggtcacgctggtggtgcgcaagggcaatccgaagcacatcaaggattgggacgacctgttgcggcccggcgtcgaggtgatcacgcccagcccgctcagttccgggtcggccaagtggaatctgctggcgccgtacgccgtcaagagcgagggcggcgcgcacggcgacgccggcgtggacttcatccggaagttggtgaccgaacacgtcaagttgcgcccgggatcggggcgcgaggccaccgacgtcttcgtgcagggcagcggtgacgtgttgatcagctacgagaacgaggccatcgccaccgagcgggcgggaaagccggtcgagcacctcaatctggcgcagaccttcaagatcgacaacccggtcgcggtggtcaacaccagcccgcacctgcaggccgccgtcgcgttcaagaacttccagtacaccgcggcggcccaaaaggtttgggcgcaagccggtttccggccggtcgacccggccgtcgccgccgacttccgcgaccagtatccggtgccggcgaaactgtggaccatcgccgatctgggcggctggagcgccgcggacccgcagctgttcgacaagaacaccggcagcatcaccaagatctacacgcaggccaccggatgacggccatcactcccgacccgctggccatccggcccgaactcggcggcgaccccggacaccagccggtgcccggacgcggccgcggcaccaccgcgctgcgggtgggggtggccacggtgtggctgtcggtgatcgtgctgctgccgctggccgccatcgcctggcagtccgccggcggcggatggcacgtgttctggctggcggttacgtcgaacgccgcgctggaatcgttccgggtgacgctgacgatctcggccggggtgaccgtgctcaacctggtcttcggcctggtgatcgcctgggtgctggtgcgcgacgagttccccggcaagcggctggtcgacgcgatcatcgacctgccgttcgcgctgcccaccatcgtggccagcctggtgatgttggcgctgtacggcaacaacagcccggtgggtctgcacctgcagcacaccgcggcgggtgtggcggtggcgttggccttcgtcacgctgccgttcgtggtgcgtgcggtccagccggtgctgctggagctggatcgcgaaaccgaggaggcggccgcgtcgctgggcgccagcggcccgaagatcttcacctccgtggtgctgcccgcgttgctgcccgcgttgttgtccggtgcgggcctggcgttttcacgcgcgatcggcgagttcggctcggtggtgctgatcggaggtgcggtgccgggcaagaccgaagtgtcctcgcagtggatccggaccctgatcgagaacgacgaccggaccggcgccgccgcgatatcgattgtgctgttggcgatttcctttgtggtgctgctgatcctgcgggtggtcggtgggcgcgcggccaagcgtgaggagctggccgcatgacgtcgtcgcccggggtccgctatggcctgcgattcgtggcgctggcctacattttcgtgctgctcgtcattccggtgagcctgatcctgtggcggacgttccggcccgggttcggccagttctatgcctgggtcagcacccccgcggcgatctcggcactgaacctgacgctgctggtggtggccatcgtggtgccgctcaacgtcttcttcggcatccccaccgcactggtgctggcgcgcaacaggtttcggggcaagggcgtgctgcaggcgatcatcgacctgccgttcgcggtgtcgcccgtcatcgtgggcgtggcgctgatcgtgctctggggttcggccggtgcgctcgggttcgtcgaaaaggacctcggcttcaagatcatcttcggtctgcccggcatcgtgctcgccagcatcttcgtcaccctgccgttcgtggtgcgcgaggtggaaccggtgctgcacgagctggggaccgaccaggaggaggcggcggccaccctgggttcgggctggtggcagacgttttggcggatcacgctgccgtccatccggtggggcctgacctacggcatcgtgttgaccatcgcacgtaccctgggggaatacggcgcggtgctgatggtgtcgtcgaacctgccggggaagtcgcagacgctgaccctgctggtctccgaccgctacaaccggggcgccgagtacggcgcctacgcgttgtcgacgctgctgatgggggttgccgtgctggtgctggttttccaggtggttctcgatgcccgccgcggccgcgcggccgggcaggcctgacgaggaggcatgacgtgatcgacgccggtaccgaccgcggcgacatcgccatcaccgtgcgcgacgcctacaaacgctacggcgacttcgtcgcactggaccacgtggacttcgtggtgccgaccggttcgctgacggccttgttgggtcccagcggatcgggcaaatcgacgctgctacggaccatcgccggcctggaccagcccgacaccgggacggtgaccatctacggccgggacgtgacccgggtgccgccgcagcgccgcggcatcggcttcgtgttccagcattacgcggcgttcaagcacctgacggtccgcgacaacgtggcctacggcctcaaggtgcgcaagcggcccaaggccgagatcaaggccaaggtggacaatctgctggaagtggtggggctgagcggttttcagggccgctaccccaaccagttggccggtgggcaacggcagcggatggcgctggcgcgggcgctggccgtcgacccgcaggtgctgctgctcgacgagccgttcggtgcgctggacgcgaaggtgcgcgaggacctgcgcgcctggctgcgccggttgcacgacgaggtgcacgtgaccacggtgctggtcacccacgaccaggccgaggcgctggatgtcgccgatcggatcgcggtgctcaaccagggccgcatcgagcagatcggatccccgaccgaggtgtacgacgcgccgacgaacgcgttcgtgatgtcgtttctgggtgcggtgtccacgctcaacggcactttggtgcgaccgcacgacatccgggtgggccgcactcccgagatggcggtggcggccgaggacggcaccgccgagtcgacgggtgtggcccgggccatcgtcgaccgggtggtcaagctgggtttcgaggtgcgggtcgagttgaccagcgcggccaccggcgggcccttcacggcgcagatcacccgcggtgacgccgaggcgctggccctgcgcgagggcgacaccgtctacgtgcgggccacccgggttccgccgatcactgccggtgcgacgacggtgcccgcgctctcccgcgacggcgccgacgaggccaccctgacgtcggcgtaaggaacgctcttcagcgcgacagccaaacaggttggcgccgaaggctttacgaggcgtgcagcccgcattccgtcttggccaggccctgccagcgcccgctgcgcgggtcggcgccggccagcggcttggccgtgcagggggcgcagccgatcgacgaatagccttcgtagataagcggattgaccagcacgttgtgctcgtcgatgtagttctgcacgtcctcgtcggtccaggtggccatggggttgaccttgaccagcttgaagccctcgtcgaagccgatcaccggcgcgttggcccgtgtcgcggcctccgagcggcgcaggccggtcacccaggccgagtatccgcgcagcgtcttgcccagcggggcgaccttgcgcagccggcagcattcgccggggtcgcgcgcgaacaggtccttgcccagcagtttgtcctgctcggcgacgctgtgctcgggagtgacgttgagcacccggatgtcgtagacggattcgatcgcatcccgggtcccgatggtctcggcgaagtggtagccggtgtccaggaagaccaccggcacaccggggcggaccttggcggccaggtcgatcaacaccgcttcctgcatgctcgaggccaccacgtagttgcaggtggcccatccgcgtggcccgttgacgccgccgaatgtctcgtcggtccaacgcaacacgtcgctggcgctggcgccttcgagctcggcggcgccgcgggcggctagttcacgcagttcggcctctggaagtttggtcgttcgttcggtcatcgcaaatcgtcctcgtctgccctcatggcccactgggcgaaacgttcaccttcgccgcgatatttcacgaagttgcgtgccacccgctcgatgtagtcgccgagctcgtcgctggtgaccttgtgctggcgcagttttcggccgaagccgctgtcctggcccaagctgccgcccagatgcacctggaatccctcgaccgagccgccctcgccgtcgtcgaccatctggcctttgaggccgatgtcggcgacctggatgcgggcacacgagttggggcagccgttgaggttgatggtaatcggcacgtcgagctgccggttgacatcggcgaggcggcgctccagctcgggcaccaaaccctgtgcccgcacccgtgtttcggcgaaagacagcttgcagaactcaattccgctgcaggccatcaggttacgacgccaatgcgacggttgcgattgcaggccgagggcttccagcccggccaccacctcgtcgagcttgtcgtcggggatgtcgagcagcaccagcttctgatagggagtgaatcggatccggtcgcaacccgcttgctgcgccaggtcggccaccgccagcaggatggtgcccgacacccgcccggcgatcggggcgactcccaccgcgttgagcccgttcttgagccgttgcacccccacgtgatcgatcggatgcgcgaccggctcgggggccggaccgtcgatcagcggacgcttgagatattcggtttcgagaacttcgcggaacttctcgatgccccagtccttgaccaggaacttcagccgcgccttggagcgcagccggcggtacccgtagtcgcggaacaccgaggtgaccgccgcccacacctcgggcacctcgtgcagcggaacccaggcgccgacccgttgggccagcatcgggttggtcgacagcccgccgccgacccacaggtccaggccgggaccgtgctcgggatggttgaccccgatgaacgcgacgtcgttgacctcgtgggcgacgtcctgcaaccccgagatcgcggtcttgtacttgcggggcaggtcggcgaagtcgggctggccgatgtagcgacgggcgatctcggcgatcgcccagctcgggtcgatgacctcctcgagcgactcacccgccagcggcgaccccaggatcacccgcgggcagtcgccgcaggcctcggtggtgcgcaaccccaccgcgtcgagcctgcgccagatctcggggacgttttccacctcgatccagtgatactggatgttctcgcggtcggtgatgtcggcggtgtcgcgggcgaagtccaccgaaatctggcccagcgtgcgcagcgcggccgcggagatggcgccgccgtcgcagcgcacccgcatcatgaagtacctggcctcgagcttttcgatgttctcgtcgccggtccagctgccgtcgtaaccctgctcgcgctgggtgtacaggccccaccagcggaaacggccgcgcaggtcgctcttgtcgatgctgtcgaagccgttcttggcgtagatggtctcgatccgctcccgaactgccagcggggcgccggcctgtttcatttcctcgttcgggttcagcggctcacgattccccagtgcccactggccctcgttacgggccttcgcgggtcgggcggtggtcatcggacgttctcctcggaaaaagatcgccagcgcggccagcacagttcaccgacactgttgggcggcatggaaccgtcagccggctggagacgcggggggctgggtctaccacgtcaaggcagacagatacagctgcagacgcgcttgagatcgatgtgccgtcgcgccacgagcaccacgtgcgggctgggttgggcgacagtcacgccaaccattgtgccacggacgccgacgggccgtgcgagcaggtcaaatcttggctcacggtgatttaaaacccgggccgcagcgggctcgccggccgtcccgggccgcccgttcgccgtgggatcatgtggcatggccattcgcgagcaaacggtcgagctgcccgacgtgcgggtggtcgacgggcacccgttcggcctctatgtgcacgtgccgttttgcgtaacccgttgcggttactgcgatttcaacacctacacaccggccgagctgggcggggtcaatcccgacgcgtggctgggggcgctgcgcacggaactggaactggccgccgcgcggctgcggcccccaccggtgaacaccgtgttcgtcgggggcgggacgccctcgctgctggggggcgcgcggctggcgctgctgctggacatggtgcgcgagcacttcgcgctggcgcccgacgcggagatcaccaccgaggccaaccccgagtcgacgtggccggagttcttcgacgccatcggggcggccggctacacccgggtgtcgctgggtatgcagtcggtggcgccgcgggtgctgggtgtgctggaccgcattcacacgccgaaccggtcggcggacgccgcccgcgaggcgctggccgccgggttcgagcacgtcagcctcgatctcatctacgggacgccgggggagtccgacgaggacctgctgtggtcgctcgacaccgcgatcgaaagcggtgtggaccacgtgtccgcctatgcgctggtggtcgaggaaggcacggcgctggcccggagggtgcgccgcggtgagctggcggcgcccgacgacgacgtgctggcgcaccgttacgaattggtcgacgcgcggctgtcgcaggcgggcctgtcctggtacgaagtctccaactggtcgcgcccgggcgggcagtgccggcacaacctcggctactgggacggcggtcagtggtggggcgcgggtcccggtgcccacggctacgtcggcacgacgcgctggtggaatgtcaagcaccccaacgcctatgccgaacggctcaacgccgcggcgctgccggtggccggattcgagcagctcggctccgaggccttgcacaccgaagacgtgctactgaaaatccgcttgcgccaagggtttccggtggatctgttgaattccgcggaacgcgaacgcgcccagggtgtggtggccgacgggttgttggtgcgcgacggcgaccggctggtgctcacgccgcgcgggcggctgctggccgacggcgtggtgcgcacgctgttggggtgacggcggcgccggtcagaccccgtaccagcgctcgacgaggcgggcgatctcgatgtagagcgggatccccaccgtgacgttgtaggagaacgtcaggcccagcgaggcggccagcggcagcgtcgggctcgcctcggggatcgccaggcgttgcaccgcgggcacggcgatgtaggacgccgcaccgcaaagcaccgcgaacagcacgtaggtcccggtcttgaagtcggtgtgggtcagcgaggcgtagctgcaggcgacgaaaatgcccagtgtcgcaaagacattcggggccaccaggccgaagacgatgaaaccccagccggccgagcgaaggtccttcaacttgcgcgacgccgtcatccccatctcgagcaggaacagacacagcacgccctggaaggcgatcacgaagaacttgtcgtcgtcggcgacgaccttctggccttgcagcccgctgaccaggccgatgatgatgccgcccatcagcaggaccaggccggggttgaggaagacctcctggaacagctcccgggagaagatcggcgcccttgtgcccttgccgcgcagcgggctcgggtcggtctgccactccgggtgctccagcttttccagcgacagttccagctcctgctcgatggccgcctcctcctgggtctgcaggctctggccgtgcggcggacgcgcggcggtgccgggaccgaccccgacccggaccggcggtgtgtagcccgcctcgtcgggcatgtacccggcggagtccatgccccggtggcgcagtcgcgccacgaagtacagcgccaccaggcagccgggaatctccatcacggccagcatcaccggcatgtaggcgttgaaggcgatgttcaccgccgccaggaccgccacgcaggtggcgaaggtgcccgccgagtccgacccgtagtagccggcgatggtggcgcggtccaccttgcgcagcgatttcagccggctcagccccaggtaggccagcccgccgatggcgcagttcagcacgaacccgagcaccatgaagcccacgatcgccccgacgctcgacgcgctgacctgggcgagttcctcgccgccgtgccagccgatggccagcagcagatacatcgtcaacccctgatagatcacgtaggggaattcgaaccgcaccttgagaatcgggatcaggaaaccgaagtagaagaacagcagtagcggcttgaagaggttgtgggtgaagttgtgccagaactcttgcagcatcgatgcctccgttgatcagagccgtgatcggggggaagcaccgtccgctagccgagcagccacgaaacgtcccgacgaccgtgacgaacctatccccgccgccctggcctcgccactcgacgacacggcgggtgaggaagatttaacggaatcctttcgggcggtataagcgctgctcagggccggatttccgggcggaatcggggcggattggccggttcgccgccgccgtgcatttggtgtgaaggtgctgtggatttactgtgcagtcaatagaagccaggtccggactgtaggccacggccggtgactgctccgaaccgacgggcggtgaccaccccgggatgagtgtggccgccggatgcgcaccgtgtgtggccgccacgtaaacggcgggaaaacgttgcgacgacgatcaccgcccttctgggaatccgactgacgagatcggttgcgcaaagctatataggttaggctacatttactaaccgtgaccgaggtcagcgtcgagacaacttccgccggctctgagtcgccgtcgattcctcttccggtgcacatcgacccggcggacctggccgccgagctggccgtggtgctctccgagcgtgccggggaagagtatttgctctacgagcgcggcggtgaatgggtgctggccaccggggtgcgcgccatgatcgagctggacagcgacgagctgcgggtgatccgcgacggcgtgacccagcgccaacactggtcgggccggccggggccggtgctcggtgaggccatcgatcggctgctgctggagaccgaccagcttttcggctggatcgccttcgagttcggcgtctatcgctacgggctgcagcagcgactggcgccgggcaccgcgctggcccgggtgttctggccgaacggacgcatcgtggtgacccgcgaggcgatccagctgttcgggacgtcgaccggccggcgcgacgacgtgctgggcgtgctcggcgacggggtgccggggctgcgcgacgcctcggcggtcgacgtcgtcaccgacccatcgaactatcgcgatcgggtggcctcggccgtcgcggagatcgctgccggccgctatcacaaggtgattctttcccgttgtctccaagtgcctttcgcggtggacttcccctccacctaccggctggcccgtcggcacaacaccccggtgcggtcgtttctgctgcggcttggcgggattcgcgcggtgggctacagcccggaactggttgcggccgtgcgtcacgacggcgtcgtggtgaccgaaccgctggcgggcacccgcgcgttcggccgcggcgccctgcacgaccgccaggcccgtgacgacctggagtcgaactccaaagagattgtcgagcacgcgatttcggtgcgaagctcgctgcaggagatggccgagatcgccgagcccggcaccgccgtggtcaccgacttcatgacggtccgggaacggggcagcgtccagcatctcggctccacggtcagcgggcggctgggcacgtccaacgaccggatggacgcgctggaagcgctgttccccgccgtcaccgcctcgggcatcccgaaagcgggcggagtggaggcgatcctgcgtctcgacgagggaccacgcgggctgtattcgggtgcggtggtgatggtttcggccgacggcgcgctggacgcggcgttgacgttgcgcgcggcctacgagcatgacggcaagacctggctgcgggccggcgccggcatcatcgaagagtcgacgcccgagcgcgaattcgaggagacctgcgagaagctgtccaccctcgcgccgtatctcattgcgcgccaatagcttcccggggctgccgctgcctggcgtgtgccgggtcacggttcggcgctaagggactttcggccctaggtggtcgcctccgccgcgtgtcatcttcatgtaaccgcatgacacagatacatgcgggctgccgaccgcgatggacaaccgggagggttccgtgcccaaggacctgactaacctgcagctgctgcatgaactcgagccggtggtggaggggctgctcaaccggcacctggcgaagttcaaggagtggaacccgcacgactacgtgccctggtcggacggcaagaatttccacacccgcggcgggcaggattgggagcccggccagacccggctgcccgacgtcgcgcaggtggccatcgtccaaaacctgctgaccgaagacaatctgccgtcgtatcaccgcgaaatcgccatgaatttcggcatggacggcccgtggggccagtgggtgaaccgctggaccgcggaggaggccaggcacagcaccgcgctgcgcgattacctcgtggtcactcgatcggtggacccggtggaattggagttgctgcggctcgagcaaatgacccggggcttcagccccggccagaatcagcagggcgacatgttcgccgagagcctgttcgactcggtcatgtatgtccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctcattccaggaattggccacccgcgtctcgcaccgcaacaccggcaaagtgtgcaacgacgcgatcgccgagcagttgatggccagggtgtcgcacgacgaaaacctgcacatgatcttctaccgggacgtcagcgccgcgggcctggatatcgcaccgaatcaagcgatgaagtcggtgcaccggattctgcgcaatttcaagatgcccggattcacggtgccggagtttcggcgcaaggcggtgatcatcgccgtcggcggtgtgtatgacccacggatccatctcgacgaggtggtcatgccggtgctcaagaaatggcgcatcttcgaacgcgaagactttaccggcgaggccgcccgaatgcgcgacgatctcggcctgctggtcaaggagctgcaggatgcgtcggagaaattcgaggaatccaagcagcgctacctcgaacgtgaggcacgcaggaccgagaaaatcaccgccagcaaagtgttgcaaacgaaaggaacgctgacgctgagccggcattgagccgagtgttccgccgatgattgtcgccgccgggccgatgtcacgcgcaaccctgcacgcctgctgcgggtttgccgcgaaaatccatcattctccggttttctgacagcgccgcgtttagcatctgtgccaccttcaacgggatggagtatttgtgtctggccgtaagtccaaaatcattcttgccgtaatgctggccctcacttaccccacggccgcagcctgcacgggcacctacacgtgcttaacctgcactgtggtcagcactcctttttagtgctgacccacgtctagattgcgcgcgcacgacccgaggtgcgcgcgaagccgtattcaggccgacgagctggattcgagatagtcggccagaatacggctgaccaacgactcaatattggcttcgatcgacgacgcgagcgtcgcggtgaccgtcgcgaccgcttgggtgcggaaccgcaccagcatggtgatcagctcggcgatctcggcgtcggccggcaatggttcgccgggcttgatccgatcgagcacgtgttcggcgcccgcgcgcaccagcatgtcgctgatcttgtcgatctcggggacgatctgctcgtgcaggtcgatgagcttgtcgaattcgacgccgtagccgcgtatttcgttgaacgcctcgatcagcttcgggcgggtcagggtggcccgggacccgtcgacgcggatcacctgaagcgccaccaggcgctcgaacgcgcgggggtcgccgacgagtcgctgcgcctcggccagcgacatggtctccggtttctcggtggtccaggtgcccacgatggcggtttccaggcccagcacgtcaccgaggttcttgccttgctcccaggcgctgagcatttcccggacgtgggcgatggtgtagccgcggtcgagcatcgacgtgatcagccgcagccgggtcaggtgggtgtcgttgaacagcgcgatccggccgacgcgcaggggcggcggcagcagcccgcggtcacggtagacgcaaatgttgcgggtggtggtgccggccagccgggccaggtcgtcgatccggtactcaccggagttggggtcgccgtgcgggtgacggaccgccgcgtcgaaaagctgcgacaccgcgccctcgatgagttggcgatattcccgcgactggcgccggacgcgcttgggtgcccgccgcacgttgtgcagcacgctggcgatggtgcccggctccggcctggaagaacggtaggttgcgcgctcggttgccatgtcggtgcgccggctcaggcggaggaggcggcgggtgtgcgggcacgccgcgccacggcctgatagtcctggtaccggaaatcgctcatctggcgaagatactgcgtggcgaagccgggatacatcgacccgttgaatccgtccttggtgaggtaccaacttcggcaccccgacatccaggtcgtcttggtgagccggcgttgaatggcctcgttgtggcggcgttgaacctcttcgcgcacatcgaggtagcgcaggtcgtcgttgagaatggtggtgatgccgcggaccgcgtagtccagctggccctcgatgtagaccagcagcgagttgtgcccgggcccggagttggggccggtcatcacgaacaggttcgggtagccgtgcacgttgatgctcttgtaagcctgtgcgccaccggcccattcggcggccagcgatcgtcccccaagcccggtgaccggaaacggcggaccggtcaggtgcacgtcgtagccggtggcgaacacgatgcagtcgaggtggtgctcgatgccgtcactggtgcgaatgccggccgggctcaacgtggcgatcggccagtcgatgagcttgcagttgtcgcgttgcagcgccgggtagtagtcgctcgagaccagcatgcgcttgcagccgggccggaagtccggcgtcagctgacggcgcagccacggatccttcacctgagcgcgcagatgcgcctttccgagccgggcgaccagcgacgtcaacggcgtgtcccacaccagcgcggtggcgctggcttcgtggccccagtacagcgcctggcgggcaagttcctgtgcggcagggactttcgcgaacaacgcctggacagccggtggggtggcgacatccagccgcggcagcacccagcacggggtgcgctgaaacaccttgacgaacccggcctgcttgaccagttcggggatgatctggatggcgctggcgccggtcccgatgaccgcgacccgcttgcccgcgaagtcgtagtcgtggtcccagcgcgcgctgtggatcttgtgcccgcggtagctgtccagcccacggatgtcggggaagctgacgtcggacaggggacccgacgccagcaccacggtgcgggcgcggaacttcttgcggttcttggtggtggcggtccacacgccggcgtcctcgtcgaaggccaaaccgctgacctcgtggccgaacctgatgcgccggcgaatgtcgaaccggtccgccatgtcctcgaggtggcgatagatctcgggggccggcgagtaggttcgcgaccatgtcgggttcttgacgaacgagtaggaatacagcagcgagggaacatcgcagctggcaccgggatacgtcgtgtcacgccaggttccgccgacccggtcggcgcgctccagaatcacgatgtcgtcgactccggcctcggccagtcggatcgccgcacccagaccggtgaagccggctccgatgatgagcgccgcgtgggcgtgatcgcgtgccatgctcacgccgccggctcgtgggtgagttcttccacccaggatggcacccgcggaagcagcagccgcggataccggtcggaaagccacaccatcgaattcgccagcaggtggtaggggtggcgtgggttggtgacaactccggcgtagcgcctcaggaaacgataggtcggcacccgagtggtgcgttcgccgcgatcgccaagctctttgaatcgtttgaccgcccggtagagccgctccggctccatgcccatggcggtgatctcgttgcggatccggttgatcagcggtgcgccggtgatcgcaccgatgatgaggcccggagtggcatggtgaccgacgaagtcgatcagcaaccgccggaccttggcgtgcccgatcatgtcgaggacttcgaaatcgacgacgagatggcgggattcgtcattgttgatcttctcgaagacctgatggcagatggggtcgtgcacctcgtcgaggagaaatttcaacagggcgccgtccagtgccacctcgagcatcgggatgacggtgcccagcagcgacagcggcatgtcgtcggcccaacggtccaaccagtcgatcgccagccggatattcacgttcggctcgggaatctcaccgtcggtgagcatgccccagcgtttcatcagcgccagttcggcgttggcgtgccgctgctcctcggcgtgaaagtagcggtagatctcggcgatggtcggggtgggcgccttcttcgccagtgccgcgaatcccctggcgccgatgttctcgatccagcacaggtcggccatgaacgccttgagctgtggccgctgttcgtcactgatcatgtcggcgccgggcgcggtccaatcgatgtcggcgagcgcccactgtcgatccttgatcttggcgagcatggcttccatgtcgatggccaccggaggctcctttccgtcgggtgatcagggcaggttgattcgggacaccaggccggctgctcgcgtataggcctgcggggcaaggcgtttgatgtgccagccgatttgtgcgtcgagctgcggcatgcagtacaggtcgccgcggtcgtgcgcgtccaagcagatgcgggcgactttgtccgcggagaacccggtccagcgcatcagttttgcggccagttcgccggactcctcgctgattcgcccggattcgaggatgttcgtcttgacgaacgtcgggcacagcacggtgacccgcaccggcgtgccggacagctcggcggccagggtctcggacagtgacagcacgcccgccttgctgacgttgtaggcagccatgccgggggccgcgccgaacgccgcggccgaggcgacgttgatgatgccccgcggcgcggccgacggcgcggcgtcgcgcaggatcggggtgaacacatgacagccgtgaatgggaccccacaggttgattccgagcgtccactgccaatcgtccagtggcgcatcaccgatggccgcgccgccggcgccgacaccggcgttgttgatcaccagtgtgggtggggcgccgaagcaggactgcgactgctcggccagcgcctgcacgtcgccgaattgcgagacatcacaacgggttgcgagggctttcgcgccgtgttgggtgatcgcgtcggccgtccgctgggcggcggcttggtcgatatcgctgcacacgacggtgccgccgcgcttgcccagttcgagggcgaaggccgcaccgatgccgcttcccgcgccggtcaccaccgccagggcgccgcggctggtcttcgatcggtgcagcagccggtccaacatgtcagtgcatctcctgggtgagggcacgggcatcctgcagggcgtgggtgatgaaccgcgcgacataggccatggccttggcggcttcgggcgtcatgcgcggcaacgcctgaaagacgtgcacctggtgcggccagatctgtagttcgcatctgccgccggcggtgcggatgtcggcggcgagttggtgggcgtccgcttgcagcatttcggctccgccggcctggatcaatgtgggcggaagcgcgggaccgcgggcgacgtcgagcgtcagccgctcatgggtgaggtcgacgccgctgtggtagaggcccaccagccggatcgcgttggccgcccgggtggtcggatcggggcgaatccgttctcgcgccttggccagctcgaacgtcaggtcatagaggggggagaacaacaccatggcggcggggtgttcgacccccggttgcagcagtaggtcgacggacaggtgaccgccggccgagtcaccggcgatcaccatctgttcgggcaacacaccgcaggtgttgatcagccagtcccagccggcgcgcacgtcgtcggcagcggtggggaagcgatgacgcggggccagtcggtagtccacgcagaacaccggcaggccggtcagcgacgacagccaggatgtcaagcggcggtgcgtctttggcgaacacaccgcgtagccgctgccgtgtatgtagtagatcgcttcggcgatgctggacgggcgcgagtgctcgctcgtcggggtgcgcgggccgaagacccattcacccttgacgcggcggccgtcgggcagcctggtgtccaccgattggacgcgggtgccggacagcgaggggccgaacgttcccatgatccgggcgacgatctggcgcgaaagccacagtccccatgcccgctcgggcgggatcacgctggtgatcggccgaagggtgtacgtacttaccgctgccgcgccgcgggaccgcaatgacccgcgagccggaacaccgcccgtcatgcaatgcagtcaacactaaatggtgacattggtcaatggcagcttttggtctgcgccgtacgcgtggtgcttggtgggagcgaatgcagtgttgggagtcatcctgcaagcagtgcttgcagcagccctcctcctcgtcgggatgggttaattcacggaggcccggcaaccgaactgcccgcagagatgcggccgttcgttcgtctgtgctttcggcgctgagcgcttggcgctgaaagggtcgcgccaaccgcgttgacgacataagcttgccgggtcactcggaaggccagccgcttcggttaccaaagcccgtgtgacttcggattattggcaggtcggccgccgtggcgaatccggcgggagcggcgcacaccgcgggtaccgcgttcaacacctgcatggcggtggccacgctggccgaacgcacatgttctgccatcgaggccgcgcgggtgaagcttgccagggcgaagaaatgcgcgcgcatcgacgggtcgccctcgatggtcaaggtccagccgtgctgcggttgcggccaatgcttcggatattcaccgcccaccgtccatagcgtctcgatttcgacgagcacctcgccgtcgcgtccgcctgaccagttccagcgttgtcccgcagtggttcccgccttgagcaggtggtcgaagatctgatggtcggcttcggcgggaacggcctcgaccgatgcggtgacctcgtcgatatccgcgttgagtgagtcggcgatcaaccacacttgttcggtgaagatggcgctgttgaatgccaggaactggttggtgtgcgggctgatgtcggcgacgggttgcccgaaacgccatgttgtcgaacgtgatcgacgtgctctcgtacgccgaccaatcggcgcgttcctgcagggtgatcttgtcgatagtgggactcatccccgaaagcgcgagcggcagtgcgctcgagaggttgccgggattgaggcccccgccgtgcacggtggtgccgccggtgcggcaggcattgaggacgcgagcgcgatcggccgtgttgatgcgcgccggatgaaattggaaagccgttgtggcaacgttctttccgctcgacagaaggctgcagacgtcgtcgatgctctggctgcggggggtgtacagcacgcagtctgcctccagctcaagcaccgcattgacgtcggtggtggcggcaaccccgatgggagcacgcccggccaatatcccgacgtcttggccggctttggaatcggagtagacgcgcgcaccgacgatccgtaggtcgtcgcggtgatcgatgatggtggtaagcatttcggctcccacggtgccgataccccaggcgatgacgttcagcggtctgcggtcagacatcggacagaagccgacgcgtgggcagcaccgtcaacgggacgccgcgatcttcgaactgccagttcggcccatgagagatgtaggtcatttcgacttcctcccggcgcttcgcttcggtgtccgaccaccggatgtcgacgaccaggtcgctggcctcgtaggtcgcgtgcagatccgaccagtgcggatcgacaccggtggccatgacctcgaggggactgacatcgtgcgtcgacagcgtcgccatccaactgcggtcgcggacggcgggggagttgcttgggatgcgcacccgcaccgcgtcgcgcgctcctgtcccgaggcgctccacggatgctccggtgtaggcgaacgggcgcagggcgggatgcaaatcgaggaccgaagcaaggtcatctgcgccgacgccaaacccgaggctgctttgatgcgcgccgaaccgacgtaggcggtgccggtgaactgcctgcgcagcagaccgagcgccttggcctcgccgccgtgccggcgcaccgagcgctcgaacgcgagcgccagcagatgatgctgaatggcgacttcctcggccaaccggacgagcgccgagcgtgaccactgatcaaatcgaatgtccgagaacaacggaccggtgtagtcgccgaggccgtcgtccgagaggtcgatcgggtcgaactgcagggccgtcagctcgcagcgcgagacctcgaccgcctcggcggggatgggcaggtcctcccggctgtcttcgatggtgaccgaccagtggcagtggggggtacggtcggccggcttgcgcgggggccggtggatgggtcggaaccgcgccttggggttggtcgcgatggccgtcgcatcaaaggtgaaatcctggatggtgtggcacatcgcgcggacccagacgtcgcccatcggctcgacgtcgatcaaggcgccgcagtagtcgttgcggaactccccgtggttgggatcgatcagcgagtagcggaagtcgaggaactgcggcggcgctccgacgtcgaactgcagcaccttgaagatgtcctcgacggtgtcaccggtgacaccgagcgcgtggcgcaggcgtcgggtgtagttgggactggctcccatccactcctcgatggcgacctgggtctgaacctctggatcgacatttgtgcggtgctcgcaacaagccgccgcgatcaggctgacgggattgcccgacggcggcaccgatgcgcccgaatcgattggaaccgtgtcaatttgatcaacggtgtctcccgccggtgaagcgactacgaactcgctgtccgcgacaccagggcggcggcgacctgggccacaggggtgtttgacgcttccggatgaacgactccgccacctgcgacgcaggaccaaccgacgcgtcggaccgtgccaaattcgccggcagccgagaagtcccatccgcgatcgggggttgcggcaaagaagaccccgatgaaaccggacatcgctagcgccggctcctgtctaggtcgacggttcccgtgcactcgttgaggccatgattgcgtctacctctcaaagccgacttcgggcctgcctgcgcggtgttgactttccggcgagcacgaacgaactgattgaagccgccaagcgaaaggcgacgataacgacacggttcaggtgttgcagagactggcaccagtgacctacacgaatctcgcacaggttgctgcgtcggtgaccatcgtggatgaagagggcctcggcgggagtcctgtttcggtatagctggcacctcaacccaagccccggccaacagcgcaaaaggttggtgtatagctaaaagccgcagacgaacgtgccgcctgttaggtgatccaatttcaatccgaactgagtaacatgccctgccaggttttcggtgcattcgcccgcaccaaatccgactgccgataaagctggccgttgggcgcaacgtatcgcccagtacgggggtcgtagtgcagcaccgcaactgaaggcgagacaccagaactgttggagtcgaacgcgcttggtgccgctggcgcggcagccacatccggcgctgtcggcggctggttgagcgaacccggcgctggcgggcctggcggtgttccagcgggcgccgccccgggcggcaacggcgtcccctcgaccggaccgaaagtcctgtcctcgataccagcccggtcatccggtggcagaccctgcgatagaaggttcgggtcgagcggatacggccccagcgcgtgctgcctctccgctagcggcacatacggtttatcgctattgcagatttcgactgtgggcgcacgctttccgggtttgcccatgcaggggtaggtccgcgccccccgcacgctgatcggcgagtcctgcggaagtttgcagtacagattgtcgggggtgtcggcctcactggtgtcggcgggtgagcgccactgcgacggtggcaggaacccgaccgtgcacgccggcgggtcggcgatggtcagcgtgaagcggccgaccgccaaaccggtcgggttgttggtgacgccgtaagacccgtaggccgcgacggacggggggagcagcaccagcagctgttccagcgccgggtgatatgtcaccccgatctggccgatggtggacaggttcgccaagaagaccggcagggtcggcttcagctggtccagcagtcgcgaaacctcttgctcgaagccaggtccggtgtgcagtagcttgcggaactgcgcatcgtcggtcaccatctggtcggtgaagccggccaggttgtgcgcccaccgtcgcgtcttgtcggcggtctgcgcctgcgcatccaggaacggcgcgccgtcgtcgaccagcgcacgggtgtggtcgacaacgccggacgcgtcgcgcgagagcttgcccgacgaatcgagcagccactccaggtcatagcccgcgccgttgaacgcggagaacgactcgttgagcagctgccccagtttgtctttggggatgctcttgaccaacgcgctgagcctgtccagcatcggccccaccggccgcgggatgctggtgtcccgcgcggtgatcaccgacccgtcgcacagatagggtccggattccgagcgcggcaccaggtccacgtattgctcgcccaccgctgacatgctgcgcaccgccgcgtgcacatcggccgggatcttcggcgaggtgtcaagctgcagcgtggctttcgcgccggtcgcggtcggggcgaccgcggtcaccttgccgatctggacgccgcgataggtgacgttgctgaagcggtacagccctccggtatccggcagctccaaggtgaccgtgagcttgccgatcccgagcagcgtcggcacctgcatgtactggaagaacatgaacgccatcgcgaccaccgacgcgagcgcgaagatggtcagctgaatccgcacgaaccgcgtcagcatcagccaccgcctcgcgacggttgatccacgggcgcaatgacactcatatcgggagccatgacaggcggcgccgaagcgggcgcgccgggagaaggcggcggcgccaaaggcggattggtgacgccgaaaccgagcgggtcgtaggtgtagttcgaaaaccagggatcacccggcgcgggcaccagcggcgcgtccggatctccccaccgggtaccggcgagcagcgtcctcttcagccggggaatggtcatgtcgatgacggcgaagacgttgaagtagtcaccccgcaccgcccggtcaatgaagttctgcgtgaacgggaaggtcggcacatatcccaaaacggtgctgagatcgggccccacgtccgccagcgcctggatcgtcggctccagattttgcaggttcttcaccaggtcggcctgggtctcattgaccaattgcgttgcggtgttgctgaacacgcggagtttgtccagggccgcggtgatgcgtggccgttcgcggatcagcacgtcgagcgcgggcggaatcttgcgcagcgcttgggtgatcacctcgcgctgggaggcgaatgtgccggcgagccggttcagtgagtcgatcgacgcaatgatcctgtcgcgctgttggtccaggacgccgacgaattcgtcgaggcgcgtcagcagttggcgcacatcggtctcgtggccggacaacgccgcgctgaagttgtgcacgatgtcgccgatctggcccaggacaccctgcaagcggccgacgatgccctgtccagcgggatggtggccccgggctgcagccgtccccgcggcggttggcccagcgggggactgagctccacgtgcatcgaacccagcaggctggtctgtccgacggcggccaccgcgtttccgggcaccaccacatcgggtttcaccgagacctcgacgtcggcgtgatcgtgcttgacccgcatcttgccgacgctgcccacgatgacgtcggccatcatcaccggcgaattcgattccagggtgccgatattggcgatctcgatgtgatagatgctggcgtgtggcccgcgaccgacagcaccgggcaggggcaacgagttcacgccctgaaaggaacagccaccaacggcgaaggcgcacgctacgatacaaagccggaccctcgtcatggcggcgtccccgggcccggcggcggcggctgatcgcccggcgccggctggcgatcgtcgggcagcagcaggtcctgcacgctgtgcggtgtcgagtcaccgttgatgccggtgtaggcggataccgccggcgggacgtcggggggcgtgggcgatggcccttcggcgccgggcgccaggcgcggttcggcgtagatgatttttccgggagtggcgatctgctgcaggatgatgttcgtcgggatgggcaggtagttgaggttcgcggtgcgcagaccggggccggcgtattccgcgcacagcttcccggtttcggccgcggtgacgttcgcgacggcgccgatggcgtcgcagaagaagtgcaccgggttggagaggttgttgatgatgaagctgcccatggctccgggggtgttggggttatagatgttgtagccgttggagaatgcggtgggcgcggcgtgcaggatgttctccacatccatccggtggtcgaccagaacctgcgtgacggtggtcagccgctgaatctgttcggcggtcttgtcccgggttccggcgacgaagcgttgcacctcaccgacggccaccgacaggttcgacagcgccgcatctagatcggatcggctgtcgtcgagcacgctgctcagtgtcgtcaaccggttctggaactggacgatctgttgattgctgtcgcgcagggtggtgacgaacttctgcaggttcttgatgatgtcgacgatgttgccgctgccgttggccaggatccggctgatcccggaaagctgcccgagggtctggcgcagcttctcgccgttgccgtccagcgcgttggcggcggtggtgatgaagcggctgaccgacgtcgacgacacgtcactggccgggcccagatcggttgcgagcctggtcaattgctcggtgacctggtcccattcgacgggtatcgccgttcggtcggtatcgatcacggccccgtccagcatcttgggaccgccgccccggtgataggcgggggtgagctggacgtagcgggcggacaccaggttttgtgcgacgatgatcgccttggcgtcggccgggatcgacacgtggcggtcgacgtgcagaatcagcctggcccggctgggctgcggctgtacggaggcgacggtgccgactttgacgccggagacgcggatttcgtcgccggcgtagatcccggttgccgacgggaagtaggcggtgatggtcagtggacggaagaacgtctggcgcaccaggaatccgctcgcacccacgagcagaccgaccaacagcgcggtcaccagcagccgcctgcgcacggtcatcgcgaaccgcccgggatgccgttgtgcggccaggggaacagcgcccgcggcatgttcgggtcgttgcggcggaacccgaagtagtaatcgaagaacggctgaatcagctcgggtatcgcaagattgggcacgaacgcgttgtagtagaagccgttcgacaccgactcgcccgaggtgatctcgaacttcttcaggccgggcagcgccttggagaggttgtcgcggttcttctccagcatggccgcaacggaattcagccggtccagtgtcgggccgagcttgctctcgttgtcggccaccagtccggtcagctgcttggagaccgcggagacgttggccagcagctcgctgatcgcatcgcgccgccgcaccaatgtttcgagcagcacgttgccgtcgaggatcagcgagttgaccccttggctgtgctccgagaggatgcccgtgacatcggtggcgctcttgagcagcgcgtccaggctttcgccgcggctgttgatcgcccgcgacaagcgggtcactccgtcgaacgtcgggcccagctgcggggcgatctgatcgatcgtcgccgacagggcgtccagcgattgattgagggtgtcggtgctggtggtcgagaggttcgtggtcatgtcggacacggcctccgtcaacgaatacggtgacgacgtccgggacagcgggatgacctccgacggacgcaacaggccggcgccggccgactccagggtcagcacccgagcccccagcagcgaaccggtgcgaatgtgcgcggtgctcagcgacccgagccgcaccttgccgttgaccccgaaatcgaccagggcgttgccgtcgtcgtccagcgaaaccctagaaaccgtaccgacattgacaccggagaccaaaaccttgttgccgggtaacagcccgccggcctcggagaacaacgcctcatagcgaatcgtcgtcgcccaggtcaccagccggtccggtgccaacccgacggcgacgacgagcaggatcagcaccgtcccgatgaagcccggtcgaatgaggtttgcgccacggtatttcagcatcagggctccgcgcaccttccctcggtttgctttagccaggggtagaccgccgtgcggccctgcagatcggtgacgcggaacgtcagcccacagatgtagtagttgacgaagctgccgtaggcgccggtgcgggcgagcttgcggaagttgttgggcgcccgctgcagtgcgtcgtcgaggcgccccttgccgtgctcgagcaggggggccagccggttcagctggtcgaccgttccggacagcggtgggcgcgcggcgctgagcaggtcggtcaccgaggcggtgccggtggccagggcctggatcgcgtccccgatcggatcgcggtcgtgcgcgaggtcggtgacgaggcgctgcaggcgttcgatcgcgccggagaactggctcccttggtccgacagggtccgcacgacggtgttgaggttgtcgatcagggtttcgatggccttgttcttgccggcgacgtcgttggagaaggacgacgttttcgccagcagggactgcagcgtttggccctgtccctggaacacctgtagtagcgcgccggccagagcgttgacgtcctgcggattcaggccctggataacgggtttcagcccgccgagcagcaggtcaagatccagggagggcatggtgtggtcgatcgatatctgcgacccctccggcagcacccgcatggagccggggccgatgatgagttcgaggtagcgatcgcccaccaggttgagatatcgcacggccgcccgggtgccggtggtgagcgcgacgtcgtcgtcggcgtcgaagtccacgactaccttgttgtccggctgcagcgcaatgccgttgaccgtgccgacccgaattccggctacccgcaccgaatctccggtcttcagctgcgaggcgtcgatgaagaccgctgagtaactgtgggtggggccgttgcggaattggccgaagatgaagaagagggaggtcgtgagcatcagcatcacggcggcgaagacgccgaacttcaccatgatgcggccggtgccggtcatcccggttgcccgatctgtgcggtattgcgcggcggtccgtcgagggggccatagaggaactgcttgagcccgtcggagttcaacaggatgccctgctgtccgtactgccacgggttggcgcctatgtcggcgacgtcgaagggcgggaaggtgttgtaggcgagcggtaattcgtgatcacactgcgggccgccccgggccgccaccttgggcaggttcttcggaaaccggtagcgctcggagcctagcgtgatgccgcccaacacctcgagccccggcaccggcgtgggcggctgcagcgccagcgggaacatgcccttcaaagaacacgtcagcgcctggtggtactcgttggtcaggtcggtcgtcggtgccagcagatgcgttacttcggcaagcttttcgcgattggtgcccaggacgtcgttgccgaggtcggccaggccgatcgaactgatcaacagcgcgtcgaggttctgctgttcgtcgaccagggtctggctgatgcgcgtcgtgcggtccgcgacggtgatgaggtcgggcgccgcgtcggcgtaggcgctcgacacctcggccgtggcctcgatgtcgtggctcaggttcggcaggctcggctcgatcttgccgagaaagttgttcaggtcgctgaacatctgtcccagccgtgcaccgcgtccgttgagtgcggtggccatggcaccgagcgtctcgttgagtttggccgggtcgattttcgccagcaccgacgtgagttgttggaacaccgagttgatttcgacggtgacgcggccggcgtcgagcacctgaccggcgcgcaggcgctgcggcgacgggctctccgggggaatgagctggatgaacttcgcgccgaacgccgtcgtcgcaacgatgttgacgagaacgttggccgggatgagctgcagcctggacggatcgagggccagatggatgtccgcctgcccgtcggctcggtcctggatggaggcgacgctgccgaccggtgcaccgtgcagcttgaccttggcgcccgggttcatcatcaagcccgcccgtccggcgaccaccgtgaccggcacggtttgggtgaagccgccgcgaaactgcgtgagcgcgagggcgaggacggcggcggcggcgatgacggtcgccaatcccgcgagcgggcgggcgtagcgaaacgtggggcggcgactggcgagggggtgcgagggcgctcggtgtccggccggcacggcctggattcgtctggtcacctaggccccttcgccgccgcgggatgtcgggtcgacgcaccaaacagccagtgcgacagtcgaagtggtgcgcacatgccggctacagacccccgtcacgctgtcccgatccatagtcatccaagccaaccggtccgcggtgtgatacaaatctcacgttagtagcgagcagaacgatacatccgcattacgagaacttcaatactgttcaacacgagagtatcgttctacgctggccacggctgaagcccaccggaggagcaatgtgaccggtatccgtgtcgtcgcgcccgagttggcgcgccgctacgaggagcagggctggtggaccccggacacgctcggggatctgctggcccgcggcctcaaagacaaccagcacaacacgtttcgcgtgcactccgcggtgcggccattcgcgggcacgttcggcgatgtcgagctgctggcccgcaggctcgcggcagggctgcgcgcccggggcgtcggcccgggtgacgtggtcgccttccagctaccgaactgggtggaagcggcggtcaccttctgggcctcggcactcctttccgcggtggtcgtgccgatcgtccacttctacgggccgaaggaattgcgctacatcctgtcgagcgtcaggccgcgggtcttcatcaccgccgagggattcgggcgcatgacctacgtgccggaggtctgtgcgggcgtaccgaccgtcgcgctggtgggcgagagctttgacgcgctgctcgaggacgaaccgatggacgccacggtggcgaccgatcccgccaacccggcggtgatcgcgttcacgtcgggcaccaccagcgaccccaagggcgtgatccacagccatcagacactgggcttcgaaacgcgccagctgttggcgaattacccgcaggggctcgggcggcagctcaccgcgctgcccgtcgggcatttcatcggcatgctcggcgcgttcctgatgctggttctcgacggcgcgccgatcgacctcaccgatgtctgggacccggacaaggcgatcgacctgatggacgccgacggcgtggcactcggcgggggaccgccgtacttcgtcaccagcctgctagaccacccccgcttcaccccggatcacctgcgctacatcaaacacatcggactgggtggatccaccgtcccggcggcggtcacccggcgcctggccgacctcgggatcgtcgtcacccgctcctacggcagctccgagcatccgtcgatcaccggttcgcagcacaccgcaccggaggccaagcggctgttcaccgacggcaaggcgcgcgcgggcgtcgaggtgcggttggccgacgacggcgaaatactttcgcgcggaccggatctgttcgtcggctacaccgatcccgtgttgacagcccgagcgttcgacgaggacggctggtatcacaccggcgacatcggggtgatggatgacgacggctacctgaccatcaccgaccgcaagtccgacatcatcatccgcggcggcgagaacatcagcgccctggaagtcgaggaagttctgctcgccatgccggcggtcgccgaggcggtcgtggtttccgcgcccgatgcgcggctcggcgagcacgccgcggccgtgctgcgtcttaagcccgggtatggcatgccgaccatggccgaggtccgcgagcacttcgagcgcgccggggtggccaagcagaagtggcccgaggagctgcacgaagtggccgactttccccgcaccgccagcggcaaggtgcagaaatacgttgtgcgccagagtattcgggagaaagcgtagcggtcggcgggcgggtcagcggctcgaccggccgaaaattgagagttgaacttctggtcaaaatagaatacggttctaccgttacctggtatttaggagttgtcgtgacgatcgtcgcggaacaacgcacgtatgtcgcgggccgttgggtcaccggtgacgaagtggtcagcgtcgaaaatcccgccgacgagagtcacgtcgccgacatcaccgtcactccgttgcccgaggtgcagcgcgcgatcgccgaggcgcgccgcagcttcgacgacggggtgtgggccgacatgccgcccgtcgagcgggcgcaaatactgcacgcctttatcgaccacatcgagtccgagcgcgccacactggttcccaccctcgtcgccgaggccggccaatcggcgcgcttcgccgagatgacgcagctgggtgccggggcggccatcgcgcgccagacgatcgacctgtacctgtcgatgtcgcacgaggaagccagcccggttccggtcgatgacctggtgcgtggccgggtcgcgctgagcgtgcggcggcacgaacccgtcggcgtcgtcaccgccatcacgccgtacaacgcggcgctgatcatgggctttcagaagctgattcccgcgttgatggcgggcaattcggtgatcttgcggcccagcccgctgaccccgatctcgtcgctgatcttcggcgcggccgccgacgcggccggcctgccgccgggagtcctgagcgtcgtcgtcgagtcgggcatcgccggggccgagttgctcaccagcgatccgagcgtggacatggtgtcgttcacgggctcgacgctggcggggcgcaaaatcctggcccaggcggcgccgaccgtcaaacgggtgtcgctggaactcggcggaaagtcggcgcagatctacctgcccgatgcggtgcaccgcgccgtcggcggcgccttcgtcgcggtcgccagcaccgccggacaggcctgcgtagcggccaccagattgcttgtgccacaagacaagaaagccgaagtgctggacgcggtcagcgcgatgtaccagcagatcaaggtcgggccgcccagcgacgaaacggcgatgatgggcccggtcatcagcgcggcctagcgcgacaaatgcgagcagtacgtgaagttggccgaagaacacggcggcaaggtgttctgcggtggcggacgcccggcgggtcttgaccgcggctactacttcgaaccgaccgtgctcgacctgcccagcaacgcgaatccggctgcgcaggaggagatcttcggcccgatcatcggcgtgctgggctaccgcgatatcgacgacgcggtcgccatcgccaacgacagcatctacggcctgtccgggcaggtgtacgggaccgacgcggcggccgcgctgcaggtcgcgcgccgactgcgcaccggcgccgtcaacgtcaacaccaccgtcttctccgcctacgcgccgagcggcggatacaagcaaagcggtctgggccgcgaacggggtccggacggcattcgcgagttccaggaggtcaagcacatgtcgattggggagttgaaatgagctcagaaaccaacggagataagacatacaacctggactggctgatctcggtcgacgaccacatcctcgagccgccaaacctgtgggtcgaccgggtcgccgccaaggaccgcgaccgcgccccgcacatggagaagaacgaccagggcgtggacaactgggtctacgacggcaagcgctacccgaactcgggcctgagcgccgtcgtcggaaagtccaaggaggagttcagccccgagccgctgtcctactccgagatgcgcccaggctgctatgacgccaaggcccgcgtcgaggacatggaccgctcgggtgtgcttgcgtcgctgtgctttccgacgatcacgcggttctgcggccagctattcatggaggccagcgaccgcgaattcgggttcgagtgtctgcagcactacaacgactggctcgtcgaggaatggtgtggtgccgcccccggccgctacatcccgctgatgctgatcccgatgtgggacccgaaactggccgccaaggagatggagcggatggccgccaagggcgtgacgtccttcgcgttctcggaaaacccggaaccgttggggctgcctaccattcacgaccccgcgggctactgggaaccggtgatggccgcggccaacgaactcgaaatggtggccagcatgcacgtcggctcctcgtcgaccctgcccaagatctgttcggacgcgccgttcatggccaacctcacctggggtgcctcccgcacctcgggaacgatgctgtcctggttgttcagcggcatgttccagcgctaccccaagctgaagatcgcgctgtccgagggtgaggtcggctggatgccctacttcctggagcgcgccgaacaggtgctggacaagcagcggtactgggtgatgcgcggcgcgaagttcgacacccacgccggcgccggccaggcgatcgacctcgacaccctcgacatccgcgagacgttccgcaaccacatctacggctgcatcatcgaagaccgccacgccgtcaagagtttggacgagatcggcgaggacaacatcatgtgcgaaacggactacccgcactcggactccacctggcccgactgcatcggcgtcgcccgcaacaccatgaaggacctcccggagaacgtgcaatacaagctgttgcgcggcaatgccgaaaagctctaccggttcaccccggccgagccccccgtcctggcgagcgcctgatgcccggagtgctcgccggcaagagcgccatcgtcaccggcgccggctccggggtgggccgggtgtcggcgctgcggttcgccgaggagggtgcgcgggtggtcgccgccgatatcgacctcgaccacgcgaaagagactgtctgccaaatcgaatcggccggcggcaccgccatcgcgatcgggaccgatgtctcggacgagcaacaggtgcaggcgatgatcgcggccgccgtcgaccagtacggccggctcgacatcctgttcaacaacgtcggcatcccgacgccgcggctcggcatgatcttcgaggaccacaccctcgaggacttcaaccgcctggtcgcggtcaacctcggcggggtgttcctcggctgcaagtacgcggtgctgcgcttcaaggagcagggcgcgggcggggtcatcctcaacaccgcgtcggtggccggcctggtgggctggggcggttcggtgtacggcgcgaccaagggcggggtcatccagctcacccgggcggtcgcgatcgaggcggcgcccttcgggattcgcgtcaacgcgatctgcccggcggccatgccgctgaccggtttcatggcggcgggcgggctggaggtcgacgcggagcagcaggcggcgatcgccgaatcggtcgggggtcagcatccgctggggcgcgccatcacggccgaggactgcgccgaggcggcgctgtatctggtctcggacgcggcgcgcaacgtcaccggggtggcgctgccggtcgacggcgggttcgtggcgaaatgaccgctcccgcactggatcgcgaccgactgcgcgagctgttcgacctgcgcagctcctacaacgcttgggccggcggcgcatacgaggacgacccgtacccggtgtggcaccggctgcgcgagaaggggccggtgctgcccggcgtcctgcacgagctgaccggcagcaccgacacgatgttcttccacgggctgccgtacccggactgcccgcatttcacggtgttcgactacgactcgtgcatgatcgcttaccgcaatccggaggtgttcgcctcgtccccggagcccgtcgacctcgagcatggcccgctgggcctgaccaacagcatgctgtcgatgaacggcgaacagcacaagcggtatcgcgcgttggtccagccgtcgttcctgccggcgaatggcaagtggtggattgacaattggatctccgagaccgtcgacctgctcatcgacggactggttcacgaggggcgcgccgaactcaacgtcgacttctgcgcggccatcccggtgctgaccatcaccggcagcttcggcgtgcccgtcgagcaggccctcgacatccgcgaggcgctggcgcgggatccgcagaaggtggtcgacctgctcaagccggtgatcgccgcccgccccgaggagccgcgcgacgacctgatcagcgtcctcgtgcaggccgaactcaccgacgaggacggcgccaaggaccggctcaccgatcgcgaaatcgattccttcgtgctgctgttgctcggcgcgggctcgggcaccacctggaagcagatgggcaccacgctgacgacgctgttgcagcgtcccgaactcctcgaggcggtgcgcgcggaccgttcgcttttgcggccggcgatcgaggaggcgatccggtggatgccgaccgatccgatgttctcccgctgggtgatggccgataccgagctggccggcgtgtcgatccccgccgggtctgtcgtgcacctcgcgctcggggcggccaaccgggatcccgcccgctgggaccgtcccgacgaatacgacatcacccgaaagttcaagccgtcgttgggtttcgggcagggttcacacatctgcctcggcatgcacgtagcccgcgctgagatgactatagcgatctcggcgctgctcgaccggctgcccaacctgcggctggatcccgacgccgaaccgccccgcttcgtcggaatgtacgagcgcggggcgaccgccataccggtggtgttcgatgtctgaacccggctacacaccgcccgacctgatgctggtcggcgacgaccacgtgcgcgcataccgcgaaaccggcggcgagaccggctatctgtggaacggcgttccgatcttgctgctcacggtgaccgggcgtcgcaccggccgcgcactcacgtcggcgctgatcttcggccgcgacggcgacgactatctggtggtggcctccatgggcggcgcgccgcggcacccgtcgtggtatctgaatctgcaagccaatccggcggccggaattcaggtgcaagccgacgagttggcggtcgtggcgcgcaccgcgtcggccgccgagaagccgcggttttggaagatcatgactgacgtgtggcccaactacgacgtctaccagtcacgaaccgaccgcgacattcccgtcgttgtactcacaccggcatgaccacggctagcatttcttcggtgtcacgtgctgaagaacgggccgcggagcggtcggcggcggtgcagcgttcgcgcgaacgcatcgccaaccaagtcaggctgatgctcgacgccgctctgcggcttattcgcgagaagggcgacagcttcaccacccaggagctggtcaaagaggccggcgtcgcgctgcagacgttctaccgctacttcgccaccaaggacgaactgctgctggcggtgatcgccgacgcgatgaccgacgcgtgtgcccgctggagggacgccgcccgcgacctgcccgatccggtcgcgcggttgcgcttctacgtcaccgcggtcatcgaggtgctcgacaacgagcaaggcgatggcggcaccgctaagttcgtcgtctcgacgcactggcggctgcaccgcgtctttcccgacgagctcgccgaggccgagaagccgttcgtcgatctgctgctcggcgagatcaacgccggcatcgaggccgggctgctggcgccggcggacccgaagtgggcggcctggttcatcgccgaactggtgcgctcggtgtaccactactacgcctacgcaccgcgcgaggtcgacgtcaaagagcagctgtggcagttctgtctgaccgcgttgggcgggaccgcacgcaagtcgcgtggtagccgatcgaaatagaggtgcgacatgccccatgcaaaaccggacgagttgcccagcggaggaggggggcggtggccggcggccggcgacaatttccgttcggtgcagtggggcgacatggaggtcgggtacacgaccaccgggccgctggactgcacgcagctctaccaattcggcggacttcccggcggcgtatgcccttgtccgcactacggatacatcttcgaaggctcgatccgcgcgacctatccgaacaccgactggccggacgagacggcgacggccggcgaggtgtatttctttccggccgggcacatcctgatctatcgggaacgaaccaaggcgctcgagctgaacccggcgttcgcgttgcagcagtgcatggatgcgatgcaaagggctgggcagaaggccgaacgcgctcagcgggagcgagagttacaagcgtgacaacgtgaacggatacgtgtaggaaccggcgggcgctccatggcaacccgcgtcgaaggaggattgcagcgagccggccagcgtggtcggatcccacgtgtagacgtcgtgggtgggaacggttgggccgtaatagatgtcgtcacacctcaggccgtcgggaacgtcgaccgtcaagacgtattggccgtcgaccgaccgcgcgtccccgacgtacgggaatgccttggccaccggcctggcgatggcattcacatgcacgcagccgccgcccgggcatgcggtgatcgcccacagccaggtgtgaaagtcgtatctgccctcgacgtggaggtcgtagttgccgaaaggcatggcggcctgcgcgattggcgggcatgccgcggccgcgaaagccagagcgccggcgagcgtcgaggtcttccgggcgagccgtcgcgcagaacccatgacgttcctcggagatcttcgtttcttacggttcgagaagtcgattctacttgcacgacgcttttttcgatagaaggtgcgggaaagttgctgacatccctgcgcggttctggaatgcttgcggcatggccgtgaccgagttgcgggaggtgccttgcggttcgggggtttcggcccggcgcatcaactgcgcggcctgcgtggccgagctggacgccgtcttcgccggccgcaccctcaacgcgctgcggatcacacgggcgtcgtcggcctccaacttggcgccgccgacttgcaagagccgcaaggacttcggtggattgtcctcccattcgcaggcctgcgcccatagtttggccagggccgggaccagggcggtcaccgtgacgccgtggcgcgcgatggtggcaaaggccgcctcggggctggggtcggtgccgaacaccgtggtcgcgcccaccgtcatcgcgccgagcaggccggggcaggcgagcgggaaattgtggccggccgacagcaccgccagatagacgtcgtcgcgggtgagcccgcacagttcggcgctggcggtggcgttgaagacgtaatcgttgtgggtgcgcgggatgagctttggtgtgccggtggtgccaccggaaaccagaagcagcgcaggcgatcccggatcgaccggcgtcgccggccgccccgcgggcgcacgctcgcacagctgcgcccaggacagaaacggccccgggtcgccgtcgacgatcacgtgggcgagcgcttcatgctcctcgatgagccccgcggccatcgttcgataatcgaaacccgctgcggtgtcggcgatcagcagtgcggtggcctggctgagcgcggcgaaatgcccaagctcggcggcgcggtggccgggcaggcacatcaccgggatcgcccccgcccgtaacagcgcgaacagcgccaccgcgaactggcagccgttcggcagctgcagcagcacccggtcgccgggggcgatacccgcgtccgccaaacctgcggcggcgcggttagcctgctcgtcgaggcccgcgtagctgaaaccggtgccgccggaggcgtcgaggacggcggttcggtcgggccaccgccgggccgcgtcggtcaggatcgtgtccagggctcgccccgtccacaaaccggccgcccggtaggcggcggcgcgctcggcgggaaacggcacgaacccgtcgaggactccggccggcggcgtggtgttggggctcatggctcctctaagcgggcttcgaacggggctagtagcggggacgcagggagtaaggatagggtaaccaaatcatttaagggcagcctgtgctaattcagggaggtctgtggtgcacgccccggcacgctcggaggacatccgggaagaggtggctgaactgctcggcgtcgacgtcgatgcagttcagccgggtagcaacctcatcggccagggcttggactcgatccggatcatgaccctggccggccgctggcggcgccggggcatcgccgtcgacttcgccacgctggccgagacgcccaccatcgaggcctgggcacaactggtcaccgccggccgccaggacaccgattcggcggccccgcccgccgattcatccggggacccgtcgggcgagaccgagccgtttgccctggccccgatgcagcacgccatgtgggtgggccgccaggacaaccagcagctcggcggggtggccgggcacctctacgtggagttcgacgccggccttctcgactcgggccggctgcgggcggcggccaccgcgctggcccgtcgccacccgatgctgcgtgtgcggtttctgcccgacggcacccagtgcatcaccccggcggtggaatgcggtgacttcccggtgcacgtcgaggatctgcgcgagctgggcaccgacgaggtcgagcggcggctcaccgcgctgcgcgaggccaaatcgcaccagcaactcgacggcgcggtgttcgagctgaccgtgaccctgctgccgggtgggcggtcgcggttgcacgtcgatctggacatgcaagccgccgacgcgatgagctatcgcaccctgatggccgatctggcggcgctgtaccgcggatgcgatctgcctgaactgagctacacctaccggcagtaccgccacgccgtcgaggcgcaggacgcgcagccgcaaccgcgccgggacgccgaccgcgactggtgggcacgccgtctgccggagctgccggatccgccggccctaccgatcaccgccggccgcggcgcaaaccgcagcacccggcgctggcactggctggatccgcagacccgcgacgcgctgttcgcccgcgcccaagcgcgcggcatcaccccggcgatggcgctggccgcggggttcgccaacacgctggcccgctggtcgtccaattcccgcttcctgctgaatgttccgctgttcgggcggcagcccttgcacccggacgtcgacgcgctggtcggcgacttcacctcctcgctgctgctcgacgtcgacctggtcggcgcgcacaccgcggcggcgcgcgctcaggtggtgcaggacgcgatgcgcacggccgccgcccattccgcctactcggggttgtcggtgctgcgcgacctgagccgtcatcgcggcacccaggtgctggcgccggtggttttcaccagcgcgctgggactcggcgaactgttcagcccggaggtcaccggccagttcggcacgccggcctggatcatctctcagggaccgcaggtgctgctcgacgcccaggtcaccgaattcgacggcggcgtgctggtgaattgggatgtgcgggaagggtttttcccacccggggtgatcgacgccatgttcgcctaccacatcgacgagctgctgcggttggcctccgccgatgacgcctgggacgcgccgggtcccgcggcgctgcccgaggcgcagcgcgccgtgcgcgaggcgatcaacgggcgcaccgcgccgcccagcggagaagccttgcacgacaggttctttcggcaagccgagcggcagccggatgcgcccgcggtgttcgccggttccggcgacctcagctacgcgcagctgcgcgatcaggccctggcggtggcggcggcgctgcgcgcggccggcgccggcgccggggacaccgtcgcggtggtcggcccgaagagcgccgagcagatcccggcggtgctgggcatcctgtccgtcggcgccgcctatctgccgatcggggccgaccagccccgcgatcgcgccgagcgcatcctgcaatccggccgggtgcgcctggccctggtgtgcggcgggcggcagctgtcgctgccggtgcccgggctggtccttgccgacgtgctgggcggtgctcccgcggacgccgagatcgcctgcgcgagagtcgatcccggcgagctcgcctacgtgttgttcacctcggggtcgaccggagagccgaagggtgtcgaagtcacccacgatgccgcgatgaacaccgtggaattcatcggccgccacttcgagatcggccccgcggatcgatgcctggccctgtcgaccctggaaggcgacatctcggtgatggacgtgttcgtcacgttgcgcaccggcggcgccatcgtggtggtcgacgaggcgcagcggcgtgaccccgatgcgtgggcccggctgatcgacacccaccgcgtcacggtgctgcatttcatgcccggatggctggagatgctggtcgaggtcggccgcgggcggctgtcctcggtgcgggtggtgcccaccggcggcgactgggtgcggcccgaggtggtgcgcaggctgcgggccgaagcgcccggcctgcggttcgccggcctcggcggggcgaccgaaacaccggtgcacaacacgattttcgaggtgaccgaaccgatcccggcggactggacggcgctgccgttcggcgtcccgctgcccaacaacgtctgccgcgtcgtcggcgacaccgggggcgactgtccggagtgggtgcccggggagctctgggtgtccgggcgcggcatcgcccgcggttaccgcggccgccccgatctcaccgcgcagcgcttcgtcgagcacgacggccgaacctcgtatcgcaccggcgatttggttcgctaccggccggacggaaccctcgaattcgtcgggcgcgccgaccaccgcgtcaagatcagcgggtaccgcgtcgagctgggtgagatcgagtccgcgctacggcgggtgcccggggtgcgcacggcggtggccgccctgatcgccggggcgggcgaatccgacgtgctggccgcccaagtgggcaccgacgaccccgccctgaccggcgagcaggtccggcaatacctcgccgacctcgttcccgcgcacatgatcccgcgccacgtcgcggtggtggagcggatcggcttcaccgcggccggcaagctcgatcgccgggccgtggcacgcgaattgcacagcgtcgtcgggcaatcgcactcgcccggccaccgcgcggcgtccacaccgctggaaggcgcgctggcgctgatcctgggcgatctgctcgggcgggacgacgtcggcgtcgacgacgacttcttcgcgctcggcggtgattcggtgctcgccacccaggcggtggcgcgaatccgggcctggctggacgcgcccgacgtcatggtcgccgacatgttcgccaaccggacggtgtcggcgctggccgcggtgctacgtgccgccgaggacgaccccgaccggctcgaccacgtcgccgagttgtatctggaggtgatcggcatggatgctgaatcggtgctgacggctacccggcaaactacgaaatcgtaaccggtgcaatgacattgaataacatcgctaccatgccctccgccttcccgtcctggatcaagctggccccgggccgcggcggcccggcgtccgggacgggcgccaccatagtgttcccgcatgccggcgcggccgccgcgagctatcgggtgctcgcggcggcgttggccgccggcgccgacacctacgtcgtgcagtacccgcagcgggccgagcgcctcggcgaccccgcccacgagagcgtgcatgatctggccgccggcctgttccgggccgcgccctggcccggagtggcgccgctgacgttgttcgggtacagcatgggcggcgtcgtcgccttcgaattcgcccgcgtcgccgaggcgaacggaaccccggtgcgcaagctgtgggtgtcggccggcccgccgccctgcgtggtcggcgacatgcccgaactgccgaccacccacgacgggctgctcgccgacatcgcggatttgggcggcaccgaccccgaattgcttgccgacgaagaattctccgaactgctgaccaccgccgtgcgcgccgactaccaagccttcaacgggtacgaccccagccccgacgtccgcatcggcgcggacatccatgtgctgggcggtcatcatgaccaccgcatcgcaaccggcgtgctccggcaatgggagaggcacaccgccggatcctttgccatgtcgctgtacgacggcgggcacttctacctctacgaccacgtcgaaacggtcgcggcgcaggtgaatgccgggtgacgccgatgtctgagaacgggttcgatgccgccggcatcgacccggtggtgatcgtggggatgggtgtcgaggcgcccggcggcatcgagaccgccgaagactactgggagctgctggcccacggccgcgaggcgctgggccctttccccaccgaccgcggctgggcggtgagcgaactgctcgccggatcccggcgcagcggcttcaaacagattcatgaccgcggtggcttcctcagcggcgcagccactttcgatccggagttcttcggcgtctcgccccgtgaagcggtggtgatggacccccagcagcgggtggcgctgcgggtggcctggcgcgcgctggaaaacagcggcatcaatcccgacgacctcgccggagaggacgtgggctgctacgtcggggcgtcggccaccggctacggaccggaaatggccaggttctccgagcacagcggtcatctactggccgggacggcgctcagcgtcatctccggccggatcgcctacacgctgggattgaccggtccggcactgactgtggactcctcgtgcgcctcggccctggtggcgtttcacgtggcggtgcgagcgctgcagaacggcgactgcgacctggccctggccggcggggtcaacgtgctgggctcgccgggattcttcgtcgagttctccaaacaacacgccctctccgacgacggacactgccgcccgtacagcgcccaggccagcggaaccgtgtgggccgagggagcggcaatgtttgtgctgcaacgcaaatcggtggcgctgcgcgccggccggcgggtcgtggcggaggtgcgcgccaccgcgatcaaccaggacgggcgcagcgccgggctcagcgcgcccagcggcgatgcccaggtccggctgttccggcgggccctcggcgaatccggggtcaagcccgccgaagtgggcatgatcgaggggcacggtaccggaaccaggctcggcgaccgcaccgagttgcgctcgctggcacagacatacggcgacaccgaacccggcgccggtgccctgctggggtcggtgaaatccaatctcggccactcgctggccgcggccggcgcgctgggcctggccaaggtgctggtctccgccgaacacggcgccgtcccgcccaccctgcacgccaccgaagccagcggcgaaatcgactgggaacaccagggtttgcggttggcgcagacgttgacgccgtggccggcgatcgacgggcagcgcaccgcggccgcgtccgcgttcgggatcgcgggcaccaacgcgcacctgatcgtctccatgcccgaggtcgcatgatgccgacccacggcctgccggacgggcgcatcccggtgctgctcagttcccacgacccggagctgatccgccgcgacgccgcggcgatcctcgagtatctcgaccgcatcggcgaatcgaccgaagcgaccggtgcggtagccgcgaccttgctgcggctgcggcgggtgcgccggcaccgcgccctgctgcgcgcggcggaccgcgccgaactcgccgccggactgggggcgatcgcccgcggcgaggagcacgcgctgatcacccgctcggcccggacgacgccgccgcggatcgcgttcgtgtttccggggcagggcaatcaatggcaggcgatgggagccgacgcctaccggctgctgccggcctaccgcgaggcggccgatcggtgcgcgcaggcgttcgtctccgccgggttcccttccccgctcccgtatctggtgagccccgacgaacagagctggacccgtcccgagatccagggcgcgcagttcacccatgcggtcgccctggccgaagcgtggcgctgcttcggggtactgccggaaatcaccatcgggcacagcctcggtgaggtggcggcggcgtatgtcgccgaagcgatctcgctgccggacgccgtcgccctggtggtcgcccgcgcgaccgtcgtcgaccggttgaccggccgctacgcgatggcggtgctgggcaccggtgccgccgacgccgagtcgctgctggccacaacacccggctgggtggaggtttcggcggtcaacgggccggcgtccaccgtggtcgccggcgaccacgacgcggtggccgccgcggtgcggttggcgcggcaacgggagatcttcgcccatcagctcttcgtcgactatcccggccacaccagcgcgctgagacccttgcgcgccgcgctggccgagctgaccccgcaatcggctttccgggactccccgatacggttcatcggctccacccgcggcgccgaggtggcggcgacgaccgactacgccagctactggtatgaaaacctttgcagcacagtgcgattcgatctggctgtgcagtgcgcccgcagctgcggggcggatgcgttcgtggagctctcggcgcatccctcgctgctgtacccgctgtccggcatcatcgacgacgagtcggccgtgatcgtcggctcggggcaccgcgaccggcccatcaccgaatcgctgtcggcgagtatggccgccgtcgcgaccgccgatcccggataccggtggtccgagaccgtgcccacccccaatcagcctgcgctgcacggattcccgaatgcgccgatgcgggcgacccacctgtgggccgcaccggaccgcgtcaccgaagcggcgccgcggccgaggctcaccgtggccgtcgaggattggcggcacaccacgtccccgaccacaccgacggcggccgacctcggattcgccggtgcgcacccgctgacccggcggctcgccgatgccgcggcggcacaaggcggttgccgggtggtcgcacccggcgaggcggagatcctggccatcgtcgccccggagctcgaccagctcgacgccgtcgccgccgtcgagcagatcggcgcccgcgaggacgccggcctccccgattaccggggactgatcggcccgcgatgccgggcagtctggctgctgaccgtgcgcgccgaacacgtcgatggcgatgacgatcaggcctgcgtcgcgcaggcggcgctggcggcgatgcaccgcagtatcggcttcgagttcccggaccaggccttcgggcatctcgacctgccgcaccgcgacgtcgacgccgccaccgcgcacgcgatcatcgaggttctgctcgcggagccggccgaggttgcgctgcgcggcgagcagtcgccgcgacgtcatgtccgaaccttccgcgcgcacaacgaatccgccgaccggcccctcgatgacgccgccctggagcatgtggtgatcaccggcggcagcggcgccatcggactgcactacgcgcggtactgcctgcagcgcgggacgcgtaacctcaccctgttgagccgcaacgggatcgaggcggccgtgctgcgtgaactcaccggcagccacgacgcccgggtgtcggccccgcgctgcgacatcaccgaccgcgccgccgtgacccaggccgccgcccgatacgcgggctcgggcgcgacgctgctgatccacaccgcgggcatcgcgcaggcgcgttcgcgaaccgatctcaccggcgccgacgtggcggcggtgtgcgcggccaaggtccgcggactggcgctgatggccgacgtctggccgctgcggccggactgccgaatcctggcctgctcctcggttttcggcgtgtggggcggttaccaccacgcggcgtacgcggcctccaaccggatgctcgacgtgctggcaacccagctgcgcgcccggggtctggactgcacggccattcggtgggggctgtggcaggacgccggggtggtggcgggcagtgagatcgcccgcaccgaacgctccggactggtggcgatggacccgcggcgggcgctgcaggccagcctgcaccggtacgagtccgatccgctgatcttcgacgccgacttcgagcggctgcaggtgttcttcgaaagccagggaatgccaatgccgttcagtgatacgccgacccgcgacgacgaagcggccgccgccccggcgggcaaacccctggcggagctggtgcgggccgaactggccgcgacgctgcacctgggcgactcggtgtcgatcgatcccagcgcgtcgctcatcgacctcggcgtggactcattgctcgcgctcgatctgcgcaagcggctgcgccgcacggtgggcaactcggttccggtggcccgcatgctcggcggcatcaccgtcgcggagctggtcgacgcgctgcgcgccgacgccaccggcggccccgtggtcccaccaaccgtccagcgcaccggcgccgtcagcggtgcgcatccctcaacgctcgcgatgctagaaaggttggactcctagcgtgacagaaaccaccggcgccggcacccgcctcgacgacgagcggctggagttgttgcgccgcaagcttgctgagcgcggcctgtcccggtcgaccggcacggccaggcacgacgagccacgcatgtccgtcggtcagcaccggatgtggttcgtgcagtcggtcgatcccgacagcgcgctgctcaacatctgcgtttcctatcgcctcaccggcggcgtcgacaccgggcggctgcaccgcgcggtcgacgccgttgcggcccgacacccggtcctgcacaccacgtatgacaccaccgatgagggggacccgcggccggtgctccgcgcggacctgcggcccgagtgggccgaacacgacctgtccgggctgaccgagcaggcccgccggttgcggctggatgtgttggcccagcgggactttcgccggccgttcgacctgagcaaggattcgccgctgcgcgtcacggcggcccgcctggccgacgaagagctgatgctgttgatcaccgcccaccacatcgcctgggacgatggctcgtgggcgccgtttttcgccgacctgacccgggcgtacgccgccccgggcgacttcgataccacgccggtggtgcctgacctatcggcggatccgaccgcgatccgccgggaagacctggactattggcgtccgctgatggccgatctgccggagccgctcgagctgcccggacccaacggttcggtggtgcccagcacctggcgcgcgcagcgtgccttcgccgaattgccggcggagatcgtcgaccgggcggccgcgctggcccgcgagacgggcgccaccccgtacatggtgttgatggccgcgttcgccgcgctggtgcaccgctacaccgggtcgacggacttcctcgtcgccgccccggtgctcaaccgcggcgcggcgaccgagaacgtcatcggctactacggcaacaccgtggtgatccggctgcgaccgcagtcgcatcagagctttcgcgagctgctggcccaaacccgcgacggcgcggtgggcgccttcgctcactcccgcgccgacctggattggctggtgcgcgaatcgaatccggatcgccggcacggcgccgaccggatgacccgggtcagcttcgggcagcgcgagcccgacggcgccagcttctgcccgcccggcgtgcgttgtgaacgcggcgatttacgagggcatttcaaccagctgccgctgagcctgatgatcgagctgaaccgcacaccggacggttccggtggcggtttggtggaggccgagtatctggtcgaggtgctcgatcagcagttggtggagcagatgctgcgtcactaccgcaccctgctggacagcctgctgtccgacccggacgcgacgctgtcggcatgtgcgctgatgagcgacgcggacgccgagtggctgcgcgcggtgtcgaccggtgaacaattcatcaccccggccgccacgttgtccgagttggtcagccaccgggcggcgcgcacccccgacgccgttgccgtcgtctacgagggccacacctacacctaccgggacatcgaggaagagtcgaaccgggtggcgcactggctcatcgagcggggcgtcggcaccgaggaccgggtcgcggtgctgctggacaagtcacccgaactggtcatcaccgcgctcggcgtgctcaaggcgggcggggtgtacctgccggtggaccccacctatccgcaggaccggctgaacttcatcctcggcgacgccgacgccaaactcgtgctgcgcgaaccggttaccgacctggccgactatccggccaccgcgcccaccgagttgctccggccgctgaccccgcagaacaccgcctacctcatctacacctcgggttccaccgggctgcccaagggcgttccggtgccgcacgcgcccatcgccgagtacttcgtctggttcggcgacgagtaccgcatcgacgagacggaccggctgttgcaggtcgcatcgcccagcttcgacgtgtccatcggagagatcttcggcaccctgatcatgggtgcgcgcctggtgattccgcggcccgacgggctgcgtgacatcggctacctcaccgaactgctggcccgggagggcatcacgtcgatgcacttcgtgccgtcgctgctggggctgttcctgtcgctgcccggggtcagccagtggcgcaccctgcgtcgggtacccatcggcggcgaggcgctgcccggcgagatcgccgacaagttccacgccaccttcgacgcgtcgctgtacaacttctacgggccgaccgagacggtggtcaactgcaccagctacccggtggaaggcgcacaggggacccgggtggtgcccatcgggcggcccaagatcaacacccgggtgtatctgctcgacaacgccctgcagcctgttccgcccggtgtgatcggcgaaatctacatcgccggaacacatgtcgcgcacggataccaccgccggccgcagctgaccgccgagcgtttcgtcgccgacccgttctcccggggcgggcgcatgtaccgctccggcgacctggcccggcgcaacgcgaacggcgacatcgagttcgtcggccgcgccgacgaacaggtgaagatccgcggcttccgcatcgagctgggcgagatcgccgccgccatctcggtcgaccccagcgtggggcaagcggtcgtgctggccatggacctgccccagttgggcaagagcctggtgggatacgtgacaccggcccagggtgccggcacggaaaccgttgacgtcgaacgcatccgggcccgggtggcggccgcgctgccggactacatgacgccggccgcctacgtggtgctcgacgagatcccgatcaccgcgcaccagaagatcgaccgcgccgcgctgccgcagccgcagatcggcgcgggcaccgagtaccgcgatcccgcgactcccaccgaacaccgtatcgcccaactgttttccggactgctcggtcacgaacgggtgggcgtcgacgactcgttcttcgatctgggtggccactcgctggtcgccaccaaactggtcaccgcgatccgcgccgaatgcggggtcgagatcgggatccgcgacgtgttcgagctcgcgacggtgggcctgttggcggagcgggtcgatcagctcagttcgggtgaactgaccggaacgcggcccaaactgatcgcgaccgcccacgacgagcccctgccgctttcggcgtcccagctgcgcagctggttcgcctaccggatggatgggcccagtccggtcaacaacattcccttcgcggcgaggctgaccggcccgtgggacatcgacgcgctgatcgcggccgtcggcgacgtcgtcgcccggcacgagatcctgcgcacccgctacgtcgaactcgacggcgtgccctaccaggtggtgggcccgcccggcgtcgagatcccggtgcgccgcgaggacggccccgacgacccctggctgcagcagcagctcgacgccgagcggcggcactgcttcgagctggacggtgaattgccgatccgggtcgcggtgctgcgcgtcgcgaacgcggccgagcatgtgctgtccctggtcgtgcaccacatcgcatccgaccattggtcggcgggtgtgctgttcgccgacgtgatgaccgcctaccgcgcgcggcgcggtggggaagcgccgtcctgggctccgctgcgcgtgcagtacgccgactacgcggcctggcagcgcacgtttctcggtgacgccggcggccaggagtccgcggttgccggtgcgcagcgcgagtactggacccggcagctggccgggttgccggaggacaccggactgcgtccggacttcccgcgccagccggtgcccagcggggacggcgaatccgtcgacttccacatcgacgcggccaccagggtcaagctcgccgaggtgtgccgcgaattgggcatcaccgagttcatgctgctgcaaacggcggtcgccgtcgtgctgcacaaggccggtggcggcgtggacattccgctgggcaccccggtagccggtcgcaccgaagccgaattggaccagctgatcggctttttcgtcaacatcctggtgctgcgcaacgacctggacggcaacccgacgttgcgcgaactgctcaagcgggcccgggaaaccgcgctggccgcctatgcgcaccaggacctgccgttcgaccgggtggtcgacagcgtcagcccggtgcggtcactgtcgcgcaatccgctgttccaggtcgtcgtgcacgtccgcgatcacctgtccgccacccgggtcatcgagaccgcacccgtcggaggcgacggccaggacaccgtgtgcacgtcgctggatcccgtcttcgacatggcgcacgccgatctaagcgtgaacttcttcggcaccgacggcgccagcgacatcggctacaactgccatctgatcttccgcaccgacctgtatcgcaggaccaccatcgagcggctggccggatggctggtccgggccgtcaccgcgttcgccgacgacctcgaccagacgttgcgggacgtcgcgctgatcgacgccggcgaacaacagcgcatcctgcgacagtggagccgcggcgcgcagccgccacgggaccggccgcgcaccataccggaactgctgcaacccacccggtcgctgggggccgaccggatcgcggtgcgctgcggcgccgagcacatcgactaccctgcgctgcaccgccgttcggacaacctggccgcgctgctcgtcgataggggggtaggaccgggcacgctggtcgggctgtccacccggcgcggcatcgagctggtggtggcgctggtggccatcatgaaggccggtgccggttacttccccgtcgatcccggatatccttcggcgcgtaagcaattcatgctcgacgacgtgcggccaccggtcgtggtcgcgacggtcgaagcggtggacaccatgccggcgctgcccggggtcgagctgctctcgctggacgatccgcaggtgcgcgcgctggtggaccgcgaccgccccaccccgatgatccgatgtatctggtgttcacctcgggctccaccggcaagccgaaaggtgctgtgggaacgcatcgctcgatggcggcccggctggattggcagctgcggcactacccgccgcgcaccgacgacgttcgattggcgcaggcctccatcaccttcctggaaggcggcatggagatgctggccgggctggcggcgggcgcgacgatgatcctggccgacgacgccgaacaccgcgaccccgaggcgctcggggagttgatgcaccggcattcggtcgcccaggtgaccgcggtgcccagcctggtctccgcgctgctggacagccggcccgatgcggtgcgctcgctgtcgcggctggtgtgcggcggcgagccggtcagcacctcgctgctgcagcggctggtgtcggtgtgcgacgaagccgacggcggcggccccgagctgttgaacaacatcggctcgaccgaaacctccggcgcggtgtcccgcgggccgttgagtccgccgaatccgcttgtcgggaaacccgttccgggtgcgcaggcgtatctgctcgacgacgggctgcgcccggtgccggtcggcgtggtgggggagctctactacgccggcgaccagctcgctcgggggtattggaaacgtcccggcctgaccgcggcccggttcgtcgcgaatccgttcggggcggaacccggttcgcgcctgtaccgcagcggcgacctggcccggtggaccgaggacggccagctggaattcgtcgggcgctccgaccaccaggtgcaggtccgtggtttccgcgtcgagttggccgaggtcgaggcggctctggcgggcgccgatggcgtcgccgcggcggcggcccgcacctgggaggtgcacggcggcacctccctggccggctacgtggtgccgcaacggcccattgccgacgaggccgagaaggcggcgttcgccgcacaggtgcgcgccgagatcgctgccaccttgccgggttacatgatgccgtcgtcgctgaccgtgctcgacgccctgccgaaaaccgaatccggcaagctgaatcggcccggcctgccccggccggtggtcagcaccggcggccggaccgagccgacccgcaccgacaccgaacgggcattggccaacgtgttcgccgagctgctgtccacacccgaggtcgggcggttcgacgacttcttcgcgctgggcggcgacagcatcctgtcggtgcagctggcgtcgcgggcgcgggcagccggcctgccggtgagtccgcggatgatcttcgagaaccccaccgtgcagcagctggctgccgccctggatgcgttgggagacaacgatagtgacggtcggctggacgatcagccggccgacgcccggttcgagccgatgagcacctcagggttgtcggcctcggatctggccgcggtgacccagctttggtcgtcgtcgcgggaaggcaccgcatgaccgccgccgaaaccgatgtcgcccccgacatcgaggacgtgatggcgctgagcccgctgcaggagggcttgtattcgctgaccacgcttgccgagttcgccgacggccagccggcggacgacccgtacgtgatcgggatggccgccgacatcaccgggacactcgatgtcgccctgctgcgcgattgcgcggaaaagatgttggtgcgccacccgaacctgcgggccagcttcttttcccggggcgtcccgcggccggtgcagatcgtgccgtcccgggtcgagctgccgtggaggtccgtcacggcctcgcccgctgaggtgccgacgctggaaaccgccgaacgccggcgccccttcgatctcgagcgcgggccggccatccgtttcctgctcatcgaattaccggatgcgcattggcgtttggtgctgaccgcccatcacatcgtgatcgacggctggtcgctgccggtgttcgtcaacgagctgatgaccctgtaccgggccggcggcgatccgtcggcgctgcccgccgcgccgcggccctatcgcgactacatcggttggctggccggccgcgatctgcaagccagccaacgggtttggcgcgaacacctggccgggctgcccggtcccaccctgctggccgcctcgctcggctcggtcgaggcgaccgagggacagcggactgcgttgccgcgcaccaccgaattgcggatgccggccgaggccaccgcgcggctggccgccgagacccggtcccgcggcatcaccgtcaacaccctgatgcagatggcgtgggcgctggtgctgtcccggctgaccgacacccgcgacgtggttttcggggtcacggtgtcgggccggccgccggagttgaccggtgtggagaccatggtcggtctgttcatcaacaccgtgccgatgcgggtgcggctcgaccccgccgcgaccgtcggcgaacagtgccgggccgtgcaacgcgacgccgcactgctgcgtgagcacagctacctcgggcatgcccagctgcgcgccctcggcgggatcggggagatgttcgacacgctgctggtgtacgagaacttcccgatggacggattgaccgccggcggtgaattgtcagccggcggtgcgacattccggccgtcggccctgcaaacgctgtcccacttcccgatcgccgtcgccgcccacatggaaggcggcgaactggtggtgctgatcgaagtggtcgacggcgcgctcggtgtcatccccgccgatgcggtcgggcgccggctgctgaccaccgccgagcgactgctgcggcactgggagcgcccgctgcgcgccgtcagcgtcctgttcgacgacgaagccgcaccgctgcgcgccgccgggcccatcgcgccgccgtcaccgaaatgcctgcccgcccgattcgccgacgtggtggcgcagacacccgacgccccggcggtcagctgggcgcagggctcgctcacctaccgcgacctggacgaggcgaccaaccggctcgcggcacaacttgtcgcgctcggggtcgaacccgaaacaccggtcgcgatcaagcttttccgcgggccgcgctacgtcgtcgcgatgctggcggtgctgaaggccggcggcatgtgcgtgccgatggagccgggaatgcccgcgccgcgggtgaactcgattctgcgccagtccggcgcctcgatcgtgctggacgaggagcggatcgacgaactcctcgaggccgcccgatcccggcacggcggcttcgagccgcccgacatcccgccggcccaggccgcctatgtggtgttcacctccggcacgacgggagaacccaagggcgtcatcggaactcacggcgcggtgggcgcctacgccgacgatcacctggaccgggtgttacgcccggcggcggccgcgctgggccgcccgttgcgcatcgcccacgcctggtccttcgccttcgacgccgcctggcagccgctggttgcattgctagacggccacggcgtgcacgtcgtcgacgaagccacccagaccgacgcggaggcgctggtcgcgctgatcgccgagcacggcgtcgacatgatcgacaccaccccgtcgatgttcgcccagctgcaggccttcggcctgctgagcgaggcgccgctgaccgtgctggcgttggggggcgaggcgctcggcagcgcggcctgggcccgaatccgcaacgcgtgcaacaccacaacgatgtcggcgtacaactgctacggcccgaccgagaccaccgtcgaggcggtggtggccgccatcgccgaacacgccgagccgtccatcgggcggcccacccggcacacccgcggctacgtgctggactccgagttgcgcccggtgccgtgcggggcgaccggcgagctgtacctgggcggcgcccagctggcccgcggctatctgggccgcgcgggggagaccgcctcccggttcgtcgccgacccgttcgcggcctccgaacggatgtatcgaaccggggacctggtgcgccggttgcccgacggctcactgcaatacgtgggacgcgccgacgcccaggtgaagatccgcggccaccgcgtggagcccggcgagatcgcggccgcgctggaatcgcaccccgccgtccggcacgccggtgtgctggtgcgccaccgcgacggcgcaccgcggctcaccggctacgtggcgacgcaccaggccgcagccgacacgccgagcccggccgagctgcgcggcatgctcagcgcccggctgccgcgctacatggtgccgcagcgcatcatcatggtcgacgaaatcccgttgacccccaacgggaagctcgacgaaaccgcgctggccgccgtggacaacgccgaagccgtcgacggcgcggccccgccacagaccggcaccgaatccgcgctggccgaactgatcgccgagctgctcggccagccgcgagtcgacgtcaccgccgacttcctggcgctgggcctggacagcatcatggcgctctcggtggtccaggcggcccgggcccgcggaatcgcgttgcgcgccaggctcgttctcgactgcaccagcatccgcgaacttgccgaagcgatcgacgcggaaagcactcccgccgcgggcgaagtggacgacggaacgggcccgatgccgttgctgcccaacggccgctggctctacgaacacggccagccgcgcagactggcccaaaccgaagccatccgggtcccgcagacgctgcgccgcgaccaattggagaccgccctggccggcatcgtcggcggccacgaggtgctgcgcagccgggtggaccgcgccaccatgaccctggttccgggaccggctcccgacatcggtagggaactggaagaggttgcggtggttggtgatctgcgcgcggcagtggccgaccacgccgcccgggcgatcgaccggctggaccccgaacgcggggtgctgctgcgcgcggtgtggctgcgaccggccggcggggacggcgtgctgctgctcaccgcgcacgtcatcgccctcgacccggcgtcgtggcgggtggtcctcggcgagctgggcgccgccttgacggcggcggccaccggtcactcgccggcggccgtccgggagcacaccagctaccgccgctgggcgcacgcgctgaccgcgcgcgcaccggctggacaccgtggggttctgggcgtccgaattggacggcgacgaccccgatctcggcgcccggcgcgtcgacccggcccgcgcccgcgcccgcgacctgctcgtccgcaacgtcgccaccgacgccgacctcacccgccggctcctggaatcgggcctgccgctgcccacgctgctggtggccgccaccgcggccaccgtgacgcgctggcgccggcaacgcggacagtccacgccgccgccactgctggccctcgaaacacacggccgcgcagacagtttggtggacggcccgggtacacacaccatcgacaccggcgacacggtgggcctgctcagctccatctacccgatccgggtcgacgcggcggacccgcgacgggtggccgacaagctggccgcgatccccggcgacggactcgactacgggctgctgcgctacctgcgcgacgacaccgccgaacggctcgccggcctcccgtcgccgcaactgctgctgaactacctgggcgccgcccacaccgacggcggcaccgggctgacgctcgagcgtgagctgctcgccggactgtcaccgatccccgagcccgacctggccgtgcgccacgagctcaccatcgcggcgatggtgctgacatacggcggacaacgggtgctggccgcgcagtggcgcaccctgcccgacattctcacagacacggatatcactgcactgcaagagctttgggtcgattcactgcgggagatggtgacatgagcacacttgcgatcctgggcgcgggagccaaggccgtggcggtggccgccaaggcttcggtgctgcgcgacatgggtgtcgaggttcccgacgtggtcgcggtggaacgcatcggcgtggcggcgaactggcaggccagcggcggctggaccgacggcgcgcaccggctgggtaccagcccggaaaaggacgtcggcttcccctaccgctcggcgctggtgccgcgccgcaacgccgaactggacgagcggatgacccgctacagctggcagtcctatctgatcgcgacggcgtcgttcgccgaatggatcgaccgcggcaggccggcgccgacgcaccgccggtggagccagtatctgtcctgggtggccgaccacgtggggatgaccgtggtgcacggcgaggtcgaacaactggccgtcaccggggaccgctgggcgctgcacacccacgaaaccaccgtgcacgccgacgcgttgatgatcaccggccccggccaggccgaaaagtctttgctcccaggcaatccgcggatgctgtcgatcgcccagttctgggatcgcgccgccaaccacgaccggatcagcgccgagcgggtcgcggtgatcggcggtggagagacggccgcggcgatgctcaacgagttgttccggcaccgggtgtccagcatcaccgtcatctcgccccaggcgacgctgttcacccggggcgaagggtatttcgagaactcgctgttctccgacccgaccaactggccggccctgaccctggccgaacgccgggatgcgttggcccgcaccgatcgcggggtgttctcgtcgtccgtgcaggaagcgctgctggccgacgaccgtatccaccaccttcggggacgggtcacccacgcggtgggcgtgcagggacagatccggctgacgctgtccaccaaccgcggcagtgagaacctggagaccgtgcacggcttcgacctggtgatcgacggctccggtgccgactcgctttggttcgcaccgcttttcagccaggaggccctcgatctgctggagctcggtctgggcggacccctgagctcggagcggctgcaagaggcgataggttatgacctggccgtcaccgacgtcacccccaagttgttcctaccgaacctgtccgggctcacccaggggcccgggttccccaacctgagctgcctcggcttgctgtccgaccgggtgttgggatcgacccttggcccgacgaactatcccgcgcgaaggagacatgatgagcgccaacccctttgacgacgacaccgcgaccttcgtggtgctggtcaacgacgaggaccagcacagcctgtggccgaccttcgccgagacgcccccgggctggcgcgtggtcttcggtgcggccggccgcgccgactgcctgcagtacgtggagcagaattggtcggatatccggcccaagagcctgatcgaggcgctcgccggcgagtagccgccaccgcgaaacgcggtccgcggccggagcgtcgtcgtaacgtgaccaactcgagacacaaaatgccctgtcgcaaggcacacttacaccatcttcaaccatgaagacgtgtgaccgcgtgcggcgcaaccgcaaaaccccgccacggtccatgcgcatcgaagggggacctgtgaaaaccgtgaagtccattgccacgggcgtggcggcgctgaccgccatcggcggcccggccgccggtgtggcttccatggcagcgccgaccggtctgcatgaggtgcagttggcggcgttcgaagcgccgctgccgcaagacccgccgccaccgccgcccccgccgccgggagcgccgggccagttgccgacggcggatcaattggccaacctctgcaaccaggtgaccgatccgggcgtgaactaccgggagaaggccaacttggtggaaaacggcgtcagccagaacgagggtatggtggccgaccacgacctgcggaaggcgtaccgcaacgggaacttccccgagcagttcaacgtcaccaacatcgcgccggccggacccaacatggcccaagccgacgtcggcatcacggggcccaagttcgccgggccggtcaacaagcacctggtgttcgtcaaccagggcggcaactgggtcctgcagcacgacgccgcgatcgcgctgatccaggcggccaccgcgatgaactgaccgacatcggtaaacccttgccggaccgccgaattcgtgtacaagcagcgacggtcatcgacccccatgcgccactcgtccaggggcgcatgggggttcggcgtcttaccccgcaacccatcggctcgcacagccggcgcacagtttgctcatgtcgtctgcacatcggcaggccgtaacgtatcggtgccgagacacgaattagcagatgcaacggggcaccatccacatccaacaaagggcgaccggggtaccacctgcgcgtcgacattcgtgcccaccgaagggggaatcatgaacaccgtcaaaaccattgccaccggcgtggcggcgctggctatcgtcgggggcgccgccgccggactggccgccgccgcggcgccgagcgcgccgggcaccgtgcggctcgcggccgtcggcgcaccgcttccgcaggatccgccgccggcacagccggtcgcgggcgccaacgtcccgactcccgaccagctcaccggcctgctcaacagcctggccgacccgagtgttccgttcgcgaacaagagcaacctggtgcagggcgggatcagcggtgtggaagcgcacgtcgccgacaagaagctgcagaaggccgccaaaaatggtgacctgccgctgtcgttcgacgtgaccaacatccaaccgaccgcctcgggtgcggcgacggccgacgtttcggtgtccggtcccaagctgacctcgccggtcacccagaacgtcacctttgtcaaccagggcggctgggtgctgtcgcgggcgtcggcgatggagttgctgcaggccgccggtcagtgatcggcgcgtagcgcacccagctccagtttcgcgatgcggtccggatccgccagcacgtcgatcgcgcggatccggccgccgcgcaccacgaaacccatgaccgacgcggcgcggcctgcgacgaagatgacggcacccgcggcgccgttgaccgtcgcggcccatgcctcgcgctcgggccccgcgtagctgcgggccagcttggccaccgcggccgcgccctgcacccgaaccgtcgcggtggccggcccgaagtcgccgcgcagcaccacgtcgggatgcagcaccgacaccaggcggtcgaagtccccgctgcggcccgccgcgaagaaggcgtcgaccacctcgcgctgcgcggccaggtcgccgtccgggaccggatcggcccgctcgatgcgtcggcgcgcccggctggccagcttgcgggccgactccggcgtgccgtccacgatcgcggcgatctgcgcgaacgggacggcgaacacgtcgtgcagcacgaacgccagccgctccgccggcggcagcgtgtccagcaccacgaacagcgccatccccaccgcgtcggccagcatcgcgcggtgctcgggatcgaactcgccggccggctccacgatcgggtccggcaggtgggccgccggctcggcgccgtcgcgagttcggcggtcgcgcaacatgttcaggcagatgcgggccaccaccgtggtcagccaggcgtccaggttggcgatgtccgcgccgccgctgcggtcgagccgcagccaggcctcctgcacggcgtcctgggcgtcatcgatcgagccaagcatgcggtaggagagggcgcccagctggggccgggccgcctcgaaccgggccgtcaggtccgccgcatccgggctcgtcatggccgcggggtgtcgggcagcgcacacacccggttcccggagaaccccgacgacccgatgccgagcgcgatgttgaagcgggcgcgcaggttgcccagcgtgatgacgtgggtcaggccgaccagttgtgcggtgtcgaagtgcgcgcgcagcgcgtcgaacagctcatcgctcacctcgaccggggtgcggctgatcgcggtggcgtattccaggatcagcttgtcgacgtcggaaaagcatgcggcgtcgcggtagtcggccatggccagcagttcctcgtcggtgattccccatcgccgggcgatctgggagcccaggtcgatgcagtattcgcagcgcaccgtcgtcgccgccttcagctcggccagcgcgcggtgccgtggcgacaggatgtccagcctggactcggcctgctccaacctgccgtaggcattgagcagtctcgggatatgcgcatacatgcgcagcggttccagcatccccgcggtttccagcccggtcatctgggcgagcttgcgcctggtgaagaagaaggcgatcctggcgcccaggccggcgtcgcggtcggacactcccggcagccgtgacatggcgatcctcctggcaagttgtgctgttgaccaaggtcctcactaggtcgacacgcggccaggcccaaacgtgaccgcggggttatccggacgggcccaacggcaggtccatgtcgtacacccgggcgtgcaacaccgtgcggttccgcagcgccgcccgcaccgcgcggtgcagcccgtcctcgagataggtgatgcccttccaccgcaccgcgtgcgggaagaggtcgccatagaaggtggagtcctccgacagcaaccgatccagcgccagcaccgttgtggtggtgaccaattcgtcgagccggatctgctgcggcgggatctgcgaccagtcccggtaggacaggttgtgctcgggatagggtttgccgtcgcgcacgcccttgaaaatcatcggcgcctctttcccgacgcggtctggtgggccgagcgtttcatgctggaaaggctagccgggaccccggtcgtccggcgagcagacgcgaaagcacccgacacgccgggcggcggggagcttttgcgtctgctcgcgcttcaacggtgaggtcggcgccgctcgagaccgtaaaatgaacccagctaacgcggtatcgatggaggtgagggccagtggggagtgccgatgagcgtcgcttcgaggtgctgcgcgccatcgtcgccgacttcgtcgccaccaaggagccgatcggttccaagaccttggtggagcgtcataacctgggcgtgtcgtcggctaccgtccgcaacgacatggcggtgctggaggccgagggctacatcacccagccgcacaccagctccgggcgggtccccaccgagaagggctaccgcgaattcgtcgaccggctcgacgacgtcaagccgctgtcggcggccgaacggcgcgcgatccagaacttcctggaatcgggtgtcgacctcgacgacgtgctgcgccgcgcggtgcggctgctggcgcagctgacccggcaggtggccatcgtgcagtacccgacgttgtcgtcgtccaccgtgcggcacctcgaggtgatcgccctgaccccggcgcggctgctgatggtcgtcatcaccgactccggccgggtggatcagcgcatcgtcgaactcggcgacgtcatcgacgaccacgagctgtcccggctgcgcgagatgctcgggcaggcattggtcggcaagaagctgtccgccgcgtcggtcgcggtggccgacctcgccgagcagctgcgcagccccgacggcctgggtgacgcggtgggccggtcggcgacggtgttgctggagtcgctggtcgaacacagcgaggaacgcctgctgatgggcggtaccgccaacctgacccgcaacgccgccgatttcggcggctcgttgcgttccatcctggaggcgctcgaggagcaggtcgtggtgctgcggttgctggccgcccagcaggaggccggtaaggtgacggtgcgcatcggccacgagacggccgccgagcagatggtgggcacctcgatggtcaccaccgcctacggcacctccgacaccgtttacgggggaatgggtgtgctggggcccacccggatggactatccgggaactatcgccagcgttgctgcggttgccatgtatatcggcgaagtcctgggtgctcgatgagcgcgcacccgcacggtgggtaggcgcggaaaagaccaggtattaggagaggcaagcgtggcacgcgactattacgggctgctcggcgtgagccgaggcgccagcgatgcggagatcaaacgcgcgtaccgcaagctggcgcgcgaactgcatcccgacgtcaaccccgacgaggccgcgcaggcgaaattcaaggagatcagcgtcgcctacgaggtgctcagcgacccggagaaacggcggatcgtcgacctgggcggtgatccgctggagggggcggccgcggcgggcggcggcttcggagggttcggcggcctcggcgatgtgttcgaggcctttttcgggggcggcttcggcggcggcaccacctcccgcggcccgatcgggcgggtccggccgggctcggattcgctgctgcggatgcggctcgacctcgaggagtgcgccaccggggtgaccaagcaggtcaccgtcgacaccgccgtgctgtgcgaccgctgccacggcaagggcaccaacggcgactccgccccggtgccatgcgacacctgcggcggccgcggcgaggtgcagacggtgcagcgctcgttgctcggccaggtgatgacgtcccggccgtgcccgacctgccgcggcgtcggcgtcgtcatccccgacccgtgccaccagtgcatgggcgacggccgggtgcgggcccgccgcgagatcagcgtcaagatccccgccggggtgggtgacggcatgcgggtgcggctggccgcccagggcgaggtgggtcccggcggcggcccggccggtgacctctacgtcgaggtgcacgaacagccgcatgatgtcttcgtccgcgagggcgacgacctgcactgcacggtgtcggtgccgatggtcgacgcggcgctgggcgccaccgtcaccgtcgacgccatcctggacggcgtcagcgaaatcaccattccgcccggcacccaaccgggttcggtcatcacgctgcgcggccacggcatgccgcacctgcggtcgggcacccgcggcgatctgcacgtgcacgtcgaggtggtggtgcccagccggctggacgcccgcgataccgagctgctgcgcgaattcaagggccgccgtggccgcgacgtccccgaggtccgctccacccacgccggcggcggattgttcagccggctgcgcgagaccttcaccgggcgctagcccgacgccgcgcgggcccgcccatggtcgcgacgctgttctacaccgacgagctgcccgacgccggctcgctggccgtgctgggcggcgacgaggggtttcacgccgccaccgtccggcggatccgccccggggaacgcctggtgctcggcgaccgcgccggcgggctggcccgctgcgaggtggagcacgcggggcgcgacgggctgcgggcgcgggtgctcgaacgctggaccgtggcgccgccgaacccgccggtgaccgtggtgcaggcactgccgaagtccgagcgctcggagctggccgtcgagctggccaccgaggccggcgcggatgggttcctggcctggcaggccgcccggtgcgtggccaattggcacggtccgcgggtggacaagggtttgcgccgctggcgggcggtcgccaaggcggcggcccgccagtcccgccggccgcacatccccaccgtcgacggggtgctgtccaccgcgtcgctgacgtcgcggatccgcgacgaggtggccgccggcgcggtggtgctggccctgcacgagtcggccaccgaccggcttacggatgtgcctgtggcacaggcgaagtcgctgttcctggtgatcggccccgaaggcggtatcgccgacgacgagctcgccgccctgcggcaggcaggcgcgctgagcgtccggctgggcccccaggtgctgcgcacgtcgacggccgccgcggtggcgctgggcgcgctcggggtgctgaccccgcgctgggacgacgccgcgagcccgtaatttcgtcgcactttggccgcagaaacgcaggtcggccaacgaccgggccgcccggtgcgccgcctgaacattggggtcagcgtcgcggcggcggtaggattaaaacgccagaaatcgccgcgatcggccagaacttcagaaggcaggcatcgaaaaccacgtgacgccccgcgacaccagcgctgctgacgcagccggagccctccaggccgacgctcaagttcgcatcagcatcgatgttccgcccgacatcgtcatgggcctgctgggttcggcagacgagaacctgcgcgccctggaacgcagcgtgatcgccgacctgcacgtgcgcggcaacgccatcaccatctccggtgagtccgccgatgtcgcccgcgccgaacgggtgatctccgagctcgtcgcgatcgtcgccaacggccaggtgctgacgccggaggtggtccggcacagcgtcgccatgctggccggcaccgacaacgagtcaccggccgaggtactgacgctggacatcttgtcccggcgcggcaagacgatccggcccaagaccctcaaccagaagcgctacgtcgacgccatcgacgccaacaccatcgtgttcggggtcggcccggccggcaccggcaagacctatctggcgatggccaaggcggtcaacgcgttgcagaccaagcaggtcagccgcatcatcttgacccggccggcggtggaagccggtgagcgccttggctttctgccgggcacgctgagcgagaagatcgacccgtatctgcggccgctgtatgacgccctgtacgacatgatggaccccgaggtgatcccgaagctgatgtcggccggggtcatcgaggtggcgccgctggcctacatgcgcggccgcaccctgaattcggcgttcatcgtgctcgacgaggcccagaacaccaccgccgagcagatgaagatgttcctcacccggctgggtttcgggtccaagatcgtcgtcaccggcgacatcacccaggtcgacctgcccggcggcgccacgtcgggcctgcgctcggcgatggagatcctggaccgcgtcgacgacatccacgtcgccgagctgaccagcgtggacgtggtgcgccaccggctggtgtcggagatcgtcgacgcctatgcgaagtttgaagagcccggcctgaccatgaaccgggcggcgcgacgggcgtcgggctcgcgcggtcgtcgatgatggtgtgcggtgagcgggatctatgagcattgaggtgtccaacgagtcgggtatcgacgtctccgaagccgagctgatcagcgtcgcgcggttcgtcatcgccaagatggacgtcaatccggcggccgagctgtccatggtgctgctggacaccgcggcgatggccgatctgcacatgcgctggatggacctgcccgggccgaccgacgtgatgagcttcccgatggacgagctggagccgggcggccgcccggatgccccggagccggggcccgcgatgctgggcgacatcgtgctgtgcccggaattcgccgccgatcaggcggccgcggccgggcacagcctggggcacgagttggcgctgctgaccatccacggggtgctgcatctgctcggctacgaccacggcgaaccggacgaggaaaaggagatgttcgccctccaggaccggttgctcgaggaatgggtggccgatcaggtggaggcctaccaccaggaccgccagcaggagcgcgaccgccgattgctggacaagtcaaggtatttcgaccattgaggccatctaaacactgtacctgaccaggtaaaacgtgctgaaacggcaactcagttcagtcaaatatctttgactcagttaactccttcatcgcaacgcgaaggagacacgccgaatgtgcaggcccacgctccactgggacgcggaccacgtgtccaggttgatggagtgcaggaacatccgtaaccgccgagccctggccaaagcgctcaggcgtcacccctccggggtctatcgtgcgttcgatgaggactggtcgggtggcgtgagcctcgacatcctcgcggccatgtcggtgcgattcaacgtgccggtcggctggttggtgcgcgaccccagggggcggtgatgcccatcaagaggtacccggtcggtgacgtggatcaggacgacgccctcaccaaagccggggaggcccccgagttgccgaccgaggtggtctcacctactacacctcctacagatgtaggacccaccgcgtgggccgaggtgggtgacgacagcctcgatgattcatcgaacctggacgaccgccggccgctgtccgtagcgctgatggcactactcgccggggtggtgatcgggtggatcggcctgggggcctacatgatcggggagcacgtgagccacaggtcagaaggggtgaacgaatcgttacccccttcgcgaacagtgcagataccgtccaacgtcgcgaagccgacgacaacggcgacgcccacccccgcgctgaaaatccagccgaacgcgtgggaggcgttcacctatcttctgcgggcgcgcgggggttgagtatcgacccggccgagaaggactacgacgacaaggccaaccgtcatctgtgctggacgctgttcagcaacgatgatccggcgtttcggcagaagacgattcagggctccattgaggccagcgagggcggtacgtggggtaagccggaagccacctacgccatccgcagcgcgatcatggcgtactgcccgcagttcgataggtagcccgtgggctcgctatgactcgtcgccccacccggcgttgggccagttcttcctgacacttgtgattgcaaattggccggtgttttccatctccacggtgaacatcgatccgtctttcgcgtggtagaccacgtgggcgcggagtccctgaacatccacgacgacgggcctcaagtcatcccttgccacaccgaacccctgctcgattgctcccagcgccaaaggatttgcattttccatcaggaatcgttcctggggcggtgacccggcggtccacgagaaccgatgcgacagctttttcaacgcgtcatagatgacgttgtacgcaagggcagtgggcaaccccaccgcgaaggcgatcccgtattgagcgaggccgccgccggggtagggagtctgcgactcggtgatgacgggcttggtctccgatgtctcggccagcgagttcacaaggttctgaagttcttcgcggaaagcggccgtgtcgcgccgaacaatgttggtaaagagaagggcaacttcggcaagttcaccttccggcgagggggccacaatcgagacgcgcgccgttctgggtaggtcgtcctgatccatgctcaaagggtcgcatgtcgaatggattggttacctctgccgtgccgcttggacagtgattgcgttactaccgggtttcttgtcggtgcgcagacttaccgtcgaggtgggtgttcacgaggggcaccgtaaccaccgaaggagattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccggaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaaccgccctgggtttgctgcacatctgtttactggtgtgcggccgcggattgggctgtgtttgcagcgtagtagatggcctcgtattcgaccggtgggatgcggcccaggcggtgcatgagccggtcggtgttgtaccagtgcacccagtcggcggtgagcatttcgacgtcggccagccggttcagcggtccgcgccggaacggtgaatccgcccgcaccgcttcggtcttgtacagccctatggtcgtctcggccagggcgttatcgaaggcgtcgccgaccgtgccgatggacgggaccagccccgacagcgatagggtttccccgaaccgcaccgaggtatattgcgagcccgcgtccgaatgatgaacggtgttgcccaacaatggattaccttcattggatcggagttgcgcggcgtcccggatggcctggcgtaggaaccggtcctccttgctggccgagcaggtccagcccacgatccgtcccgcgtaggcatcgatggcgaacgcggtgtagacgaacgccccggaagccagtcggacgtaggtgaaatcggccacaagcaacatgttgggagcgggcactcgaaacttgcgtttcaccagatccgcagcacgtgccgcggctggatcagcgatcgtggtgcggaccttcttgcggcgggtgaccccacgccacccgttggcccgcatcaggcgctccacggtgcagcgggccacgccgatgccctggcgttgcaggtgagcccacatcttcgtggctccgtacaacgactccggcttgcgtcgaccgtgctcgtcgggctcgtagtagccggccagcacctcggtgatgaccgtgtcccacaaggcccgggcggacggggctcgggccagccaggcgtagaacgttctcggggcgatcttgcagccatgctcggtgagcacgcggcagatcggagcgactccgaaccgagcacgatgctcggtgatgaacgcacagatcagcggtgtcgcgggtcgctctcccgcacgaagaaagttgttgctgcccttaacatctcgacggtctgctccaactcggcgaccttacgcttgagctcccggttttcccggttggtggccgtagtcaccccgtcacgctcaccgccatcgatctcggcttgacggacccacttgcgcagcgtctctgggccaacaccgatccgagtcgcgactgcccggatgcagccatactcgctgtcgtactcgtcgcgatggtccacgaccagacggacagccttgctcttcgttgcttcgtcgtacttcttcggcatgatgcgccttaccttccctcgaaagaaggtgtgcatcaaacacggggcgattcaaagtctgaatttccggggctcagatggccgctgcggcgttttcagccggtgggtggggcgggtttgcacccgcttgtcggaccagggttgagatggcgcttaggctgcaccgtccgatgtgacgagttggcgggtcagcacctcaaggcggccaaaatccttattaagtcggtctcgaatttcggtgtatgtctcgatggggtcgctgtcgacgaggtctttccaaagctgagcgactgtccgtatggcatccagagtcgaggaaattccggcgtcagtggtcaacagccaggctcgaatcgcaagctgttcaaccttattgagctgcggcgtgtgctcatcgcgtacctgcaaggccttgttgaaccgctcattagccgagacctccggccgctgcctatcggttttgtactcgtctgccgctgtcgcgagtttgtatgcggccttatccgtcgcccaacgctcaccaagcaggttggcgacctcctcgcgcagtcggtcgttgcgctcggccgcccgatcggcacgcccttcggcccgagtggtgtctagctgctctctgtgacgcttgtctgcgttcctattggtgcaccaaaccccgaccagtccgccgacgaatagcacacccgagccgacaagcccgagtaccggaccaagccaggcccaggccgaagcctcgttgacgatgtctactggccacggatacacccaataatccacgcacgcatttaaccagtgactaccgacaaacgtcgtggggtatgtcggcgccgacgatgatcggcagccagacgacggggatcagtgcgggacggccatgcggtaaccgcccacgcagccgctgacaccattgatctcgctggtacgccaggagccgggaccgtgggcactgtagccccagccggtcggtggcggtcgacttgccgcataccgggcagggggtggcggtcgcgcttgggttgctggaaccgcctcacggcaccccggccagatggtcgaagcgtttttgcagatcggcaagcacttcatcacggcctgcggtgtcgcggccgttcaactgatcgacgtacttgccttcggtgaacgtcctgagcagggactcaaggcgggccatctctgactcgcccgagcgtttgcagccctcgcagcaccaacgagaaggcctgccgccgttggagtttcgggtgatggggttatcgcacttcgggcaggtgtcagggtggtacctggtcaatgaatctcccttgatgagaaggcttttcgtgcgtgtatgtctgtaccgacgaaatcttgtgaaagtacttgcgcgacagtgcatcccgcgctatggttgaagcatgaacagcaacaggacccgggggttaggaatcgacgtgcagcgcggcgtttccacaggtcaggacccgtttttgaggtttccgagatcccttggggcacagtcaatttggcacgcgcacgacgacacccgaagggtcgccagctaaggcgcggcggcgggattgagactcaccccctttgggttgcagtcaggtgcccatgttctaggtcctggcaaatagaggtggtgtatcgcagcgcatcacccagcagatgggttatcttctgcggcaggaattcttaaatcgcgtatggagtttcggtggtctggcttgagccgaacttgtcgaacgtcccactctcgcccctgcgtcgggatgactattgccgccatgcgcccaggaattgggctagttgctaccaccgcaccactgaacatctcgccggtcggtaccttttccatcgcgcaatacagccacggatgaaactcccaccgcagcttacccacgatggtcactcctcgtacttgatgtaagttttcgtcggacaggcgtatgtaagcctcgtcgcccatcacaccaagtgtatgaccaaaagaccacggcggttcgtctggtattggctcgccccggcggtaggcatcgtcaagcggttcaactcgatctttcaaaggctttgtcagacataggatgtcggtagagcgcaccaacatctcgtagccgaatgcgccgaagtttggataagccgaatgcactcgaccccgctcgtcaaagatcgggtcctccggcgctatgttgaagtctggcgcatgaacgtcgagccagatgtcccactccttccacgtcagaagccactgcgctgccctaatcacctctgagggtttaccagtcatcggagccaggtcgggaaagtgctcttcaagtggtgtcgtccactccttgatcacgtagagatcgacgccgtggtacgcggctttcttgattgcgggcttgtaatagccagaggtcgaaacgatagcgcgatgggtcacgccgggcatatcgttaagcttcgcagcgagttgttcaacgtgagattcgttgagcggcttcttccaatgctttacctcgtagcccataaatgcgtactccccatctggggtgtcgagggtgacggtcacatcgacatcgcgaggctcgccggacgcctggtctagcaccatgtcgccgagaaccacctccttcacagacgcggcggcgccccatttcaatacacacaggccggcgaggtactgaacaagcattggcgacaatggcaacttttccttcggcgacatgacgccaatgttaggtacctactacgacacgctcccgtaaaagtcgcggtgcgggctgtcgggccgtcgctggtttggctctactgcaacatggcgggcgcggttttactcatcccaagagttggaacgccatacactgcttcgcgtgagtcagccgagcgagcagccctctgggcgcccgtccctggagagtctggttcgttctgcagccgatccgctggcagcaagcactgccgttgcggcggtagacgcgctgaatcagtcagaccgcgccctttcacggctattggagaatgaatcgatagcgtcgtcaccattcaggaactccgcgttgcgcccagcgaagcgcaaagcggcggcgcttcgccagcttctccgtgacgatctgtcaattcacccgttcaacgtggtcagcgaacatgatctaccgaaccttgaatcgattagtgtgcctttcggtgcgctaattccgcgtgatcagttaaatattttgatggcccaatgcgcgtcaatgaattaagtgctgagaacgccagccgcaagtttttctgcattcgaaagtactatttcaggatttctgaagtatctagatgaattcagtgagaattcggttaagccggcgctagacgttttggatgggctccggcagcttcgggacgagtaccacatcgagatcggtggtcaggcgctagacgcagcactcgcggatcgtcgccgtcaacttttggattcgtatgtcgagttgcttgaaagcgtcctgagtgatgcgcagagtcgcactcaaaggctcacagaggatgaacaggctgttgaaaaagccgtatcgcggaagggccgtcagcgtctccaacgagacttcgccaccatggtcaaccgtgagacttggtgggcggcagggtggacggtaacagcgttcttgttgacatgcactgctatcgcgatccccgtcgtactgttttcacggggcgtacagtttcccgcagttaccggcttgtccgcgacgctgattaaggcattcattgggattccgctacttgcattcgctgcctactgtggcaaaattgcgtcccagcaccgagacacggctcggcacatgaacatcttggtgacacaaattgactcagtgagtgcttacgtaactgatctacccgccgaatcaaaaaatgagctcaaggtgattctgggcaaacgagcgttttcaacccctgaccttgattccggcgccaaggcagagtctgagcctagttcgggagaagttgcgctgctgctgtcgaaggctctggatattctttcgaaattcggtgagaagtagtcgcggttagtctaagcgaggcatccggtgcttccatgcccaggtgtcatcacgaaacgctgtatccgtgcccttggcggttcatcgcgggcgaaggcgataaggcgatcaagctcggtatcactgagtacgaggacgccgcgaaaatgtccgcgcactgccaccccgccatcagtacggcgttcggcggtaatcggaacccttagcgggtccgacacgattacgacgtcggtcatcaaaacttcccggtgaatagctcgggtgcttcaaccatcaatgtcttcatcatcaacatcgcgagatcgcgtgccgcctcgaattcaatcggcatgatgaaggattctccatagccgagaatcggatcaacgttgagtccgattaccggcttagccggatgcttcggattggagtccaccaatacctcaaagctgtcagcgatgacgctgcggtaatcaggtgacttgatgttctgcttcatattctttcttcaatccccactggatgagcttttcggtcttcggtgatgttgggtgacacatgtaggtctcgccgctgaattcggcggcctcgatgtcgtagacgaagctgtcgacccactcgcggttaggttcttcttcatgcggcttgccggccatcagattctctaggcagcagccgatgacgtgccacagcatggcctcggcgtcgggaacccatttcaggttgtccggcgaatcatcgccaagttcgtccaaccgccccaggatgtacggcaccgtctcgcggcacttctcgcacgtccagtactcgggccagccgtgggcggcgaccgcgatcaggtgagcttggctgaccttctcgcgccggccatcgcgcatttgtacgcgcacgaaaccgtgccgggtggccactacgcgggtaccgtgccggatcgcgctggttgtgccccgtgaagtggtgtaaagccgatcggcgtttcgcctgaggctctgcgagtttccactatgccgtgatggcggcggggacggcaacggattggtcggctgaatcggagcggggatgtaatagggccagggtggtctcggagagatagcgcttttcggcgacttgccattcgtcgtgggcttcgacgagaacggagccggccagccgtagcagcgcggcggggttggggaagacgccgacgacgtcggtgcggcgtttgatctccttgttgagtcgttcgagggggttggtgctccagatctttttccagtgcaggacagggaaatcggcgaatgcggtgatgtcgtcggcggcctcgcgcagcatcgtttcgaccttgggcagttggcggccgagcatgccggcgatggtgtcgagttgctctcgcacatgttcggcgtcgggttgggcgaagatggtgcggatcgctgcggcgaccatctcggctgatcccttgggcacctgggcgagcacgttgcgcaggaagtgcacccggcatcgttgccaagatgcgccgatgaggatggcctcgatggcgctgcgcaacccggtgtgggcatcagagatcaccagctgcaccccggacaggccgcgggttttcagtgagcgcagaaacgccgtccaaaacgcgccgtcctcggagtcaccgacgtcgaagccgagcacttcacggcgtccgtcagccgcgacaccggtggcgatgacgaccgcttgggagaccacccgatggttgacccgagccttgcagtaagtggcgtcgaggaacacatacgggaagtgctgttcggatagaggccggtcccgaaaggcgcctacctcggtgtccagatcggcgcaaatccgggagacctcgcttttggagatgccggcgtccgcgccgagggctttgaccaaatcgtcgactttgcgggtggaggtgccgtgcaaataggcctccatcaccaccgcgaacaagcactgatcgacccggcggcgccgctccagcagcgccgggaagaacgagcccgaccgaagcttgggaatccgcaactccaaatcgccagcgatcgtcgacagtgtgcgcggccgagacccgttgcgctggttgattcgtgatgcgctccgttcatgcggaccggcgccgatcaccgccgtcagctccgcatcgatgagtgcctgataaatcgtctcggcggcctgcttgatccgatcagcggcatcggcattgcgtaatgcgtccagcacctccagcaaggcagactggtccagggccatcgcgatgttcctctcggtagtgatccttggtcgtttcaccacagagactcacgcgatggccctctacatcagtaccgacacgccgccactatttacaccacgccccggcacgttcccatcgcgctgccaccgctgcgacgccattggtagaccggcgcgaccgcctgggcggggttgttgggattctcaacctttaagtcatcccagattttttcgttcgtcatttccttcgttcgttcaggatcgcatttcaaagaatgagtgtgcgtatgcacacaatgctggatcacggagcggaagcgcagtgatcctgccctcgcctttaggcgagcctcttacgtaccgagtcggtacagtgagtcagcctggaaagggaagacaattacccaagtcgtgtagtgacgttgcgttctcgaatcagacgttgcattgtggtctgttcgcgcggcctgtcactgaccgtacttcggcggattctttcaagaatcgaagattcaaagaaccacaatcggaactgtcacgttctcgcactctccatgccccgcacttctggggtacggctgggtctagagactctcacctagcggtgagggtttcgccatctcgctgcgctcaatggctcacaaggaatagaccctctacttataaggacacttctgggcaaaaacgtgaatgttgaaatcgcatttccccaggtcgccccaaaagcgtgtgaccaacctcacattgacaggtggcccgcgcatcccggaggccatcacgccgcctcccgcgcggcgacgatggtggcccacaggttgtcggcagtgtcgcaacaatccaacaggtcttcgcgtaccagctcgcgacccaaccggtcctaaaaacagctcgcacacaaccagccctgcgtgggcgggccgtagatgcgccacagctcgtcactcacccggtaacagtcggcacggccgccgcaccacttgcacggccaccatgcgccccggtcgtctgctatcgcgccagtctcgtcatcccggccggtccggtagccctcgcagaaggcgtccacccagccgccgtcatacccgtcatcccagccgccgacgtagccctcatcccaccccacgtcgaagccgatgtcacggccatcgttgaggccgtgggcgtagtcctcctcgctcacgccgccaccccgtcccggcgacggcgccgggactcgacggacttcaacgccatcttcttgaagtgggccgcgcgggcgttctcggccatcttggcgcgcagggcggggggtagcttgccctcgggatcgacctgcttttcgaagcggtcccatgccgccttacgggcgttatgcgttcgcgcggaacggttttcggtgcgcgcccagctctcgtgaacggcgacctgtaagcgcaaacggcgctcagtagatgttgacacttgcgtactcctggcatccttgatcaggcccccgagatgccaactcgcccaagggtggacgaatctgccgggtggccaatgtgatcaaggcacgccccaaagtgggggagctacgctgtacgcgcctttaggtacggctgcaaagctacagcgttgaccagccgtgctcaagcggaaagtgtcacattccccaaagtcgcagtaacactttggaaagtgccagctcagatatcgcccaagttgagcctgcgggcctcgtcggcggcaaggctggcggcagcggcgccgacgtacctgtcaatcatgctgcggttcttccacccggccacgctcatcagccccgactccgacccgccagcgcgtagccagcgggtcgcggcggtgtgcctgagcatgtgcaagtggaaggtctcgatgccggcggcggtagcgcgctgcttcaatgccttgctcagcccgtagtaccccaggctcttcccgcccccgcccagccacagcgccccggtgttggacagccgatgcgcacgccgtgcccgaaggtagcggtcgatggcggtggcggtctgcacgctgaagggcgatacgcggcccttgccgcccttgccgcggacaatcgtcacgatcccggcgtcgaggttgacgtcggtgatctgcaggctgagggtctcattggcgcgtagtccggtctcggccatgaggcggactatcgtctcgtcgcggcggtccattagggatttgccctggcaggctgcgatcagccgtttgagctgatcttcggtgagggcgttgaccaccttctggtcacccttgggcggtttgagtcctagtaggggatcggagctaagctcgccttcatcaaccagccatttcgcataccgcttcaaggcgaggtcccgggacttcgacaactgatgcccgcaaaattgagccgactccggattctggcggccgccgcgatcgctttcgcgccgttgtcggtggtggtcgacggcccggcggcgcaggcggcgccgtgtgccggcgccgggtcgaacccggtctcctgccagcactgcatgttctacgtgaacgcctaccacaccgccaacgtgtgcaacgaggaccggcggggggtgcagggcccgccgagcaacgcgcccacccggcccccggaagtgccggtgccggcttacgagccgcccccgatcccggtgccggtgcaaagcccgctggtgttgccgccgcccaacgcgggccagggcgccgtgccggtgctcgagatcaatccgcccgggcccgacgcgccgcgcgacgcccccgtggtggcaccgccccgcggcctggatgcgccgtcgctggcgatcgccgcggccaaggccgccccggtgacccgcgtcgacccggccaacccgcccaaaccgcccacccaggtggacttcaaccagcaggtgcagaacgtgttagccgcgcaccgggaaaacgtcgacgtgctcaaggttgacgagcaacggctgatccgcccccgccactgggactacatcgactacgacgacgcctaccgccgccccaccctctacaacccgctcaattcggcggtcaccttccgctacttctacaacggcgcctaccagcaggcctacctggcgcgcggcgcgcggatggtgctcgacgccgcgacggtcggcgtggtcccgttcaccgcggtcggcgacagctatgtggccgcgggcagcttctacggcggcggatcgatcccgctgaacggctacaacggcccgccgccgccggactacaagccgccggcgccgccgaagctgtacgagaacgtgacggccttcatccccgccaagggtgagaccgtcgaagtcggccacgtggcggtggtgggtcacgacggcagccaacccgcgggcagccaggacaccttcctgctcgacgactccaccctggcctggggccagatcgataactccagcagcgccccggcccagatccgggtgatcaagacccaaccgctgccgggcgccgggccgaccgacgacggcggctttttggtgctgctggcggtccaccaccaggagcccggtcagcccaggcagtccgggtggggtctggcgctgcggttcgggggcttcgcggtggtggtgggcgtgatcgcctggctgctggcccgccggagccggtccgaggagcagaacgccgattcatgaccggctggtctgagttgctgggtgcggtggcgttgatcgccttgggcggcctgttcgcggcgatcgatgcggccatcagcacggtgtcgctggcccgggtgcaggagctggtgcgtgacgagcggcccggcgcggtggcgctgtccaaggtgatgtccgagcggccccgctacatcaacctggtggtgctgctacggatcacctgcgagatcaccgcgaccgtgctgctggtggtgtttctctacgacaacttcgggctcaggtgggggctgttcggcgccgccgccatcatggtggtgaccagtttcgtggtcatgggggtgggtccgcgcaccctgggccgtcagaacgcctattccatcgcgttgacgacagtccttccgctgcaagtcatttcatggctgctgatgccgatcagccggttgctggtggtgctgggtaatgcggtcactcccggccgggggttgcgcaacgggccgtttgcctctgagatcgagctgcgcgaggtcgtcgacctggcccagcaacgcggcgtggtcgccgccgaggaacgccgcatgatccagtcggtgttcgaactcggtgacaccccggcccgtgaggtgatggtgccgcgcaccgagatgatctggatcgagagcgacaaatcggcgagccaggcgatcaacctggcggtgcgcagcgggcactcgcgcatcccggtgatcggcgagaacgtcgacgacatcgtcggggtggtgtacctcaaagaccttgtgcagcaggcgctcttacccggcggcagcggccgggccacaccggtgtcgcaggtgatgcggcccgccgtcttcgtgccggactccaagccgctggatgcgttgctgcgggagatgcagcgcgaccggaaccacatggcgctgctggtcgacgagtacggggcgatcgccgggctggtcagcatcgaagacgtgctggaggagatcgtcggcgagatcgccgacgaatacgaccaggccgagaccgcaccgatagaagacctgggcgacaagcggttccgcgtgtcggcgcggctgcccatcgaagacctcggcgagctctacggcgtggagttcgacgacgatctcgatgtcgacacggtgggcggcctgctcgccctggagctgggtcgggtgccgctgcccggcgccgaggtgatatcgcacggcttgcggctgcacgccgaaggcggcaccgatcaccgcggccgggtgcgggtgggcaccgtgctgctcagcccggtcgaatccgacgggtcacccgacggtgaggaacccgagcatcatgactgaattccgttccggcttcgtgtgtttggtcgggcgccccaacaccgggaagtccacgctgaccaacgcgctggtcggcaccaaggtcgcgatcacctcgatgcggccccagaccacccggcacaccatccgcggcatcgtgcaccgggaggacttccagatcattctggtggacacgccgggtctgcaccgtccccgcaccttgctgggcaagcggctcaacgacttggtgcgcgacacctacgccgaggtcgacgtgatcgggctgtgcatcccggccgacgaggcgatcggcccgggagaccgctggatcgtcgagcagatccgcgcgaccgcgccgaagacgacgctggtcgccatcgttaccaagatcgacaaggtacccaaggaccgggtggccgcgcagttggtcgcggtcagcgaattggtcggcgactcagccgagatcgttccggtctcggcggtgaccggggcgcaggtcgacatcgtgatcgacgtgctcgccgcggcgctgccgcccgggccggcctactaccccgacggggagctcaccgacgagcccgaggaggtcctgatggccgagctcatccgggaggccgccctcgagggtgttcgcgacgagctgccgcattcgctggcggtggtcatcgacgaggtcaatccgcgggaggaccgcgacgatctgatcgacgtgcacgcgctgctctacgtcgaacgcgacagccagaagggcatcatcatcggcaaagggggcgcgcggctgcgcgaagtcggcaccgccgcgcgtgcccagatcgagaagctgctcggcaccaaggtgtacctcgacctgcgcgtcaaggtcgccaagaactggcaaagcgatcccaaacagcttggcaggctgggcttttagcgggatttggtcggtacgcgcaatcctgcccggtctgcggccgcgactgcacccgaacggaccgggcgggctgcgggcatcgctggtggccgacgtgccggtggacgaggtgaccggcgaggtgcgccagttgctcgggtgacgcctcaggcgagcacccggatggtctgcagcgacggatcggccgcgtcgggcaggttcatccccgcggccaccccggagcaaaggtagtccagcacagcatcattgagccgctcgccggggacgacggcggggatgcccgggggatagggcgtgatctgttcggcggcgatccggccggcggcggttttggtcggcacctcctgcacccgtccgaaaaacgcgtcgcgtggcaattcgaccgtctccaactgcatttcggacggcgacggcagcgcgatccggggggcggggtcgaagtcctgcgccgcggtgcgccacgcccgcagcgcatcggtgagacgacccaacgtctccttgtcgtcggccatggacaaggtggccaggatgcggcggtggtcgctcatgcccacgtcgatgcgcgcgtgctcgcgcagccagtcggcggcctgataacccgatgtgccggtgccgcatacgtcgatcagcacctgcatgcggtccaggtcgtgggacgcctgcacgcccagcagctcgtcgtcgagcacctccacatcgggaatgagctcgatctcgtcgcgcacctgccgcgccaaatccaatgcagcgccgagcaattggtgaccgtgctgcaccatctgccggcgccagccatccatcgccgcgtagatcaggacgttggggctggtggtcatcagcagatccgcgcacgccgagaggcggtcccggtcgatgaggtcgccctggacgtggaacaccgagccctgctcgaaaccggcgcccatcttgtgcacgctgaccacgcacacgtcggcgccggcatccatcgcccaggttggcaggtcctcgtggaacggcagatgcgccccccacgcctcgtcgaggatcaacggcttgccccgccgatgacacacctcggcgatgccggcgatgtcggcgcaggtgccgtacgggctggggctgacgaccagcgcaccggcggcatcgggatgcttgtcccaggcctcttcgacctgctgcggcgagggcggatgagaaaagtggcgctcggcgtcccagcggggagtgatccagcgcggctgcaccccggagaagatcagccccgccacgatcgacttgtggctgtcccggccgaccagcaggctgccctgcccaccggccaccgccatcatcgccgcgcgcaccgacagggagctgccgcaggtggagaaccaggcgatctcggcgccgacggcctcggccatcaggtcctccgcgcgctgcaggtagccgttgctggcgcgacggtcgtcgagcccgccgctggccagcacgtcgtcgagaaagggctcgcggcccagcaccgcgaggacccgatcgtcggtgccgcggccctgccggtgcccgggcggcgcgaacccgtaccggttcttgtcgcgatagtcggccagcgcgttgagcaaaggtgcgtcggattggtccattgcgctcggataccccggttgtgcacggccgactcgccgcggccggccgccggcgcgctcgtcgcggacggccgtcacccggtgggcgcgggctggccgggggcggggggagtgtcggcgctctggtcccaccagggctgcggctgtttgctcgcccacccggacaccgcctccaactcggcggccagcgagatcagcatgccctcgctgttggccgggcccatcagctgcacgccgatcggcaggccgtcggaggtgaagccggccggaacgttgatcgacggccagcccagcacgttccacgggaaggtcagcgggcacgccgcgatcatggcgcggtcggtgccgaagccgctgagccggtcgaaggcgcgggccagcggcgggggttgcgcggtggtcggcgccagcaccacgtcgacgatgtcgaagatcgagcccacccggcgctggtcggcggcctcgtggcggcgggcgctgcgcaggatcgcctgtcccagcagatgacccagccgcaagttggccaccgtgcgggggtccagaaccacgccgtcgcccaaccgctcctcccagtcccgcaggccggcggtggagcgggcgagaaaatcccacgacagccgcatgccgtagtccgggttgcccggcaccacggtgtggcccagcagctcgagttgcttgcccaccgcacgggtcgcggccaggatctccggatgcagcttcggccggaaccccgtgtaggggaaccgggtcgacagcgcgatgttcaacggaccgggcgccttgcccacatagtcggaggcggtgatcgggggcggtttgtgccggtcgccgtcgacgttgccggacgccgcgtcgagcaccaacgccgcgtcggccaccgtgcgggccagcacgccgttgaccgtgatcccgttgaacgcctccggcagcggccaggtcgagatgcgtccgcgctgcggcttgatgcccaccaggtgcgtccacgccgccgggatgcggatgctgccggcgccgtcggacccgatggcggcggtcaccaggcccgcggccaccgccgcggcgctgccgcccgacgatccgcccggggtgtgccggcgcgaccagggattgcgggtgtgcccgaagcccggtccgctggtgaacggccattgcccgagttcacaggtgttggttttgccgacgatcaccgcgccggcggccttgaggcggcgaaccacctcggcatcgtgcgtggcgggcggcaccgagccctcggtgccgaaggcggtgggcacgccggcaatgtcgacgtcgtccttgacggcgatcggaatgcccagcagcggggcggtgtccccggccgcgcggcgccgatcggcctcggcggcgtcggccagcgccgactcggtgagcaccacccggaaggcgttcagcgtgggctggctggcatggatagcgtgcagcgagcgacccaccagtgtggtggaactcaccgaccggctggccagctgatacagcaggtcagtcagggtgggcaggcgctggttgccggatccggaacccgagccggaaagcgccccgggacccgactcagaagcgccaatcacggggtacgagactaacggcgcggatccccgcaatgtcgcggcggggtgcaaaactattgggatgcggctgtatcgagaccgagctgttgtgctgcgccagcacaagctcggcgaagccgaccggatcgtcaccctgttgacccgggaccacgggctggttcgcgcggtggccaagggggtacgccgcacccgcagcaaattcggcgcgcggctggagccgttcgcccatatcgacgcgcagttgcatccgggccgcaacctcgacatcgtcacccaggtcgtctcgatcgacgcgttcgccaccgacatcgtcagcgattacggccgctacacctgcgcgtgcgcgatgctggaaaccgccgaacgcctcgccggtgaggagcgcgcccccgccccggccctgcacgggctcacggtgagcgcgttgcgggcggtggccgacggccgccggtcccgggacctgctgctggacgcctacctgttgcgcgcgatgggcatcgccggatgggcaccggcgctgaccgagtgcgcccgctgcgccacccccggcccgcatcgggcgttccacgtcggcgccggcggcagcgtgtgcccgcactgccgcccggccggttcgacgacaccgcctcccggcgtgctggacctgatgtcggcgttgcacgacggcgactgggagttcgccgagcagacgccgcaatcgcaccgcaactacgtcagcggcctggtggccgcgcacctgcaatggcatctggagcgccagctcaagacgttgccgctcgtcgagcggacctatcacatcgaccgcaccatcgccgaccagcgcgccacgctgatcgggcaggatatggactgtggttagagccgagcgcgccccgacgtcgaccggctttccgcagctgcccccggcgcccgacgactacccggtgttcccggacaagtcgacgtggccggtggtcttccccgagttgccgccgtcgcccggcggcgggccgagccggccgccgcagcacatctccaaggcggccgcgccgcgcatccccgcggaccgactgcccaaccacgtggccatcgtgatggacggcaacggccgctgggccaccgaacggggcatgtcacgcaccgacggccacaaggccggcgaggcggtggtcatcgacatcgtctgcggcgcaatcgaaatcggcatcaagtggctcagcctgtacgccttttccaccgagaactggaagcggtcccccgaagaggtccggtttttgatgggcttcaaccgcgacgtggtgcggatgcgacgggtgaacctgaacacgataggggtcaagatccgctgggtgggttcgcggccccggctgtggcgcagcgtgatcaacgaattggcgatcgccgaggagatgaccaagcgcaacgacgtcatcaccgtcaactactgcgtcaactacgggggcagggccgaaattgccgaggccacaaaggaaatcgcccggctggccgccgccggccggttgaaccccgagcgcatcaccgagtccaccgtggcgcatcacctgcaacggcccgacatccccgatgtggacctgttcttgcggacctcgggggagcagcggtccagcaacttcatgttgtggcaggccgcctacgccgaatacatcttccaggacaagttgtggcccgactacgaccgccgcgatctgtgggccgcctgccaggaatacgcttcccgcaaccgcagattcgggagcgcataatgtcctcgctgcaagagcgtctggcatcggtgctgcgcgaggtgctgccgtcgcaggaggagtccgacggcgcgctgaccgtccaccacgagggcaccatcgcctcgctgcgggtggtcaacatcgccgaggacctcgacctggtgtcgctcacccagatcctggcctgggacctgccgctgaccaagaaggtcagcgaccacgtggccaggcaggcgcgggatgccaactttggcagcgtgagcctggtcgagaaggtcaacaagactgcggtgcagcgcaattcgggcaagaacaccgccaagctcgccgacgtgatgctgcgctacaactttcccggcgccggcctgaccgacgacgcgctgcgcaccctggtgttgctggtgctcgataccggcgcccggatccgtcacaccctgaccgattgagtccttccccgcctgccgagcgtgaagctagtttcacgctcgaccgcgaacgtgaaactagcttcacgttcggcgcggtttaccggcactccgagcaggtgccgaagatttcgatggtgtggctgacgtcggagaaaccgtgcttggcggccaccgcggtggcccactcctcgacctcgtgatcgcccacctcgatggtggacccgcaactgcggcacaccaggtggtggtgatgatgctcggaacatcggcggtacaccgactcgccggtgtcggtgcgcagcgtgtcgatcaggcccgcggcggccatcgactgcagcgtgcggtagacggtggtcagcccgatgttctcgccacggcggcgcagctcgtcgtgcaactcctgggcggagcggaagtcgtcgagggtctccagcagagtggagatcgcggcgcgctgccgggtggagcggacactcactcctgccccgtcgccggacggcgtcatgggcgcggctcttcgccggcgtgggcgacggcgtcgaccacgatgtgcgcgaggtgatgatcggcgagccggtagagcacctcgcgtccggaccgctccccggcgaccacaccggccgccttgaggatcttcaggtgctggctgaccagcggctggggcaccccgagcgcgtcgaccagctcgtgcacgcagcgatgggactggcgcaactgcagcacgatcgcgatccgcaccggcgccgccagcgcccgcaacagctcgccggcggcgtcgaggatgtcccgcggcggcgggacggggtagtcggccggaccggggtggcccgcggcggcgagcccgtcgtggtcgtgggcgggcaggcccggctccggtcccatggcgccgtcggtggcggccggcatcgaggcaggtgagggggacatcgtcatgggagcggcatcacctcgagaagtgccaggtagtgggaaagcatccgccgttgagtatcgcgaccggccggcttccactgtcacatgcatgatgacgcatgtcaaaggtggcggggccgatcgctaccatgactgatgctctgcgcaccgcggtcgatcgccgcgcgtgcccgcccgaacacggaaagggagtgcaccgcctcgtggcgtccgtcatcgacaccgtagtgaacctggccaaacggcgcggcttcgtctatccctcgggggagatctacggtggcacccgctcggcctgggactacggcccgctgggcgtggagttcaaggagaacatcaagcggcagtggtggcgctcggtggtcaccggccgcgaggacgtcgtcggcctggattcgtcgatcatcctgccccgccaggtgtgggtggcctccggccatgtcgaggtcttccacgacccgctggtcgagtcgttgatcacccacaagcgctaccgcgccgaccatctcatcgaggcctacgaggccaaacacggccacccgccgcccaacgggctggccgacatccgcgacccggacaccggcgaacccggccggtggaccgaaccgcgcgagttcaacatgatgctcaagacctacctcggacccatcgagaccgaggaaggcctgcactatctgcgcccggagaccgcgcagggtattttcgtcaacttcgccaacgtggtgacgaccgcacgcaagaagccgccgttcggcatcggccagatcggcaagagctttcgcaacgagatcaccccgggcaacttcattttccgcacccgcgagttcgagcaaatggaaatggagttcttcgtcgagccctcgaccgccaaggaatggcatcagtattggatcgacacccggctgcaatggtatgtcgaattgggtatcgatccgcagaacctgcggctgttcgagcatcccgccgacaagctgtcgcattactccgaccgcaccgtcgacatcgagtacaagttcggcttcgccggtaacccgtggggcgagctggagggggtcgccaaccgcacggacttcgacttgtccacgcactcaaagcattccggggtcgacctgtccttctacgaccaggccaccgactcccgctacatcccgtacgtgatcgagccggcggccggcctgacccggtcgttcatggcctttctgatcgacgcctacgttgaggacgaggcgccgaatgccaagggcaagatggaaaagcgcgccgtgttgcggctggacccgcggctggctccggtcaaggcggcggtgcttccgctgtcgcggcacgccgacctgagtcccaaggcccgcgacctggcggccgagctgcgccggttctggaatatcgaattcgacgacgcgggcgccatcggccggcggtatcggcgccaggacgagatcggcacaccgttttgcgtgacggtggatttcgactcgctggaggacaatgccgtgacggtgcgccggcgcgacgacatgtcccaggagcggatcggcatggacgccgtggccgactacctgtcggcgcggctcaagggctgctagcgccgtcgtggccgacgcctccgcaggcccggattcgggaaataaggtttgcgtaaattccggcttccgacgctaagggtgccttaggatctgctctggggcataagtcgataactagtcgccatgggcggatgtcgggccgtccgttgcaggagccgttaactcggccggttggggttgcgaatgattcccgcgtttgtgttcttccctcccgagatcaactcggccctgattgcgggaggcgcgggctccggacccctattcgaggcggcctcggcctgggacgggctggccgccgaattgtcgtcgtcggcgtcgtcattccaaaccgtggtgacggatttggcggcgggttcgtggatggggccgtcgtcggtggccatgaccgcggccgccgcgccctatgtgcagtggctgatcatcgcggcggcccaggcggaagtggccgcgttgcaggcccggctggcggcgctggccttcgagggggcgttggtggcgacggtcccgctgccggcggtgctggccaatcgggccaggctgctggtgttgatcgcgacgaatttcttcggccagaacacggcggcgatcgcgcagaccgagctcgagtacgtcgagatgtggctgcgggacgtggccgccatgctcgggtatcacgccggagcgcaatcggcggcgcaggccctgccggcgttcacggtgccccccgccggcctgggcggcggcgcggcgtccgcgggcctgggcggcctggccgggttggtgagcgcaccgctgagcttcgcgtcgcagttcttcgagggcctgtcctcgctgggaacggcgttcgccacccagctgcagtccgtgttggcggcgctgccgccggcggtgtcgtcgctgacctcgttgatcacctcgacgccggtggcgacgttgacgtcggtggcgcaggccgggatgtatccggccaccgcgctgatgacgcccatggtgacgctggcccaaagcaccgccccggcggcggcgccggcggcgacacccacgccggcgctggtgaacaccgccaagatgcccgtcgagaccccgcatgctgccgccaacccgttggccgacctgcagccgctggccggtggcgggctgggcgccctgggggtggcctcggcgggcctgggcaccgcgcggttcgtcggggcgatggcggttccgccgacctggcaggggtcgatgccggcgtacatcgccacccccgcgatgtcgggcgcgcccggcgcggcgccgatgacggcggcgacaacgggttcgaccggttcgagcagcggcgtgccggtgaccgcgatggcggtgggggacaagaagcccgagggcgaggaccgcgcgacccgggcggaggtggtgcggtcccggccgaaggtggtgccccgaaaccggcccggataacgccgcgcggtgccgctgtggcagatgtgcatgaagtgcattgcggcgcgaattcggaattcttcggccggcgcgaaaaccacgtaccggcaaagccgaattcgtccgccgtgtcggtcaaaccggagcccggcgcccgctgcccgcggtgtccctgcctcgccccgcaagatgtcccgcggtcgccggcccgtccggcgctcggggttgccccgaccccgcacgctgttcccgggcagcggaaccccgtgcacggcaagggttttagcgctgccggcgcgtacgagggattagcgcgggcaccggtcggcggcgtgtcgcgctgcgacggtgcaccgcccggggccggacggcggcggccgatgctgttcgacacacgcgtaacgtacggaaaatcagcaattcccgcatattctcttcggtttgtcttacgatgtgaaccggttggtgtaaataggttcgccacagcgtccgaacgcttcgatcggctgtggaagggggcaggggtgctgttgcctcttggttcgccgttgccggatgacacggtgtcggcagtacgcggtgagtcaggcgtgctgggtggcttgtcggtcccactcaaatggggcgtggccgttccacccgacgactacgaccactgggcgccgaagccggaagcgagcgccgaggccgtcgaggagacggccgagatgccccgcccgaccgcggtcgccgacggggtctggagcgggtgggacggcgaagccgtaccgcgcaccgcgggcgtcataccgcattccccggccgccggctgagccccgctagcaccgaaagtccctgcgggggctggtttctggtcgctcagaatcggccgccgccacccaggaaaccgccgccggaggaactcgtgctgccgccgaacgacgcagggccccagccgccgaacccgccgcgcatgcccgagctgagcaggtcgccgatgatgatgccgccgagcatcgcgcccatgtcaccgcccccgccgcgcggataggcgcgtcgcgccgcttgcacgtcgccgttggccagcgactgggcctcggcggccagcgtcgacgccgcgttggcgtgcgcgatcgcatcggccgggtccgtcgcccgcctgtccgccgcggcgtgcaggtgccgttgcgcctcggccagccgggtgcgggcctccggcccgatgctgccccggcgggtgtcgatgtagtcggagaccgcccgcacccgcgattgcgcggtgaacaacgcctgctccagcgaccgggcgagtcgctcggcggcggcccgctcctgagccacggcggccagcaccgcgttgaggcccgcgtcggccttggtcagctcccgaacgcgcccagcggatcgtcgggcgcaccggcgcgtgcgccctcgacggccctggtggccgcgtcgcgcgcggcggccaactcggcggcgtggccggatttggtgtcgcgggtggcggccagtaactccgcggcgcgcttgatgtcgttttcgatatcggccatcgccgaaggcaattggtcgatcgcgtgccggatgtcaccggccgcgtggtccaccgcgtcgagtagtgaccgggcctgcccgagcgccgactcggcggcgcgcaccgcgtccaccaatcggccttgctgtccgctgacggcttggccggcgagctcgcgggcggtgccgatgttgcggtcggcgaacgccagccgctccttggccgctgtgacattgccggacaccgaagtcagtgcggcagcgctgaattcgttgtgcagcgccgccagctgttgctcagccgggccgatgcgggcggtcagttcgacgtactgctgcgtcagcccgtccagccgcgacggggcgttgatcaccagatcgcgcaggctctcgaaggcctcggtctgcgattccagttcgcggtcggcgcgcgccgccgacacgatcacctgggtgagcagctcgcggcgctgcgcgggcgtctccggcataccgtcatccaattgctggcgcaccgtaaacgcttgggagagagcggctttggcgttggtgacggcctgggtgaacggttgggtgcgctggtcaccgaattcggcgacggccaggtccagttcgttggcgctggtgcgcaacgcgttgtcgacgtcgaccaccagcgcgcgggacaggtcgtcgagtgtcggcagcggcagcgcggccagcgcgtcgaggtcggtggggtcgaggcggcgcgccgcggccaatgcggcggctcggcggcgccgcccgcgataacgcatgaccagcaacagagccatcaccgcgacgagaagggccgccagcgtcgccagcaggatcacccggcccgacgagccgggcgcggtgtcgagcccggtggccgcggccaccgccgcgccgctccagtcgccgtcgtgcagggcgggttcgatcttgttgtgccgcaaggcctcgactcgactctggttgacccccctgatggtgggcggcaccaggaaggcgtaggcgcggtcggtggtggcgacggccagcagcgcgtcgtagtcacccaggtcgctggtgcgcagggtgtcttgtgcccaccgggtcgcggtctgcccggagaaggtgtcgacgtagaccacccagagccggatgtggcggtcggtgtagagcttgtcgacggcggtggtgatggctttacggccggaatccgatagcactccggcggtgtcggtgaggtagtcggacaagcgcagtggtggttgcgcgccggccggcggtgccagcagacccgcgctgaggccgaccgtgaggagcgcggcgagcacggcgagcaggcgagctgtgcgcatagggtcaatctagccccgcgacgattcgggccggagggcccgatgaggagtggggcaatcgaacacagccccgcgacgattcgggccggagggcccgagtcgagccggactcgggcgggcattccctggcagactgtgcgtcggtgaccaggaatcagcacgacccctacgacgacttcgaccgtcagcgacgggtggccgaagcgcccaagactgcgggtctgccgggcaccgaaggtcagcaccgcaccgacttcgcccgcgaccgcgcccgcgtgctgcacagcgccgcgctgcgccgcttggccgacaagacccaggtcgtcgggccgcgagagggagacacgccgcgtacccggctgacgcactcgctcgaggtcgcccagatcgggcgggggatggcggtggggctgggctgcgatctcgacctcgtcgagctcgcggggctggcccacgacattggccacccgccctacggccacaacggcgaacgcgcgctcgacgaggtcgccgcggcatacggcgggtttgagggcaacgcccagaacttccggatcctgaccagcctcgagcccaaagttcttgacgcccaaggaaatagcgccgggttgaacctgacgcgcgcgtcactggatgcggtgatcaaatatccgtggcggcgcggcgaaggccccgggacaagcaagttcggtttctacgacgacgaccgggaagcggcggcctgggtgcgcgccggcgccccggccggccggatgtgcctggaagcgcaggtgatggactgggccgacgatgtcgcctattcggtgcacgacgtcgaggacggcgtcgtctcgcaacgcatcgacctgcgggtgctcgccgacgacgacgaggccgcggccctggccaaactgggcgagagcgaattctcccgggtgggcgccgacgacttcatggccgccgcgcgccggctgtcggccctgccggtggtcgccgccgtcggcaagtacgacgccacgctggcctcctcggtggcgctcaaacggttgaccagtgagctggtcggcaggtttgcctcggccgccatcgccaccacccgcgcggccgccggacccgggccgctggtgcgctaccgcgccgagctcgcggtccccgatctggtccgcgccgaggtggccttgctgaaaatcctggcgctgcagttcatcatgtccgatccccgccatcaacagacccaggccgggcagcgggaacggatccaccgggtggcgcactggctgtatgcgggggcgccccgaacgctggatccggtctttgccgccgcgttcaacaccgcggccgatgacggcgcccggtggcgggtgatcgtggatcagatcgcctcctacaccgagggccggctggaacgcatcgacgcccgccaggccggtccgtagcgccgcgccggcgacaagtcgcgcggcccgggaagcggcgcgggcgcggcgagttaggctccccgatatgaagaaaatcagcggctcgccctgcatcgccaccctcttgatggggcttccggttctcgccatgaccgcgtgcagttcaccgcagcacgcgagcacccagccgggcaccaccccgccggtgaaaagcgccgcacccacgtcctccggtgcgacgaccaccccggcgcccggcggcggggcgctgaccgcggaactgaagacgcccgacggccggtcggtggccaccgcgaccttcgacttcaccgggggctacgtcaccgtcaccgtgaagacggtggccaacggcgtcctgacgcccggcctgcacggcctgcacgtgcacgagatcggcaagtgcgagccgaactcggtggcccccaccggcggtgcgcccgggaacttcctgtccgccggcggtcactaccaggcccccggccacaccggcaagccggaaagcggcgatctggccacgctgcaggtgcgccaggacggcgcggcctatctggtcaccactaccgatgcgttcacccgcgacgagctgttggccggtaacaagactgcgttgatgctgcacggcgccgaggacaccgaaaacgcgatggaccgggttgcctgcggtgtcatcggtaccggatagcttttccgtacccggcgcgctgcgcgccttacactgagccgatgtccagcccggcaggttcacgcgcccagggcgatggccgtgcccggggccggggccggattcccgaccgcgacatcgccgccatccgcgaacgggtgcgcatcgatgaagtggtcggcgattacgtccaattgcggcgtgccggtgcggattcgctcaagggcctgtgcccgtttcacgacgagaagtcgccgtcgtttcacgtccgccccaaccacgggcacttccactgcttcggctgcggcgagggcggcgacgtgtacgcgttcctccagaagatcgagcacgtcagcttcgtcgaggccgtcgaactgctcgccgaccggatcggccacacgatcacctactccggcccggccaccagcgtgcagcgcgaccgcggcagccgcagccggctcatcgcggccaacgcggccgcggcggagttctacgcggcggcgctcgagtccgacgaggcggcgccggcccgccagtatctgaccgaacgcaacttcgatgccgaggcggcccgtcgcttcggttgcggatttgcaccgtcgggctgggatacgctgacaaaacacctgcagcgcaagggttttgagttcaaggagctggaggcggccggcctgtcgcggcagggccggcgtggcccgatggaccggttccaccggcggctgctgtggcccatccgcagctcggccggtgaggtgatcgggttcggcgcccgccggctgttcgacgacgatccgatggaagccaagtacatcaacacgcccgagacgctgctgtacaagaagtcgaacgtgatgttcggcatcgatctggccaaacgcgacatcgccaagggccaccaggccgtcgtcgtcgagggctacaccgacgtgatggcgatgcatctggccggggtcaccactgcggtggcctcctgcggcaccgccttcggcgacgagcatctggcgatgctgcgccgactcatgatggacgacagcttctttcgcggtgaactgatctacgtcttcgacggcgacgcggcggggcgggccgcggcgctcaaggcgttcggcggcgagcagaacctggccgggcagtccttcgtcgcggtcgcgccggacggcatggatccctgcgacctgcggctgcgctccggcgacgccgcgctgcgcgacctggtggcccggcgaacaccgttgttcgagttcgcaatccggtcggcgctcgccgagctggacctggacagcgccgagggcagggtggccgcgctgcgccgctgcgtgccgatggtggcccagatcaaggaccccacgctgcgcgacgagtacgcccgccagctcgccggctgggtcggctggagcgacgtcgcgcaggtcatcgaccgggtgcgcagccagtccaagcactccgccggcgcgggccgcggcggctccggcgccagggtctcccgccgcgccgagcagtccgccgccccggccggtcccgccgccagccgtcccgacccccgcgatcccaccctgtggccgcagcgggaggcactcaagtcggcgttgcagtacccggcgctggccgggccggtgttcgactcgctgaccgtcgagagcttcacccatcccgggtacgccgccgtgcgtgccgcgatcgaggcggccggcggcacgtcgagcggtgtcaccggcgggcagtggatcgaggcggtgcgcgaccgggcctcctcgccgctgacggcggggctgatcagcgaactgggtgtcgaggccatccaggtcgacgacgagaagctgccgcgctacatcgccggcgtgctggcccggctgcaggaggtgtggatgggtcggcagatcgccgaggtgaagtcgaagctgcagcgcatgtcgcccatcgagcagggcgacgaataccacgcgctgttcggggacctggtggcgatggaggcctaccggcgcagcctgttggagcaggctagcggggacgattagacggcgccaaggcctcgtcggccggctcggcctcgcgttccatgatggcggtccggtcgtcgatctgcgtcagcgtgacgaacccggcgtcgggcgagatccgattcgcgatcttgcgccggcccccttcgatcaccgacttggccaccgggctgctggtcagcgcgcggtaggtgccgacgatctgctcgtatcggcgccgccccgccttcgagcccagcacataccccagtccaagcaccacgacataccggatcaaagcgttcctcccgactatcgatggctccatcctgcctcaccggatggggtgcaggcgtccgcgatcgccacggtatgccacgggtcacgctagttgggtgcggtcgtgccagtacgctagagtcgtcccgcgatcgggttagtcccctgtagctcaattggcagagcattcggctgttaaccgaagggttcctggttcgagtccaggcgggggagcactttctgcagcgcccggcgtcggtgagcacgaatcacttgggagacccgatggagttcctggttgccgcgacgacccaggttcccgacggcacccccgcggaagcggtcgacgacctgcgggcccgggtatccgcacgctgccgtgagctggctcggcaggggcagttgctgcgcttgtggcgcgcgccgtcgccgcccggccggtggcgcacgctgggcctgttcgccgcggccgacgacaacgcgctggaacagctgctcgcctcgacgccgctgcgggcatggcgcaccgaggaggtgacgccgctgccggtgcacccgaacgacccgaccgcacgcctgatcaccccggagccggtttcgggcgggaccgccgagtttctgcaggccatcaccatccgggttcccgccgacgcgccgcagcgggtggtcgacgacgtgctggcccgtgaggccgagcgcgccggcgagctgggcgcgcagggctgcctgcagcggctgtggtggctgcattccgggccgggcgagccgcgcgtgctggcgctgtggcgcaccgcggacaccgagagcctggcggccgtactgcgctcgctgccgctgcacgcctggctgcaggtggacaccacgacgccgctgcacacccatccggacgacccggtcagcggctcactggcgggccgttagcgaatcatcctgtcgcgcactggctttccaggtcagcgccgggagcgttgcccggagccggcgccaggccgagatgctcgcgcagcgtaatgccgcggtattcggcgcggaagctgccgcgctcttgcagcagcggcaccaccttgtcgacgaactcgtcgagaccgtgcggcgtcaggtgcggcaccaggatgaagccgtcgcaggcatccgactgcacgtagtggtcgatctcggcggccacctgctgcggcgttccgacgaactgctgacggctggtcacctcgatgatcagctcccggatcgacaggttctcggcccgtgcccgggcccgccaggtctcggcgaccgtcttggggtcgccgtgccggacccggccgcgggtgatggtcgggttctcgacgggctcgacgtcgggcagcggcccgtcggggtcgtaggccgacaggtcgacgccccaaacctgctcgaggaatgcgatcgcggtcgggccgctgacctgctgctcgcggatgtggcgggcgttgtcggccgcctcggcgggggtgtcgcccagcgcgaacgtcgcaccgggcagcaccttgagctgctcggggtcgcgcccgtgggcggcggcgcggctcttcacgtcggcgtagtagcgctgccccgcctcgagcgacccgtgcagcgtgaacagggcgtcggcgtgcttggcgccgaagtcccggccgtcgctggagtcgccggcctgcagcagcaccgggtggccctgcggcccggcgggcagcgaggccacaccgcgcacgtcgaattgccggccgtgatgctcgacgacgccgatgcgcgcgggatcggcgtaggttccggcgtcgacgtcggcgatcaccgcgccgggtgaccagctgtcccagaactttcgggccacggtgatgaattcctcggcccggcggtatcggtcggcgtgggcgaggaatccgccgcggcggaagttctccccggtgaacgcgtcggaggaggtgaccatgttccaggccgcgcgcccgtcggagaggtggtccagcgtcgcgaattgccttgccacctcgtagggttggttgaaggtggtgttgatggtgccggccagtccgaggcgttcggtgaccgcggcgagcgcggccagcacggtgaaggtgtcgggcctgccgacgacgtcgaggtcgtggatcttgccgcgatgctcgcgcagccgcagaccctcggccaagaagaagaagtcgaacagtccccgctcggcggtccgggcgagatgcacgaacgattcgaacgcgatctggctgcctgcgctcggatcggaccacaccgtggtgttgttcaccccggggaagtgggcgcccagatgtatctgcttgcggcgacgtgcttttcgcgtggtcatccggtgagcccccagcgtttggcgatcagttcgtgcgagcgcagccggtcggcgtgccgatgcgtcaccgaggtgatcaccagctcgtcggcaccgctgacccggcgcagcacctcgagccggtcggccacctcgtcggggttgccgacgaattgtgttgcggtgcggtcggccaccagcgcccgctgctcctcggtcaatggatcgcacaggtccgggtccgggtaggggatcgcgccctggccgctgcggatggaatacacccagtggccgtagctggacgcgagatggcgcgcggtggcgctgtcctcggcgaccacaacgtcggccgacaccaccacgtagggccgcgccagccgggcggacggccgaaaagcattgcggtaggcctcgattgcgtcgagcgcggtgcccggggtgatgtggtaactcgcgacgaacggaagcccgcgggccccggcgacctcggcgctctggccgcgggtgctgccgaagatccacggcgtcagctcggcgtgctcgcccggcaccacctgcagccgatggccgttgacggcatagctgccgtccagcatcgcctcgatgtcggcgatctgttcgccgaagtccgcgggttgtgcgcacggcggggccaggaccgacgactgcgcccggatccgttcgcttttcatcagcgccgtctggtcgaagggggcggggatgaccagcccgtccgtctgccgccacggccgggcctcgggccgggaggccgcggccgacgacgcggccgcctcggcgcgacgctgcccggatcggcccagccccatgtcgattcggccgggatacagcgcgtcgagaatgccgaagttctccaccacggcgaccgcggtggtgtggccgatctgcaccgcggccgtcccgacccggatgcgcgaggtggccgcggcgacctggccgatcagcgtcaccggtgcggagctggccaccgccacgaaatggtgctcggcgagccagtaccggtgatagccccagcgctcggcgtgccgggccaggtcgatggtgttgcgcagcgcggtcgcggcgtcgcagcccgcgctgatcggcgcgaggtccaggatcgacagcggagtcacggtcatgacgccgccgtcgcgtagcggttcggggcgggcgccaatcccagccgctcgcgcagcgtctcgccgtcgcggtagccggtgcggaaacggccggcccgctgcagccgcggcaccaggtcgtcgacgatcgcgggcaggtccagcgcgttgaccgccggccgcagccgcaccccgtcgacgcccgcgtcctgccaggcgaccacgagttccgccaaatccgttgcgctgcccgcgaatacccgggcgtccgacgcgatggccgccgcgggggccagcggatgcccgaccaacgacaccaccaggtccgcgtacacccggatcgcccggcccgcggcccgtcgcgcccggtcgacctcggccaggatcgcccgcagggagtcgtcgtcgcgaggcgtgacgaagaccagatcggcattggcgacggcgaattcgtacaccgggggcgtgtgcgccagcgccgccaccaccggctggccctgcggtggccgcggggtgatggacgggcccttgaccgagaagtacttgccggcgaagtcgatgtagtgcagcttgtcgcggtcgatatagcgaccggtgacgacatcgcggatgacggcgtcgtcttcccagctgtcccaaagccggcgcgccacctccacggcgtcggacgcctcgtcgaacagctcgtccaccccggggaccgcccgccgcccgaacaacgccgcttcctgctcggtcgcgctcacccgcacctgccaaccggcccggccgtgcgagatatggtcaagcgtggcaatcgctttcgacacgtggaacggctcggtatgggtgaccgtcgccacgggaatcaggccgatgtgttcggtgaccggcgctacccgggccgccaccagggtggcgtcggcgcgtcccaccagtcgccgcggcgagatctcggcccggcggcccggctgcgcgtccaggctgtcgtcgatggtcaggaaatccagcaggccgcgttcggcggtgcgggccagcgccgcccagtatcgaccgctgaattgaccaccgccggtggtgttgtgcgcgaacgcgtatcgccacgcctgggggtgccagccgtacccatccagcgccacggctaggtgtagctcggtcatgaccgaccccggaaacgtgtcaacggctcaccttcgcgttgtgtcgataactcactgtgcaacgctgggcgcggcaatgcattccggcaccgggttaagttcagcctgagtaatacttcgccgagctcagccggggtgaaacgccaccatccgggttaggtgcagcgtgggcgaatcgcgtgcgcatgactcggatgcctcacgggcaaagccgttcggccgaaccacctttggcggctcacactcagatggaaaagtcttcgccgtaccagacgcccgcttcgggcgggcggatgacccgaccggtctgtgatccgtcgaccttcgcctcgagcttggtcacccgggtcagcagcgattgcaggctgaccccgaccagatcgggcatcagcgagtcgtccggaccgccggggccgggatgggtgcgggcgatgacctgcccgggcacgcccaccaccacagcgctggagggcacctccttgaccaccacggcgttggcgccgatgcggctgtcgtcgccgattttgatggcgcccaagacttttgccccggccccgatgatcacccggtcgccgatggtcggatgacgcttgccggtgtcgcggccgctgccgcccagggtgacaccgtggtagatggtcacgtcctcgccgacctcggcggtttccccgatcaccacccccgtcgcgtgatcgatgaacaaccccggccccagcacggcgccggggtggatctcgacgccggtcaggatccgggtgatctcggcggagatccgcgcggccagccgggcgccgcgacgccacagccagtggttgacgcggtgaccccagatggcgtgcacgcccgggtaggcgaagatcacctgcagcgtggtcggagcggccggatcgcgctcccgggccgccctgatgtcacgacggatggctgccagcatgctaatcggccaggtcggcgaacagcggcgtgctcaggtaccgctcaccgaagtcggggagcacgacgaccaccagcttgccggcgttctcgggccggcgggccacctgcagggcggccaccagcgccgcgcccgaggagatgccgaccagcagcccctcctcggcggccagccggcgggccagcgcgatcgactcctcgttgccgacggcgatgacctcgtcgaccagatccatggcaagcaccggcggcacgaacccggcgccgagaccctggatcggatgcggccccttctggccgccggacaataccggcgacgcggccggctccacggcgatgaactgcgccgacggcttgcgttccttgatgacttgggcgacaccggtgatggtgccgccggtgccgacgccagcgacgaagatgtcgaccttgccgtcggtgtcgcgccacacttcctccgcggtggtgctgcggtgaatagccgggttggccgggttctcgaactgctgcggcacgaaataccggtcgtcgctcttggccaattcctcggccttggcgatcgcgcccggcatgccgtcggcgcccggcgtcagcacgatctcggcgcccaaggcgcgcaacaacattcgccgctccacgctcatcgtctccggcatggtgagcacgcagcggtagccgcgcgccgcggccaccagtgcgagcgcgataccggtgttgccgctcgtcggctcgagaatgatggtgtccggtttgatcaggcccgcctgctcggccgcatcgatcatggccaccccgatacggtccttcacgctgttgcccgggttgaagaattccaacttggcgacgacgtcggcaaccgcaccttcggtgacccggttcaaccggaccagcggggtgtttccgatcagctgcgtgacgttctcggcgatgctcatctaccttttgtctcccacgatgtaggaccaggcctcgtcggcctgccagctaatatcgaactctatggccatttcggtggggatggctagcgcaacgggggtaaaccgttgcgacgcttcgtccagcgccaccccggtgagcacgcgtccatgcagatcgccaacggttttcgcggtcagcgttattcccgagccgcccggcgcctcacgtatgtagaagtccgtgcccggttcgacgacctgcccgacggcgaaaccgtcggcgtccaccagttggtggccgtcgtcggcgctgagcagcagcgggattcgcacccggaagggtccgatcagcccggcatccgcggtggcgtgccggtcgtcgagcagcagggcgtcgtcggcgtggtggacggcgcgtcccgcctgcgcgagcaggtagttgtacagatgcacgaccttgtcggcgttgcggtagtggcgggcgccggtgagccggaagttgacgtgctcgatggtgggcgtggccgtctccgacgttgccaccagccggtagtagcggtagccgcgcccgccgcggccgtgactgctcgacgacagcgtgctgccctcgcccagcgtgcgctggtagcgccgctgtccgggctccaacctcaggtgcgaacccgaaacatcctgccacacaacaccattggtggatttctgcagtttcaatgtggcgtcgcccgccgacgagctccacaccgagtagccgccgagctgaggttggccgtcgaattcgaaggtgagcaccggtccgggcgcccggtgcaccgcgatggggacgttgagcggtcgggtgtccagggccaggccgttggtgaagaaccagatcgccgcctgcgtcgcggcgatcgcctcgtgttcggtgatgttggccggcccgagcggatagccggcgtcgcgcacctgccggctcagctcggcagtggagcgcagcggaagcgagttgcgcaggatccagtcgaccttggcctcgtgccccgacgtgcgcagatgcggcagcgcggaccaggagtcgacccggtagcgggacggatgcgccggggcgatgccggcgaaatccagcgaataggcgtgcacgttcgggttgagccggatcagatcggtgcgggcccagctgccgtcggcgaacaccacccggtcgacggtgtgcgaatacgtgccgccgcggtagcgggtcatccggttgagcgcggtggccggtcgcaccacgcagcgccggcgggtggccaccggcgccagggcgcggtcgggctcggacaatatggtcatgagtcgttgatcttcctgaaaaaggctttccatcggcccgcgtcgtcgcagcgccggacagcgccggcgacaccgcccgggcaggggcgagcgcggggatttctacagcgtcagagggcttgcggaaatcaacgacaacaacagcaacaacaggccacgacaaggcagcgcgacggggcaaagcgcggctgtaggcggtgttgcatgtcaccactataggtcatcgcacttggccgtttgttcggctcagcccggctgtaagtcttgggcggcggtgaccggctggcctaatgtcgggactcgttgagtcaccgaccaccgcgggccggcggactcggcgcggcggagggatgtacggcacgccgagcgacgacgcacaacaccggctcggcgcgcggcccgggccccgatggggcacgatgaatccaccgatccgggccgcatttttcgaccacgcacgaaaggatcacgatgacgtcggctcaaaatgagtctcaagcacttggtgatctggctgccaggcaactcgccaacgcaaccaagaccgtcccccagctctcgacgatcacgccgcgctggctgctgcacctgctgaactgggttccggtggaggcgggcatctaccgggtgaaccgggtggtcaatcccgagcaggtcgccatcaaggccgaggccggcgccggcagtgaagagccgctaccgcagacctatgtggactacgagaccagcccgcgcgagtacacgctgcgcagcatttccacgctggtcgacatccacacccgggtctccgacctgtactcgagcccgcacgatcagatcgcccagcagctgcggctgaccatcgagaccatcaaggagcgccaggagctggagctgatcaacagccccgagtatgggctgctggcccaggcgacgccggagcagacgatccagacgctggccggggctcccacgcccgacgacctcgacgcgctgatcaccaaggtgtggaagacgcccagtttcttcctgacccacccgctgggcatcgcggcgttcgggcgcgaggccacctaccggggggtgccgccgccggtggtgagcctgttcggcgcccagttcatcacctggcgcggtattccgctgatcccgtcggacaaggtgccggtggaggacggcaagacgaagttcatcctggtccgcaccggcgaggaacgtcagggcgtcgtcgggctgttccagcccggcctggtcggggagcaggcgccggggctgtcggtgcggttcaccggcatcaaccagtcggcgatcgcgacctacctggtcacgctgtacacctccctggccgtcctgaccgatgacgcgctcgccgtgctcgacgacgtcgcggtggatcagttccatgagtacaagtgagtaccgagcggtagacgccgaaagcgacctgcccatcagcgccgcggaactcgccgcgctggccagccagctgtatgcggccagcatccgcccgggccccgacagcccgccgcagcaggcgccggtggcacctcgcggcagcgtgccggacgccacggcggcaacctcggccgggcggaccgccgccggcacggccgacgtgtacccgggaccggttccgcaggtcggtgggcgcgacgtctacctgccgcccccggcgtctcccgcccccgaagcacccccgcaggcggcgccgcccgccccgcgcggcagcgcgccggacgccacggcggccacgtcggccgggcgggcggccgccggcaccagcgacgtgtattcgtcatgggtgccgcagctgggagtcgccgacatctatctcggggctccgacgcccgccgggccggaggcgccgccgcagagcgcgccgcccgccccccgcggccaggtgcccgacacgaccgccgcggccaccgcctacggcgccgacctgagcgcgttcgcggtgcccaccggcatcgtgtccaccgcgcccggtgtgcaggccgggacggcgccgcccgtccctgtcgttccgcgggccgcgacggcgccgtcgtggctgcccgaggcgccctcggtcgccgacctgggctggtccgacgcacccgcacccgatgcgccggccggcgacgagcatgactaccacttcctgaccaaaaccgatccggtgccgcagtttcgcgacgagcacgaggttttcgacgtcgccgcgattcgctcggacttcccgatcctgaaggagacggtcaacggaaaaccgttgatctggttcgacaatgcggcgacgacgcagaagccgcaggtggtcatcgaccggctgtcgcacttctacgcccacgagaactcgaacattcaccgcgccgcacacgaattggcggcccgcgccaccgacgcctacgaggaggcccgcgacaccgtcgccgagttcatcggcgcgcccagctcggacaacatcgtgttcgtgcggggcaccaccgaggcgatcaacctggtggcccacgcgtggggcgccaagcatctgcagcccggcgacgagatcgtcatcacccacctggagcaccacgcgaacatcgttccctggcagctgatttcgcaaaagaccggtgccatcctcaaggtggcgccgatcgacgacgcgggcaacctgctgctgagcgaattcgaggggctgctgggcccgcggaccaagctggtcgcggccagccacgtgtcgaacgccctgggcaccgtgatgccggtggacaagatcgtcgagttgggtcaccgctacggcgcccgggtgctgatcgacggcgcccagtccatccagcacatcccgatcgacgtcgccgaactcggcgccgacttcttcgtcttctccggccataagatctacggccccaccgggattggtgcgctctacggcaccgaggaagcgctcaccgagaccccgccgtggcagggcggcggccacatgatcgccgacgtcaccctggaacgctcgctgtaccaggggccgccgacgaagttcgaggccggcaccggcaacatcgccgacgccgtcgggctgaccgaggcgctgcgctacgtgcaacggttgggcgtcgagcggatcgccgcctacgagcacgccctgctggagtacgcgacaccgcggttggccgacatccccggggtccgcctgatcgggaccgcgcaggagaaggccagcgtgttgtccttcgtgctggcgggccacgaaccgctcgaggtgggcaaggcgctcaacgccgagggcatcgcggtgcgggcgggccaccactgcgcccagccggccctgcgccgactgggactcgaggccaccgtgcgcccgtcgttcgccttctacaacacgttcgaggagatcgacgtgttcctgcgcgcggtgcgccggatagccgagggcggcgccaacgtcggctgaaccgccggccgggcggttaaatcctaagtggttacgccccaaccgaatacgcgcgaggtcagcagcacgatgcccagcgagacggtggcgaccacggtcaacccgatgaccgcgaccaccagcgggcgccacccggtgcgggcgatctggcggatgtcggtgttgagccccaccccggcaaaggtcagcaggaacgcccatttcgacacgttggcgaggttggccgtctggcccttggtcagccagcccgcggtggcgatcgccgagaccaccaggaagcccagcacgaacttcgggaatttggcccagatgaaggcggccttggcccgaacccccggggcgatctcgtcggcctgcccgcggcccgcccagaacagcgcgaaacccagcaccacgaaaccgatcagcgcgttgcgggtcgacttgaccagcaccgcgatcttgccggcgtgctcggagtacaggtatccggtggcggtggtctcggcggtgttgtccaccgaaagccctgcccacaaaccgaattcgtgatcggtcagcccgatcgcatgccctagcggcggcaacacgaacagcgacaccgcgcccaacgccagaatcgcggcgatcgcgtagctgacgtcggagttacgcgcgcggatcgcgcccttggccgccacgatggccgacaccccgcagatggacgtgccgatcgccaacagcgaaccgagcttgcccgacaacccgaaccagcgggccacggcgatgatgatcgtcccggcgatggtcatgtccaccaggatctgcaccaggctgatcccgcccagcttggcgatgtcgcccaacacgaatcgcgaaccgagcgccacgatcccggccttcagccagaattcgtaggtcagcacgccgggccgaaagatcgggtgcagcccgacggtgttggtgatcaccagcccgatcacgatggcccacaacacatattcgatgtcgggcaccgtccagtgctcgtgtttggccagcgcgttccaccagatctgggcgtacttgcccaacacccccacgccgatcagcagcaggatgcccggcaggtagtcgagcgggcgggtgctggtgaaggtggcgtccgctgtttcgtctgtttcgtcgggtgcgacgcgaacggtgctcacgccggtcaccacggaaccttcgggagcacgtcggccaccgccagcgcgacgatcacgcccgccaccgcggtggcccaccaatccaccgaaaccgacgccagccgcgccgcccagtcctgcccacgatcgggcgcctcgtgatcgccgcgattgtcactcaccatgtccgctcctcgagcaaccggtggcggcccacgcgggacgcctgctgacggaatcgtggcggtcgctcccgccgcatccaagcgattggctcggcctgaatttagctccgccgtatttcaggtcggcagaccgtatttctccgcgtcggcgcggtagcggtccacccactcgtcggagcggtggtccgcctggcgctccagcaccggttcgggcgccagttgcgggtcgagccccaactgctcgaggatggcggcgaccacctgagtcaggttgcgccacaacaccggatacgggatctccatgggtttgaggtcctcttcggcgaaccaattgcgccagccctcttcctgggcgcgcagcatcgtcacgacgtgggcgatcgccccggcgtgataggtggcgcgcgcgtcgcgcgccgggtcgggccggccgcgccagacccgcgtctgcaccgcccgccagaacgacaccgcctgcgagaccacatccggccggtagacgtgaatcagcagcggctcctcgccgatcacatcgcggatggccgcccgcagcccgtcgccgctgcgatccggcaggttcttcgcacggtccaacagcagcggggtctggttccacatcagcttgccgccccacaccccgttgggggtccggccgaccgtgcggatgtagctgcgccagatctcgggcggagccaggtccggcgtgcccgcgtccaggggatcgagcaggctcaggatcgactcgtcgtcgaccccggcgaaccattcccgcggctgcggcgcctggctggtggacggcaggtactggaagaactcctgaggctcgccggccacgccggtggcccgcagcgattcgaccagcagcgtgctgccgctgcgctgcgacgccaacaccaggtatgacgacgggctgtttgtcaccggcgaagtgtatccacaaccggcacttcttattcctcgacttgatgcccacctgttcctggacagccgaagttgtggtcacgccgacgcaaaaccttgcccacgacagcggtgcggcgaatcctgacgctcgtcgtagaagcgttgcgtgcagcactattccggacggcgggtgaagccatccgtccggttcccgtccacatttcttctggttgattgcaaccctgacggcggacgaggtcgtggccgtagattcgctgaactatgcgcgaagcacacgtgagtgccgcatgtaaacagcgctgtttgcttgggagccaggtgattacgaacggataaaccgtgttacgaaatatgggggtcgggttgagtcagcgaatgagcgggcgagcaccgtgaacgcgaccgccatcgccaagcccatgacggcgctcggccaattcttcttgctcagcgccgaggcgctggccgccgcggttcgcgggccgtgggcgtggcgggaaattctcgaacagatctggttcgtggcacgggtttccatttttccgaccatcatgttgtcgattccgtacaccgtgctgattgttttcgtgctcaacattctgctggtggagatcggcgccggcgacctgtccggcgcgggggccgggctggcgtcggtcacccaagtggggccggtcgtcacggcgatggtcgtttcgggcgccggatcgaccgccatgtgcgccgacctgggcgcgcgcaccatccgcgaggaaatcgacgcgatgaaggtgatcggcgtcaatcccgttcaggcacttgtggttccgcgcatcatcgcggccaccttcgtggcggtcatgctctacgcggtggtcgccgtcatcggattgacgggcagctacatcttcgtggtcttcgtccagcacgtcacgccgggcgcctttgtcgcgggaatgacgttggtcaccgggctgccgcaggtggtgatctcgctgatcaaggcgaccctgttcggtctgtccgcgggactgatcgcctgctacaagggtctctcggtgggcggcggccccaccggcgtcggcaacgcggtgaacgagacggtggtgttctccttcatggcgctgttcttcatcaatattttgaccaccgcgctcggggtgaaggtgacggccaaatgaccgagatcgcccgcgagccgtcgcggttcgctgcgctggggcccaggctcgtcgagtcgacccgcaagctgggggagcagaccgtgttctacggccaatccctgacggccattgccgacgcgatacggcgctatcccggcgagctgttgcggctgatcgccgagatgggcatgggcacaggcgcgttggcggtgatcggcggcaccgtcggcatcatcggcttcctcaccctcaccaccggagccttggtcgcggtccagggctacgacacgctgtccaacatcggcgtggaggcgttgaccggattcctctcggcgtttttgaacgtgcggatgatcgcgccctgcacggcgggcctggcgctggcggccacgatcggtgccggcgcgacagcgcaattgggggcgatgcgcatcaacgaggagatcgatgcgctggaagtcatgggcatccgcgccgtcacctacctggcgtcgacccgcatcatcgccggcatcctggtggtcatcccgctctacgccgtcgccgtcctgatgtcgttcatcgcggcgaagctgctcaccatctacgtctacggccaatccaaaggcgtctacgaacactacttctccaccttcctgcgcccgaacgacctgttgtggtcgttcttctcggcgctggcgatggccacgggtgtgatggtggtgcacacctattacgggttcaccgcgaccggcggccccggcgggcgtgggggaggcggtcggccggtcggtgcggtcgtcgatgatcgtcaccgcctttgtgtgcctgatgatttcgctgtccgtgtacgggcagtccggcaacttcaacctgtcgggatagccgatgagcaaacacagcagcagcggcctcatccggcgcggcggaaaccagcgcaacgggatcgaccccatctggtgggcgcccaccctgttcatcgtcatcggcggactggtcgcgttgaccgcggcctccttctccgggaagttccagaccttcgtcccgctcacgctggtgtccgaccgggcgggactggtgatggaggacggcgccaaggtcaagttgcgcggtgtgcagatcgggcaggtcgcctccatcggcaccgacgtgaagaccgcccggctgcagctgaagatccagccgggcccgttccgatatctgccgagcaacctggaagccgagatcaaatcgaccaccgccttcggctccaaattcgtcgacctgatcgttcccgagcggcccagcgccagcccgctcaagccgggcgcggtgctgcgttcacgtaacgtcaccgtcgaggtgaacaccgtcttcgagaacctgcaggcggtcgtccaggcgctcgacccggccaagctcaacgccatcctgtccgcgttcgcccagtcggtgcgcggcaagggcgagcggatcggcgaagccatcaccgacgccaatagccttctgcgcaccgtcaattcacgcatggacaccatcggtgaggactggcggctgttcggggcgaccaccggcgtctactccgacgcggcgcaacacatcctgtcgattctcgactcggcgagcaccaccagcaacaccatcaccgacaaccagcgctcgctcgactcgctgctgctgtcggccgtcggcttcagccagaccggcatcaacgtcatcggagccaacgaatccaacatcgtgcgagcgatgaacctgctcgatcccaccatcgcgctgatgcagaaatactccccgacctacacctgcctgttccagggcgcccagtggtacgtcgaccacggcggacgagatgccttgggcggcaacggatattcggtgatcctggacgcggctctgctgttcggcgatgacccgtaccgctatcccaaacacctgcccaaggtcaacgcgaccggcggccccggcggcaggcccagctgtggttcgctgcccgaccccagcgccaacttcccggtgcgggccctggtcaccgacaccggttggggagccgcgccgaacgagatccgcaccaacgtggccgcgggtaacccgtggtgggccaactggttcccgaccaccaagaacccgcccgaagcgccgcgctacttctggcggggagggcagccaccgccatgagaaggaaattgtcgagcatcgcctggcgggtggcgatcttcaccgcggtctgcctgctgttcaccttcacgctcatcgcggtgttcggtcagctgcgcttcgaggaccgcaccggctaccaagcggtgttcaccaacatctccggcctgaagtctggcaacttcgtgcgcatcgccggggtggaggtcggcaaggtcggcgatctcaccctgcaccgggacggcaccgtcaccgtcggcttcgcggtcgacaagggcgtgcggctcagcgagggcaccaaggcggtggtgcgttacgaaaacctgatcggcgaccgctatctggcgctggaggaaggcccgggctcgccgcgccggctgccgccgggcgcgacgattccgctggcgcgcacctcgccggcgctcgacctggacgcgctgatcggcgggttccgtccgctgttccgggcgctggaccccgatcaggtcaacgccctgtccggccaattgctgcgcatcttccaggggcagggcggcaccctggcctcggtgctgtcgcagacctcgatgctgacctcgaccctggccgggcgcagccagctcatcggcgagctcatcaccaacctgaacaccgtgttgcgcaccttcgccacccgcgaccacgaattctccgacggcctggacaaactggcgcagttggtcgatgggctggcccagcgccgcgacgacatctccaccgggctcgcctacatcaacgcggccgccggctccatcaccgacctgctctcccagtcccgccagcccctcaaagacgttgtgcagcaaacggatcggatgtccgggcaggtgctctccgaccgcgactacgtcgacaacctgctcaaggagctgcccgacatctaccaggtgctggcccgccagggcctcaacggcgactacttcggcttctacttctgcgaagtgctgctgaagctcaacggcaaaggcggcaacccgatcttcgtcaaattgctgggtcagcccagcgggcggtgcacaccgaaatgacgtggaagctacccaaatcacccgccccgcaacggcccttgatgctgggcgtgctgggaaccgtcatcctggcctgcgtcaccgtcgtcgccttccagtacaacaagctgccgttcatcaagaacaccgacgactacgcggcctacttctccgaggccggcggcatcaaacccggcaacgcggtgcgggtttccggcatgggcgtgggccgggtctcggatctgcgcctggagggcaccaaggtgcggatcggattcaccgtccgcaagggcgtcgtcctgggcgatcgcaccgaggcggcgatcaaaaccgaaacgatcctgggcgccaagatgttggagctgaccccgcgcggggacgggcggctctcgggcgtcattccgctggaacgcaccacctcgccctacgatctgcccgacgccctgggcgatctgaccaccaccatcagcggcctggacaccacccaactctccgcggccctgaccacgctggccgacaccctcaaagccacaccggagaacctcaagcccgcgctgcagggcgtcgcccggttctccgacaccctcaacagccgcgacgcgcagctgcgtagcctgctgggcaacgccaatcacgtctcggcggtgctgggccggcgcagccagcagatcgccgggctggtggccaactcccacgcgctgctggccgcgctgctggacgaacgggattcgctggacgcgttgatgaatcacctcaccgcggtgtcgcatcagatcagcgggctggtcaacgacaaccgaacccagctcaaacccgcgctggacaagctcaacggtgtgctcgagatcctggacaaccgcaaggaggagctgcagaaaacgctgcccaagttcaaacggtatgcgatgtcgttcggcgaatgcctgggctcggggccgtttttcaaggcctacgtggccaacctggtgcccggccagttcggtggaccggtgttggacgcggacatgtacgaccgtttcctggaccccgatcagaagctgccctcggaggtggtggatccgccgacggggactccgccggtgccgccggagaacgcgccggtgccgctgtggtcgcagccgccgtcgccgccgccgtccacgccaccggtgcggaccatcccgccgccctcgccccacgaattcgatcagccatgaccatcactcgagacgccctgcgcaaggcgaccgcgctgagcctggtcctgacgctggccgtggcgagcgtgctggtcggcggcaagctgtggcgggccgtcgaaaagaacagctacgcggcgtatttcgcggagaccaacggcttgttcgtcggcgacgaggtccgcatcctcggcgtcgccgtcggcgcgatcgacaagatcgaaccccaatccgccggctcgaaagtgacgttctccgtcgacaagaagtacgcgatcccggccgctgcccgcgccgccgtgctgtcgccatcgctggtgaccgcccgggcgatccagctggtgccggcatactccggtgggcccacattgagccccggcgcggcgatcccgctgagccgcaccgcggttccggtggagtgggacgatttccgcaagcagctggagaaactgaccgacgcgctgcagcccaccaccgcgggcggggtgaactcggtcggcgaattcgtcaactcggccgccgacaatctccgcggccagggggacaccgcccgcgacacggtactcaagctctccgaagcgatttcggcgctcggtgaccacgccgatgacatcttcagcacggtgcgcaacctgcaactgctggtgtccgcgctgtactccagcagcgacctgctggcctcgttcaacaccaacctggccgccgtgacgaccctgctgaccaacacgcccaacgaggtgggcagtgcgctgaagtcgctggacggggcgctgagcgatgtgcgcgatttcctggcggagaaccgcgaggcgatgggtgtcacggtcgaccgcctgggctccatcaccaccgcgctcaacgacagtcgcggtgacgtcaagcagatcctgcacatcgcccccacggtgttccagaacttcttgaacatctaccagccggcccagagcgcgatgacgggcatcctggcgctgaacaacttcgccgatattccccaattcatctgcagctcaatcgaagcggcgtcgcgggcccggctggcgcgggtatccaaactgtgcctgcaatacctcaacccgatcatcaagaaccgcatctacaactacatcccggcggggatcaacccgttcgtcggtacccaggcccgccccagcgagatcacctacagcgaggactggctgcggcccgggtacacgcccccggacggcggcccgccccccgaggcgccggcgcctcccggccagcccgcgcccgccgatcagccgcccgccgaacccggcccgccaccgaacccgacgagcaactcgctgcaggtgctgcgggacctgatgctgccgacggggccgtcatgagacgcgcggtcgtcgcagcactcgtggtagcttgcgcggcagcgctttccgggtgcggctggcgtggcttgaattcgctgcggctgcccggcaccgcgggcgggggaccgggctcctataccatccaggcgcagatgcccgatgtggtgaccatccaggaaaacacccgcgtccgggtggacgacgtcaacgtcggcaacgtcaccaagatcgaactgcaggactggcacgccctggtcaccatgcgcatcgacggtgacgtgcacctgccggccaactcgaccgccaagctcggccagaccagcctgctcgggtcgatgcacatcgaactcgcaccacccaaaggcgagccgcccgtcggccggctcacggccggctcggtcatcccgttgtcgcgggcgagcctgtatcccaccaccgagcagacgctggcctcggtgtcgattctgctcaacggtggcggaatcgggcagctgcaggagatcacccaggcggtggcgaaggccttcgccggccgggaagccgacatgcgcagcctgctgagccagatcgacgagttcatcgcgcacaccaacgagcagaccgacgacatcatcgccgccgccgagaatctcaatgccctggccggtcaggtcgccgccgccgacccggtggtggacaaggcgttgacgtcggtgcccaaagcgcttgccgtgctggcgcaagagcgcaccaagatcgccgacaccatcgaccgggtcggcaagttcagcgcgatcgcggccgacaccatccaccagagcaagcaatccctggtggacaacctgcgcaacatcgcgccggcgctgcggtcgctggccgacgccggaccctcgctgacccgcggcctggacggcctggcgacttacccctggccggcgtcgacggtgcggaactggttccgcggcgactacgccaacctcaccttgatcgtcgacttgacgctgagtcgcatcgaccaagggcttttcaccggctcgcgctgggaaggcaacctcacccagctcgaactgcagtggggtcggaccatcggcatgcagcccagtcccgtcaccggcggcaacccgctgacctatccgtaccatttcgggggatactgatgcttcggttgaaccgccggacctggatccagttgtcgattctggcgctggtgaccgttgtttcctgcggcgcaatggcattcaacttcatgaagctgcccgcgaccctgttcgggatcggcgagtaccgggtcacggtcgacctgccgcaatcgggtgggctctaccagacctcggtggtcacctaccgcggcaccgacgtcggccaggtcaaatcggtcgacgtcaccgcgaccggagtgcgcgcggtgctggctatgcggtcggggatcgaggtgccattcgacgtccaggcgtcggtgcacagccgctcggcgatcggtgagcagtacatcgagctgaccccgcggcccggcaccggcgaccaccagtcccggacgctgcgcgacggcgacgtcatcaccgccggccgcgtcgacgtacccgtcgacatcgggcggctgctcgacatgaccaaccgtgcgctgcaagcgattccccgcgacaacctgcgcacggtgatcgacgagaccaaccgggcggtcggcggactgggccccgagttgtcccgcatcgtcgacgggtccaccgcgctggccgtcgccggcggccacaccgtcgacccgctcgccacgctgatcgatcaatctccggcggtgctcaactcacaggtccagacctccggggcgatcgccacctgggccgagcgcaccgcggccctcatggcgcagttcaaggcgcaggatgccgcggtgcgagacctgttgacgcgcggcacttccggagtggaggaggggcgcgccctgctggaccgggtgacgcccgccctgccggtgctgttcgccaacctggtgagcctgggcgacatcgccgtcgtctaccgccacgacatcgaacaactgctggtgttgctgccacagggcatcgcggccatggcggcgatcatcgtgcccagctccaacaccaagcaggagtaccggggcgcccagttggacttcaacctcaacctcaacctgccgccgccgtgcacgacgggttatctgcctccggcgcaacgccgttcgcccgccagcgtcgacgcgccggaccgacccgccgccgacttgtattgccgggtgccgcaggactcggaattcaacgtccgcggcgtgcgcaacatcccctgtgagagcaagccgtggaaacgcgcaccgaccgtcgaactgtgcgaaagcgacgaagaatacgtgccgctcaacgacggctacaactggaagggcgaccccaatgccaccaccagtggtcaaggcgtgccgcagtatccgccgggacaggatccgcggctgccgccaccgcgcggcaccgccccggcacccccgcccgtcgcggtggcgccctacgacccggccaccggggattacatcgggccggacggccgccgctacaccgagtccgatttggcgcacccacgcgccaaaagctggcaatcacttctggttccgcaaccctgaggagtgcgagcatcatggccgacgaatctgatacccccgccgccgaggaaaagtccgacgcagcaacacaactcgacaccgacgagggagacgatcaagaccagggccgggtcgcgcgctggcgcgaactcgcccggcggcgacggctgtcgcgggcggcgacggtgttggcggtcggcgcggtcatggtggcggcgttggccgggttgagcggctggctgggctaccgcgcctaccagcagcacgacgcccaggcgcggcgcaacctgttcgtcgcgaccgccagtcagggcgcggtcaacctcaccaccatcaactacacccaggtcgaccgcgacgtgcagcggatcctcgattcggccaccggcgcgttccgcgacgagttcgagcagcggtccaaaccgttcgcggaggtggtcaaggcggcccaatcgaaatccgaaggcaccgtgaccgatgcgggactggagtcgcagcgcggcgactccgcccaggtgctggtggcggtcgcggtgaagtcgcacaccgcgggcggcgacgagccgccgcgggaatggcggatgcgcatcgaggtccgatccgtcggcgatgacgccaaggtctccaacgtggtgttcgtgccgtgaccgcgccgagcgagacggcccggaccgccgccgatatccgggcgtcggacaccgacccgcaaccaacgtcgtcgcggggcgaaccatcgatcgcctggccgcgggtgttcggctacggcatactgcccgggctcgctctggtcttggcgttgggcgccggctacctgaggtggtcggccggatccgccgacgacctcgcccaggctcgcgcccagtcggtgcaggccgcccgtgaggacgcggtggcgttgctgtcctaccgggcggattcggtggacaaggacctcgccgcggcgcgtgaccggctgaccggtgagttcaaggatgcctacgccgagctgacccgccaggtcgtcattcccggcgccaaggagattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccggaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaagcctaaggccgacggccccgaacacccttcaagaaaggtaaggaaacacatgtcgtccgcggcaagggtcaacgcggcggcatcggtctcggtcgccgaaaaccacgcggtggctttggttttcgtcgaccaaaccgtcaccatcggcgacggcgcccccaccgacacccagcccgtcgtccggatgaccttggacaaggtcaacggccgctggttggtgtcccgcttcgaaccggtgtgaggcgtgtcggtatcggtgagccgcgccgcccgcctgatggcgggcgcggtcgtcgtgtcggcggcgctgccggtgcccgccgcgcacgccgacaacaagcggctcaacagcgccgtcgtctccgccgtctacaccctgcagcaccaggcgggctgcaccaacgacgtggtcaggaacaacgcactcaccctggccgccgaatggcacgccgaagacatgatcaacaaccgaaacatcaacgacgacatcggttccgacggatcgacgccgcaggaccgggccaatgccgccggctttcgcggcagggccgccgagacggtggccatcaacccggcgatggcgatcagcagcctcgagctggtcaaccagtggtatgccaacccggacgacatggcgatcatccgggactgcgccaacacctccatcggggtgtggtcggacaacagcctggaccgcaccgtcgtggtcgccgtctacggccagcccgatccggcccggcggtagcggcgcgatcggtggcggctacccgctggaaatggactcgctcgccagctcgcacacgcacacctggccgccgcgccgccaggtgccgaactgtgttccgtgcctgcgcttgaggtgctgggcgtagaccttgtcgcgttgatcccgcgagaacgcgaagtccagattgaccggcaagcccgcccagtccacctggtcaccggccgcattctcggccaccccgccgtatcgccgggggcactgcagcggacagttcttcttcatgacccgatcgggtccatcacactcccgagccacgactacgtcactccttcaggtgcgcgaccttttgagtgcagggtgcgacgcgcatgtttcagcggtgggtgtgcgatgtttccgccgtattacgagttcgacgtcgtcgcggctagtgcgggctagtgcgggctagtagacgtcgcggtggtagcgcttgtccgcgctgagcgactgaacgtaggccttggccgcgtcggggtcgagattgccgaattcggcggcgatgtcgcacagcgcccggtcgacgtccttggccatcgggtcggcggtgccgcacacgtacagctgggcgccgtcctgcagccagctccatagctgcttgccgcggttgcgcatcaggtgctgcacgtagaccttgtgttgctggtcccgggagaaggcgaggtccagctcggtgaggaagccgtcctcgcgcatctgctccagctcgtcgcggtagtagaagtcggtggcggcgtgctgctcgccgaagaacagccagttggggccgcggtggccgagcgcgcgccgctcctgcaggaagccgcggaagggtgcgatcccggtgcccggcccgatcatgatcatcggggtgtccgggtcgctgggcgggcggaagttgctcgacggctgcaggtagacggccacccgatcgccgggggagcgggcggcgaggtaagtcgaacacaccccgcggcgcggcacgccctggaagttgtagcgcaccggcgacaccgtcaggtgcacttcgcccgggcaggccttggggctcgacgagatcgaatacagccgcggctgaaggcgtttgagcaccctgagccattcgtgggccgaggcggacaccggcagctgcgccagcaggtcgatggactgccgcccccacgtccaatcggccagtgcgcgtttgttttccggcttcaacagctcggcgagtttggcgtcgccggtacgctcctgcacgaaacgcaccaaatcccggctgatgtgggcgatctcgatgcgctcggtgagcgccgaacgcagtgacatcagcccgtgctcgccgacctcgaccggggtctgcccgtccaggccggtgaccgccagccactcgtcgaccagctcatcgctgttgcgcggccacaccccgagcgcgtcaccggcctcgtagctgacggcgtcttccggcaggttgaacaccagatgccgcacgtccttggtggatttcggcccgttcaacgtggtgttgcgcaccatgtcggtgatgagcgggtgctttttgctgtaggtgtgcggcgcgggcgtgttcgggcgggacggtgccgccaccggggaggtgcgggccgagacggtcgcgccgccgtcgccgcccaccgcggtgggggtgcgggtcagggcatcgatgacgtcagcgacccacttggccgcggcctgttcgtagtcgggttcgcagtcgacgcgttcggcgattcgggtcgcgcccagctcggccagccgcgcgtcgagtttgcgtccgtgaccgcagaagtcgtcgtagttggagtcgcccagcgcgagcaccgcgtagcgggtgttgcccaatcgcggtgcagcgtcgccggtcagcgcgcgccacaggccggagccgttgtcgggtgcgtcgccgtcaccggtggtgctggtgatcagcagcagctcccgcgtcgccgccagctcggccgccgggaagtcgtccatgctgtgcagggcgaccggcagctcggccgccgcgagttgcgcggcgacgtccgcggcgagctcctcggcgttgccggtctgcgacgcccacaacaccacgaccggggcccgctcgggcgcgggtgtggcaccggccggcgcggccggtggctgctgggcggccggctggggcggctcgggcagcgccgcctgctgggatgcgtcggcgcgggagaacaacccggccagcaggccgtccacccacagtcgggtgcgggaatcgaagggcgcgctcggcggcagcgtgggcacgccaccggcgcggcggccgacgtccgagcgcagtccggtcagcatcccggccaggtacgagcggccgagctcgttgaattccggcttgaatgacgttgccacgcccagcaattcgccgagggcatcgacttgtgacacgctgatttctcgtacctccgtgggcgaggattccggtgtgtcgtggcccgccgaagggccggttccgatggccgaatcggggtgggagacggcgactttcgtcagggtgacggcgcacgccttgaattcgggctggttcgagatcgggtcgaccgcgtcgttggtgaccgcgttgatcgacagatactcgccgaaggcgtcgttccagtggaacggggcgaagcagttgccgggccgcacccggtcgctgacgacggcgggcagcacggcccggccgcggcgggaagcgatttcgacgcggtcgtgttcgccgatgcccagccgggcggcgtcgtcgggatggatctcgacgaacgggccggggttgagcttgttgagtttggcgaccttgccggtcttggtcatggtgtgccactggtgcggcagccgcccggtgttcaacaggaacgggtagtcgtcgtcgggcatttcctcgggctgcaggtgcggacgggcgaagaacaccgcgcggccgctcggcgtcgggaaggccagccgcggcacggtgccgtcctcgcggaccagttgtgtctggctgacgccgtcattgaggtagcggatcgggttgcggtcggccgtgctctgcggcgggcacggccactgcagcggctgccggcgcagccgctcatagctcacaccgcgcaggtcgtagccggtcgtcggattccagaaccgcttgatctcctcgaacacctcctcggcgcagctgtagctgaacgcctcggaaaaccccatctcgcaagcgatccgggcgatgatctgccagtcgggcatggccccacccggcgccgcgaccgccggctgggacagcgtgatgttgcgctcggaattgaccatcaccccctcggtctccgcccacagcgccgccggcaacaacacgtcggcgtattcgctggtctccgtgccgaggtaggcgtcctgggcgatcaccaactcggcgcgctccagcccggccagcacggtcttccgattagcaacggaggcaacgggattggtgcagatgatccagcatgccttgatctgcccgtcggccatccgggagaacatgtcgacggttccggtgccgacctcggtgcgcagccttccgcggggaacaccccacacgtcttcgacgaactcgcggtcggcgaccgatgccaccgaccgctggcccggcaaacccggtcccatgtaacccatttcgcggccgcccatcgcgttgggctgaccggtgagcgagaaggggccgctgcccggcttgcagatcgccccggtggccaggtgcaggttgcagatggcgttggtgttccaggtgccgtgcgtgctctggttgaggcccatcgtccagcagctcatgaagttgtcggcctcgccgatcagctgagccgccgcgcggatgtcttgctcggggatgccggtgatttcgctgacccggtcgggggtgtactgctccaggaagctgggcatcacctcccagccctcggtgaactcggcgatgaattcgcggtcggtgtgcccattttcgacgatcaggtgcaacaggccgttgagcagtgcgagatccgtccccggggcgatctgcaggaacaggtccgccttttcggccgtcgcggtgcggcgcgggtcgacgacgatgagtttcgcgcccgccttgacgcggtccatcatgcgcaggaacaggatcgggtggcagtcggccatgttggcgccgatgacgaagaacacgtcggcgtgttcgaagtcctggtaggaacccggtggtccgtcggcgcctagcgacagcttgtagccggaaccggcgctggccatgcacagtcgcgagttcgactcgatctggttggtgccgatgaaacccttggtcagcttgttcgccaggtactgcgcctccagcgacatctggccggacacgtacatcgcgatcgcgtccgggccgtgctcgtcgatgatcgcccgtaactgtttcgcgcaccgggtgatcgcctgatccgtgtcgatcggttcgagcggttcgccgcggccggcccgcgcgtgcgccgagtccatccggcccggggcggcgagcaggtcggcggtggtggcccccttggtgcacaggcggccgaagttggccggatgttctttgttgccaaccgacttggcgacgtgacggcgcccggtttgcggatcggttgtgatctgcaacaccatgccgcagccgacgccgcagtaagcgcacatggtgttcacggcgttctccggcgccatggactccctggccacgcttacgtccctccgtcgagtgtgcacgggttagctcgctaacgagtgagttcattgtggggcagccatgtttcggcaccgctgcccgaaatttccccccgtttacttcttcctctcaacggcaggcacgccggtgtgaaatcgccggggagattcagggcttgggatcgtgttaccgcaggtcaccgttgaccatccgccccggctgagggtactcaccgcggcccgcgccacgcttcttcgaacgggctttttgaccaaaccgacgggacattcacagtcttcgctaagctcaccgcgtgcgtcggctcattgtgatggtgttggttttgctggcctccggttgcggctggaagccaccggcgccgccacaggcccggccggacacctgcaaggcctccgacgggccgacggccgacactgtgcgacaggcgatcaccgcggttcccatcgcgatccccggcaccatctgggtggagatcgggcgcggccacacccgcaattgccggttgcactgggtgcagatcatccccaccatcgccagcgagtcgactccccaacaactgctctttttcgaccacaacacgccgctgggcaccgccaccccgaacgcaaagccgtatataaccgtgctaccgccctcggatgacaccgtcaccgttcaataccagtggcagaagggaaatgatcagctgtgctgtcccaccgggatcggaacggtgaagttccggatcgggcccgacggcaaactgcaaaccatcggcaagatcccgaatcaataacgaccgcgggctcgcgatcgccccaatatcgttgggcaacaaggtgatcgccatgacgcagcggacggccacggggcgccggcccgcgggaactcacagcttgccctcagtgagttcttaccgggaaatgccgctttactcggaaagcgctggcatccttgacaaccggtgcccggcgcggtggtcgggcgacgtgtcgtgggtgccgatcgacagaaggcgggtttgatggcacggacgcgacgcatcgcgcattgggatcccgaggatctggtggcctgggaagcgggcaacaagctcatcgcccggcgcaacctgatctggtcgatcgccaccatgcacgtcgccttttccatctggtacctgtggtcggtgatggtgctgttcatgccgcaggcccgctacggtttcacgaccggcgacaagctgctggtgggcgccaccgcggcactggtcggggcgctggtgcgcatcccgtacgccatgggcaccgcgcggctgggcggtcgcaactgggccgtgctgtcgtcgctggtgctgctgatccccacgctcgcggccatcgtgctgctggcacacccagggttgccgttgtggccgtatctggtgtgcgcggcgctgaccggcttgggcggcgggaactacgcggccgcgctggccaacgtcgaatcgtttttcccgcagcggcgcaaggggttcgcgctgggtctcaccggaggcgtcggcaatctcggcgcggccggcatccaggcggtcgggctggtggtgctggccaccgccggtaaccaggcgccgtactgggtgtgcgccgtctatctggtgctgctggcgctcgtcggggtgggcgccgcgctgttcatggacaacctggaccattccgtcgaggtcggtcacgtgcgctcggtgctgacggtgcccgacacctggacgatttcgttcctgtacatgtgcgcgtcgggctcgttcatcggattcgcgttcgccttcggccaggtgatagcccacaacctgatcgccggcgggcagacgcacgggcaggccgcgctgcacgccgccgagatcgccttcgccgggccgctgctcggatcgatggcgcgggtggtcggcggcaagctgggggaccgcttcgacggcggccgggtcaccctgaccgtgctggccgccatgatcgtcgccggcggcttcctggtcgcggtgagcacgcacgacgacctgacccgcccgtccggcgcgccggtgtcgctgtacacgaccgccggctacatcgccggcttcatcgcgttgttcatctgctgcggcgtcggcaagggatcggtgttcaagctgatcccgtcggtcttcgcacagcgcagccgggcgttggagctcggcgacaccgaacgacgccactgggaacgggcccggtcggcggcgctgatcggcttcgccggctcgttcggcgcgctgggcggcgtggtgatcaacctggcgctgcgccagtcctatgccagcaccggcagctcgacgccggcgttcggggcgttcatgctgtgctacgtcgcggcggcggccctgacctgggccagatatgtgcgcccacgccgggcccgagccgcgcatcgcgccggactggcagccgatggccgagcagccggtcagctcgtgagggcctccgacaggttctccgggtgcagcatctcggcgtagcgcagccgctcggggatcccgaaaccgtcgaccagggtttgggcgtgcggccgcagcgcccggcagcggtcattgatgccccgggtgaccgccttggcgcgctcggtggacaggtagcggtgctcgatgtaccaggccttgtcgtcctcgatcaccgacagcgcgtacaggtcgcacaggatgcccaacagctcgcgggcctgctcgtcggggcagccgtcgatgccggcgacgaacgcttccagcaccacccggtcgatgtgcgcgctggccgcgtgcaacacatggtcctgcaccgagttgaacgcgtcgaattcggacatctctttcgatttcgcctgcagccgccgcgccaccgaggccagcagatactcctcgcggtcttcgaacatcttgatctgggtgccgcggttgaacaggctgccctcttcctcgctgtcctgccgggcgtcgacgatggtctggatgatcgtctcggccgcggtgcgtttgatgacgcgatcgccaacggcgttggcggcgaagcgaacccattcgaccggactcatgctcttgatgtcgtcggcgtaggcggtcagcagctccttggccaccagctgggtcagcacgtggttgtcgccctcgaaggtggtgaacacgtcggtgtcgccgcgcagcgcgatcagccggttctcggccatatagcccgcgccgccgcaggcctcgcgggactcctggatcgcccgcgtcgcatgccaggtgttggcggccttcagcccggccgcgcgcgcttccagttcgcgctgctcgtcggcatcgggatcgtcggcgctctggatgtcgtggcacttgctgaccagttcgttctgcgcgaactgcagcgcgtatgacttggcgatcaacgggaacaaccgccgctggtgcaccaggtagtccatgatcagcacctcggagtcgccgtccggggtggtgaattgcttgcgctgcaacgcatatcgggtggcgatgtccagcgccacccggcccgccgcaccggcgctgccgccgaccgtgatccggccgcgaaccagcgtgcccagcatggtgaagaaccggcggttgggattctcgatcggcgagctgtaggtgccgtccggggccacgtcgccgtacttgttcagcaggttgacccggggcacacggacgtggtcgaacacgatgcgcccgttgtccaccccgggcaggccgcccttgtattcgcagtccgaggtggtcaccccgggcaggtcgttgccgtcggcgtcacggatcggcaccaagaggcagtgcacaccgtgattgaccggcttgccgtcttcggtggtgatcagttgcgcgaataccgctgccaccgtggcggtttcggcggccccgccgatgtagtccttgcgggccgacggggtgggggagtcgatcacgaactcgtcggtcgccgggtcgtaggtggcggtcgtctccagcgactgaacgtcgctgccgtgcccggtctcggtcatcgcgaaacaaccgcgcaactccaggctgatgatcttgggcacgtaggtctcgtgatggcgctcggtgcccaggttctccacggccccgccgaacaggccccactgcaccccggccttcaccatcaacgacaggtccgacatcgccagcatctcgatcatggtgatcgccgcgccgacatcgccggtgccgccgtgttctttgcggaagccgtcggcggccgcgccgaacgccgccataatccgcatctgctcggccaccttggtgcgggcgatcacggtgttgggggtgtagtggggacggaacaggtcctcgctcagcgtctcccgcatccggtttctgacgtcacgccaacgcccgtccagtgcgttgcgcagatgttcggctgtgcttgtcgtttctggcgccatgaaccgaccgtaacgtgcgcgtcgcgtcgccggaacaacgacgacaattcatgtcgccgaacggatcttcccgggtgagcgcaaccggtagagggtcacgcccgcggcggcgacgccgaacagcacgagcatcaccatgtcgaagacccaccagccgctgtagtgcgtccaggtctcggcgttggcggccagcgggtcgatccggcgcaggttcaccgtggacgccgacgcggcgaaaccccaccgggccgggatgagccagctgatctgctgcagcccccacatgctgaccagctgcaccaggcttccgttgaacagcaccgcggccagaatcaccggcaccagcagcggcaggacttcgcccagcgacttgcccagcgccgacagcgccaggccgatcaccgcggacaccatcgcggtgaccgccacggcgacgtagagctcgaacgtggcgtcgtgcagcacgacggcgccgtacaccggagcacccttgacggcgatgacgacggccaacatgacggccgcccagacggccgcggccagcgcgtacacggcgatcttggcggccaggtaggccggcgcggacagcccgacctgctgttcgcggcggtagacgcgatgctcgccgaccatggccggaaccgtcagcgccgtcccgatgatcaccgcggcaacgttgagcagagccaggatctcgatggcctcgtgcgcgttggcactgctcggcgcgggccgcgccaggcccgaatcgccggggatcagcagcgtgagtccggccaacacgaacggcagcagcgccagaaatgcgaagtagaggcgattggcgagcagcagccggatctcgcggcgggccacgcaccgcacctgccggggaaccggcagcgcggccggcggcgcccacggcgccgcgacctccggcgggatggtcggcgccgcggattgcggccgcgcccgaaacgcgcgatgggcgccgtccggatcggcgccgacccgggccagcaccgccgaccagtcggcgctgcccatcgcggactcggcctgcagcggcgtcccgagataggcgaccttgccggcggcggtgagcaccaacacctgatcgcacatgttgacgtcggtgagcgacgtgcgcgacgagatcgccgccaccacgacgcagccgagattggcctggcggcgcagcacggccatcacgtggcgctgctgcgccgcgttcagcccggcggtcggctcgtccaccaccagcaggctcggtcgcgtgacgagctcgatcgccagtgcggtgcagcgccgcacctcgggcgcgagtttgcggatcctggtgtcgcggtgggtcgtcaggtcgagttcgtcgagcacctggccgaccacccggtcgcgttgctccgccgaagtctccggcggtagccgcaattcggcggcatagcgcagcgcttgttcgacggtgagccgccggtgcaggcgctcctcgcgcgagacgaccccgatgcgggcgcgcatggccgccggttcggcgtgcacgtcgtgtccgtcgacggtgacgcgcccggagctgggcgtccgggtgcccgccagcagcgccagcagcgcggcattgcgcgccggggagggtccgatgaccgcggtcatggtgccgggcttcgccgtgaacgagatgcccgacagcgtctcgtgcccgtcgacggacagcccgagctgataggccaccacgccggtggtgcgggcggcggtgcgcagcggcagccgatgggtggagttggcttcgtcggtgcggaacgacgggcgctgggcgcgcagcttggaggtgatcatccgctcgatcaggcccgggcccttgggcggctcgggcgccggcgcgggcggggccggcggcggagcgggagggggaggcggtggaacgggaggcggagcagacggtccgggatcttcgatggtgatggccaggccgtcgcggatctcgaccgtcgggacccgggatccgtccaggaagatgccgcggtggctcaggtcgatggccacccagtgggcgccggtgaagcgcagcaccacgtccacgcgcggcgccgggggtggttgcggggcgaggcgttccagcggaatgtcacagccggggccgtagcccaccaccacgtcgcgaccgggggcgaagacgtacctgctcggtccggcccatacggtcagcgaggccggaagcgccgaagcctcggtcggcatcgccccaccctttcgtcaccggtcagttcgactacgtgtctaccctcgcgccaggtccggccaccagcctcaggacgtctggcgccggcccgccagcgaggacgccagggaggcgttgtcgagcagccgtcgcaacacgtcgaccgcctgccgcagcacctgccggtcttcggcgtcgagcagcgccagctgcggttgaatcgcggcggcccggtcggcccgcaccgcgttcagggtgcgcctgccatcggcggtgatgcggatccgcaccgcgcgcgcatcgccgggatcgaccgttcgggtgaccaggcccgcttcctcgagtcggcgcacctgcgtcgtcatcgtcggctgcgagcagtggtcgacagcggccaggtcaccgatccgggcctcgccgtgagcttcgatggttgccagcagcctggcctgcgctgccggcaacggcatctggatgcgctgggtggccagccggttgagccgcgcgaccacggcgagcaggtcggcccccagtccctgccctccctcgagctttgcggtgtcgacgacgttgtccatgtctccatggttgcatagctttgctaagcgtggcctcagcgcgggcgcgtgccgtgcgaaacaccttcttcagcggacactcccgcggccggctggcagaatcgcccaagtgaccttgctgcgttttcggccagccggaccaggggcactgcggccgaatgagttggcacaggccgcggtcatgggggccctgtgtgcggcgatcgagatcctcgccgcggtaatcccattcgctcagggactgggcgtgctgggcaccgtgcccatgggattgctggcttaccgctaccgcccccgcgcgctgatggccgcgacggtagccggcggggtgatcgcgttcctgattgccgggctgggcagccttttcatgctcgtcgactgcgcctgggtcggcggattgtgcggcatcgtcaaacgcaagggtcgcggcacgccgacggtcgcgttgttgtcgttgatcgccggcgtactgtggggcgccggatgggtcgcggtgttggcggtgctgacccggctgcgtcatctgttcttcgacgtcatcacggccaacgccaacggcgttgcggccttcctgaactggatgcacctgcagggcgtgggcgcagggctgaagcggtacgtcgccgacgggctgcagcactggccgctgctgatcttcccctacatgatcctgttggtcgtcgtcgtctcgttcatcagctggtcggcactgtctcggctgctggatcggatgcgcaagatccccgacgtgcacaagctggaccctcccgacgacgggcacgccgccatcgggccggttccggtgcggttggagaacgtgcggttccgttatccgggtgccgagcaggacgcgctgcgcgaggtcagcctggacgtccaggccggcgaacacgtcgcggtcaccggcgccaacggctcgggcaagaccaccctgatgctgatcctggccggccggcaaccgacgtcgggcaccgtgcaccggcccggtgcggtgggactcggcgaggtcggcggcacggcaattgtgttgcagcaccccaaaagtcaagtcctgggcacccgggtcgccgacgacgtggtgtggggtctgcccccgggcaccgacattgatgtgcaccggttgctgcgcgaagtcggcctggacgggctggccgaacgcgacaccggaagcctgtccggcggcgagttgcagcggctggcgctggcggcggcgctggcgcgggacccgaagctgttgatcgccgacgaggtcaccaccatggtggaccagcagggccgagatgcgttgctgggcatcctgtctggtctcgcgaaacggcatcagaccgccctggtgcacatcacccactacgacaacgaggccgcgtccgccgaccgcgtcatcaagctcagcgactcaccggacaacgccgtcgccgccgaaaccaacgccgcggccgcgccggccgtcgccgtccagcacggttcgggggtgcccgtgctggagctcatcgacgtcagccacgaatacgccagcggcacaccgtggtccaaggtcgccctgcgcgatgtcagcttcgtggtggaacagggcgacgggctgttgatccacggcggcaacggctcgggcaagtcgacgctggcctggatcatggccgggttgaccactcccaccagcggcagctgcctgatcgacggccggcccacccacgagcgggtcggcgaggtggcgctgtcgttccagtcggcccggctgcagttgatgcgcgatcacgtggacaccgaagtggcgtcggctgccgggttttcgcccaccgaccaggaccgggtggccgaggcgctgatgtcggtcggactggatccggcgatgggcaaacggcgcatcgaccaactcagcggcggccagatgcgccgggtggtgctggccggcctgctggcccggtccccgcgcgcgctggtgctcgacgagccgctggccgggttggacatcggcagccagcgcggcctgctgcggctgctggaaaacctgcgcagagaacggggtttgacggtggtggtgatctcgcacgacaccgtcgggctcgaggagctgtgcccgcggtcgctgtacctgcgcgacggagccctgcaaacggcgtccaccgcggcggggggaatgccgtgaccgcgccctcggacacccagtcggcggccggccggactcggcggccgccgcgaccggtggtgctgctggtcccggtgcccggcacctcgaaaatccacgaattgtgggccggcaccaaactacttgtggtgctgggtgtttcggtgctgctgacgttctttccggggtgggtgaccgtggggttgatgctggccctgctggtggccgcggcccggctggcccacattccgcgcggcgcgctgccctcgccgcggcgctggatctggatcgtgctggcggtgggcggcatcacggccgcgctgggtgccgggagcccggtggtctcgatcgccgggctgcacatcgggctgggcggaacgctgcacttcctgcgcgtcaccgccttgtcgatcgtgttgatcgggctgggcgcgatgctgtcgtggaccaccaacgtcgccgaaatggggcccgccctggccactttgggacgcccgctgcggtggctgcgcatcccgagcgacgaatgggccgtcgcgctggcgctggcgctgcgcgccttcccgatgctgatcgaagaattccaggtgctctacgcggcccgtcgactgcgccccaaccagacaccgcgcagccgccgggcccgccgccgtcagcaggcccgggacatgatcgacttgctcaccgcggcaatcgtcgtgacgttgcgacgcgccgacgagatgggcgacgcgatcaccgcccggggcggtatcgggcagttgtcggccgccccggcgcgaccgaaactcgcggactgggtgaccctgaccatcaccgtcgccgccggtgccatcggggtggcgctggactcgatgatccccttccagtaggccggccggttcctgcgcgcccgctagggccgcatccggtcgatgaggttggacaacacgacgatgctttcgctgcgttcgacgtccgcgctggaccggatccgttccaacgccacctccaaatgccgcatgtcgcgggccaatacgtgcaggatggcgtccggggtgccggtcaccgtcgcggcgctgaacacctcggggatgtccacccaggccgcccgcagctcgtcgggcgcgatgcggccgtggcagaacacctgaacgtaggcctcggtgttccagcccagtgcgttgcggtcgacgacggtggtgaagcccttgatgaccccgctgtccagcatccggtcgacgcggcgcttcaccgccggcgccgacaggttcaccttgtcgccgatttcggcgaaggtggcgcgggcgtgctcggtcagctcggcgaggatgcgctcgtcggtgtcgtccaggcgatccatgacgcctccccggtgctgagacaacaaatcatcgaatatccgactatagcgcaataaatcggcggtatacccgcaataatagtcgtttgattgtctaggggcccgcaaataccgttgatggatgacggatcaatacgtgcgggcagcccgcccggtgccccgatcggccgcccgcaccggccgggtgcaccggctgcccagcgtccgccggtatgcgatgacgcgaccgtccttcttcgcggtcgactacgcgatcaacccctggatggacatcaccacacccgtcgacgccggccgcgcgcaggcccagtggggggcactgcgccgcacctatctacggctcggccaccgggtggacgtgatcgagccggtggccgggctgccggacatggtctatgccgccaacggcgggttcatcgcgggagacgtcgcgatcgtggccaggtttcggttcgcgcagcgggccggcgagtcccgcgcctacgccgaatggatgcgctcgctgggctatcggccggtgctcacccgccacgtcaacgaggggcagggcgatctgctgaaggtcggcgacatcgtgttggccggctgggggtttcgcaccgaccgccgggcgcatccggagatttcggccgcgctgcgcgcgccggtcgtgtcgctggaactggtcgacccgcgcttctaccatctcgacaccgcgttggcggtgctcgacgaccgcacgatcgcgttctacccgcccgcgttcagcgacacggcccggcggcaactgggtgcgctgttcccggatgccatcgtggtcggcccggccgacgcgcacgtgttgggcctcaacgtcgtctccgacgggttacatgtggtactgccctctgccgcaacgggtttcgcaacccaattgcgccgggcggggttcgagccgataggcgtcgatttgtccgagctgctcaaaggcggcggctccgtcaagtgctgcacattggaggttttcccatgacgattctggacgggcagctcaccgcgacccgcgtggattccgcgatcaggctggcggaaaagcgtgccgcgcacaactattcgccgttaccgatcgtcgccgcgagcgcgcagggggcgtggatcaccgatgtcgacggccgacgctacctggactgcctgtccgcctattccgcggtgaacttcggccaccgtcaccccgagatcgtcgccaccgcccatgcgcagctggacaccgtcaccctggtcagccgcgcggtccattccgacaagctcgggccgttctgcgcggcgctcgcctacctgtgcgacaaggacatggtgctgccgatgaattcgggcgccgaagccgtggaaagcggcctcaaggtggcccgcaagtggggggccgaggtcaagggggttcccgccggccaggccaatatcatcgtggcggacaacaacttccacggccgcaccatcagcatcgtcagcttctcctcggacgccgcggcgcgggacgggttcggccccttcacgccgggattccgctcggtgccgttcggcgatgccggcacgctggcccaggcgatcgacgacaacaccgtcgcggtgctgctggagccgattcagggtgaggccggcatcgtcgtcccgcccgacgactacctgccggccgtccgcgcgctgtgcagcgagcacaacgtgctgatgatcgccgacgagattcaatccggcctggcgcgtaccggttacacgtttgcctgcgaccggtggcgggtggtgcccgacgtctacctgctgggcaaagccctgggcggcggggtggttccgctgtcggcggtggtggccgaccgcgagatcctcggcgtgttgcatcccggcgagcacggctccaccttcggcggcaacccgctggccgccgcgatcggcaccaccgtggtgtccatgctggcccgcggcgagtaccaggctcgcgcgaccgcgctgggcgcgcacctgcagcggcggctgcgggcgctggtcggtcacggggtggacgaggtgcgcggcctggggttgtgggcaggggtggacatcgacccgtcgctgggcagcggccgggagatgagcctgcggctggccgagcggggcgtgctggtgaaggacacgcatggcgcgaccttgcgcttcgcgccgcctctggtggtcaccgcgcaggagatcgactgggcggtcggccagcttgctgcggtgttgcgggaggctgcttcataatcagctgacccggcaacaggaggggcaattgccagccacgccgatcggcttgagagcacagctgctgcgacggcgcccggtggtgggcgcacacgtggcccccggcaccgccgatcacctccggcgcggcatcgggaccttccagctgaccatgttcggggtcgggtcgacgatcggcaccggcatcttcttcgtcatgtcccaggccgtccccgaggccggccccgcggtcatcgtctccttcctgctcgccggcgtcgccgccgggctggcggccgtgtgctacgccgaattggcttcggcggtaccggtttcgggctcgtcgtattcctacgcctacaccacgctgggcgaggtggtcgcgatgggcgtggcggcctgcctgctgctggaatacggggtggccaccgccgcggtctcggtgaactggagcggctacctgaacaagctgctgagcaatgtcgtgggattccaactgccgcatgccttgtcggccgcaccgtgggacgcgcaacccggctacgtcaatctgccggcggtcatgctgatcgggatgtgcgccctgttgctgatccgcggggccagcgaatcggccaaggtcaacgcgatcatggtgatgatcaagctcggcgtgctcgtcgtattcgggatccttgccttcaccgcgttcgacgtgcaccacctcgacgacttcgcgccgttcggtgtcgccggtgtgggcacggccgccggcaccatcttcttctcctacatcggcctcgatgcggtgtccaccgcgggcgacgaggtgacgaacccgcagaagaccatgccgcgcgcgctgatcgccgcgctgtcgaccgtcaccggcgtgtacgtgttcgtcgcgctcgccgcgctggggacgcagccgtggcaggactttggcggtcagcaggaggccgggctcgccaccatcctcgaccatgtcacgcacggcagctgggccagcaccattttggctgcgggcgcggtcatttcgatcttcagcgtcacgctggtcaccatgtacggcatcacccgcatcctgttcgccatgggccgggacgggctgctgccgccgcggttcgccagggtgaacccgcgcaccatgacgccggtgaacaacaccgtgatcgtcgcggtcgccgcctctaccctggccgcgttcattccgctgcaaaacctggccgacatggtctcgatcggcacgctcaccgcgttcgtcgtcgtctccgtcggggtgatcgtgttacgggtgcgcgagcccgacctgccacgcgggttccgggtcccgggttaccctgtcacgcccgtcctttcgatcatggcctgcgggtacatcctggcgagcttgcactggtacacctggatcgcgttcagcggctgggtgttgctggcgctgatcttctacttcgtctggggccgtcaccacagcgcactcaacgacgcggcggtcgacccgtccggccaggagcgctgaccggcttaccggcgggcggcggcgttggccgccgcctgagcccgcctcagtgtcgtggcgacatcgccgcggccggagaacatttcgtcgaagtagggccgcagcgcatcgttgccggcggcgaagccggccccgcccggggcggcgatgcgcggcccgttgagcaccgcgaagaacggtgtcacgtccacgccgcgggaggcccagtagcggaagtacaccggttgcgccgaggtcaccgcgggaatggccgcgccgtagcggcccaggtattcgttgccctgcctgctgcccatccaggccagcacctggcgcaccgccgcgggatgcttggtcgcggcgttgcccgctgcggcaatgccgttggtgacgctcacccggcccaccggcccggcgggcatcatcgctacaccccaccggaagcgcgcatcgcgggccaccggcgccaggttgtaggtgcccgattggaagagggccatccggccggcgaggaactggttgcgggagaagtcgccgttgtcgttggtgtcggcggccgaaggcgcgacgtggtcgcggttgatcaggtcgaccaggtagcgaaacgccgacaccgcggcgggattgtcgaaggcgaactcgtcgccgcgctggaagacaccgccggccgaaccgatgtaattcaggtagatgccctgcgggtcgttggccgcgttgtagccccactgccgcacccggcccgggtcgaatccccgggtgtcgccgcggtttccgtcggcgtcgacggtgagccgggccagcagcggacgcaacgtgtccccgccggccgggtcccaccgcaggccgttcagctgggccgggtcgatgccggccgcgccgagcaggtccgcgttgtagtacaaggcgataccggcgtccgtgagctgcggcacgccccacagctgtccgtgccgggtgaactgctcgacgacgggtcgctcccagtccgcggccgcgttagtgccaagtgtgtcaaggatattcagcagtcggccgctgtcggcgtaggcggcgaggtaggcgttggacagccagaagatgtcgtcggcgctgccaccggcgacgtcggtgcgcagggtgttgaagtaggtcgagtaggcgaccatgttgacgtgcacttcgatgtcgggatgggcacgggtgaacgccgcgaacgattgtcggtaggcctcggcgagctcgtcgccccagactcgcaccgtcacgatcgttttgtcgccgtgcggctgcccggaataatccagcagcaccgccgccgcggccagcaacgcggcgaccagcgccaccgccccggcgaccagcgtggagaagcggggccgggtcacttgagtcccgagacgacgatcgaggcgacgatgtgacgctggaagatgacgaacagcgtgaccagcgggacgatcgcgatggtggtcgccgccatcaccagcgtccattgcgcgttgaaccgggtctgcagatcggcggtcgccaccgtgagcacccgccacttgtgcccgctggtgatcaccaacggccacatgaagttgttccactgcgagaccacggtgatcaacgccagcgcggccagcaccggccggctggacgggatcaccacgtgcacgatcacgtccagggtgtgggcgccgtccaggcgggcggcattgaccaggtcgttcggaatcatgcgaaagtgctcgcgcagcaggaagattgcgtacggcgagccgaacatgaacggcagcaccaacgcccagaacgtgttgcgcaggcccagctgggccatcatcagatacatcggcacgatggtgaccgtgcccggcaccatcagcgtcgcgatgtagacccagaacagcgcgtcgcggccgggaaaccgcaagcgcgcgaacgcgtatccggccagcaccgagaacgtcagctggccgaccaggatgaccgccgtcatcaacgccgtcaccgccgccgcgcggccgaacccggccccggccaggtcggcgaaattggacagggtgggcggtcgcggcagctgcaacggggtgccggtgacgaattgatgcgccgaggtgaacgccgtcagcaagccaagtgtgaacggcgccaacgtgatcaacgcgcccaccagcaggccggcgtagatcgcgatgttggcgcgagcgcggtcaggtgaggtcatagctgatccgccgccggaaatacagatgctgaaccagggtgacgccgatcaggatcacgaacagcaccaccgccatcaccgacgcccggccgatggccgccgagccgaacgcctcggcgtagatgcggtgtgccaccaggtcggtgcggccggcgggaccgccgccggtcaacgcgtacaccgtgtcgaaaacctgtgcgctgctgacgatcccggtcaccagcacgaagaacgtcgtcggtcgcagcatgggcatggtgatgcgccagaaccgctgccacgcgttggcgccgtcggtgcgtgccgccgcgtgaatgtcctcggggatggcgagcaggccggccaggaacgacaacgagacatacccgacgttggtccacaccacgacggccgacaccagcggcagtgcaaagctcgggtcggacagccattcgatgctgtgccccagtaccgcgctcaccgcgccgtcggtgggcgccaggatccagcgccacagcaccgcaatggccagcggcgcgcaaatccacggcagcacatagacggtgcggaacagcccggtgccgggcagccggcgggccagcatggtggcggccagcagacccagcgccgtctgcgccgggaccaccatggccacgaagacggccgtgaccatcagcgagttgccgaacccggcgtccgtcagcaccgaccgccaattggacaggccgacaaagcgcagcgggcccagcagatcccaccggcacaggctcagccagatcaccaccaggatgggcagcagtagaaacgcgagcacaccgaacaagctcggcgccagcagcgcgtagcccaacgcggtggaccgcggtgcaacccggcgttcggcgctggccatgaggtaattaaagcgggcgctgccacggtttgtggggaccggccgttacggtggagccgtgacaccgaaccgggggatcgatgccgacttcctggacctgccgcgccacgaactggccgacgcggcgctgtccgcggccaccgcggccggggccagccatgccgacctgcgggttcaccggctcatcaccgagatcatccagctgcgcgacggcgagctggaaaccgcggtgatcaatcgcgaggtcgggttggcggtgcgggtgatcgtcgacggcacctggggattcgcgtcgcacgcggagttggcgccgtcggtggccgccgagaccgcccgccgcgccgtgcacgtggccaccacgctggccacgctgagcagcgagcgggtcgagctggcgcccgaacccgtctaccgggacgccacgtgggtgtcgagctaccggatcgacccgttcgacgtctcggccgccgacaagatcggcgtgctgggcgactactcggggcggctgctcgccgccgacggcatcgatcacgtgtcggcgctgctgaccgccgtcaaggagcagacgttctacgccgacacgttcggctcgtcgatcacccagcagcgggtgcgggtgctgccctcgctggaagcggtgacggtggacgcccaggcgggcagcttcgactcgatgcggacgttggcgccgccgatgggtcgcggctgggaggccctggccggtgacgaggtgtggaattggaccgacgagctggcgcagctgccgtccctgctggccgagaaggtcaaggcacccacagtggctcccgggcccaccgacctggtgatcgacccgaccaacctctggctgaccattcatgaatcgatcgggcacgcaaccgaatacgaccgcgccatcggctacgaggccgcctacgccggcacgtcgttcgccacaccggacaagctgggcgccatgcggtacgggtcgccggtgatgaacgtgaccgcggaccggaccgtcgaattcggtttggccaccatcggttacgacgatgagggggtggccgcgcaaagctgggatctggtgcgcgacgggattttcaccggttatcagctggaccgggtgttcgcccggcggctcggacacccgcgctccaacggctgctcgtacgcggattcgccgcatcacgtgccgatccagcgcatggccaatgtgtcgctgcagcccgcccccgaacagatcagcaccgacgacttgatcgcccgggtcgaggacggcatctacatcgtcggcgacaagtcgtggtcaatcgacatgcagcgctacaactttcagttcaccggccagcgggtctaccggattcgcggcgggcggctggacggccaactgcgcgacgtcgcctatcaggccaccacgaccgatttctggaattcgatggaggcggtgggcggcccggccacctggcggctgggcggagcgttcaactgcggcaaggcccagccgggccagatcgcgcccgtcagccacggctgcccgtccgcgctgttccgcggcgtcaatgtgctgaacacccggaccgagggcggccgatgatcaccccgcagcatgtcgtcaacgtcgtgctcgacgaggcggccaagctgggcggcgccgacgagaccatggtgctggtcaccgacaaggtcgaggcgacgctgcgctgggcggccaattcgatgaccaccaacggggtttcggtgagccggagcgtgacggtgatctcggtggtgcgtcgcgggtccggcgcgcgcatcggaacggtggtgtcggccgaggcggacccgcgggtgctgcccgggctggtcgcggcgtcgcagcaggccgccgcgtcggcgccggaggccggcgacgccgcaccgctgctcgccgacgccggggaacccgccgactgggacgcgccggtacccggcaccgggccgttgatcttcgccgacctcgacgactcgctcggccggggtttccgtggcaccgatcggctctacggctttgcccaccacagtgtttcgaccactttcgtggcgacctcgaccgggttgcggcggcgcttcacccaacccacgggggcggtggagatcaacgccaagcgcggcgacgccagcgcatgggcgggtgtggggacacccgacttcgtcgatgtgccaaccgattcgctgctcgagcaactgtcgacgcggctgggctgggcgcggcgcagcgtggagttgccggcggggcgttacgagaccatcatgccgccgtcgacggtggccgacatgatgatctacatggcctggtcgatggccggccgcggcgcgcaggagggccggaccgcgttctcggcgcccggtggcgggacccgggtgggcgagcggctcaccgacctgccgctgacgctgttctccgatccgatggcgcccgggctgatctgcacgccgttcgtcgcggtgagcagctcctcggagacggtgtcggtgttcgacaacggcatgccgatcgaccacgtcgactggatccgcgacggggtgatcaccgcgctggcctatccgcgggccaccgccgccaaatacgacgtcgacgtcgcggtggccgccgacaacctggtgatgaccggggggacggccagccaagccgacatgatcgcggccaccgagcgcggcctgctgttgaccacgctgtggtacatccgggtcgtcgagcccaccacgctgttggtcaccggcctgacccgtgacggcgtctacctgatcgaggacgggcaggtcaccgcggccgtcaacaacttccggttcaacgagagcccgctggacctgctgcgacgggccaccgaggccggcgtcagcgagaagacgctgccccgcgagtggggagattgggccacccgcgccgcgatgccggcgctgcgcatccccgacttccacatgtcctcggtgagccaggcccagtagtcgattgccgccgggccgcgcgcgttctagcgtgtgacggatggcggctccggtttcgcttcgagaagaccagctcacccggttggtggcggtgtttccggggtcgccgtccgaggcgcgcgtcgcggcgttgatccggcgggtgtgcgcgcagacatcgtcgctgccgccgttgcccgcgcccatggaggtgggcgagccggaatcggaaaccgaggccgccgtcgccgagttcgccgaacaattcagcgccgacgtctcggcgatcacccacgcgcaacggtctcggctgtcaaagcagctgggggacaggacctttggggtagtcgtgcagatgtacatcgccgacttcgtcctccgggtgcgcgccggactggaagcgctcggggtcggctcgcggtatctgggctggctgtcggggccgatcagctgggaccacggcagcgacccgtcggatctggtgttcaacgactttttaatcgtggtggcgcgaatgcgtgccctggacccggtgacttccgagctggttcggctgcggggcgcggctcagcaccattgccggctgtgcaactcgcttcgcgagggcagcgcgctggatgccggcggttcggaaacgctgtacgaggagatcgagcgcttcgaatcgtcgggtttgctggacgagcgcgcaaaggcagcgctgcgctacaccgatgcgttaatttggacgcctgcgcacctcgtcgccgacgatgtcgccgaggtgcgctcccggttctccgaggccgaggccgtcgagctcaccttcgacatcatgcgcaatgccagcaacaaggtcgccgtctccctggctgccgacgcgccgcgggtcgaaaacggtacgcagcggtatctgatcggcgccgacggtcagacggtatttagctgaccgagcgggcgacggcctcggcgcgggttgaggcgcggtttcgccacggttgggtggccttggcgcctcgcgccgaaggcacgaaatgttaactattcgtacaccgccgcgcaagcgtccgttaccgctttgtgctgggctcattggctaacttaagcgcggtcaccgactcttatatgaacaaatatgtcgacgatttgacgccgggcgtgcgtcgcaagcaatcgcattggtgcgcagagggaggttcgcagatgaccaccgggacacgctcgcagctgcgggtgccagcggtgtgggttgccggcgttgcgctgggggcctcgatgctcggcgccgcggtgttgtcggctccgcaggcttcggcgacctgcaacctgagcgacaaggacgatcagtacatcaacctgctggcgcagaacaagatggttcacaacgccgactacagcgattgccacgaggccgcagagggtcggtggttcgccgatcaggtccggtccaatcccaattcgttcggcgaggcgcaggagttggtgaacatgatcaccaacaccacgccgctgagccaggcccaggccgagtgggaggtcgagtcggccatctatgtgtacgcgcccgacttgatcccgaagatcaaagaccaggcctcgaaggcaaactggcccaccgagggctgatcgtcgtggcggagcacggaccgccaatgcctttgctcgccttggatttcgcggacgtccgcacgacgctctgaggttcagcacttttgtttggttcaaataccctgtcgtatagctcttttcggtattcgttgttcacccattgttcgtaagagccggtgtttgtcgcgctcgcggtcggtggtatccgatccacagtgcgtcaagggaagaagggacattccaccagagggggtatctggagaaatggcaagaacacgagcacagggggccgggctggcggtgggaaccgccggaatcatgttgggggcggccgtgttcggtggggcggtgctgtcggcgccacccgccgcggcggcgtgcagtctgactcccgccgacgaccagtacatcaacctgttggcgcagaacaagatggttcacaatgccgacttcagtgactgccatgaggccgccgagggtcggtggttcgccgatcaggtccggtcgaatcccaatccgtacggaaaggcgaaggagttggtgaacatggtcaccaacacgacgccgttgtccccggaccaggccgagtgggaggtcgagtcggcgatctatgtctacgcgccggacctgatccccaagatcaaggctcaggccgggcagccagcgccgccggcggcctaatcgccggcgctgcgccgctgggctggccgcgggacgccgacttcgggcttgggctaccgtttcctacggagcaatcacgtcggggcggtagctcagttggttagagccgcggactcataatccgttggtcgcgggttcgagccccgcccgccccacgaaaagcgtgttttacctcggctgatggttgacgtctcggcttcgggtgatgggcgacggtgtttcggctgatgcgtgacagttacttcggctgatccttgacactcgccccatcttgtcgcgcactggttgacggggcggcgttagttcgtctgttgcgatatcgccaattagtgtcatccaccccgtcgccgctgagccgaacgtagctgcgttcgtgagcgcctcgcccagccgaggccctccttactccgcaagtccgaggaagactaggagcgccatgtcgagccgaacgatgtctccgtccggtagccggccgacccggcgggtcaggctggcgcgcgggacggttgtgatcttatcgatcatcagccggctggtctccgccaagccggttgtctccgacggttgaacaacgatccgaaatagtggcgcgtcaacgtcactggtggtgaagggcaccaccgtcaccgatgccgttgcgtcgaatcggtcgtcttggacgacgacgactggccggggtttgccgcaataagcgccgcgtccgcggccatgtagatgtcgcctcgtcgcacgtctatgtggcgtcgtcccagtcggccgaaacggcatcgacgaaggcctggtcgtcacgatcctgttcgctggcagccacgagcgccgattggcggtgcgcttctctgacgaactccgtggcgttcacatcgggaacccagagctggatcggccgcaggcctcgttggcgcagccgttccctgtgcctgcgaacgcgctcacgaccgagtgacattcgctcatgtaacggcgctacctgcgggttgccatcgctcggacacaacagcacccacccagccgatcacagcccgatgtagacggccttggtgttgaagtaggcctcgatgcccttgcggccgcgctcgccaccccacccggactgcttgtgcccgctgatcggcatcgaggggtcggccgcgagcgcggagttcacccaaatctggcctgcgcgaagctcattgacgacccgatgggcacgcgacaggttctcggtccaaatcgccccggcgagcccgtagtgtgtgtcgttggcggcggcgatcacttcgtcctcgtcgtcgaacgggatcacgcagccgaccggcccgaagatctcctcgcggatcagccgcatgtcgggtgtggtgttggtgatgatcgtcgcctcgtagaagtagcccttgcggtccatcggcttgccgccggtgatcaccttggcgccggcggccaccccgtcgttgacgatgccttccacgcgttgccgttgcttttcgctaatgagtggtcccagaacggaattggggtcatcgctgccgcccatcggcagcatcttggcgaactcggcaaggccctcgaccacctggtcgtagatgccgcgctggacgtagatgcgcgaggtgcacgagcagttctgccccgagcccgcgagcaggcccatgcccgctcccatgatcgccttgtcgaggttggcgtcgtcgaacatgatcagcggcgacttgccgccgagctcgagcgtcagccgcttgaggttgccggcggccgctttgacgatcagccgccccacctccgtcgacccggtgaacgagatcttgtcgacgtcggggtgcgcggtcagcgccgccccggtggtctcgccgtagccggtgatgacgttcagcacgccgtcgggcagacccgcctcgcggaagatctcttccagcttcagcgcggtcagcggcgtctcctcggcgggcttgagcacggcgctgcatcccgccgcgagcgccggcgcgaccttgagcatcgcgacgaaaaacggcccgttccaagggattatcaggccgacgacgccgaccggctcgagctgggtgaaggtgtgataggtctcccaggtgccgagcagaccgtcggagaccaggttggccgactcgccgtggatcttgccgacccagcccgcgtagtacttcagcatgtcgaccgagaccgggatgatgtggccggcggccgtcaggttcatcccgttgtcctgggactcgagcgcggccagctcgtccttgcgttcctcgatgatgcgggcggcgcggaagagcacgttggcccggtgcgacgcgggcgccttgcgccacacgcccaactcgaaggtctcgcgcgcccgcgccaccgctgcgtcgacggcggcctggtcggaatccgggacctcggcgatctgctcctcggtggacgggttgaagacgggaatggtggtactcacggttcgtcggggcccttcgtcggcggaaatccagtcgtcgcgcgacagaggttacgggcttaaccatcgggtgtccagcacgtgcgagcgctcgatgagcgtggcatccggacggatcctgcaggtcacccgcgtgccgaaacggatgcgccggccgcgccccggcaggtggagccccgccgcaaaatggcggctagattacccctatgcgggttgttcgcctgttcgctgcggtcctgaccatcctcacagccgggctgctgtgggcgaccccggccggcgcgcaaccgccgaccaagctcaccgatcacctcaccgacagcaaccgggtgctgacggattcggatcgggcggcggtcagctcggccatcgaccggctgtaccgcgatcgacacatccaactgtgggtggtctacgtcgacaacttcaacaagttcaaacccgacaactgggccgaccgcacccgcagcgaaagcggcatgggcgaccgcgacgtgctgctggccgtggccaccaacaccaagttgttcacactcaaccccccgccgcagctgcagaacccgacagccgacgagttgaatagcctgcgcaccaacaagattgggccggcagtcagtgcgaagaactgggccatcgccgccatcgccgcggccgatggtctggacacttcacccagcgtgtctcatcccgcgagcccggccaagcgggcctggctgccgatcgcgatcgctgtcatcgccgtcgtggtcgtcgtcgtgctgctgctggtgctctatcgggcgcggcgccgccggcgcgccgctcgcggagtcggccccggcggtccgcaggatcgttcgttgggggaggcgttgtcgacggccgaggccaggttgcgccaaatctccgactacgtcgcccggcatcacgacagcgtcggcgccgacgcccgcagccgcctcgacgaggccacccggcacctggcggccgcgcgcgccaagcaggcaagcaacgacaccgaggcgatcgcccatgccaaccgggcatcgacgttggcggcagaggcgcaacacctggcgaacgacgacgtgctgggcgcccaccgcacgacgcgacgccggggtgccgcatccaagcgatgacctgaaccgtcgaacgtggagttgttgcggaaaatcggccggatccgcgcaacaaccccacgttcggcgtcacgacgaacggtagcgagcacgcagcaggcccagcgcctgctcgacggtctcctccgtatcgcgggtcgcgtcgacacgcagcaccgacgcctgctcatcggggggagtgaacgcggcgcgcagctgcggccacagctcgatccgcgcgtccgagacgacgccttgctcggtcgcgcgccgcttgagccgcgcgatcagggtgtcgtcatccgcgtcgcacagcacgacgtgcaggtcgacgccgagccggtgggcaagctgccgcagctgggcgcgctcacccggattgccgaacgtcgcgtcgacgaccacgccgcggccgcggcgcaaccaacgggcggcgtcgcggcgtaacgcggcataggtgttgcgcgtcatcgcgggatcgtaaagccccgaaccgaattcgtcgctgccgcggcgggtcggcggaatgcccgccatcctcttgcgggccacgtccgacgagaggtgcaccagcccgagccggccggcgagcgcccgcgccagcgtggtcttgccgctggccggcagccccatggtgacgaccatcagcggacggggcaggccgcccgcgtgcgcccacgccaggtcgaaatacccgcgcgactcggcgatgagcgcttcctgttcaccgccgggcaccttttcggtctgggccaggcgcaggctgcggaccttgccgcgcacgtaggcccggtagcacatgtagaagtcgagcaggctgggcagctcgtcgtcgccgctggcgcggacgtaggagtcgacgaacgcccaggccaaatcgccgcgaccgtggtactcgaaatccatggccagaaacgccacttccgaagccaggtcggcgcagcgatagcggggcgcgaactgcagactgtcgaacaacacgatctgaccgtcggcgatgcagacgctggcggcgtgcagatcaccgtgaccgtcgcgcacgtgcccctcggtcacccgccgctcgagcagggcggcctgctggccgacgaattcctggacataggaacggatttcgtcattgatagctggggagatggtgcgcccgatgaacgggcccatctggtcgaaattctcctgccagttcgcgatcacgctggacgggctgccgtacgcctcgatgtcgggaccggtttcggcccggccgtgcagcttggccagggtgcgaccgatccggcgggcgagccgcgtgtcgacatcgccgcccgccagcttggccggcagcatgccgtcttcgggcagccgccgcatccacacggccggctcgcccgacccggcctcgccgccgacccggtagtggccgttctgctcggtgatgtcgacgacgccgaggtacacctgcgggctgaaccgccggttgagccgcagttcctcgtcgcagtcggcgcggcgttgctcgatgctggtgaagtcgaggaagcccaggttcaccggcttcttcagcttgtaggcgtaggggccggcgagtatgacccacgagctgtgcgtctcgtgcaggcgcaggtcgtcggccggcggccggcaaatcgtttttccccgagctgatttcgggtccgttccacgccgggctggtggtggtgttcgtcgcggcggcgctcatgatggtcaccggcgcgttggcatcgctggtcaaccccggccgctatgccgacgacgtcgaggagatctgagcgccgggtagtgttcgtggggcgagactatgacgcacgccttcgaccccaccggacccgacggacagccgcggatcgtcgcggatcttctgcgacccgacgcgtacgaccgtcagtgtcgcggcattgacgccgggttgctgcagtgcgtgcgacggtgcgagcaattcggcgatcgggttgtagcccagaaacgccgcgaacaggctgcccaccggggggcagggcggcggcgtcctgggccaccgccgcggacacgccctgctgttgcagcccgctgctcagcgcgtgcggcagcgtgccggccagcccgacgaccatcagcgagaagaacacgccgatcgacagcgccgagccggcgttgaagaaggtcgaccgaacacccgaggcggctccccggtcccggggcggcacgctcgacatgatcacggcggtgttgggcgccgcgaacaggccgccgcccagcgcgttgaggaaaatcagcagcgcgaacacccggtagtcgaaattgaccgggatcatcagcaacccgatgaacgtgacggccatcagtagcatcccggcgacggcgaacggcctcgcaccgaaccggtccgccaaccaccccgcgaccggcgccgcgatcaggaagccgatcgtcgtcggcagcatgtagatgccggcccacagcggcgtcgattcgaagcggtagccatgcagcggcagccagatgccctgcaaccaaatgatgagcatgaactgcaggccgccgcggccgctcgacgacatgaggttggccaggttgcccatcccgaaccccgccgagcggaatagccggacgttgaccatgggctgcggtgcgcgcaattcgatgaagcagaacacgatcagcagcaacagcccgaaggcgatcgagcccagcacccacgggttcgtccagcccgtcggatggccaccgtagggctgaatgccgtaggtgatgccgaccaggacgacggtcaatcccacgccgaacgtcacggtgccgggccagtccaacgggcccggcgtgcgcacgcccagctcatgcaacgagcgcatgccccacaccgtgcccaggacgccgaccggcaccccgacccagaagatcgcccgccagtcccattccgagagcagccccccgaacagcaggccgaggaacgagccggccaccgcggcgaccatgttgaagccgagtgccatgccgcgctggttgctcgggaacgcgtcggtgaggatggcggccgacaacgccatcaggatggcgccgccgacgccctggaccacgcgccagccgatcagccacacggcgccgccggtgagcgggaacgggtcgaacgacagcgcgatcgccgcgacggtgaacaccgcgaagccggcgttgtagatgcgcacccggccgaacatgtcgccgagtcgcccgacgaacaccaccaggaccgcggtgaccaccaggtagcccatcagcatccacagcagatagccgatgttggccggcgccagcgggttcaatccgatgccgcggaagatggccggcagcgagatcaacacgatcgacgagttgatcatcgccagcagcattcccagggtcgtgttggagagggcaacccacttgtagcgcgggtggtcgcggtcccatcggggcctgcggacattggtttgcttggcgaccagcgtcgggctcgtcgcggcagggctgtcggccatctatatcccggtcatcatcagtcgtcgcctacatcggtccaaaggcattatgttagccatacaaacaaatgcgtttgcaggcgtctctctccggaccgtcagtcgccggttccgacgggcaacagtttgtgcgcgaggtgagcgttgacgacgcggaattcgtgtgcggggcggcgcacgggctcgagggtgccgtcggcgtggacgacggcaccgccgccggaggggattccgacacctagggcggctcgctcgagcgattggatcgcccgcgacagccgcgcccagccggttcgctcgtcgtgcgtgtcgatgaccgcgggcaccaggttgaagacgtcgagcagtcggtgctccgggggtgttccgatgatgccgtagcgcccgagctggaccgcaccggccgaaatgcccaccagcacagtacctttggcgtaccgatcgagaatcgcgtccttcatgccggttctctcgaaggtgttccagccccgctgcacgtcgccgccggccaggacgatcaggtgggcgccgtcgaggaaggcgcggtcggccgggccgaacgacgacgcgatcatgcggcgctcggtgacgccgatcgcctccatcgccggctcgaagatgtcgtagaactcggggcgatcaccgttcgatgcgccgatgtaggctgcgctcagcggcttgtctcttgccaacccgtcgagagccgcctgcacgagcggtcggtcgtgacgcttccagaacagcaactgactgtcggccagcaggtacagcggttgacggtgtggcacagtcacttcggccggacttcggcggagagttcgtcgaagcgggtgagcgcggcatcgaggtcggtgtcgtcgaaggcttcgatacgggtgtagaggtcgccgtcgagtatgccgacgacgatggcccgccattcggcgtcaaacccctgttgcgaggttccacgcgcaacctgtgtgatgaccgctccccggtcgctgagccggtgcaccgcctcgatgtagacgctgaggtccggcatgatttcccacaggctggggaggaatccgggcagaggctcccgctcggtggtcacggtcgtccgatggtcgatgagaaccgaatccgttgtcatgtcaggaagttcgcaccggttggttctggaataggcccgtgtgatcaccgaccaaatgcgcgcatgcgcggcggcttcaccggcaaggtagcgggcgtcgagttcctcgaatgccgcgtcgaagtcgtcggggtcgaacacaatggacgccgtggcttggttgtcgtcgctggcctgcacgacgccgagcgcggcggcttggaatgcctcgggctcgtgttcctggctcgcgaaggcgaaacgaaacagtgccaggtgtgctccgcgggtcgcgatcacggtcgagctgacatcgctcatccaaacatcacccgtggcatgccaattcgccatctcggcgtcgcggccgcgtcgtatgccggcgttcaaggttcgccggcgatcctctgagtagaagtcgtcggcgagtagttctgccatggcgtcccagtcgcgaatcgcgaaatgcgccaggaatagctcgatcagtcggcttgtcacgttttctggtcggggtgccggtcgatgcagctcctcgaagcgggccagcgcgtcgggtaggtctgcctcgtcgaaaagctcgcaacggctgaccagatcaccttcgaacatgacaagggcgacctctcgccactcgacatcggaccggtttcgcaacctgccatgcgccaaatgcgtgacgaccgctcctcgctcggtcattcggtgcacggcaaggatgtgatttttgacgtcttccgcgagatcccaaccagcacgcagatatgcgatcaagccgcccggttcaaacgcggtcgcccgccggtggtcgacgttggcccagtccggagtgtgcgccggcacctcataccggtcgagcgcggcatcgctcgccctgagcagcgaccacgttcgcgcgtaagcagccgcttcacccgtgaggtagcgggcgtcgagttcctcgaatgccgcgtcgatatcgttggggtcgaacacaacccgcgcaagcatccggtcttcggcatcgagttcgaccagaccgagcacctcgctatggaacgcgccgggtccttgctcccggccgaaaaaccgggtacggccaaggaagagacgctggccgcggatcgcgatgacgtccgacgcgatcttcgtgatcccgacctcagcccacgcccgcatgttgttcatatcgacgtcacggccggattgaatccccgcacccaccacgcgacggcgatcgtcgctcgcaaaatcatcagccgtcatgttggccatcgcatcccagtcgcgtgcggcgaagtacgccaggaagcggtcgctgacttcgcttgccgtgttgtgtagtcggggtgcgggtcgatgcagctcctcgaagcgggccagcgcgtcgggtaggtctgcctcgtcgaaaagctcgcaacggctcagcagctctccgtcgaacgtcagaagtccgatctcccgccattcggcctgaaagccgcgtgtcgaggtgccgtgcgacgccatggtgacgacggctccgaggtcgctcaggcgatgcaccgcagcgacgtcgacatggaagtccggtgcgtcgtcgaacacgtcgtggatgtaggaggtcatgtcgcccgcggcgaacgtcgctccccggcggtggtcgatattgacccagtcgggcgatatctcgggaagttcgtgtcggttgatcgcggcgaaggcggccgtcaccagaccccacgtgtgcgcatgggcggcggcgtccccggcgacgtagcgagcattcagatcgtcgaatgcggcctcgatgtcgtctgggtcgtatgcgacgcgtgccaggatccgtttgtcggcggaggtttcgacgatgatgagcatgtcgatgtggaatcctccgggttgctgatcttcaccccggatacaggtccggcagaggactaggcgttcacctcgagtcgcgatgaccgtcgccgtactcctcgtggccccaagaccggcgaaggcgcgcatgttcgcgatttcgacgtcccggccgcgtcgggtctcggcgctcacgactcgtcggtggtcgtcgacagttgtctcggccgtgagaagtctcgccatggcgtcccagtcgcgggcggcaaagcaacttcggaagcgttcgtacgtttggctggccgcgttttcgagccgaccggggtgcgggtgcaattcatcgaacctcgcgatcgcggcgtcgacgtccgcctcgtcgaagacttccaaccggtcgaccagatcgcggtcgaccgtgataacggcgatactgcgccactcggctttaaagccctctcgtgaggtttcgtgcgataccgtactgaacacggctccaaggctgtccagccggtgcacggcctcgacggcgctgctcacatcggatgcgagttgccattcggccagcaatgcgggcagtccaccgggcgggaacgacgacgcatgccggtggtcgatagtgacccaatctgacgtggtcggcggcgtctcgcgccggttgagcgcgtcgtacgcccgcaagattaccgaccaggtgcgcgagtgggccgacgcttcgccagcgacgtagcgcgcgtccagttcggccacggcagcgtcgaagtcgtcggggtcgaaggtagcccaacccgcgatcttctggttggaaccaatctcaagcagccacaacagatccacgtggaatgcttcggtgtccacgtccccgcgcgacacctgtgaccggatgagggcgagacgctcgccacggattgcgatgacgtcagacgtcgcattcgtgacgtcgagatcggcggccgaccggaagtcgttgatctcagcgtcgcggtcctggcggatgcccgcattcaccacccgacgacggtccacggttgaaatgtcgtgagacagcatctccgtcatggcgtcccagtcgcgggctgcgaatttcgcgaggaattgctgaacaactcggctggcaccgttttccagccgcggttccggccgggtgagctcatcgaatctctcgagcgcctcgtcgaggtcggattcgtcgaatacctctacacggctgatcatttcgccgtcgaccgtcatcagatcgacggcccgccactcggcgtcgaaaccgtcatgagaggttccatatcccgcccacgtgaaaaccgccccgacctcggtcacacgatggacggtctcgacgtagaggtcgaggtgttggtcgagctcccatcctgcccggaggaaatcgctcccctcatcgggcccgaatgccacggcccggcgatggtcgagagtgatggcgtccggggtcgccactgccacttcgcgccgattgtgtgcgaccaaggcgccggcgatcgtcgaccaggtgcgcgcgtatggtgccgcttcgccggcgaggtaccgggcatcgagttcggcgatggcgccggtgatgtcatcggggtcgaaagcgatgtgggccccgagtcggttgtcggcgttgatttcgacgatgccgatcatctcggtgtagaacgcctcggggttgcggtcctgctccgaaaagcgaagacgacgcagggcgaggcgttcaccgcggatggcaatgacattcgacgtgacgttcccctgcccgacgaggtcagccatgaccttcaaattcgcgatttcggtgtcccggccccgccgattaccggcgttgagtgcctggcgacgatcatcgagcaagaagtcgtcggccagcgtcgcggccatggcgtcccagtcacgaaccggaaagtgcttccaaaagcgttgatcggcttgacttgccgcgttttgcaggcggggtgccggccgggtgagctgatcgaacctggcaagcgcagcgtcgagggctgattcgtcgaacaattcggagcgggtgatgctttcgccatcgaccatcaggaggtggtggtaccgccactccgcgtcgaccccttctggggaggtcccccgcgcgacgtgtgtgacgagcgcgcccatgtcgttcagccgatgaaccgcgtcgatgtagctggtgaggtcaggcgtgtcgtcccatgccgcgcgcatgtaactgaacaactcacccggtgcgaacgcagtcccgcgccggtggtcgatgctcacacaatccggcgtggtcgggggcggctcgtgccggttgaaagcggcgtagccctccgcaatgacagaccacgtgcgcgcgtgagcggacgcttcgccggcgaggtagcgggtgtcgagcgcggcaatcgccgcatcgaagtcgtcgaggtcgaacgccgccatcgccgcgatccgcccgtcgctgtcgatttcgaccagctgcaggaaatccacgcggaacgcttctgattccttgccgtttcgcgcgtagtgggcacgagcgagggccaggcgcgctccacgggttgcaacggtgtccgatcccgcgtccgtcacgtcgatgtcggcggccgaccggtaatcttcgatcgcggcgtcggggccgcgccggatcccggcgcccaccaccgaacgacgatcgtccccgcaatagtcgtcggtgagaagatcggtgatcgcgtcccagtcgcgggctttgaaataggcgtgcaggcgctcgtatgcgcgtgtcgcgccattctcgagcggcggtcgcggacaccgtttttcgaaccgagcgtaggcggcgtcgagttcggccatcgcggcgtccatgtcttcgacgtcgaaccagacctgtcgcacgacttggctattctcatcgacggcgtaaacctggagaagctcgtcgtgtggcgctccgggactctcgtcgacagcgctcgtgatcatccgagacagagccactcgctcgcctcgcgcggcgaccatgacatggtcgatacgtgtaacgccggcttcgagctcacgcctgacctcacgtcgcatcgcgtcggatgggaagccaacgccgacgatctttcgccgattctcgatcgagacatttggtgcgaatagtcggtcgaactcatcccagtccttgcgatgaacagcggccatcacgcgttcaccgactcgcgtggccgcggtgtcaagttcgacgctgggacttcggggcggggtaggtgcagacgggacggtgtgctcaccgagaagacggcgtgccctctcggcgagtgccgcagcgcccttccgctcgtacaggtcgaccgcccggccggcggcggcgcgcgctcccgcggtctcgcccgcagcgttcaagaccgttgcgagagtgaggcatgcgccgccatgatcgaccaacaggtcggtgtgcccggccacgcttacagcctcttcggccatccgccgggcctcgtcataatcacctcggcgcgacagcaacagcgcccgaagcgcacgccaggcgatcgacgccttcagcgcgtgaccggcgagccgctcgctctccgtgcacaattcgtcggcctcggcttcgcgatcgagcaccagacatgcccgacccagcagtgctgccgtctcggcggtatcggcatccagacccatgcgacgaaaaccgttgtaggccttgcgtagatgcggctcggccgcggcggcatcgtcggcaaccagctcgacaatgccggcgaactgctcgacctcgaggagggcgtggcgcaggccgagttcggtgacggtgcgccgcgccgagtcgatcatccgacgcgccgccgcggcccgcccgcggaaggcctccaacacggcctggcaccgcgtcgacgtggcttcgaccgcgggcgagtcggtcgtgatccggagcagtcgcaccacgtcaaggcaccggccgcccgcgcgcggaacaggattcgggccccacagcgccgcgagcggcgcattcgccaaaaccgcgttcacccggcgatgttcgcgggcacggcgcgccgcggtgagggcattgtccagcgcgatctcgcagtcaccgattcgcccgagacgcgccaggcatccggcgcggacggtgtgcgccgtggcctctccggcggcatcgtccaattcggccagcctggcggcggccgcgccgaccgcggcctcgacctcgtcgagtcgttcgggatggctcaatattgacagctgcccgtcaaagcacgtagcccatgcgctcagccgagctgaatcgaccgttgcgctttgcaattgggaaacggcgcccactgccgaaccgacgtcgccggcggcgagcagtgcctcgcagcgcgcgatcaacagctcggtgacctggtcgtcacggtcgggcagttcgtcgtcgatctcctcgagcgcgtgcagcgcccgatcgtagaggtcggcggcgccctcgtagccgagccgggtcatcgcctggtcggccgcgcgccggcaatactgcacggccttggccgcattcccggcccaggcacattcgaagtagtggtgcgccagttcggccagcagctcgtcctcggcgccgggctggttctccagggtcgtggcgatgcgctggtgcagccgcatgcgccgcaccgacgacagctcggccagcagcgactgccggacgatggcgtggttgaaacgataacggccgccgggctcttcgatgacgatgcccgcctggcatgcctcgtcgaaggcgtcgacctgatcctcgccgaccacgctttcgacgagttccagagcgaaccggctgccgatgaccgcggccgtggcgagggccttgttcgtctccggcgacagccgggacaggcggcggcttacggcctcgcgcaccccctgcggcagggtgctctggtcccagcggccgccgctttcgtccacatgatgcagagcctggatgaggaagaacggattgccgcccgtgaccgacgccagcgcccgggccagctcgtcgtcgtcataaccggcctcggcgacgtacgcggcgacgtcctgctcatcaagtccgttgagctgcaagcgattcgaaggctcgaaaccggcgctgcggtgcaggtcggcgagcatggccgccagcggatgggagcggtcgaggtcggtgctgcggtaggtgccgacaacttgcacccgggcatgctcgccgaaccgcagcagatgccgtaacagcagcagcgtcggcttggccgcccagtgcagatcgtcgagcaccagcaccaccggcgcaccggccgagacggccgccaacagcgcgacgaccgcgtcgaaaagcgcgtagcgctcggtgtcgggatcggcgcgcgtcggcgtgggcaggtcgggcagcacgtcggtgagcccgggaaccagcggaagcagcgcctccacaccccgaagcccgcgcagccggtcggggcccaggcacggcaccagcatccgcagcgcttcggcgaacggctgatacggcgcaccgagatcctcgtcgcagcgcccgtacagcacgaccgccccctgttcatagacccgccgcgaccattcgcccgccagccgggtcttgcccacacccggttcgccggcgatcagcacggcctgcatgtcaccggcgagcgtgctctgccacgccgagagaagcccgtcgagctcgcggccgcgaccgacgaacggccccggaccgagcagcaccgcgggcaagccgggtcgctccatcggcgcggcgctcggctgcaccgggggagccgcttgggcgccggtttccaggcgcagctcgaaaacatgctccggacggggcaggttgcgcagctggcgcattcccagatcggtgagcacgacgtcgtcgggcagcgtgtcgatcacgagttcggcggtggcgcccgagcacaggatctggccacccgccgccagtgacctcaaccgcgcggcgcggttgaccgcgcggccgaagtagtcgccgtcgcgcagctcggcttcgccggtgtgcagcgccacgcggatgcgcatgggttcccgtaacgcccacggctcgtggccgatcgcgtcctgcaattcgacggcggccgcggcgcccgccgacggccgatcgaagaccgaaaacgtcgcatcgccctcgccgcgcgtcttgatcagccgtccgccgcgcgacgtgacgacctgttcgacgagctcgtcgtgccgcgccagcgccaccgccatggcggcggcgtctgcctcccaggccgcggtggagccctcgatgtcggtgagcaggaacgtcaccgcgcgcgtcaccgacgaaagattctgcaccacaaggacatccagggaggtatcctgcgcgacgatcgcgctctcgagccggcgaagctccggccccggatcgacgcccaactcgtcggccagctgcgcgcgcgccccctggtacgcgccgagggcctcaccctgcctgccggcccggtagagcgcgagcatcagttggccccaacgtctttcgcgcagcggcgcctcggccaccgcggcctccagctcaccgatgatctcggccgcgcggccggtggccagcagcgcgtcggcccgatcctccaccagcgcggcgtgaccctcgatccaccgcgtcttctccgaggtgccccgccggccgtcgggcaactcggggattccgcgccacagggccagcgcctcgtcgaagcaggccaccgctcggccgttgtcgccggccgcggcggcgtcgcgtccgcggcgggcggccaccttgtatcgcgcggcgtcgacgtcggcgtcggccaggatccaacccgcgccctgcgtcagcacgacaccgtcacccaggatgcgacggagcgaggagatgtgcgtttgcagcgccttggccgcggtgcgcggcggttcctcgccccacagcagctccatgagggcgtcggccgagaccagggcgccaccgtgcaggccgagcatggtgaggacggcgcggggtttggcgcccggaatcgcgaccggcgtgccgtgccgccggacctggagaggccccaaaacccccagctccaccggtaaaagggtactcatctcgatgatcgtcggcggcgcaattcaatacctggtcaagatccggtaaagccgccggtgacctgcccggatggcgcccgaacggctaaggcgccgtacggtgaccggcgctggccgcatggtgccgggaggtgcggcaccgacatggccgcgcacccgaccgtttactttggtatccatggacagcgaccgggatgactccgccgccatccggcgggaccggcgcgaactggaccgcatgcacacccagctcgacgagctgatggctgcgcgcgaccagctggaacaactggtgcgggtcatcgtcgaaatcggctccgatctggacttggacgtcacgctgcgtcgcgtcctgaaagcggcgatggagctgaccggcgcccgctacgccgtgctctcttcccgcgcctccgacggcgcactcctctcgttcgtgcatgccggcctcgacgcggacacggcccggcagctcggcgagctcgcggtgggcgacggtcttcgcatcgacgatgtgagcgttgatgcgcgcagcgcccacctgtcggcacacgacccaccgctgcgggcgctgctgggaataccgatcacggtgcgggcagccaactttggcaacctctatctggcggacgaccggcaagggcgcgtgttcaccgactcgcaggaaggcgcggtgcgcgccatggccacggcggcagccgccgccatcgacaacgcgcgactcttcgagcgcgagcgtgaatcggcgaaatggacgaaggccagtcgcgagatcaccaccgcgctgctgtccggtgatccgcagacgggtccgttgcagctcattgtgaaccgggcgctggagctggccggcgccgagcaggcgatcttgctggtcccgcgagagcccgagtcgcccggccgggaggccgacaccctggtggtgtccgccaccgcgggccgctatgcctcgcaggtgatcggccggcaggttccgatggacggctcgaccaccggcggtgtcgcgcggcgcggcctgccgttgattaccgactccttccaatacccgatcgagggattcaccgacgtcggcgaacgctcggcgatcgtgataccgctgattgccgacggcgcggtgctcggcgtcatcgccgtcgcgcgcgacccgcagcagccgccgttcggcaacgactacctcgacctggtcagtgacttcgcccggcacgccgccatcgccttggcgctggcggcgggccgccaacacgcgctcaatcaggaactggcccaagcggatacggtcgacgaggcggtacgcgccgcggctgaagaactgcgccggctgtggcgcgcccgccgggtgctggccgtcaccttcccaagccacacctctgctacggaaacggcgttcggcccgcccgaggtcgtttcggtcggcgagcccacgcagtgggccgatctgccgtcgcacatgcaccaggcgctcggcgcgttgcgcgacggcgacctgctcaccccgaacaccacgcagcccgggacggcgggcatcgccctgcagcatcccgacggcgtgctggtcgtctggatcgacctgaccgatgagcgttcgttcaccttggaagaccagaccctgctcaccgtgctggccggccgcctcggccagggcctgcaacgggtgcaccaggtcgaccagcagcgcgaaaccgcactggctctgcagcacgcgatcctcggtcccgccgatctgcccaacggattcgcggtgcgctatcaggccgccacccggccgttgcaggtcggtggtgactggttcgacatcgtcgacctcgaggacgggcgggtcgcgttggtcgtcggcgactgtgtcggccatgggctcgcgtccgccacggtgatgggtcaggtgcgcagcgcctgccgcgccctgctgctcgaaaacccaagtcctgctgcggctctcgcgggtctggaccgattcgcggcgcggctgcccggcgcgcaatgcaccaccgccgtgtgcgcggtgctcaccccggacaccggtgaactggtctactccagcgccgggcacccgccgcccatcgtggtgcacggcgacggcagcacccagatactcgacgagggccacaccatcgcattgggcatccgacgggactggccccgcccggaggcccgggtgaccataccggcgcgcgcgaccctgctgttgtacaccgacgggctggtcgaacgtcgccgcagcccgctggatcggggtatctaccgcgtcgccaccgtcgcgcaggatgcgcgcggctcgtccctcgacgagttggcgacccggatcatgtccgccgtcgcgccgagcggcggctaccaggacgacgtggtgttgctgctgtaccggcatccggcgccgctggagctgaacttccccgccgacgtcaaccagctggcgcccactcgcaccgcgttgcgcaactggctgcgccgtgtccggctggacccggagcagacgttgaacgtactggtcgccgccggggaggcggtcgccaacgccatcgagcacggacaccggcacagcccgcagggcacaattcgactgggcgccaccgcgttaggcgatcaggtccggttgacgatcaccgacaccggcacatggaaggttccccaagcgacgtcctatccgcatcgggggcggggcatcccgttgatgaaaagcctgatgaacgatgtcgacattcggtccgacaccggcggaaccaccgtccagctctccgcaaggatcacctgatggtcaccccgctgacgctggacaccggccgtggtagcgacggcaacccggtgctggtggcagtgggcgaaatcgacctgagcaacatcgacgcattccaccgggcgctggccaccgccaccgcggaggtcaccgggagtgacggcgcggtgctcgtcgacctcagcgccgtggagtatgtggacagcgccgccatcaatgcgttggccgcgcacgccgaccacatcgcgctcgtcgcgcacccggtcctgatgcccgtcttcagggtcagcggtttgaccgagctgaccaccgtcgaagccgcacccccgccgccggcgcctcgttgaaacatgttgcagcgcaaggcggccgcgaatccgccaagcccgcgagcgccgtgtgaattgccgcggcccgagcgggattcggtctactcggtcgtcatcgggcggaccaccggacgatcgttcggcccgccaatccggcccgcggacaggtcgtttgccgcacaatgaggtccgcgggtccgacctacgacgagtcatcaccgcccgcccggacgacgaagtggagtcggcgatgagagatcacctgcggcgctgcctggtcggcgcgttcgccctcgtgtcgatcgggttgccggcgacggcgctcgcgtccccggagatcagccgcgccgacggggactgcgccccgggctggggctggagcgtcgaactgaatcaatgcgtgttcctgctgccggccgcgaacggacccggcggacccgggggaccgggagggcccggtggaccgggcggacccggcggacctggagggccgggcgggcccggcggaccgggcgggcccggcggacccggagggcccggcgccccggggcatcccggcccgcactgataccgtcacccagctgcggcaacgccaccccggaccagcgaaatagctggtcggcggcgcgtgggaactcatcgcgcccgccggtcgttatatcagctaagtaaccggtgatttcgagggggtaatagccgcatgccacgcacagacaacgacacctgggacctttccaccagtgtgggcgccaccgccacgatggtggccgccgcacgcgccatcgcgaccaacgccgacaaccctctgatcgaggaccgattcgccgaaccgctggttcgcgccgtcggggtggacttcttcacccgctgggtcaccggcgacctcgtcgccgccgacgtcgacgaccacgactccggttggaagctcgagcacatgcccgtggcgatggccgcccgtacccgcttcttcgactccttcttccaggccgcgacgcaggccgggatccggcaggcggtgattctggcctccggcctcgacgcgcgcgcctaccggttggcctggccggccggtacgacggtgttcgagatcgaccaacctcaggtgatcgaattcaagaccgccacgctggcaaagctgggcgcgaccccgcaggccacactgcgcaccgtcgccgtcgacctgcgcgatgactggccaaaagccttggtggaagcgggttttgacaagggccagcccaccgcatggatcgccgaggggctgttcggctatctgccgccggaggcccaggaccgcctgctggacaacatcaccgcactcagcgccgacggcagccggctggcgtgcgaagctattccggacatgtcagaggtagacaccgagaaggctcaagagatgatgcgcagggccaccgcgaaatggcgggagcacggcttcgacctggaattcggcgatctggggtatcagggcgagcgcaacgatgtcgccgagtacctggacggcctgggctggcggtcggtcggcgttccgatgagtcagctgttggccgacgccggactcgaggcgatcccgcagaccaacgactccgtgtcggtggccgataccatctactacagctcggtgctggcaaaatgaccgcaccgcagcggcgagggctgaacgacgtcgtcacgcggatgtggagcttcctggcgccggcgtatgacctgcccttcctgcagcagtgggtgtaccggcctccgcacaacgaggtgatagcccagctacgcaaccacggttcgcgcagaatcgccgacatcgcttgcggcacagggatactcagcgagcggatccagcgcgaactgaatcccgacgagatctacggcgtggacatgtccgacggcatgctcaaccaggcgcgggcgaaatcggaccgggtgcagtggttgcgtgcgccggccgaacagctcccgtttgacgacggtgcgctcgacgccatcgtgacgacgtcggcgttccacttcttcgaccagccggcggcgttgcgggaattccatcgcgtgctggcccccggggggttggtggccgtctcggcgctcagtacccggcgaccgctgctgcaggcatccgccgacagcaggtggaagccgcagcacaacgcgtcggctcccgagatgcgcaagctgttcgaggacgcggggttcgtgatcggcgatcagtatcggatcccgcggccggcctggacgcgcctggtttctgacctgctgaccgtcggcaccaaacccgactagtgatgccgggacgaaatgcgttcgccggcaacggcataactgacgacgcccgcctcacctgatcggcgaggcgggcgtcgtttcagctatggctcacagcgggatccacactccgaagaaccagaagccccactgattgaacccgggatcccagacgggagtctcctggtagccccagtagttgatcgggccgtaatcccagtgcccgcctggcggagggagcggtcgatcccacgccggacgcggtggttcacccggtccccagggggcgggtccgtcgccccacggggcgccgtggaagtagccacgttgggagtccccatgccagggaccacccgggccgccggggtgatcgggcccgcccggcccaccggggcggccggggtgatcgggaccgccaggtccacctggtccaccagggccaccgggatgaccggggccgccgggaccgccaggcggcccaccgggcccacccggcccgccgggaccgcccggtccgcccgggtcattggggccggtcggatggtggaaatctccgggctgcgacccgccatggccgggaccgccggcgggaggggcgccatgcccgccaggaggcggcggtgccccgggagcggcgccggcgaacccggcgcccattcccaacgcggcggcgccgagcgccccggcgatgcccacccctccgacaaattgcttcaacctcacgatgcttcacctatccactcggtccactcgggatctctgcgaaaggggaattcctcgaacgccccccgacaccacccagacactagatagcttccctatggaccagctgtgtcccgcccatgcaaaggtttgatcccggtcaaccggcacccgcgagcgctggtttggcaaggctatgttggctagtcgcgcacggttttcgtctatatcgttgccgccgtgtcgagtacgccacacccggccgaaccccacatcggttcggtgtcgtcgaagttgaattggctgcgcgccggcgttctgggcgccaacgatggaatcgtctccaccgcaggcattgtcgtgggcgtcgccgcggccacggcgctgcgcgctcccatcctgactgccggcagcgccggactggtggccggggcggtgtcgatggcgctgggcgaatacgtctcggtcagcacccagcgcgataccgagaaggcgctgctgatccaggagcatcaggagctgcgtgacgatccggccgccgaactcgacgagctcgccgcgctctacgaagccaagggtctgaccgcggcgacggcgcgtaccgtggccgaggaactcaccgatcagaatccgctgctggcccatgccgaggtcgagctgggcatcaatcccgaggagctgacgaatccgtggcatgccgcgtcgtcctcggcgctctcgttcgccatcggcgcgttgctcccgttgatcgcgattctgctgccgccgccgacgtggcggattccggtcaccgtcgtggcggtgctcatcgcgctggtgatcaccggcgcggtatcggcccgcctcggtggcgcgccgcagcttcgcgccgtggcgcgtaacgccatcggaggcagcctcgcactggcggtcacctacacgatcggccacgtggtcggcgccgcgatcgactgaccacgccggcgcatcgggccgactggaagcgcaactgtaagatccacggttgcggtcctcagcagaggccgcacaacccgtcgcgtgaagggtcatgcagtggccgaacccaatgtcgttcccgatcaacctcgctgggctgacgggctgccgtatttcgtgcgcgacggaaacgatttggtaccaaccgaaatcgcgcgcggcggatgggggccatcgctcagcggccatgtcgtcggcggactcttggcgtgggccgtcgagcaagccgcccccgacgccggcctgcaaccggcccggttgaccgtcgacttgccccggccgacggcgctggaaccactccgggtgcacactcaggtgcgccacgaccggcggcggttatggctggtcgaggccgtcatcagccaaaacgacgccgtcgtggcgcaggcgagcgcgctgtttctgcgccgcggcccgcagcccgacgggcgggtctggtcacccccggtgcagatgccgccgctcccgccggaccagacctactcgacgcttttcatgcgcacctacggctggggctcgcaggtgcagaaccccgatcctcactggccgcagaccgacggcccgaaatacacctggatacacgagacgcgcccactgatcgacgacgagccgctcagcgcattcacccgcgcggcgatggccggtgacatcaccgcgtcgatcgccaactggggcagcaaggcactgcagttcatcaacgccgactacacgctcacgctgagccggttgcccgagggcgaccacatcgggctcgcctcgctcacccaccacagccacgacggcgttgccagcggctcggccgtcctggtcgacaccgcgggcccgatcggcaccggactgtcggttgccatcgcgcactcgggatttcgtccgccgtccgccgacccgtcggcggggtgagttccggtgacgttctggtcgctgattgccgaggccgcacgacgcggctcaccccggccacttctcgccgacgagcacggtcgcagcatgaccgcacgtcagctctacgacgccgcatgcgtcgccgcggccgcgctggccgagcggggagtccgccggggcgccgtcgtgtcctggcagttgcccaccacgctggagaccatggtgctgatggccgcgctggcccggctcggtgcggtgcagaacccgatcatcccggtcctgcgggaaagcgaagtccgcttcatcaccggccagctgaacactgaatactttgtggcgcctgggctttggcgcggcttcgatcacggtgggctggctcgggcactgtcggccgaacggggcttcgaggtcatcaccgtcgacctggcggcgccgccggccgccggtgcgctgcgcctgcccggcgccgatcccgattccctgccggcgccgccgcaatccgccgacgaggcgcgctggatctactactcgtcggggaccaccgccgctcccaaggggattcgccataccgacagctcggtcatcgccggctcggcgggagtggtcggcatggtgggggccaccagcagcgacgtcgatccgatcgcctttccggtcgcacacatcggcggggccgcgatgctggccaccgcactgctgaccggcatgtggttagtgctgttcgaggctttcgacccggccgccactccgctggccatcgccgcacacaatccgacgttcctgggcaccgcgacgcccttcttcgtcgcctatctcgaagcccaacgggcccaagggaatcggccactgttcccgtcgctgcgcggatgcctggccggaggcgcacccatcaccgccgagttgagtcgacgggtccgcgacaccttcggggtggccggcatcgccaacgcctggggaatgaccgagttcccctgcgcgacatccccgtcgctgaccgcggcacccgaggtgctcgaccataccgtggggccgccggtgcccggcgtcgaagtccgcgtggtcgacggcgcagagaatgaactggctgccgggcaggagggcgagctgcggctcaagggaccccagtgcttcctcggctacgccgacccaacgctggacgccgacgccttcgacgaccagggctggctgcgcaccggcgatctcggcctgatcgacgccgacggcaacgtccgcgtcacgggccgcaccaaagacgcgatcatccgcaatgcggagaacatctcggccctcgagatcgagaacgcacttgcggcgcatcccgccgtcgccgacgtcgccgtcatcgggatccccgacccgcgcaccggcgaacgggtctgcgccgtcgtggtacccgcgacggccgacggcgtcacgctggaatcccttgtgcaacactgccgatcacgcgggctgagccgctacaaacaccccgagcgcctggtcgtcgtcgacaccctcccgcgcaaccagttcggcaaggtgatcaagaaggacctgcgcgacgccttcgggtgaagccggacgcctgggcccggcacgcctattcgcgcggatgtaacgccacggcgagatttcgcccggatttccgccgtggcgttacgagcgcggacagacacggacgggcgcggacgtgcgcggacggctagaggcccttgggggcgtcgcggaccgcctgcaccgccgccgcgtcaccctcgaagtcgacccgggcggctcgccccacggcgaacagcagcagctcctcgggcgccccggtcaccgtgaccgccgggccccgcccggcggtgagcacggtcttgccctccggggtgcgcaacgccacccgggcgggcactttggccagggtgagccgggccatcagcggcagggcgcgtcgcagcgtgcgggccagcgccggctccagcgcacgcggcgtccaatccgtctgggcgcgtcgtacatcctcgtggtggatgaacatctcgcccacattggcgaccgggtccagcaacttgaacggggagtagaccggcgggccggcggcgaccttgtccagcaactcgtcccagtcgttctgctcagtgacctggctctgcaccttggcggtgtgcgaggccaagaacgggatcatgatgcccggcgtcgcgtcgggccgatactcccggatcaccaggtgcgcggccaggtcccgcgtcgtccagccctcgcacagggtgggcgcatccgggccgacgccacgcagagtttccaccagggcggcgcgttcccgtcgagcaacagacatgggttcagcgtagggccagcccccgggcggcgaccatcgattactcggtaaatttgaaacgtcaagttgtcgaaggggaatgccatgaacgcgcgcgtcgagcagttggagtttcaagccgaggctcggcaactgctggatctgatggtccactccgtctactccaacaaggactcgttcctgcgggagttgatctcgaacgcttccgacgcactggacaagctgcggctggaagccttccgcaacaaggacctcgacgtcgacacctccgacctgcacatccagatcgaggtggacaaggatgcgcgcaccctgaccatccgcgacaacggcatcggcatgacccgcgccgaggtggtcgacctgatcggcaccctggccaagtcgggcaccgccgaattgcgccaacaactccgggaagccaagaacgcccagaacgaagccgcctcagaggaactcatcggccagttcggcatcggcttctactccagcttcatggtggccgacaaggtcgaactgctcacccgcaaggccggcgagagcgaggccaccaaatgggagtcgagcggcgagggcacctacaccatcgaatcggtcgagaacgccccgcagggaacctcggtcaccctgcatctgaagcccgaggacaccgaggacgagctgcacgactacacctcggagttcaagatcaagagcctggtcaagaagtactccgacttcatcgcctggcccatccggatggaggtggagcggcgcacgcccgccaccgaagagggcggcgaggagaccgtcacccgggaggtcgagaccctcaactcgatgaaggccctgtgggcccggcccaaggacgaggtctccgaggaggagtacaaggagttctacaagcacatcgcgcacgcctgggacgacccgctcgaggtcatcgcgatgaaggccgagggcaccttcgagtaccaggcgctgctgttcatcccgtcccacgccccgttcgacctgttcaaccgggacgcgcacaccggcatccagctctacgtcaagcgggtgttcatcatgggtgactgcgaccagctgatgcccgaatacctgcgcttcgtcaagggtgtcgttgacgcacaggacatgtcgctcaacgtgtcccgcgagatcctgcaacaggaccggcagatcaaggccatccggcggcggctgaccaagaaggttctgtccaccatcaaggagttgcaatccgagcggctcgacgactaccggaccttctggactcagttcggccgggtggtcaaggagggtctgctgtcggacttcgacaaccaggagacgctggtgcagctctgctccttcgcctcgacgcacagcgaggaggaggccaccacgctggcccagtacgtcgagcggatgaaggaagggcagacgcagatcttctacgccaccggcgaaacgcgccagcagatcctcaagtcgccgcatctggaggcgttcaaggccaagggctacgaggtgctgctgctcaccgacccggtcgacgaggtctgggtgggaaccgtcaccgagttcgacggcaagccgctgcagtcaatcgccaagggcgaggtggacctgagcgccgagggcgaggagagccaggccgagcgggatgagcagcagaaggaattcgccgatctgctcgcctggctgaaggacaccctgtccgaccacgtcaaggaggtccggctgtccaaccgactgaccgactcgccggcctgcctgatcaccgacgccttcggcatcacaccggcgctggcccggctctaccgcgcctccgggcaggacattccggtgggcaagcgaatactggaactcaatcccaagcacccactggtcaccggcctgcgccaagcccaccaggaccgcgccgacgatccgtccgtcgccgagaccgcggaattgctttacggcacagcgcttctggccgagggcggcgccctcgacgacccggcccggttcgccgagatactggccgaccggttggcccgcaccctgtagccccgggccgccgcagcaaatcggcgaattcggggattgaaaagcgccgggcagggatacttaagtcccatggccgagttccgcgtgatcgacccgcacgggcgggtggtcgcgacgcagaatttcgccgccgccgaggccgcacacgcctggttcgtccactcggtcggcggcaacaccgagctgggttggcggatggaggtcaacgacgacgggcagtgggcgttcttcgatgacaccgagggcttcaccgccccggtgagtcgacggcccgaacggcgctgaatccggctcccggagaccgaacatgatgggcgccaacctgattgggtgacccaccgccgccgtcgcgagacggccgtgacgcgccgcgtacgctcccaccatgcacgtcgacgcgatgaccgttctgcagccgctcggccagatcggcgaccttgcccggcgaacccaatccgccgggttctccgggctgttgttcaccgagacgggccgcaccgcctacctgaacgccgccgtggcgtcgcaggccgcgcccgggctcgagctgtccaccggcgtcgcggtggcattcccgcgcagccccttcgtcaccgccgcggtggcgtgggaactgcaggaagccaccgagggccgcttccggctggggttgggtacccaggtgcgcacccacgtggttcggcgctacggcgcggccttcgagcggcccggcccccggctgcgcgactacctgctcgccgtcaaggcgtgcttcgcggcgtttcggtccggcacgctcgagcaccacggcgacttctacgacctcgacttcatcaccccgcagtggagcccgggacccatcgacgcgcccgaccccaaagtcgatatcgccgcggtgaatccgtggatgctgcggatggcgggcgaagtggccgacggcgtgcacgtccatccgatcggcgaaccgggctacctcgcccgtcacgtcctgccgacggtcgccgagggcgcggccaaggcgggacgctcaccgtcggacatcgcgatcatcgtgccggtaatgacgatcgtcggggacaacgacgaggaacgcgaccaacagcgcgaagccgtgcgcgccagcatggccttctacggcagcacgccgaactacgcgttcatctgggacgaagccgggttcgagggcaccaccgcccgcatccgcgagaagcagaaggccggtgactacgccgggatggccgcccaggtcagcgacgaccacatcgccgtcttcgccaccgagtcgacgtgggacgggttggccgacgcgctgatcgagaaatattccggcaccgcaacacgtctggtcatgtacaactcggcggccgacccggagcgcttcgagcggtacggcgaggtggcccgccggatacagcacgcggtcagcggctgagctgaatcgccttgaccaccagcagcaacgcgccgacgaccaggtagccgcgcagggcgatcatggccagccgcgttccgggcgaccaggtgaccggctcgagcagcgccagcggcggcatccgccaggtgctgcggtcgacgccccgcgccggaagccgcgggccgggtcgcgcgggctgacgacgggccagccagcgcagcaccggggccgcaccggccgccaggatgatcaacgccagcgtcagatagccggcgacggcgacgacgttgaggtcggggaacaaggtggtggccatcaagatcccggacagcagcagcaaagtgccgacgatcaatccggcgacccagttcagccaggcgcgattgacccacggccccaacacttctcggtcattgcacagcaacagcagaaagacgctggcgctgggcagcagcagaccggcgagggcctgcaccgcggtggtgatcaaccccagcggggcgcccgggatcagcacgatggccgcggccaccaccaccatcgcggtgtaggacagatagaactgtttggcgtcggcgaagccgcgatgcagcgaatgcttcagcccgaacacgtcaccgaaggcgtagctggtggccagggtgaccgcggcggcgccgatgatcgaggcgtccatcagcacgatggcgaagatcgagccgagcacctgacggtgttgacccagcaggtgcgcggtcgcgccggcgtcggtgaagccgcccacggtgtcggtggagcgggctgcccagtcaccggtcatcaccagcgccgcggcgccgatcaccacgacgaacgcgcccagcacggtgtccgcgcgctcgtaacccatgaaccggggcgtgatgcgcttgtcgaccacattggactgctggaagaacaactgccacggcgccaccgtggtgcccacgatggcgatgatcagcagcaccgcgtctgagctgaccccacccgaaatgctgggcaccacaaaggacttcgcggcgcgtccccactgcgggtgcgacatcagcagcatcgggatctgcagcagggtgatcgcgatgaaaatgaacatggcccgctcccaccggcggaagctgccgctggccatgatcgccaccagcgccgccgccgacaccggcaccacgacgtatttcgagacgccgatgtactcggcggccaggctgatgccgatgaactcggtgacgatggtcaagaaattgagcaagaacaggtcgccgaccgagaaccagccccagccccggccgaagcgctcgttgatcagccgcgcgtgccccaccccggtgaccgcgccgaggcgcaccaccatctcctggttgacgatgagcacgggtaccagcagcagcaacacccacagcagcgagtagccgtagttctggccggcttgggcgtaggtggccaccccgcccgcgtcgttgtcgccgaccatcacgatgatgcccgggccgacgatggcgagcagggtcagcagccgcgtcttccaggttcgggcgtgttcggtctcgccgacccggatgcggccgaacgcgccctcgatgtcgcccaaatgcgcgctgtcgagcactgccgcgccccggggttccaccggctcggcgcggcgggtgttctcgccggctgagctcacggtgcgttacctccgggcagcgggcggtcctcagcggtggtgatttcgcgaatcgggcggggcgcgggctctcggcggcgccagtcttcggggatggtggcctccagcacgtcgtcgacggtcaccacgccgagcaggtggtcctgctcgtcgacgacggggatcgagtagaggttgaaatcggccatcagcaacgcgatgtcggtcaggtcggcgtcggcgttgacccgcaccggatcggaatccatcagccgctcaagggtttcggagggatcgacctgtagcagggtgatcacccaaacgacgccgtcgagccggcggtcctcgtcgagcacgtgcaccttgatcagcgcctcgggctgaatgctgtgcgaggaggcgatcaacgccagcgcctcggccgccgtggcgctggccgcgcaggagaccgagtcgacgttcatcagcccgccggcgctttcggggttgaaacccatcaacgtgatgaccttggtgcgttgcggggcgggcatcaggtcgagcacgcggcggcgccgcgactggcgcagatcgacgatcgcgtcggcggcgtcgtcggcgcgcatccgccccagcaacgcggcgacctcgtcatcgggcatctcgtcgagcagccggctggccttctccgggtccagctcttcgaagacgtcggcttccagttcggggtcgctgtgcacccggtccaggatctcgccgccctcggccttgtcggcttcttccagcaggtccgcgatctcggcggccttgagctcgccgaaccggtccgacagccggcgcaccgcatcggagcgggcgtggccgatcagcggctcgaacgccttccagtcgcgcgacgcgtggcccccggagtgcttgatcagcccgaacaaccggggcggacggcgggtgtccagccgggcgaccatccagccggcggtggtctgctcgagttcgatgtcgtaggcgcgcaccagctcgacggtggccacgtcgatcagccggtggcccaacacgtcggtgcgcaacaacacctcgccttcccggcgttcgaagccgcgaaggtcaatcttgttcttggtcaacaggactcgatccgcggagtattcgtgaatcgatttgtcgccgacgaacacccgccgcccgccgacgccggccacgatcccggtcaccagcgggtactcgtcggctccgcgcagccgcacgatcacgtcctcgacccggcccaccgtttcgcccgagcgcgccagcaccggcgcccgcagcagttgcgagagatggatgaccggctgcccgggggccttgtcctccgatgtgcccacgtatccctcctcaaggcggtacgaccgaacccgccgacaacctacccctaatccaggccgtgctggcggctaccgcgtcaatgtggccgggccgacagagcgtacgccgcggtcgcggtggatggccaccaccaataggtaaacggcagaaggctattggggtcgccgctactgtttgtcgacctttccggcgatctgtttggcaatgtcgatgccgaggtcgccgacgtccttgcggcacgcgtcgacgtcgatgacgacgttgttgcgggcggtcagcgcacgctgacagggcatcgtcacgttcacgccgttgccgttgacggtcacggtcacctgggtgctcagcatcccgttggcgttggttaccggccccaccttccaacgcagttccgggttggtgccgtcggcgggaaccgtgtcctggcgattggcgcacgcgggccaacgcgcagacgaggcggacaggaaggcgctcgcctgctcgggggagggaaacaacacgacaaattggtacacctcagggctttccagttgattggcgcccgcgggggtgggcgccaggtcgtggtagccgtagaccgcggtgctgccgctgccggcgtattcggatgccaggccggcgtgcgtggtgtatttgcattcggcggggaatgtgtaatcggtgcgccggacggggtcttctccgagcgcggtgaacgggggatcgctcgtcgtcccggtcacgcccagcgcggtgtcgatgtcgttggggctgagcatcaggtcgggcagcgcggcccgagccagcggcgtcttgggtgaggccgtgctgccggtggccgtcgacgagggggcggcgccgtgattgccggcgccgcagccggcgacgagcattccggtggcggcgagtgttgcggctaatcggcgcacagttcagtgcccttcccgcgcgagtcggctgcccatttttcggagcttacgacagcaggacggtgccaactgcgaattcgcgacagctgcgcccggttggacgatgctgaaccacgggctatgttcgccgggtgtctgttgtgcagttcacctcggtgtcgccgatcgtcccggtccgagacctcgatgtcgccctggaccggtatcgccggctcggattcgacgcgcgggcataccagggccccgagcggtacggtttcgccgaccgcggatcggtgtcgatccacctgaccgaatgggacgagcacgacccgtcgcgcacggcggccagcgtctacttctacgtcggtgacgccgacgccctgtatgcggagtgggcggcgttggacaacctcggcgggcgcctgttggctccgcacgacacaccgtacggtttgcgcgaattcgcctacgtggaccccgacggcaccgcgcaccgggtcggctcgccgcgcagctgatcacgtcttttccgttgagaacggcggagtttcgtcagctgttggggccgatgcggcctggctgcgggccagcgccaccgtcgcggccgccatcaccgccaccgagatgcccagtgccaccaggccaatgccgttggtccgcaacgtttcaccgagcacggtgacgccgagcaccgacccgatgaccggctcggcgacggtcaccgccggaagcgacgccgtcagcgggccggcccggaacgccgactgctcccaggcggtggccgcgatggccagcagcacccacacatacagctcgggtgtgcgcagcaatgccgggatgccgcggtcgagttggtcgaccacgcccttggtcagcaccgcaaacaggccccacagcgaaccggacatcaggccgagcaacaacgcggcgaccgggccgggatacaggcgtgcgccgagcacgcacccaaccagcgccggccccatgaccagtgccacgatcgtccacgtctgcagcgatccccgcggggttccctcctgcgggtcgcccaccgtgaccaccaccgcgacggcggcggccagcagtagcgcccaaaccgcttgccgcccagtgattctgcggtggttcacccgcgcgctgatcagcagggcgaacagcaacgacgtcaccaacagcgcctgcaccagtaccaccgagccgaaacccagcgctgcagcctgaaagccgaatccgccggcggccaccaggcttccggtccaccagcgccggtcccgcagcagccggcgaaacagcgcgacggtgccgaccggttgatccgtgacctgctgagccgattgctgttgggcgacgtcgcccgcgcccaccatgagggcggccgcgaccgcgagcaccgtcgcgatgtccgttctgcccactagctctcttccgtgtgtatcgacgccggcaacccgagtcttcgcgccgaggctcagctgttgcgccgaatcctgagcgccgtggtgatcatcggaatctgcagcggcagccgggccagggcggcgatccgcatcggccacggcttgtcccaccacaaccggaccatgttcaggttgcccggaaagacgccgatgaacaggatcgcggcggccagcgcggcggcccgtcgggtgcgtcgcggcaccagcagcgccccgaccgtcagctcggccacccccgagccgtaggtgtagagccttgggctgccgggcagttcggcgggaatgatggagtcgaacggtttgggcgccaggaagtgcagggtgcccaccccgagcagcatggccgcgacgcggtaggccgccagctcggtggcgtcacgggcagcggctgatctggttgtcatggacccattgtgtcccgcgccccgggcggtgcggccaccggtaagccgcgatcggcatgggtgccgcgaccgcgtgtactaaccgcttaattgttagcgcggtcacagaccggcccgcaccgaacttagaccaatactattgtctatacagtatttgatacgattcgccgcgactgaccgctgccagaccgttcgaggttgagaacatgggtacacccgtaatcgtcggagccgttcgaacggcgatcggccgttccttcaaggggacgctcgtcaacaccccgcccgagacgctgatcaccgcggtgcttcccgaggtgatacgtcgctccggtgtcgacccggccgcgatcgacgacatcatcttcgccgaatcccattacggcggtggcgatctcgcgcgttacgcggcggcggccaccggcctggaggacattcccggccagtcggtgaaccggcactgcgcgggcagcctcaccgcgatcggcaacgccgcggcccagatcggatccggcatggagcgggtgctgatcgccggcggcgtgcagtcgttgtcgatgacgccgctagtcaactggcgcatcccgggccccgagctcaagttcgaggaacgctggatgccgccgacccacgtcgaggcgcccgacgcgcccacccgggacatgtccatcaccgtcggctggaacaccgccaagacggtcggcatcacccgcgaggaaatggacgcctgggcggcccgctcgcaccagcgcgccatcgcggccatcgacgccggcaagttcgtcgacgagatcctgccgctcaagatcacccaggtggacggttcggtcaccgagttcgccatcgacgagcatccgcgccgcgacaccaccgtcgagaagctcgccggcctgaaggtgttgcaccccgaaatcgagggcttctcgatcaccgccggcaacagcagcggcaccaacgacgccgccgcggcggtcgcgctggtcgaccgggagtacgccgaagccgaaaagctcaatgtgatgggcacggtgcgggcgtgggccgccgcgggcgtgccgccgcgcgactgtggcctgggcgcggtcaaggtgatcggcaaggtcctgcagcgggccgggttgtcgcccggcgacgtggcgctgtgggagatcaacgaggcgttcgcgtccgtgcccatcgcggcgtgccgggaatacggtctcgatgaggagaaggtgaacttctccggtagcggctgcagcctcggccaccccatcgcggcctccggcgcacgcatggtgaccacgttgacctacgaattggcccgccgcggtggcggtatcggcgtggcggcgatgtgcgccggtggcggccagggcggcgcggtcgtcatcgaggtctagccgggcctcagttgcagaacgtgtagccgatgaactgggtgccgcgggtatcgccgctcgagtagttcgcgaaatgcaccgcgggcatcccgtggtactgggtgttcatcttctgcacgtccggcggcggcacatccttggggaaggccaggatcatgtccgcgaagatcttcaggcccgcctggcagatggcctcccgtcgcggcggctgcgggttccacgcgtgcaccaccaccggctcggtcagctgagatccggtcgcgcagttgggatcgcagagtttgaacaccgccgtcccggtgccatcggcgccctgcggcccccaggaactccacgacatgtcctgcagcgcaacggccacactggcgcaacccaacacgttgagtttcttgggacgctcgaccggcaggaccgacgggttgtaacagcccgggatcgcgtagctctccggcgtcggcggcggtccggcggcgggcgccgtcgcgccgtgatcgccccgatccagctgcatccccacggcggtgagcacaccgatcagcaccgcggccacgatgccgatcacgatgagacgcccccgcgagatgtgccgcgaccgcctggacaaaggaacgttgccgctcacgtcaccagattacggggcgaaaatcgggtctagggcggtccacgccgacggggaatcaaagggtaaagttggtcatcgctaccaacatattgaggatttcgcatgaatgaccatgagctggccgcgcggttggccaccgaggccggtcggctgctgctgggggttcgagacgagttcgccgacgctccggcaagcgagcggaaagcggcgggggacaagcgatcccacgattttctgatcgaggcgctggctgccgaacggcccggcgatgccgtgctgtccgaggagggcgccgacgacccggtgcgattgcgctccgagcgggtctggatcgtcgacccgctggacggcacgcgggagttctccgagctcggccgcgacgactgggcggtgcacgtcgcgctctgggaggccggcgagctggtggccggcgcggtggcactgccggcgcagggcgtcacgttcgcgacccccgaggtcgcgtcaccccccgtcgcgccgggcaagccgcgcatcgtggtgtcgcgcacccgcccgcccgccatcgcgttgaacgtgcgggacgcgttggacggtgttctggtggaaatgggttcggccggcgccaaggtggcctcggtcgtccaggggctctccgacgtgtacgtgcacgccggcggccagttcgaatgggactcggccgcgcccgttgcggtggcgcgggccgccggattgcacacgtcgcgcatcgacgggtcgacgctggcctacaaccaacccgacccgaagctgcccgatctggtggtctgccgtcccgagctggccgacgccgtcctcgcggtcacccgctgacggtcctcgagagtcgctggcgcgcttggtctttcgcgctaggacgcgggcctgggcaatggccgcgactctgcactcagagcagcgcctgctgccaggacaggatgcgttcggccagttcgggtccgcggtcctcctggatgaagtgactggcgttgatgcgggcgtgcggttggcccgcggcgcccggaatgtgcttgatcagcgggctgtccgcgtggccgaggatggggtcgcgggcgccgaagatggccaggaacggtttttcccagcggccgagggcttcccacgccttgcggttggccggaatcgcgggatcggccggcgaggtgggcaccagctgcggaaatgcccgcgccccggcctgatacgtcttgtcggggaagggcgcgtcgtagccggcacgcaccttggacgaaacccggcggacggtcccgacgctgacgatgcggccggcgggcagcacgggggagtagcgcgcgaaggctcgccacgcgtagaaggcgggcggggtgcgtcgctgcgcggtgggaagaaagccgttggccaccaccagccgtcccacccggtcgggctgctcggcggcgatgcgcagcccgatcaatgatccccagtcctgcacgaacagcgtgacgtcgctgaggttgaggtgttcgaaccaggagaccacccagtccacgtgccgctggtaggagtagtcctcgatccggctgggcttgtccgaccggccgaagccgatcaagtcgggtgccagcacccggtttccggcgtcggtcagcggcgtgatcatggtgcggtacaggtagctccaggtgggctcgccgtgcagcagcacgatcggtggcccgtcgatcggcccctcgtccaggtagtgcatgcgaagcggccgggtgtcgcgcgcggtgacgtcgagatagtgcgccacgaacgggtagtcctccaggttttcgaatcgggagtccggggttcgcagcacatgcatattcagctcctcgtcgtgaaccggcacctctgctagcctctctcgccgacgggcattcgtctagtagcagattcgttgagctacaccgttgcggccactaaactggcctcttcatggcaattcggcgcgcggtgctgctcatcgccgacatcggtggttacacgcattacatgcagtggaaccggacgcatctcgcgcatgcccagctgaccgtcgcgggactgctggagtcggtgatcaacgcgggcaagggcctgaagctggccaagctcgagggcgatgccgcgttcttctgggcgccggacagcagcgccaaagtggtggtctgcgagcggctgtcgcggatgcgcacgtcgttcctgcagcggcgcgagcggatgaagaacgacatcgcctgccagtgcgcgagctgcgcccagctggagcagctgtcgctcaaattcgtggttcacgtcggcgaggtggccgatcagcgggtgaagcggcacgtcgaactggccggattcgacgtcattctggtgcatcgaatgctgaaaaacctggtgccggttgcggaatacgtgctgatgaccgatccggtcgtggactgcctcgacgagccgatgcgcgcgctgtgcatgccgctggtgcacgtgttcgaagggatcggcgaaacgccgacgtactacatcgacttggcggaggtgcgggttccggtcaccgagccgcagcgcagtttgctgcgtcggctcggcgcgaccatgaggttcgagttcaactcgctgccgttcaccctgggcatgaaggagcccgcggaagggttccgcaacttgggccggggcggggaggagattcccgcgtagcgcgggcggggctagccggaccggccggccagcgcgcggcccatgcgcgacagcgcctcggtgaggatcgcgcgcgaggtggcgaagttcagtcgcaggtgtccagccccgccggttccgaacacgtggccggagctcagcgccacccgggcgtgctcgaggaaccagcgcgcgggcccggacaggtcggcgaccacggccaggccctgtgcggcgtcctcggcgaagcccagctctcggcagtccagccacgcgaggtaagtgccttgcggccattgatatttcacgcccggaagatgttcggccaccagctcgccgagcaacgcgcggttctggtccaggccctgcagcgtggcgtccagccatccgtcaccgctgcggaatgcctcggtgtgggcgatgacgccgagatggctgggcccgtgactgacctcctccggcatccggttcaggtcggccgccgcctccggtccggcgatggccagggccgccttcaggccggacaggttccaggccttggatgccgaggtcagcgcgaaggcgttctccgccccggccacggtcaggaagggggtgaatcgtgatcccggcaagatcaccggcgcgtggatctcgtccgacaccacgcgcacgccgaaccggcgggcgagctcggcaactccgcgcagctccgcggcggtgtgcaccgacccggtcgggttgtgcggattgcacaacaggtaggcgaccttcgccgtgttcccggagcgggcgtgtgcgaacgcttcttccaacgcgcccaagtcaattcggccgccgtcgcctagcggtgcctcgacgacccggcggccgtcgtgcgacacgaatgcgtagaacggcgcgtacaccggcgggttgacgacgacggcgtcgcccgggtcggtgaccaggcgcagcacctcgacggcgccgagcatgacgtcgggaaccagcgcggtgcggcgcacgtcgaggtcgtgccactgccaacgccgcgccgcgaattcgctcaccgcctcggcgaacgcggtgccgcaggggtagccggtgtcgccgttgtcgatcgccgttcgcagcgcctgcgccaccgtcggcgccagcctgacgtccatctcggcgacccacagcggcagcacgtcggcgggatgggcacgccatttcatgctggtgcgaagccgcagttggtccagcgtgagttcctcgaacgggttaaacgtcactcgggcagattaaggcagttcagtgagcgaacgtggtcgcggccgtaccccggctgccgtgctcgctagagatcccgaccacgctgccgctttacgccttcgactgaacgtgtaacgtacgtcgcagacattaggccagctaggagttcgccgtgtacacactgcgcttcgacatgcgtgatcccgaatgggccgcgcccccagccgatctgtacgccgcggcgcccgaaatggcggcctgggccgaggagcacggcggcctggccgccgtgctgtgtgaacaccacggctccgaggacggctacctgccgtcgccgttcctgctggcctccgcggtggccgcgcggacgcagcggctggcgctgagcctgatcctgatcctgccgttctacgaacccgtgcggctggccgaggacatggccgtgctcgacatcatcagcaacgggcgggcctcctacatcctggcgctgggctaccggcccgaggagttcgagcactttggtgtgccgatcaagaaacgcggacgcctctgcgacgagaaactcgcgctgctgcgccgactgctggccggtgaaaccgtcgtcgaagacgggcggcggatcaccgtgacgccccgcccgctgactcccggcgggccggggctgatgtggggtgggggcacgatcgccgccgcccgtcgggccggccggtacggcctgggcatgctgggcaacgcgaacgcgccgggcatccaggaggcctacgaggaggcctgccgcgagcacggccacccgcccggcccgacgatgttccccgaccgcaacacgccctcggtggtgttcgtcgccgaggaagtggatcaggcgtggaaggagatcggcgagcacctgctgcacgacgtgcggacctacgccgcatggaatcccggggacgagacgacggcgggcttcagccacgtcaacaccatcgacgagctgcgtgagacggggacctcgcacgtgatcatctcggtgcccgaggcgatttcgcgggtgaaggccgggcaggtgctcaacctgtcgccgctgtgcgggggactgccgccggacatcgcctggccgtatctcaagcgcgtgggcgaggtcgtactgcccgaggcgctcggccattagctttaccgccgagcgtcacgcccccgtaccgccgagcgtcgagttatgatggaaaataagcgatttcggcgcaacaactcgacgctcgcgggctagcggggctggttcggcactcccgggaacagctcgcccgtcggacccgcggtcacccaaccgcccagcttcgtcaccaggtgcggcgcgaaaaccgcgccgtagagcgcatttccgacgacgaccacggcgaccacggacaggaccgacgcaccgacccggctcttcgaccggtgctcggcccacatctcgatgacgttgggtccctgcgcgtcagtgcggcccaacaggtaggtgaagagcatcatctggatggccatcgccaccgagtcgtagagcgggtactggtgcacggtgccctcgcggatcgccagcccgggaatcacccggccgtaatagaagaccccgagcttggcgcccaggaatccgttgaagaacagcgcccagcagaagccgacgacaaggcccacgaccaacagcgtctggggccggcgccagccgaagcgcgcgctcagccaccgcccgagggcggtgcccgtcaccgccggcagcacgaagtaggagatgtagccgatcggaacgaacaacggcagcccgccccaggtcatgttcagcggccaccacgacggcatccgggggatggccggcgggaactgtgcgtacatcgcccagtcgtagggcgcctcgatccaggagaacgacatcgccgaaatgcacagcagcagaagcggatgcaggcggcgccggcgaacgctcaggtagatgccgaacgcggtgaacccgatgccgccgatcagcgcgaattcactggccgcctgcatcaccggcgtcatctgcgcgctcatcggtcagcctggcggctccggcgggcttgcgggtcgaagcgcagcaccagcccgaagatcaacacgatcaatccgaacagcgtgccgagcatgatgacagcgcccacggccgcaccccttccgatccgagctcgactcattagatagtgcacactatcctaaagtcaaccatcgacgagaggacaccacgtggcccagcggccgtccaccaggcgcggcgcggcagcggcgccggcctcgatccgccggccccgcggcgcgccgcgccagctgctgctcgacacggcccgggcccgctttgcccggcaggactaccgaagcaccacgacacgcgaaatcgcccaggccgcaggggtaaccgagcatctgctgttccgccacttcggttccaaggcggcgctgttccgcgaggcgctggtgctgccgttcaccgatttcgtcgccgaattcggccgcacctggcaggctgtggtccccgaggagaccgacgaggaggagctggcccggcggttcgtcgggcagctctacgacgtgttcgtcgagcaccagggtctgctgttgacgctgatggcctccgaggcgttgagcgaggaggagaaggccgacgccggcatcgccgaggtcaggcgggcaatcactacgctgggccggatcagcgccgagggcatgcatctgcggggcctgcggtccgaccatcccgacctgccggcgcattcgacggtggcgatgatcgcgggcatggcggcgttgcggtccacctacttcggcgccgagccgccggcccgggaagtcatcgtcgacgagctcatccaggccatcctgcacggcttcctgcacagaaacggctgatccgttcaattggccaccgcaccagaggaattggttatgacaggcaccagcgcgatcgagttgtactacgaccctttcgattccggcatcgacgacaacccgtacccagtgtggcagcgcatgcgcgaagaagcgccgctgtactacaacgagaagtacaacttctacgcgctgagccgctacgaagacgtggcacgcgaattgccgaactggcagacctaccgatccgggcggggcaccaccgccgacatcctgttctccaatgtcgaagtgccgccgggcattctgctgttcgaggacccgccgctgcacgacctgcaccgccgcctgctgtcgcgcgtcttcaccccgcggcggatgctggccgtggaggacctggtgcgcggattctgtgtccgtgagctggacccgctggtgggcgccggcggcttcgatttcatcagggatctgggggcgatgatgccgatgcgcaccatcggctacctgctgggcatccccgaggaagaccaggagaagatccgggaccgcagcgtcgccaacatcgagttgtcccgggacagtgatcccgccgcggtggacgcgaacgtgttcgccaactcgatcgcgttgttcgccgactacatcgagtggcgggccgatcatccctccgacgatctgatgaccgagctgctccgagccgagatcgacgaacccgacggcacccggcgcccgctgtcgcgcaccgaggtgctggcctacaccgcgatgatcgccggcgccggcaacgagaccaccgcgcgtctgatcggtttcatgggacagctgctctccgatcacccggatcaacgacgcgaactcgccgccgacccgtcgctgatccccggggcggtcgaggagacgctgcgcttcgaaccgccgtcgccggtgcaggcgcgatacgtggcgcgggacgccgagcactacggacgcgtcgttccggaagggtcgttcatgttgctgctcaacggttctgcgaaccgcgacccgcgccgcttcaccgatcccgaccgctacgacattcaccggcaagggggaggccacctcagcttcgggcagggcctgcatttctgcctcggctcggcgctggcccgaatggaggcgcgggtggctttcgaagaggtgctcaaacgctggccggactgggaagtcgactacgccaacgccgagcgcgcgcgcaccgcgagcgtgcgcgggtgggcgcggctgccggtcgtcaccggtggttagccctcgactgtcacgccagcgtgacgctcgaggtcgaccgtcacgccagcgtgacgcgcgaggtcgactgtcacgctagcgtgacgctcggcggctagacatcccaggtccgtaagttgtcaagccgcctgggagtcggggttggtttggcggtgtgcccaggctttgtgttcgtcgtagtgggttcggtgtcgtaggcagccgtggaggatgcctacgaggcggttaccgagggcgcgtagcgcttggtggtggaggtcgccggcagcgcgacgccggtcgtagaacaggcgggcgccggggctggtgttcagggcgcagaaggcccattggtcgatcgcgtcgtagagccggcggttgcggacgtggcgggccagcacggcgcgtttgcggccggaggcgacggtcagcggcgacgttccggcgtagtttttgcgacacttggcggtggtgtacctgttcgggtcgtccccgaactcaccgagcacccgggcgccgaggatgacaccaagtcctggcagggagcggtagatgtcggcgtccgggtgtgtctcaaaatgtgttgccagttcggcctcaaggtcggtgatctggcggttcagttcagcgatgatgccgaccgtggcgcgggttggttgcgccgaacgcggcggtgaccgcggcaggggcggcgagctgctcagcgcgtaaagcggtttgaatgtcctgggcgacggtgtccgaggttgccgttgtcgcccagcggcttttgagtgcagaccggatcttcgacagactcaggttcgccgcttgcatgggggtgggcgccctcggctccaggatcgccaagagcgtcgcggtcgtgcagatcgtcgaacgcctccagcgcgcctgggtagtactcgcgcagcgccgagcgcagcgcgttggtgtgccgattgcgggtccagatcagattctgatgtgcccgggccagcactttgaccgcctcggtatcagcggagtcaccggcgacgcggcggtgattgtggcgatcggtgcgcaccagatccgccaagagcttggcgtccccggcatcggatttggcccccgacacatggtggcggtcgcggtagcgggcggccgccatcgggttgatcgcatacacctggtaatcggccgcggtgagcgcctcgacccacaaaccacggtcggtttcgattccaatcacgacctggtcgggctcttcggcatggcgggccaaaagctgatggaactcgccgatgccggcaagtccctccggtaaccgacgcgaggccagccgggccccggattcatccatcaggtggacgtcgtgatgatcctccgcccaatcgtcgccgacaaatatcacgtagcgcctcctcggtggtcatcgaacatgttcgagcccaagggcacccggcgacaagctaatggatcagtgctcaacggcacgacaccccatcagtgctacaggaaccctcaccaaccggccggggcgtgatctagccttagaagtcggccatcgcttcagctggcaacgacgctcaccgaccggcggctcggtaaacagcgtcccccgaacaagggatcaacagccgaaggctcactgttcgatccccattagctggcgctggcgtccaccaacaccgcgccgtcgggccgatctcccagggtttgcagcggcacgtcctccccgcgggcggtcaggcgcacgatctcggccaattgcgcgggggcgtcgcactgcagatagtggtcagcgccggggatcacccagtagcggttgcggcccggcttcgtcttcagatacgtctgccatacgtggttggggacgcgcagcggcgcgacgttgtcgtgcagtccccacaccatggtggtgttgacatcgctggtggaaagtgcttccagccaacgggtttcgtcggcggcgcgctcgttgagatattgaatggtgtcaggcagcacccggattccgtcgttgtgggcgaagcatttcgccagggcggcgatttccgggtcgtccagcgtccgccgcggcatgaacgtgctggcgcccattccggccgccagcagctcgggtgtggtcgcggccgcggtggcccgcgcggtcgcgggatcgagcagcgcgctctgaaacgcggtgaggttggccagcggaaggtagatgttggcgttggtcaggatcaggtcgacgggtgcggccggcgggtcgagcgcggccagcatgcccgacgcgatcatgccgacactgctgccgcggtcgtgggtcagcatgcggtagtcggacagtcgccacacctcggtgatggcgtggacgagcagacgggcgtcgtcgtacagcgaatacacgtacggctcggacggtttgtcggacagtccgtagccggggaagtcgatcaggtggatgtcgaagtcacggctcagctcgccggccaaggcgaagtagtcgatgctcgacgtcggaaagccgtgcaccaacaccaatgcgggcgcacccggggtcccgcaacgtcggctgaacaccccgacttccctgccgtcgttggccgcggtggtcgagcgccaacgaagttcggtgccgccgccttgccactgcgcgaaaatgtccaagcagtcagcatctcagaggccgtcgcggcggacaaccaccgttctcacgggcaggtgacgtggatcccgaacgtcacgtcgcgcgtcccgctttggccgggtgtggtcgcctggccggtgccggtgaccgtgtagctcttgctgtccttggttgcctgcacctgagtcggcgatttggttccctggtacggcaattgatattggccgttgtcgagcttgagcgaaatcgcgaagccatcgacggtgggcggttgttcgtcggagaccgccagggagaccgacgccgaatcgtcgtgcacgctgatgcgggtggtgaggtctcccgattccggcggcgacgcattcggttgtgctgctgcgctggtgcagtcgacgccggcgatcatggtgtgcttgttcccgtcgatcatcacggtggtgcttgccaacgtggcggtggaactcggggtggcggccgggtggccgtccttgccggaacacccgggcagcccggcccccaacgccagcacaccgagcgcggtcgcggcgccgacgacccggcgccgatcgttcaggttcctcattgtcggccctccgctagacgtcatcaggactataaagcccgatcgttaccgtcgggacgcccagccgatcatggcgtgcggcggtcgggcgaacgggcgttgaacgcgcccgtgttcacgacgcgaaagcctatcccgcacaagggtgttcgttatctcagtgtgtcgcggtcgcgatgaacatgccggcggcggcgacgacgagcacgcagtcgatcaggagcgcataatgccgctgatcggttcggcgcacgagcggacgcgtgacgaagggcccgatcatcaaggcggcgccgatcaccagcccgcgggtcaccacggcgaagctgagcgcacccagctggctgaaggtgccgattttgccgatgtagagcagcaaggcgctgacggcctccgacccgaggaacgcgccgccggacagcccgtatccggtgaagacgggcacgctcagtgggcccgtcgacaggaccagaccggtgaggaagccgacgacgacgcccgcgacggccaaatgccgcagccgaatccgccaccggcgggccagcgcaaccctgcgcatcgggatcatcgcaaggaaaaacacccccagcagcccgtcgaccaccgcctgcgggatgctcagcagggtgttcgcgccgagcacgacggcgggagtcccgggcagcgcgtaggcaagcaccggccgccagcgaatctgccgccaccatgcggcaacccgcgcgacgttcgccatcaccgccgcaatccccatgacgggcaccgcaattcgcggcccgtacatcatgaccagcgccggcagcagcaccagggacgagccggtgcccaccatcccaccgagcgctccggcggccagcgcgatgagaaagaggacggcgagagccaccatggcaggaccttctcgccggcgcgcggcgcaccggcggggtcctccaggcttttgtccgttcagatgaccgccttccgtcggggaaggcggtggcgccgctcggaccagtcacaccgcgtggtgccggaaccctaggcgctgtcgggaacaggctaacaggtggtgcagccgcctacgcgccgccgcgttccaccgggcgggccgggtccgcgcaccactccgaccacgatcccgggtacagcgccgccgttcggcccaccgccgcgagcgcggcgatcgtcaccgtggcggtgacgcccgagccgcaataggcggccaccgcgccgtgccgctcgattcggtgctcggcgaacacccgggcgagcgcgtcgtcgccgaggaaggtgccgtcggccgccaaaacctcgccgctgggcagattctcggcgccgggaatgtgcccggcgacgggatcgagtggttccatttcgccgcggtagcgttccggcgcccgggcgtcgatgagtgtggcggcgcccgcggccacctgctcggtcgtcacggtcggacggttgccggaatgcaaatcaccatgcggcacagtcacattcccgggcactggttcgacgggcccggacacgagtcggccgccggtcgcccgccaggcggccagcccgccgtccagaatgcggacgttgtccagcccggccgcgcgcagcagccaccaggcgcgcgcggagccggcgcggttccagtcgtcgtagaccaccaccggtgtgtcctgccggatgccccatcggcgggcggccgcctgcaggctgggtcccgacggaagcgggtgacggccccgcccggacaccgtgtggtcgctgagctcgtcctcgagcgagacgtacaccgcgtcgggaaggtggccctgcaggtaggccgcgcggccgtcgggctcgtcgagcctccaccgcacgtccaggatgctcaccgggtctccggcctcgatgacgtcggccaactcggtcgcggtgatcaatacctgatcgcgtgcccccaccggatcctccttgtcgtctgtagcgagactaaccagggcggtcgggcaaaccagcgcccgcccgagcggcgcggcgaaaaggcccgggtgacgggggccgtcgacaggagcaacgggtggcgcacacacggcgagcgacgcggacgcgccgcgccagtcaggcggtttgttcggagtccccgcccggatcgtcgaaaaccggtgcccgcaacgacgccagcatgccggcggcggcccggtgccaggtgaagtcctcggcgcggcgctgcgcggaaatgcggcgctgccgctcgggccggctgacgatggcgctgaccgctcgcgcgatggcggccgggtcgttggcggccgacgcgccgctgtccggggtgacgatctcggtcagcgccgaggtgcgggagaccacggccggcgtgccgcacgccagcgactccagcgcggccagcccgaacgtctcgtgcggtcccggggccagcgtcacatcggccgaggcgagcagctgggccacggtggtgcgatcggagacgaaaccggtgaagtcgaccgggagccgggcggcctgccgctgcagcctggcccgcagcgggccctcgcccaccaccaccagccgcgcgtcgacaccggcgtggcacagctcgccgagcgcgtcgatgctgcggtcgacgcgcttttccaccgacagccggccgcaatggaccagcagcagctgggtcggcgccgcccagcggcggcgcaccagctgcgagtggtgccgcggatgaaacgtctgcaggtccacccccagcgggacggtgacggtgttgccggcgccgatgcggtcgaattcctcacgcgcaaagcccgtggtgcacaccacggtgtcgtagtcggcggcggtgcgggcgttggccaagtcggcgaacttctgcgctgcccgacgcggaagtacctgccccacaaggcgatccagccgctcgtgagagatcatcaccgtcgtgacgccgtggtcgcggccccagcggcccagcgatcgcagggtgagccggtcggacacctccagtgcgtcgggccgcaacgcttccagcagcgccttgaccgggcccggcagcaccgcgcggtagccgccggtgaagggaatcagtcgggcgggcaaggtgattcgcaccacgccggtgtacagccgggcacgctcggtgcgctgccccggaacgatcaggaagacctcgtggccgtgggcgcagtattcggcgcccagtcggtcgaccgcggtgcgaaggccgccggagcgagggccatagaaattggcgacctgtacgacacgcataccgtgaggacacgcggcgcgcgtgtgcactcctcaatgctggcccgacgcgggcctgaacactagatgaacttcgcctggcggggtgctgctcggcggtctggcgtcacactcgactaccgggtgccccaatcccagcggggcgtcgtcatcaaagtctgcccgccgatgcgcgtttcgccccagtccttgtacagctcgatctcgacggcttcgccgtcggcgccgccttcgcccagcgggacggtatccaagaactccagcagcgagcgcgagtgggtgaccacgacgacctgggtgctggcggcggtggtgcggatcagcgacgccagcggggcgaccaggtcggggtgcagcgaggtttccggctcgttgagcaccatcagcgacggcggttgcgggctgagcagcgcggcggcccacagcaggaaacgcagtgtgccgtcggataattcggccgaccgcagggcgcgcagcatgccgcgctggcgcagctgaaggtcgaacaggccgtcgtggatggccaccgagacggtggcgccgtcgaatgcctcggcgacggcccggttgaggtcgtcgaaccccgactcgaggatggtctggatggcggcggcgaggtcgctgccgtcgtcggcgagcaccggggtgcgggtgcccacctgcgggtgccgcgccggtgcccccgcgtcgacccggaagccgtcgtagaaccgccagccgcgcagccgttctcgcaccgccgccagttcgggcagcgcgtgcgggtgggcgtattcggcgagcacgctgtgatacgacggcagcgaccgggacagctcgtcgaaaccgctgccgctgtcggcgctggcctcggcgaaaccgcgggaccgtcgcaccagcgtcgtgctgggccgcagcaccgggccggcgaacagcacttcgcgtttgatctccggatcgcgggcgaacaccgacttcccggccgactgcggcaggcccagatccaccagataaccgaaatcgtctgcagcgaagcccaattcgagggatacgggccggctgcgcacggtgccctcggttttcccggagcgtcgcgagccggccggctgctcggggccggcccacagcaccgattgcaggccgccctcgcgggccagcgacccgatcacctcgccgcggccgcaatccgccagcagccgcagtgctcgatacagcgacgacttgccggtgccgttggcgccggtgatcaccgacagccggcccagcggcagaaccacctcgcgcagcgagcggtagccccggaccgcgacggtgtgcagcatgaggccgactgtacggtcggccaccgacgggccctattccgtgtcgccgtcgtcctcgtcggccgcggcggccagcagctgcacctcctcgagatccatctcgttttgcagctcccgcagcaccgtgtcgtcgatccggttctgattgcgcagcgcggtgacctcgcggcgcttgtgctcgagcacccccagccgcacctgccggaccttctcccgggtcttgaggatccggttgtccggcgaaccgttctcggtggccagcaccagcgcggccttctcttcgtattccttgtgcagccgccggcgcagctcgtcgctgacgccgacctcgtcggcgaccgcgggtagggcggctagggcggcgcgggcggcacgggtgcgggccagctgcagctcctcggcgtgcgcgacgtccgccggcagccgcgcccagcgcaccacagcgggcagcgtgctgccctgcaccagcacggtcaccaggatgacaacggtgacgatgaagatcagcaggctgtggtccgggaacggcgcgccgctcagcgtggtcatcggcacggccaccgccgcggccagcgacaccgccccgcggaatccggcccaggcggtgacgaagcgctgccgccagccgacccggcgttcgcgttgcaccgcccggcggtcgatcagccggatcagcatggtggtgaattcgccccagaagatgcgcgacacgatcaccaccccggtgatcaccagcgcgacgaacagggcgtgccgcacaccgccgtcgacgcccgcgatgccgcgcagcgcaccggggatctggacaccgacgaacacccacaacgagccgttgagcaggaacgtcgcgatgtcccagaaggcgtaggactgcagccgggagcgggcccggatcaccaccggcccggagtaggccagcaccagggccgacaccaccaccgcgaccaccccgctgcactcgaccgattgcgccagcaggaacgccgcgaagggcgtcaccaaactcagcgctccctcttcctggggcgcgtcaattcgcttgcgcaccagcgtcactgcgccgccgaccagcaggcccgcggcgatcccacccaggtacgagccgatgaaccggagtgtgacctccggtgggctgatcgccggcgcgccgatcgcgacgtgcacgctgaccgcgaacaacaccagcgcggtgccgtcgttgatcagactctcggccttcaacaccgtcagcgagcggcggggcagcttcttggccagcccggccaccgcggccgcgtcggtgggggagagcaccgcgcccagcactccggccgcatgcggatccatgcccagcgcccgcgccgtccacgacaccgccaccgcggtggcgatgaccagcgcgacgctgaggaacacgatgatgcgtgcgttggcccggatctcgcggaagctgatgttcaggccttcccagtacaggatggcgggaaggaacagcagcaacacgatctcgccgtcgatccgcacgtgcccgaactgcgggaccagacccagcagcacgccgagcacgatgagcagcaccggcgggcccacccggtagcgacggccgatgaccgtgcccacgatgacggtggacaccagggcgacgatcaggacgaggccgaacaccagcccatcctgccggacgcgacggacggtggccgcgggggccgcacgacgtcatgcgccggcgcttcttcgcctatcttcggtctgggtcacggccgattaggctgcggagcggaatcgaagggggatctggtgaaggtcaggctgctggcaacagtcgccgcgctcatcttgtcgacggtgctgggctgtcacttcgagtcccgcaacccgccgtcgaccaagaccctccaggtccccatgaacgacgtgctgacgcagagcgacatcagccagaacatcaccctggccgtcggcaacaccctggtcgtgcagctgggttcgaactacaccaccccctaccggtggacgcccgacgcgaagatcggcgattcggcgatcgtcaagcagaccagtcacgagttcgtcccaccgacttcggacgcgctgggggcgccgggcaccgaggtgtggacgtttgcggcgctgaaaccggggagcaccaccatcaccacgtcgtacagcagcttcgtggacaagaatgccaaaccggcgtgcacctacaccctcagcgtgaccgtgcgatgagctgatcgggcagccgatcgcgggccgagtagacctcggcgaggaactgctcgacggccaccgcggtgtgcgcggcgcgcaccgagccgaagatgtcgaaagcgtgttgggtgaacggcaattcggcgtagaccaccggttgggtgctgacttgccgcagccgttcgacgaacgcgcgggcctgctcgacgtatgccaacgagtcattgcggccgtgcagcacgaaaaacggtggtgcgtccgggtttacgtgggtgatcggtgaggcggcggcgaacgtctccaggtgggtggcgggccgttgtttgatgatcgacttgatcagcagtccgggcatcatcgggtgcaggctgtcgtcgaagcgggtgaagtcgtagatgccgtagaacggcaccgccgcctgcacccgggtatcggcgtcttcgaagccgggctggaaccgcgggtcgttggggggtgagcgcggccagcgacgagaggtggcccgccggccgaccccgccggtgatggcgatgaagtcgggatcgccgcccgtagccggcgatgtgttgtttgacccaggccagggcgcgcttgacgtcgacgatgtggtcgggccaggtgttgcgcgggctgtgccggtagttgatcgccacgcagatccagcccagttccgcgagatggctcatcaacggatgtgcttgtccgcgtttgtttcccgtcgtccaggcgccgccggggatctggaagagcaccggcgccctgccggtgaggtcgaggtcggggcggcgccagatgtccaggtggttggcgctgccgaattcgccgtagctgatgttggagtcgtgggcgtagtcgcggtagatgcgcagcatccgcagcaggcccggtgttttggcggtgccggcgccggtcggccggcgccacaggtccgccgactccgtgagccggtcggcgcccagttcgctgtccagcgcatcggtcagcggcacattggcccggtggcccgcccggctcaggttgagcaggccgagcgccgacaggcccgcgaccagccacgcgatgatgcggaccggccgggtcaggcgacgtgccgtcagggccagcccgccgagctggctgagcatcgtctgcagcggcaattcggtgacgacgagcccgaacatccaggcgtacagcgacgggtaccccttgcgcgccagcggccggtaggcgttgagggtggacgccgcggtcaccgcgctgaccgtcagcgacccgatctgccggatgaggtggacgattcgagctttgcgcattggctcactttacgtaggggtgtgacgcccgaatccgctagcgccggtgctagcggatttggccgaatcgtcatggtgtcgggagggacggccgggccgccgaggtcgggacccggggacaacccggccgcctaagtccggagctctccgggtggggatgagtgactcgcgaatccgccagcgcccgtgctatcaacccggcgtgaatcactacacctaccgagtcgcctggtcgccatacctcggcgaatacgtcggcacctgcctcgaattgccctacgtgcgccgccagggtgcgacggcgcaggaggcgatgggcgcgatcgaggaggccgtcgactggtacatcgccagcgctgagtcctcgggggaaacgctgccgacgccgatggccgaccggcactacagcggcaccatcgtcgtccggacgtccccggaactgcacagccggctggccatggaagccgccgaacaaagggtctcgatgaaccaatgggtggtgcagaaactgtctggacgacgcccgagcgagacgttcgggctgtccggattcgactagcgaaaagctacgacgcgtagcgaaaggctacgacgcctccgcgcggctttccaggttcttcaccggggccgggtcgttttcggtcagccccaccttcgcggccccgccgggcgagccgagttcggtgaagaaatcggcgttgatctgcaggtattggctgtgctcgggcggcaggtcgtcctcgtagtagatggactccaccgggcacaccggctcgcaagcaccgcagtcgacgcactcgtcgggatggatgtagagcatccgggcaccctcgtagatgcagtcgaccgggcactcctcgatgcatgccttgtctttgatgtcgacgcagggctcggcgatcacgtaggccacgagtgttgtccttccttctggcgagcggggtcagccgggtgcggggccgcagcaactcggttcaggctggctaatgtagcgcggcggcggccgcgcggggcgccggccgcgtgccttccatgctggcggcccacgccgggcggcagtagaggtgccagcgttgtggtgtcacaagctatagttgtgtcacacgatttgattgtgagcccgcgaccatgccgctcagcccgaggatgcccgaactcgcctcgttcgaggcgtttttggcgatcgccgagacgggcagcctcggccgggccgcccgcgaactcgagcttacccagcaggcgatctcccggcggctggccaccatggaggcccagatcggtgtcaccttggcggtgcgcaccacgcgcggttcacaattgacgccggccggcctcatcgtcgccgactgggcggcccggctgctcgaggtcgcccacgagatcgacgccggcctgggctcgctgcgcaaggagggccgggagcggatccgggtggcggccagtcagacgatctccgaacagctgatgccgcattggctgctgtcgctgcaggccgaggcgacccggcgcggcgaggccgcgccgcaggtgatcctgaccgcgaccaacagcgaacacgccatcgcctcggtccgcgacggcagcgccgatcttggattcgtcgaaaaccccggcacaccaaagggtttgggcagctgtgtggtgggggaggacgagctggtgatcgtggtgccgcccacccacaagtgggcgcgccgctcccgcgtggtgaccgcacgcgaactcgcccagacccccctggtcgcccgcgaaccgcattcgggaatccgcgattcgctgacggtggcgttgcgcaaggtgctcggggaggacatgcagcaggccgcgccggtgctggaactgacgtccgcggcggccatgcgcgccgccgtgctggccggcgcggggccggccgccatgagccggctggcggtggccgacgacctggcggtcggccggctgcacgccgtcgagatcccgaagttggacctgcgacgcaagtttcgggccatctggatcggcgggcgcaccccgcccgccggggccatccgcgacttgctcagccacatcatcgcccgcacggcggtatcgaagtgactcaggctgcggcgtcggccgacagcgcctcgtcgtaacgatccagcacggtctcggccaccagtcggtgcgcccccaacggggcggccatgcgaatcccgttgtcccgggcgaaggttgacaccccgtcggtgatgaatcccggcgccagaaaccacggcgcgatcaccagccggcgcgcgccgcgacggcgcaactggtcggcggcgcgggccaccgacgcctcgggccgggtcgcgaagccgttgtggcgcaagcccatcgggttccggcggccaaccgggacgccaccttggcggtgcgtgcgttggcggcgatgttcgacgaaccgatcgccaccaccatcaccccgagatcgtcgtcgagcggggaaaccccgatctcggccagacgcccgcgcagcaccgccaccaaccggtcgtcctcgcccagcacgtcggcctgccggatgccgcgcgcaccggcgcgggcgatctgttcggggatgtcgagccgcgcgtggtaggcgctggccagcagcagcggggcgaccacggcgcgccggctgtccggcaacccggccagcacgtcgacgaagttcggggcgttgagctcgaggaaggccagccgcacgtcgaggccgggccgcatccgccgaagccgatcggcgacggcctcggcattggcggccgaccgcggatcgcggctgccgtgcgcggtgagtaccagggtgctcatgaggcgtgtaacccgcattcgaccttgtttcgtccccgccaacgcccgctgcgcggatcctcgcccggtgccggcttggcggtgcacggggcgcagccgatcgacgggtagccctcctgcaccagcgggttgaccaaaacccggttgcgctcgatgtattcgtcgacctgctcgtcggtccaggcggcgatcgggttgaccttaaccaccttgaacgactcgtcgaagctgatcagcggggcgtcggcgcgggtgggcgcctccacccggcgcagcccgctcacccacgccgcgtagccgcgcagcgccctgcgcagcggctccaccttgcgcagccggcagcattcgttggggtcccgggcgaacaggtccttgcccagcagctcgtcctgctcggccacggtgtgctccggggtgacgttgagcaggtggatgtcgtagaccgcctcgacggcgtcgcgggtgccgatggtctcggcgaagtgatagccggtgtccaggaacaacaccggcacgccggggcgcacgtctgaggccagcgacaccgtcaccgcgtcctgcatgttgcaggccaccacgtatttgcaggtggcccagccgcgcggcccgtcgacgggcccgaagtgctcgtcggtccagcgcaggatgtcgatcgcgctggcgccctccagctccgaggcgccgcgctcggccagctcgcgcagctgttcctcggtgaagtcggttgccacgtcgctcatttcgacctcggacctcagcgcagctcttcctcgtcggcgcgcaacgcccaggacgcgaacgtctcaccgtcgttgcggccctcgaggtacttgcgcgtcacccggtcgatgtagtcgcccagttcttcgctggtgaccttgtgctgccgcagttttcggccgaagccgctctgctcgcccaggccgccgcccaggtgaacctggaagccctcgaccgatgtgccgtcgccgttgtcgatccattggcccttgaagccgatgtcggccacctggattcgggcgcacgagttcggacatccgttgaggtggacgctgatcggcgcgtcgagctgggcgtcgacgtcggccaggcgccgctccagctcgggcaccaaagtctgggtgcgcacccgggtttcggcgaacgacagcttgcagaactcgatcccggtgcaggccatggtgttcttgcgccacgacgacggccgcgacggcaggcccagcgcgtccaggccagtgacgagttcgtcgaccttgtcgtcgggcacgtcgaggatgaccagcttctgaaacggcgtccagcgcgcccgatcggagccgacctgttccatcaggtcggccaccgcggacagggtggtgcccgagacgcgcccggcgatgggcgcgacgccgacggcgttgagcccgttcttgatcttctgcaccccgacgtggtcgatggtgtgcttgaccggcgcgggcgccggtccatcgatcagccgccggttgaggtattcctgttcgagaatttcacggaacttttctatgccccagtccttgaccaggaacttcagccgggccttggcgcgcagccgccggtagccgtagtcgcggaacagctgggtgacggcttcccacacgtcgggcacctcgtccagcggaacccacacgctgagccgctgggccagcatcgggttggtggacaggccgccgcccacccacaggtccaggccgggtccgtgctcggggtgctcgacgccgacgaacgcgacgtcgtgggtctcgtgcgagacgtcctgcaggcccgagaccgcggttttgtacttgcgcggcaggttggcgtattcggggttgttcagggagcgacggacgatctcctcgatcgcgggcgacggatcgagcacctcgtcgagcgagtcgccggccagcggcgagccgtggatgccgcgcgggcagtcgccgcaggcctcggtggtctgcagcccgacggactcgagccgtcgccagatctcgggcacgtcctcgatgcgaatccagtgcagctgcaggttttcccggtcgctgatatcggcggtgtcgcgggcgaattcggtggagatctggccgagcgtgcgcatggtgtgcgccgacatcgccttgccgtcggagcggacccgcatcatgaagtacttggcttcgatcttgtcggtgttgtcgtcaccggtccagctgccgtcgtagccctgctcgcgttgggtgtacaggcccatccaccggaagcggccgcgcaggtcggacttgtcgatgctgtcgaaaccctgcttggcgtagacgttgatgatgcgctcgcgcacgttcagcggcccgtcggccagcttgatcttctcggtgtcgttgagcggttcgcgatctcccagcgcccactgaccctcgttgcgggtcttgacgggacgtgcggtggtcatgtggtgttccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttcccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctccttcgcgaacattccccggtgtgcgacgcaccggggtggtgttcctgacggcggctcagatcggcctgctacggggccgggatgggctgtcggccgcggcatcgcgatgatgttggggctttaggcacccgcaagttcgtcgttggacccacgggtcgcgattcccatagtgcactacttgcggccgcgtcagtagaggtcgcatgttgtgagggcacaaccggacgttgtgtgcgccgcttcacgatgggtgacggcgatcactttgcgggccaggcgaattgccgggccggtcgctgccgtgaggttggcaattccggcctgattggcaaccttggtcaggccgggcgtcagaccggaatcgtggcggaagtcgttctgcggccgccgagttgggccggcagccgggtgtatccgtgcaagttgatcagcgaccgccgttgcggggcggcggtgagccgcagatcggggaagttctcgaagagcgcgcgcagcgcggtggcgccctcgatgcgggccagggcggcgcccaggcaggcgtggatgccggaggcgaacgccaggtgctcgcgcgcattgggtcgggtgacgtcgaaagtggttgggtcgctgaacactttggggtcgcggttggcgccgccgaggaacagcccgaccatctcgccggcgccgatgtgggcgccggcgatgtcgacgtcgcaggcgggggtgcgcgcggtcatctggaccgggctggcgatgcgcaggatctcctcgacggccgagggccacaggtcgggattgtcgtgcagcagcgccagctgctcggggtgtcgcagcagcagcacgatcccgttgccgatcaggttcaccgtggtctcgaaaccggcgccgacgatgagcgcggcgttggcggtgagttcgcggtcggtcagcgacccgtcggcggccatccggccgaacggattgtcgctatgcgggtcggcgcgcagctggtggaagtgcgcgagcaggtactcgtcgacgccgcgcagcccgtcgatggcgtcgcggtaggtcctccagtcgatgccgaggtccagcagcggagagccgctgcggccccacgccagcatgcgcggataggaatcgggcggcataccaaggatttcggcgatgatggcgaccggcaatcgggtcgcgaagtcggcgatcagatcgggttgcgggatggtcgcgatgcgctcgatcagctccagggtcacctgcgcgacccgggtgttcagtgcctcgatggcgcgcggggtgaagctctgcgcgaccagttgccggtagcgggtgtggtcgggcggatccacgatcaccatggcgggcggctccaccgggttggcgacgcccgggtcggttctggcgatcagcgcccgcaccggacgcggcagctccatctcggtgggtgaggtgacgccaaatcgcttgtcgcgcagcacttgtcggcataacgcgtggtcgacgctggcccacacgaagggcgcacgcatcagcggcccgcgggcgcggatctgttccatcaacgcgtagcggtcctcgcccgtcgttccgctgcgcagcagccgcgccagcgggtcaccgcgccgggcctggaccgcgaagtaggcccgcggcaggccgtgcatggccatccaccgggcgccgagccggacacgcatgggcgatccctccgaaaccgtgagccggtcacgagacgtgcgatacagtggaactctaaatgtctcagatggctcgttcgtcacggtacgacggccgcggccggcgggcaaggagggatgcgtgacctcgacgcgaacggcggagttcgtgcgacgactcaccgaacccgaccccgtcgtcctcgcccaggtcgacaaccccgacgagatcaccgcccgaattctggccgccaccctcgaacaggccgaactcgtcgggatgcgccgcaccaccatggaggacgtggcccggcgcagcggcgtcgggcgcgccaccctgtaccggcggttcccgaccaaggcggcgctcgtcgacgccgtggtgctggccgaggcgcgtcgctacctcgagggggacgcgcaggcctgggcgcagggcgcgacgttcgaggaccgcatggtcaacagcacggtgttctcggtgaccttcatgcgcgaacacgcgctgctgaagaagttgctgcgcaccgagcccgagacgatcctgcccagcctgaccgtcgacgcgggcgtcatccttgactacgccaccgagtacaccgtcgggctgctgcgcagggagctctacggcacggagaccacgccggcgcaggagcggcacctgcgcacggtcgcggaactgcacacccggctgacgctgtcgttcatcgtcacgccgcacaccagcatcaacctcgccaccatcgaggacacccgcagttacgtgcgcaactacctgatgccgatggtcgtcgggcctcgttagtgggtccgacggcagcggactaggcggccttgggccggcccacgtcgaatgtcgttgcggctagggtgggatggcgtggctcgcgcgggggtggctcggtagcgacacgcgtgaggttggccacgttagctcgacgcccgattcgggaacacgcgggctgagccgtcgtgagagtcgtgagaaaggacagttctggtgagctcctcgtcccgcgggtcgcggctcggcacccggttcgggccgtacgagctgcgatcgctgatcggcaccgggacgttgggcgaggtctaccgcgcctacgacacggtcaaggatcggttggttgcgctcaagctgttgcggggcgagttggatgctggcttccggcaacgtctttggcgcgactgccgggcggtgacgcggctgcaggaaccgcacgtgctgcccctgcatgacttcggcgagatggacggcgtgccgttcatcgacatgcagctggtcgacgacggcggcagcctcaaggagttgctgcgcgagcagggcgggctggagccgtcgcgggcggcgtcgatcaccgggcaggtggcgcgcgcactggacgccgcgcacgccgccgggctgatgcatctggatgtcaaaccggaaaacatcctgctgacccacgaccacttcacctatctcgccgacttcggcctggcccaggccgccggcgacgacaagctttcgcgcacctacatggcgcccgaacggttcaccaccggaagcctcgggccgcagaccgacatctactcgctggcgtgtgtgctctacgaatgcctcacgggccagccaccattcgagggtgccgacccgggggagctgaggagcgcgcacctgctgtcgccggcgccccggcccagcatcatgcgccgcggtgtcggccgggcgttcgacgacatcatcacccgggggatggccaagcagcgaagcgcgcggttcgggtccgccggcgagctggcccgggcggccagcgaggcggtgttcgcggcctacgagccggtgtcggcggcggccgggctcggcgggccccgtccgttgccgacgccgccggcgcagttcgacggcccggatgacacgttggggccgcctgccgccgagcgaccgccgcgcgggcgggtgggccggctgcccgtggtggtgaccgcggtggcggtgctgatgttgatcgccggggtggtgctgtcggtgaaatccgttgtcgggactcatcacaacagttcggccccgccgccggccccgagcacgcgcgcgttggcgcctccgcccccgacgaccccgccacccccgctgactccgacgttgtcgcgtccggtgacgggcgccgacgggttggggttcatcggcgagacggcgcgctgcgacccgggcaacccgccggccgcggtggtgcgcacggccaagtcgctggccgtggtgtgtcaaaacctcagcggcagttactactaccgcggcgagcggattcgcgacggcgcccacatcgagctgtccaacgccgagcgggtggaggacgggttcgacgtcaccaatccggtcgacggcgtcgtctacgaggtgcggccgaatcggttgcggatcatcagcttcgggcacgtcgactcgtccgagccggtgctgcagtacgcgacggcgtcgtaatcggcacggttcatttttggggcgcgtgttggggcgggtcgtctgcgccggctcttgggggtgttatgagagtctcatgggcatcatcggtcacatgggtaccggtttgcctaccatgagatcactcccaaatctgctagcggatgtgatggcactcctgtcgaagcggccaatgggaccgttgcgtgtaatggcacgggatcaccacggccgcaatgcttttcggctccttccgggtgcgaaggtgaccggcagctggcccaggcccgtcatgctggggttgcccaggtactggtgcacgttgtcgacgtcgacctggtagtccgggatgcggacaagaaccgccctgaccatgacctccgacatcagccgcgccaggtgggagccgatgcagcggtgcggacccaggccgaaggcgacgtgccggttgggtgcgcggtcgaggatgatctcgtcgggccggtggaattcgttttcgtcgtggttggccgacagccagctgatgacgacgcggtcgttcttgcgcagccgttggccggccaggacaacgtcgtgagtgactgtgcgactgagggtttggttgaccgagaagtagcgcaggaattcgtcggtggcggtgcggtagagctcggggtggtcgatgagttgctgccggaggtcggggtgggtgcccaggtgcagcagggtcagcgcggtctgcgaggtggtggtgtcgacgccgccgccgatcaggttccacaggatgttgagcagctgctcgtcggtgaggcggtggccgtcgaactcgaatcgaatgaggaagctggttaggtcttcttccggtttcgcgcgtcgggtggcggcgtagtcgaggacttcttgcatcatcgccggcactttggcgatcgcggcggcgtactcgtcgctgtcctgggagaccgccatgaccgagtgaaacaggttggcgtacaggtgccaattgtcgtatggcagacccatcagcttcatggtgaggatggccgggacggggctggcgtagtcgagcactaggtccatctgcccggtggttatctgttggtcgaggaaccagtgggcggaatgctccatgaacggcttgagtttctcgacggcgccgggggagaagaacggggccagcgcgtggcgtagcgcttggtggtaggggccgtcgacctcgccgaggcccagggccggttggccttcgggtcgcgggacgcccatctcgccctggtagtccacgccgtctgcggcgttcggctcgtacttgtgggcgaaagtgtcgccgtcgcgggcggtttggctgacggcgtcgtagctgctgaggaaccagaacccgccgtagttctcgttccacgcgaccggacatcgttgccgcagttcggcgttgacggccagttcgttgaggttgaacgcgtcggagtgatggtcgaagtcgacgatcgcgtcggggctgacgttcggacgtgtggccatcgaaaagccctccaacggaaggtgatttgcgtattcggcggaagcgggcggctattggtttatcgtttgcattattacgcgttccagctggttgcagtaggggcctcgacgccgggcggcgtcgggcagggccggttcggtccgacttgctgcgggaaggttgccatgacgagccatcgcacggtttttaatcacgttgggttatgcgtggcggaccgggagcgctcccgccggttctacgagggcctgctggggttccagttctggtgggagatcgacccgcccgacgatcggaccgctcagctggtggggctgcccgagccgctcggcgtgcatgcgacgtatctagtgcgcgacggcctagtgctcgagctgatcgactactccaagcgctgggttcatgccggctcgcagcgggcgatggatcagatcgggctgacgcacatctcgttctcggtgtccgacctcccgggtgtgttggcccgggtgcgccagttcgggggagcggtggtcggcgggagcgtgtccgacggcgccgcgatgatccgggatccggacgggcagttgttggagttgctgtcggacggttggttggcggcattgccggcgaggccgtagtcggtcggccggatgcgggcgacaaggcaatgttgtcggtaccggatgagatggtctcttcatggagacggcgctcggtcgaagcgatcgcccgtcaccaaacacgtcctctcagagcggctttgggcaggacaaacttggccgcgcccggaagggctacaattgtgctacgtttgtagcatgtctgaagtggcgtctcgcgagctgcgcaacgatacggcgggggtactgcggcgcgtacgggaaggggaggacgtcaccatcaccatcaacggccgagccgtcgcgatgctgaccccgctgcggccgcagcgacggcggtggctgagcaaggcggagttgctgtcgcgcttgcgccgcgcgcaagccgatcccgggctacgccaagacctcgcaacccttgcaggcgacaccactgaggacctcggtccgatccgatgactgcaaggccggcggccggggtgctcgacacctcggtgttcatcgcgtccgaaagcggacggcagctggacgaggcgcgtatccccgacgaggtagccaccaccgtcgtcacccttgccgaacttcacgccggcgtattagccgcgacgacgtccaacgttcgggcgcaacgcctcgcaacgctggaatcgatagcggatatggaaatgctgccagtcgacgacgacgcggtccgcatgtgggcaaggttgcggatccacctagccgaggctggacggcggatgcgggctaatgatctgtggatcgcggcgatcgcggcatcgcggggactgcccgttgtcacccaggatgacgacttcgccgcactcgacggcgcggcgaacctggcgattattcgggtttgacggtgtgtctccgaggtgcgcaacctggtcaagcacgtgcggtgcagagtcgcaggggcgaatgcgttccagtcacacgccggtacgcgaatggcggtggagttgagttcactcttcgctcgctgcttttctgtcggaccatcaaattagttgtaagcggtacttccggcttcgggatgcgtcgtgctgacgagcttggcggcgcagtgatctcggtcaaacccttggaacctgcaccaggccaacgggccagaggagtcggcgaaggtaaggccggcaacggtaacccagaagtccggcccggaaaaagtcgaccaatcacccgaccaaagcaactttacgttgggataccgctgcctcagctgcaagtgctcccggagagtcattgcgttgtcccacacaacaccattgtctacgacacccggacgtttggagctaagttgtggaacccagcggtcggcgagttgcgcgcgaacaaacgcgcggtcgtcattggcgatctggtgtagctgctgtgtggcgtcttgtggtgccgacgtcggcgtgctgggtaatcgggccggctcggtctcataggtaggcacggggttggtataggaaacaagcggtgaggttgatggctccgaggtgcttgaatttcgttgtgtggtaaggccaatgaccagtccggtgccgccgaccaagagcgccaccgcgaccccaacaatggtcagcaccatcaatttcttcgagccgccttggtctgcgtcggtagcacttaccggacctgttgcgggataaggatattgggcagcgaacggcggatagctagaaggcgcactgacgtattgcggcgccagcagtgtattggtgccggccgaagtggccggatcgggagccagcgcgcgctttgccgcgcgtcctaaggccccagcactcccatagcggtcatctggatgtttagccatgccgcgggcaatgacatcgtcaaacgacgccggaacgtgcggattcacggcactcggccgcggaggcggtgacgacagatgggcgcggatggcctgctccgcgctgtgaaccggaaacggtttcgcacccgtgagtgcctcgtacaggacgcatgccaacgcgtagacatccaccgctgaggttgtttcctcatcaccgaatcgttcaggcgccatgtagtcgaaggtgccgactgtgtgccctgccatggtcaggtgcgtatcacctctcgcttccgcgatgccaaagtcgactaagtatgcgaagtcgtctggcgtgacaatgatgttctggggcttcacgtcacggtgaatgaggcctgcggcatgggcagcgtccaacgccgatgcgacctgccgaattatgtcggtggcccgccgcggctcaagtgaacccgtcttgagcatttcgtgcagtgtttgaccctggaccagtcgcatgtcgatgtacaggacaccgttaatctcaccccaatcatggatcgggatgacgtgaggctcctgcaaaattgcggctgcccgcgactcgcgcagaaatcgctcacgaaacttttcatcgtcggcatagttgtcggtgagtaacttcagcgcgacggctctgccctttttggtgtcgtacgcctcgtacacctcgcccatgccacctttaccgatcagccgccttatctcgtattggccgaacgatgtgccgaccagcgacttcatggtgcccctcctctgactttcgcttcagtcagtatccggcgcaggaggtagctcgcgcaggagtttccggaggaaccgcggaatctgtacgggtgtaggcgccgctcgtaaatcgttgcgtcgatgcttcatcaggtgcgttgccgcggcttaccgttaatcggccccgccgagcatgatcgcgttcagtatccttcggtgaacgagctgacgacaccggcggaaaggcatcaggagtgacccgactgcccctcgcgaacgccgacgagcaacccgaccacatccgccaactcttggagcgccccgacaccctggacgtcctgcgcctgatcgccaacgcgcccaacatcttcgaatcctggtcgcagatggccagccaactgtttgacaccgaaacctttagccctcggatgcgcgaggtgatcatcctgcgcgtcgcgcatctgcaggattcgccctacgagctcgcccagcacgtcgtcttcgcccgcgcggccggcctgaccgaccgccagatcgacgccctgcaagacaaggcggacctcgacgcggcagggttcaccgacgacgaacgcatcctcatcgacaccgtcacggagctgtgcaccacccaccgcctggacgacgcctccttcgccaaagcgcacaccctgctcggcgacgaggcgcttaccgaactgctgatgatcgtcgccacctactacggcctggcattagtccttaatgcaacggacctcgacatcgacgcaccgacatgacccgaatcccgtaccgccggcccgaagagatgcccgccagagcccgcgaattgaccgcccgccgaggcaatctcaacgtctaccgcaccctggccaacgccgagaaggtcttcaccagctggatggtcgccggcgacgccgcgctgagcagcccggtgctgccccgacggctgcgcgaactcatcgtcctgcgcaccgcatcggcgatggactgcgcctacgagctcggccaacaccgggacgtggcacgaaccgtcggcatcgaccccgacaccatcgacgccgtcatctccgaaaccggttggcaggccggcgatctcacccccaccgagctcgcggtcctgcacctgaccaccgagttggtcaccacccgccgggtcgcccaaccactcttcgatcgcgtccaccgagctctcggcaccgaggccaccgtggaggcactgatggtgatcaaccgctacgcgggactggcgttgatgctcaacgcgctcgaggtggacctcgacgagaccgcccggctgccgataccgccgacgagctgagcccaacacggcggcaccgagatcgccaatctcctcaggggagaggacgcctcccgtaatctgcatgatgtggcacccaagcccaagtcaacccgtctgtcagtcgaggactggctcgaggtgggctacacagtgctcgccgaagagggcgtgcgggcgctgaaggtcgaacgcctctgccagcaggccggtgtcacccgcggcagcttctactggcacttcgaggacatcgacaactaccgggccgccctggtcgaatcgtggaacaagttcctcgaacgcgaccgccaggcgctctccgagctcgactcgctgccaccccggcaacgcctctcagccatgatgggcaccctggtcagcccgcagtactggatgctggagcgggcgatgcgcgaatgggcgcgcctggacccggtcgccgccgagaacatccgggccgccgaccggcacctgctgcgcaccgtcaccaaggcctaccgcgactacggcttttccccggaggacgccaagctgcgcgcggagctgaccttcgccgcgggcatcggactgctgcacctcaccggctcggccgagcaggcccaatcgctggcccaacgcgaacgattcctcgacctgatgctgaccgaggcgggcgtggcctcagatcattgagatcggggagatcttcgccccaatcgccaacgccccggccaactctcggctcgtgtcgtagtcgaacaccacatgccccgcggcgatgtccacgtcgcgcttggcgcgctgcatcgggctggacaggaaatgagcgctcgcgccggacgcctccatgacgtcggcgatgatcgcccggctttcgtgcaccgtgcgcgcggccgccagccgggcatcggcccgcaccgagcggctcacccggtcgccgccggcgacgatcgcctcgatccggtcggcggtctgtgcgaccaacgcccgcagcgcgtccagccgcacccgggcctcgcccagcctgatctgcgcggcgggctgatccttttgcgccactgcgctatacgccagcacccgctcgccgagccggtcggcgaacagctgcaccacccgctccgccgcccccagcacgggcatcgccgccgtcagcgccagcgcgggcaccatcggccagcgataggtggcggcggcgtgctcgcgcgcgccgggcgcggtcccgccgtagatgtcggccaccgccaccagccgatgctcgggaacgaagacgtcggtgatcaccacgtcatgcgaacccgtgccgcgcatgccggcggtgtgccaggtgtcgacgacctcgacctgcccggcgggcaccacgaccaacgccggatcgatgcggtcggtgcgctcgatcaacgcgccgacgatcagccaatcggcctccatcgcccccgtcgcccaggaccacctgccggtcagccgcacaccgccgtcggccggtgtgccgcggccggtgggcgccaggggagccggcgccagcaccggcccggacgcgaagacctcccgctgcgcccgcggatcgaacaacgacagcatccagttgtgcagcgcatagaaacccagcgtccaggcgctggacgcgcagccgtgcgccatccgccgaatcggttgcagcagttcgggaaacgaggcctccaggccaccgaaccgggccggcaacagcaggcggaacagctcggtctgccggaactcgtcgaccgtcgccgccggcagccggcgcagccgctcggcctcctcggcgcgctcgcccaaccgcgccatgaactcgtcggtgatgccatgcagggggtgatgttcgaccacggacatgcgcacgaccgtaacatactttttagtatgtagagcccgcggttgttaccatcgcgccgtgagtgatcgccgagggccgcggtccgtggcccgccgcgacgtcctgcgcctcgccggcgccatgccggtgatcctggccgccggtgcggtactgcccggcccgcgcgcggcggccggtgtggccggcatgtcggtcttcctcgacccgggccacaacgccgtcaacgacgcgtcgatcaaccggccggtgcccaacggtcgcggcggcagcaagccgtgccaaacctcgggggcggcggccgacgacggctaccccgagcacgcgttcacctgggcggtggtcggcctgatcaacgcgtcgctgaaccagatgggcgtgcacacccagctatcccgcgccgacgacagcggcgtcggtccgtgcatcgaccagcgcgccgacgcggccaacgcgatgcggccggacgcgatcgtgagcatccacgccgacggcgggcccgggtccggcagcggattccacgtcaactactccagcccgccgctgaacgacgtgcaggccggcccggccgtgcagctcgctcacgcgatgcgagatgccttggcgcaggccggttttcagcccgccacctacatcggctcggacggcctgtacggccgcgacgacctggccgggctgaacctggctcagtatccggcggtgctggtcgaactcggcaacatgaagaacgccggtgacgccgcgcgaatggaaagccccgatggccgggcggcatacgccgccgcggtcaccgcgggaatcgtcgccttcctgaacgcgaaagcggcgtcgggctagccgagcggctgctcagctgccgacgccgccgccgctcggcgccgccaccgcgccgctcggcgccgccaccgtcgccggcccgcccaggccgaggtggctggaggcgaacgcgacgcccttgtcgatcatttcgttgtcgttggcgtaggtgttgtgcgcggcgaagttcatcccgtccgagcacaccggatcctcggtggcgcacaccttcagcgtcttgtcctggtacgcggggccgatgaccaccggcggctcgttcaggaaattcatcgctcgcacgttgggcatgccgaatagcaccaccgaggagacgtggttggcgacctcgggatccagcggcttgggcacggtgttggggtcgacgccgtcgggcaccgaggccgaggtgacgaagcccatcacggccgcgccctgcgagtagccgccgagcaccatcttggtgttggggcagtcgtgcgccatcgaattcacatgtgcgcccgcatctctgatgccctcgatgccggtgtcccactggtcgctcgcggggtagttgaccgggtagacgtcgaaggaccgcccgcccacccgctggtgcagggcgtcgacaaacgcttgccccgtggggccgacgccgggggcttcaccggtgccccgcgcgaacaccacctggatgtccggacattgcgccgcggcggtggggatgaccgaaccggacaccgccgaggcggccacacccgaggccgccatgaccagtgctgaaccgagagaacgaacgatgtgacgtgcgaacatgccgtcgaaaatgcccatgcaagcccctcccaaacctgtcaagtttccgaccgtttaatgaaattttcctgtatgcccgggcgcggcgacgaacggtggataggggcggcgtcgcctccatcggaccgacgccgcaattgcgcagtcgcgtcgtgtaccaagacagtctaagcgtcgtttggggtatccacgggcgggtagccggagaccgcgagcacaaaatccactactcacggtctggcgaggtgacgacatggcaacgggtgaaacgggtttcgacgacgtgacctacgacctgatctccgtccagtaccactcgctcaaggcgggccacgactacggccagtacgtgcgcgacgcgaagaacgccggcatggaggagatcgcctccttcttcagcgaggtgatggcgcaggactccgagcgggcgcggcgctgccacgagttcctcggccaactgcaggggacgcccgccgccggcccggccacaagataagaatcaccgcgagccgccgcggccgcctgccgagctaatacccgaaccgggtcagcccgagcggggcccggaccggcgtttgtgctgacaaggacggggtaatcgcgcgcaatgacccgtcgtcgcattaccgcgcgggtgtcagcatggtcacatactggcaaagctcggatgcgcctgtcggcgcggcctattagagttgcgtatcttagggaaagcttaggtattcgttaagtatgggttaggtagctacggagcaaggctgtggtcacagaccgtttcgacgcgatcatcgtgggtgcgggtttcggcggcatcggcgccgccatccagctcaagcgcctgggctttgacaacatcgtcatcctcgaccgcgaggacgacctgggcggaacctggcacgtcaaccactacccgggcatcgccgtcgacatcccgtccaccacctactcgtactggttcgagccgaaccccggctggtcacggctgttcgcgccgggcggcgaggtgaagcagtacgccgccgacgtcgccgacaaatacgacgtgcgccggcacatgcggttcaacaccaccgtcgagggcgcgcagtgggacgaggacgccgaggtgtggcgggtcgcgctggccggcggcgagagcctgaccacccgcttcctgatcaccgcgaccggcttcctgtcgcagccgcacactcccgacatcccgggcatcggcagcttcgggggaaaggtcgtgcacaccacggcgtgggaccacgactaccgctaccagggccggcgcatcgcggtcatcggcaccggggcgtccgccgtgcaggtcgtcccggagttggccaaggaggccggggagctgaccgtctaccagcgcaccgccacccacgtgctgcccaaggtggacttcgagttcgacccggcggtgcggcgcctgttcgcgcgggtgccggcggcgcagcgcgcgctgcgctgggtgaccgacgtgctgctcgagatcatcatgatcgtcggcgcgttgcacttcaaggaatcccgcggccgtggcaacatctccgcctcagatctggccaagatcaaccgatttcggtggatccgggacaaggaactgcgcgccaagctgacgccggactacgattgcggctgcaagcggcccaccttctccaacagcttctaccgcgtcctcacccagccgaacgtgcacctggagaccaacccgatcgaacggatcgagccggatggcatcgtcaccgctgacggccgcaagaccgtcatcgacaccctggtgttggcaacgggtttcgacctgtgggaggccaacttcccggccatcgaggtgatcggccgcaagggccgcaatctgggcaagtggtggcgcgagacccggttccaggcctaccagggcgtgtccatgccgtactttcccaattacctgagcctggccagcccgttcgccttctccggcttgtccttcttccacaccatcgaataccagatgcggcacatggaccggctgctcggcgaggtcaagcgccgcggcgcgaccatcttcgaggtcaccgaggaggccaacgaccggttcatggagcggatgaccaaactgctggacaattcggtgttctacgccggtaactgcgccacgtcgcggtcgtactacttcagtcccagcggcgaggcctcgctgctgcggcccacatcgacgctgaactcgatccgcgaagccagcagcttcccgctcagcgactacgtcatcgcctagcccgctcggcggtgcgccgacccggtcagcggctgcccgtcggacgactgcagcaggcagatcaccgtgctcggggtggggttggcgccggtgcgatcctgattcgaatcgatcagataggtgatcgaaaaccgcccgccgtcgccaccggtgtagccgggcagcccggccgcgcaatcccgattcgccacgctggcgatggcagcgtccacggccatcggcgcccgcagatacacctcggccaaatgcgctgtggcgcagtcgaccacggtgacgtcgacccggctgccgtcggccggcggcaggtcggccacgcactgaccgggctgcaggtcgatccacttctcgctgtgcgagcccggcggtagcggggcggcggtgacggtgggggtggcgaggctggcgttggcccagcagcccaccgccgcgaccgcggccaggccgcaccgggtgcgcagccgccgaacccgcatcggaagcctccctgaatcccttgcctggatggagtttacggcgcgccggtcagcgccggctccggtttttccgacgacatcgccaagaacccccgcacgcagcgcgcggccaacagccagttgcccggcctcctcatgtccagcccacccagcagctgtttgatcatggtcagggtgtcgaagtaaatgcgttcgcagacaagggtttcggtgtcgtcgaacaggaagtaggcggtcatgcggacgcggaactggctgccggtgggcggcaccttgcccaggtaaccgcgatgcgtgcccatcagccagaattcgacgatcaccgcgtcggcgctgtgccgcagcgcgatgatctcgtggtcctggtcggggaacgcggtccgcgtgtaggcatagtagtcgcgcaccgccgcttcgccgtcgtgcacgatcatttgcgggatcagctcgtaacgcggatgcgggaaggtcgacaacacgtcgtcccaggcgtggcggacctcgtcgtggaagtggtcgagcaccagcttctggcgggcggccagcacgtcgggagcgggaaacgcggggatggtcaccgggtcagcgtaatccggcggcccggcacggggcggtgttcgcgccgcgaatccgatagcggatgtgctagtggatgtggcacgcacacatgccttgggaggcaggcgaactcggggctagcgcgggggagtccgggccaccgggcctagcgcgggggagtccaggccaccggcaggcgcttgatgccgtggatgaattgcgacagcagccgcgcgggctcctcggtggcgacgatgtcggggatctcgtggcgcagctcgtcgaagaccacccggatctcgcggcgcgccaggttggcgcccaggcagaagtgcgcgcccccgccgccgaaacccaggtgcgggttgggggtgcgcgccacgtcgaacagccagggattgccgaacgtcgactcgtcccggttggccgagttgtaccagagcgcgaccttgtcgccggccttcatcttggtgccgcgcagcttgacgtcgcgggtcagggtgcgccgcatgtacaccaccggcgaggcccaccgcacgacctcctccaccgcggtcggcgtcaaccggtcgaagtccgagaaccacttgtcgcgctcgtcggggtagcgggacagggccagcaccccgtggctgatcgcgttgcgcgtcgtctcgttgccggccaccaccagcaggatgaagaacgacgcgatctccgacgacgtcaaccgttccccgtccacctcggcctccaccaggctggtggtcaagtcgtcgtgatggttgacccgccgatcctcggccagcgcggtggcgtaggcgccgatgtccatcgacacctgaaggaactcctcgaaatcggtggccagatcggggtcgccgaacccgagaatcacgttggtccaatggaatacccgctgatggtcctcctcggggatgcccatcatgtcgcagatgacctgcagcggcagcggcccggccagctcgctgaccagctccgcctccccgttggggtgattggcgacaagcgacgacaccagccgtcgggcccgctcgcgcaccgacgcctcgatgcgcgccaccaccttcggggtgaacgcgcggctgacgatcgagcgcagccgctggtggcgcggatcgtcgagcacgatcatcgagccgaaatactctgccagctccggtgtttggtcgttgatggtgatgttcgggacggagctgaagatctccggatgccggctggcgaagtggacgtcctcgtgcttggtcagcgcccaataaccgttgcccgccacgaacccgtccatctcgatcgcgggccagaacgagatcggcgcctcgcggcgcaacgtggcgaaagcgccgtcgcggaagtcgtcgtcgtatccccaaaagtcaagcgactcaaggtgaatgtcggccagcgggacgcggggcggcggcgccccgttgatccgagtggccaagccctttttcggtcgcgtcttgaggctcaccgggacctcctctgtgctcgggactgctcggtcagtgggtgcacacggtccgggcgggcgtgccgaccgaagccgtcgccgcgctcaccacgttgccgtcgaccaggatcttgcaagagatggggcccggcccctgcgcgctgacggtgaacacctccccgccgaacccggtgaactgcgtcgaccagggcagcggcgcgttcacctgatgcagctgaccggtgtcggtttggtagtagatgaattcggcgaccgcgggcccgttgacctcgtagcggacctgcggcatctggggcagcgcgtgggccacaccgcaggcgttcgcgaaaccgaaaccgacggccaccaacatcgacgacccggcgaggtgcttgctcataaatgcatcgtgtcaccacgggcgacggtagggaagcttatggtgaagcccgacgcggggattggtgaaccgaaaggtggcggcaaggatgtccgaacacggctcgaagcgtgtggtcgtttggggtacgggtttcgtcggcaagatggtgatcgccgagatcgtcaagcatccgctgttcgagttggtgggggtgggcgtcagcaaccccgccaaggtcggccgcgacgtcgccgacatctgcgggttgcccgagccgacgggcgtcatcgccaccgacgacgtggacgccctgatcgcgctgaaacccgacgcgctggtgcactacggcccgacggccatgcacgccaaggagaacatcgcgctgatcacccggttcctgcgggccggcatcgacgtgtgctcgaccgcgatgacgccgtgggtgtggccgaccatgcacctcaacccgcccaactggatcgcgcccatcaccgaggcctgcgagctgggggagtcgtcctgcttcaccaccggcatcgaccccggcttcgccaacgacctgttcccgatgaccctgatggggctgtgctcggaggtgcgccgcgtccgggcctccgagctgctcgactacaccaactacgagggcgactacgaggtcgagatgggcatcggccgcgagcccgaatacagcccgatgctggaaaaccgcgacgtgctgatcttcgcctggggcgccaccgtcccgatgatcgcgcacgcggccggcatcatgctcgacgagatcaccaccacctgggacaagtgggtgacacccaccgaacgcaccaccgccaagggcgtcatcaaacccgggcatgtcgccgccgtccggttcaccatcaacggcgtctaccggggcgagacccgcatccagctcgagcacgtcaaccggatcgggctggacgccgccccggactggccgtccggccacgacaacgacgtctaccgggtggacatcgagggcaccccgagcatcttccaggagaccgcgttccgcttcaccgacggctccggccgggacgccgccgcggccggatgcctggccaccgggctgcgggcgctgaacgccgtgccggcggtcaacgagctgcggcccggctgggtcaccccgctcgacctgccgctgatccccggcgccggcaccatccgctgaggcgcgcacagcgtgcgcatagccgaagctgacccgagttacaggtttggacggcacaatgacggctagccgaatgcgagtcggtgcgctgcgaacacggggatcacacatggccaatggagctgggaccgcactgggcttgtcgatcggcgccaccaacctggcggccgtcacctccgatcacgccgtcacccgcaagcccgtcctgacccggtatccggaccggcccgccgaggtcggcgtgcccgccgagaatccccggctgcaggggcccggcgtggtgatcaccggcttcgtcaaccgggtcggcgacccgcggcccgtcgtcgcgtccgacggctcggtgcaccgcagcgagatactgctggccgacgcgctgcgggcgctggcctacgccgccaccggcgggcgcgcccagcccgacgacatcgccgtcacctacccggcgcactgggagtcggcggcggtggaggccctgggcgccgcgctcggcgagatccccgaatggtcgcgacgcgcccggcccatcgtgctgatccccgacgccgccgcggccctgctggcggtgcggaccagcccgggcctgccggcgcgcggaaccgtggccgtctgcgatttcggcggcagcggcaccagcatcacgctgatggacgccgacggcgactaccgggcgctggccccgaccgtgcggcaccgcgatttctccggcgacgtgatcgaccaggcgctgctgggtgtcgtggtcgccaatatgccgaccaccggcgcattccccaccggcaccgcggccatcggctcgctgagccggctgcgcggcgggtgccgggtggccaaggagcagctgtccgccaacaccacgaccaccctgaccgacgggctgaccggggtgcgcggcgaaatccggctcacccgagccgaactcgacgacgcgatcgcccccgcgctgggcggcttcgtcagcgtgcttcgggaaacgttgtcgcgcaacgggatccgtgatctcgccgcggtggtgtcgacgggcggcggggcgaatctgcccgccgtcaccaccacgctggcgcggcttttccgtgttccggtcgccaccacgccgcacccgcagctcaccgcggcggtcggggccgcgttgcgggtggcgcacgcggacgccggcgcgacgttcaccgcaccggccgcacccgccaccgccaccgcccgcgcggcggcacggccggagccgcgcgcggacgcgaccgcgaccgccgcggtgccgccggcgaatcccgcaccgatggcggtgcaggcctggtcggacaccgggaccgacgccgcggccccgccgccccggcgcaagcggctgttcacccggtcgcggctgttccccgcggcggcggtcgtcatccccgccgcggcggtgctgctggtgggcaccgccctgatgatcggactgaccgcgcagaacaaatcggacaaatcggtgaccaccccggcgcccactctgagcaccaccccggcaccgcccccacccagcgtcaccgccgagcccgcgccgccacccgcggacatcccggtgccgtcgacgtcggacaccaacccgcccgccgagaccgagacgccgatgaccaccacgccgcgggccaccccgcaggcggccccgcccgcgcatccgctgcccccgcgcagggtggcggccccggcgatcccgcccattcccgggctcaacgaacccatccccgggctggaccgggtcaaccagatcattcaggaaatcgaaggcaacctgggcgtcgggtaattcccttacggctcagcccttttcgcccttattcggggcggcggcggcttcccggagcacctcgttgagggccttgtccttctcgatctgatcccgcaaggcctgctcgtcgcggccctcgtcggcgtgatcggtgccctcggcgacttcatgcttgggattgccgtcctcgtccagccactcgttgaccgccgtcccggacacgctgccgccggtgccgggcagcacgatggtggccttgtcctcgtaggcctccatcatctcggcggccttcttcttgtcgtcctcgtcgggttcgggcttctcggtcaaccgctgatcatcgtctcggccagaggcttgatcgtctcgcgcgctcatgcatctaccccctcgcagtcgcagattcgacgattccgtggggttacccgctgcgctgttgtgccgaaactctcatcactgcgccgcctcgcgcttgaccagcaccaccagcgcctgcgggatccgcatcggctcgggcgcgcttgacaggcgctgggcgatcgcgctctgcagctgctcgacgaaccgcggggcccgcgggtcgcggatcccgtcgtcgagtccggccaccagcgcggggaacagcgcggaccgcgcgaaggccgcccactgcgcgccgaacgcctcggcgtcgtggtcggcctggaagcgagcccagaaccggtcctcggcgttgaagatctccagctgctcgaccatcaacccctcgaaccgacccttcggcgcgaacggtgcgcgaaaatccttctcgctgcgggcgaaggtgggaatcgtcatgcgctgcaactcatccgggcgcagcaggccgtcgcgccgctgatcctcgagcgcctcgacgatggcgtcgagcagcgcggcgaaacccgccgagcagcgcccgtcctcctcgtcggcggccagggtcaacgccaccagccggccctcgggggccagctcgcggccccggaaggcgacgaagttgtgccagtccagcgcggcctggtcggcgtaggccgccagcaccgcgtcgtccctgctgcacgacacgtgcacatgatcgggcaccgcacccggggtgcggctgagccaccgcgtcgcccacgatgtccagcccaggttgaccgtccgcgacggcacgatctggttgtagaacgaccggccgatcgccgaggtgaacgtcgccgcatccgcgtgcaggtagctctccgggtcgtcggcgacagtgtcgaacagcgccgagaagtcattgcccggtaaatcggtgtgcgccaccaggattgcgtgatcggggcgggtgcgccggcgcagcaccgaaacggccgccgacaacggcttgagcgaattgtggccgttggcggcgccgtagtcggcgacgacgatcggctgcggggccttgggcagcgccacctgctcggcggcccgctcgaactgcgcgatcgccttcgtcaaaccggcggcgcgcagccgcgaggcctcggtgtaggtgggttccggccggaccacgatgcttgattggaggcccgattcgggcgtcccaggttcaggcatggatcaacgatagtggttgagttgccggtcagttcggcttgccgggatcagtggccgcgcgccacccactcctcgtagtgcacgatctcgtcgccgatggtggtgctgtcgccgtggccggtgtgcacgacggtttcgccgggcagggtgccgagccggccggagatcgactgcaggatggtcgggaagtccgaataggagcgtcccgtcgcgccgggaccgccggagaacagcgtgtcgccgctgaacaccacgccgagttccggcgcataccagcacaccgagccgggggagtgccccggcgtgtgcagcgccagcagctcggtgccggccacatcgatggtgtcgccgtcggcgatggtgcggaagtccttgtccgggtgggtcattcgccacagcacgtcgtcgccgggatgcagcagcaccggggcgtccagcgcggcgcccagctcgggggccaccgtgacgtggtcgttgtggccgtgcgtgcacaccaccgccaccacgttgcggttgccgacggccgccacgatcggctcggcggtgtgcgcggcgtcgaacaccaccacgtcggagtcgtcgccgacgatccagatgttgttgtcgacttcccaactgccgccgtcgagttcgaaggtgccgtgggtgacgatcttgtcgatgccggccatttacagcatcaccaccgagcgcagcaccttgccgtcgtgcatgttgtggaaggcggcttcgacgtcgccgagcccgatgcgctcggagacgaacttttcgaggggaagccggccctgcagatacagctcgatcagcgtggggaagtcgcgttcgggcaggcagtcgccgtaccaggacgacttcaacgacccgccgtggctgaagaagtccaccagcggcatctccagcgtcatgtcgggagtcggaacacccaccagcacaacggttcccgccaggtcgcgggcgtagaaggcctgcttccaggtttccgggcggcccaccgcgtcgatcaccacgttggcgccgaacccgtcggtgaggtcctgaatcgcggccaccacgtcggcctggcgggcgttgacggtgtgggtggcgccgaagccgcgggcccagtccagtttggtgtcgtcggtgtcgacggcgatgatgcgccgggcgcccaccagcgccgcgcccgcgatcgcggcattgcccacgccgccgcagccgatcaccgcgacggtgtcatcgcgggcgacggcaccggtgttgatcgccgcgcccagcccggccatcaccccgcaacccagcagcccggcgacggcgggatcggcggcggggtcgaccttggtgcactggccggcggccaccagtgtcttgtcggcgaacgccccgatgcccagcgccggtgtcagctcggtgccgtcggtcagcgtcatcttctgggtggcgttgaaggtgtcgaagcacaggtgcgggcggccgcgcttgcaggcccggcactgcccgcacaccgcgcgccagttcagcaccacgaagtcgcccggctgcaccgcggtcacgtcggggccgacggcctcgacccggccggcggcctcgtggccgagcagaaacgggtactcgtcgttgatgccgccctcgcggtaggtcaggtcggtgtggcagaccccgcaggcgatgacgtcgaccagcgcctcacccggcccgggatcgggaacgacgatgtcgaccaactcaacgggttcgcccttcttgcgtgaaatcacgccgcgcactgtctgactcatgggctccaacctactgtcgtccgccatacatctcgcggcgggccgtccacccatcgagccggtgtagcgtccctgggcgtgacggctttggagacgaccgacgaattcaccgaccggatcaccgcggccatcgacggcgccagcctggcgctgctgctgagcatcggacatcagaccggtctgctggacacgatggccggagtcccgccggccaccagcgatcggatcgccgaggccgccgggctcaacgaacgctacgtccgggagtggctggccggcatgaccaccgggcgcgtcgtcgactaccaccccgccaccgccgagtactcgctgcccgcgcaccgcgccaaggtgctgacccgcgcggccgggccggacaacctggccctagtcgccctgttcttgccgctgctcgccgaggtcgagcagaagatcatcggctgcttccgcaccggcggcggcctgccctacaccgagttcccgcgcttccacgctttgatggccgagcagagcggcgtggtgttcgacaccgcgctggtcgacgtggtgctgccgttggtcgacgggctggtgccgcggctgcggcgcggagtcgacgtcgccgatttcggctgcggcagcgggcacgcgatcaacgtgatggcacaggcgtttccggccagccgattcaccggcatcgacttctccgagcacgccatcgccgccgggatcgccgaagccgccgaacgcggcctcgcgaacgtgtccttcgaaagtcgcaatctcgccgatctcgacagggccgacgcctacgacctcatcacggtgttcgacgccatccacgaccaggcgcagcccgcccgggtgctggcgaacatccaccgcgcgctgcggcccggtggcgtgctgctgatggccgacgtcaaggcgtcgagccggctcgaggacaacatcggcgtcccgatgagcacctacctgtacaccacctcgctgatgcactgcatgacggtgtcgctggccgccggcggcgccgggctgggcaccgcgtggggcacgcagctggccgtcgcgatgctgggcgaggccggctttgccgacgtgcgggtggccgagatcgagtccgacccgatcaacaactactacatcgcccgcaagagctgatggcggcgctcgacgctctggacgaatggcccgtcggggccgtcgccgccgcggtgatcggacccaccggcgtgctggccggccacggcgacgccgagcgggtgttcgcgctggcctcggtgaccaagccgctggcggcgcgcgccgtgcacgtcgcggtcgaagagggcgccgtcgagctggacgcggccgccggtccgcccggcgccaccatccgccacctgctggcgcacacctcggggctctcgatgcactccgatcaggtgctggccccgcccggaacccgtcgcatctactccaaccagggcttcaccgtgctgggccaaaccctggaagaagagaccggcatcgaattcgcccgctacctgcacgaggcggtgtgccaacccctgggcatgaccgccacccggctggacgggggcgcggtggcggccggattcggggcgacgtcgaccgtggcggacctggcggcattcgccggcgacctgctgcggccgacgacggtctccgggcggctgcacgccgaggcgacgacggtgcagttccccgggctggacggggtgctgcccggctacggggtgcagcggcccaacgattgggggctcggtttcgagctgcgcgacggcaaggcgccgcactggaccggcgcggccaactcggcgcgaacgtacggtcatttcggccaggcgggcggcttcatctgggccgaccccgacatcgagcgggcgctggtggtgctcaccgaccgcgatttcggggagtgggcgatggaccggtggccggcgatttcggacgccgtgatatccgaatacagctaaatcggatcgcacactagcgcaacatgggtatcacagggcacaatagacacgcgcgacacagaaaaaatcgaagatttgcgcaagctgccctgcttgccgggtccacaggtcgttggggaagacgtccctcgtggaaccgaaggagcaggaaatgcgagcgtcgaaccaattcgccgacgtgacgactggcgtggtgtacgtgcacgcctcgccggcggcggtgtgcccgcatgtcgagtgggcgttgtcgtcgaccctgggggccaaggccaacctgacctggacgccccagccggcgatgcccggacagctgcgcgcggtcaccaactgggtcggtccggtgggcaccggcgccaagctggccaacgcgttgcgctcctggtccgtgctgcggttcgaggtcaccgaggaccccagccccggagtcgacggccaccgcttcagccacaccccgcaactgggtctgtggagcggggcgatgagcgccaacggcgacatcatggtcggggagatgcggctgcgcgcgatgatggcccagggcgccgacacgctggccgccgagctggattccgtgctggggacggcctgggacgaggcgctcgaggcattccgcgacggcggcgacgccggcgaggtgacctggctgagccggggcgtgggttagggaccggcccgcaggatccgcagcgcgcccgctgccggcggagatctccgccggcagcgggcaggcgaagtcgccgtcggcgtagacgttgatccccggacactcgacgtggatggatttggcccgcaccgtgctcacctgctcgagttcgacgtgcgtgcccgtcattacggtggggaacaggcggaccagcttggcgcgcgatgcctcgtgcaccatggtgatgtcgagcaggccgtcggcgtggtcggcggccgggcagatccgcattccgccgccgtagctgcgggtgttgccgaaggcggccagtgtgatctcggcgtcgatctcctgcgcgccgtcgagcaccaggcgaaaaggtaagagccgcaactgggacagctcggcgagcatggccacgtaatagcgcagccggccgtgcggccagcgcatccggttggcgcgatcggtgaccagcgagtcgaagccggtggccgccacggtgccgaaccacttgtcgaatccgttgtcggcccgaatccggcccaggtcaacggtttcggcccagccgtcgacgatgatgtcggcggcggcctcgggatccttggtggggatcccgaattcacgggcgtggtcgttgccggtgccggccgggacgatgccggcgggaatgtcggtgcccgccaacacttgtagcgcgttggagaacaccccgtcgcccccggtcaccatgaccgcgtcggcacccttgtccagtgccgcgccgaccaggtgccgggcgtcttgcgcgtcgtcgccgatgatttcgacgacctccaccccgcgccggtgcagccgggcgatcgcccgctgcgcggcggccaccgcggcgccgtgcccggagaccgggttggtcagcgcgatcaccttgccgatctcgtaccggcgcagccgtgcagccggggacgtcacggaatcagcttgccggggttgaggattccggccgggtccagggtggccttgaccgcgcgtaacacctgcactcccaactcgccgacctcctcgcgcatccacggccggtggtcggtgccgacggcgtggtggtgggtgatggtcccgccggtggccatgatcgcatccgaggcggccttcttggcggttttccactgctcgatcggatcgccgcgttgcccggcgaccacggtgaagtacaacgacgcgcccgtggggtagacgtgcgaaatgtggcacatcaccagcgccggggtgccggtctgcgccagcgcggtggtgagtgcttgcgtgacagcggctttcagcgccgagatgttggaccagtcggtggccgtctccagtgtttcgcacagcgccccggccgccagcagtgagtcgcgcaggtagggcgcaccgaaccggccgcgctcccaggcccgggccgggccgtcccccagcgacgttccgccctgggccgccagcagcgcgcgggtttcggcgtgccggctgtcgacgtgttgttcggtgccctcgaacatggtgatgcacaggcagccgccggtgatccgggactcgccgatcgcctcggtggtggccaggttgaccccggtctcggcctcgtcggagaggcgaatcacggtggggccggtgccattctgggtgaccacgcgcagggcggccgccccggtttcgaagtcggggaacgaccatgcctcgtagcgaacggcctgcggaatgcggtgcacccgcagccgcacccgggtgatgacgcccagggtgccctccgagccgatcagcagctgacgcaggtccgggccggcggccgactccggtccgcgccccaggtccatggtgcccaccggggtgatcacccgcagcccgcgcaccatgtcgttgaaccggccgtagcccgccgagtcctgcccggaggaccgggttgcagcgaagccaccgatggtggcgtattcgaaactctgcggaaaatggccaagcgaaaagccatgtgcaccaagcagtttctcagcatccgggccggtgaccccggccccgagaaccgccagcccagacaccgggtccaatgagatcagctgatcgaaacggcgtagatccaccgcgacggcggcgccgaacccggcgcgctcgggggcgagcccgccgaccacgctggtgcccccgccgaacggtacgaccgcgatccgatgctgggagcagtagcgcagaatcgcggcgacggactcgtcgtcgccgggcagcaacacggcgtcgggcgcatcctgcgggcccgggccgttgcggctgagcaggtcgatggtggacttgccgcccgcgtgcagcaaccgatcggaatcggcggtgcggcagtactcggggccgacgatggcggccagcgcctcccggtccgccggcgatagcgtggacggacgcaaccgcacctgctcgggtcgcggctcggccgtgcgggacccctcgatccccacggcctgctgcagcaatgaccggatgccctcggagagcggtttggccgcggcgggatccccccaggcgttccatttcatcggcggcagcagccgcttcggatgcgtcatgcgttacagtattacagatgctgtcaatccgtaacgataagccggatgccgtgctggacaccggcgagcgcatcctggcggccgcggccagctgtgtggtcgacttcggcgtggaccgggtgaccctggccgagatcgcccggcgggccggcgtcagccggccgacggtgtaccggcgctggccggacacccggtcgatcgtcgcggcgctgttgacccggcatgtcaccgacgtgatgcgggccgcgccgttgctcggcgacgaccgggaatcgctggtgcgacagatcgttacggtggccgacctgttgcgccaggaccgactggtgatgtccgtgctgcactcggagctggcgccgatctacatcaccgagcggctcggcaccagccagcacatgttgatcgacgccctcgccgcccggctgcgggtggcccagcgtaatggcagcgtccggcccggcgacccggtgcagatggccaccatggtgttgctgatcgcccagtcgaccatccagtcggcgcagatcgtcgaaccgctgctcgacgccgaggcgctggccaaggaactcgcctactcgctgaacggatacctgtcgtgatccccgaccccagcgcgctcaacgccgcccgccggaccgccgacctggccgcgctcgccgagggtgagccgctggacgtgctggtgatcggcggcggcatcaccggggccgggatcgcgttggacgccgccgcgcgcgggctgcgggtggcgctggtggaaaagcgcgatctggcgttcggcaccagccgctggagctccaaactcgtgcacggcgggctgcgctatctggccagcggcaacgtcggcatcgcccggcgcagcgccctcgaacgcggaatcctgatgacccgcaacgcccctcatctggtgcacgcgatgccgcaactggtgccgttgctgccgtcaatgagccgggccacgcgggcgctggtgcgcggcggcttcctggccggcgacgcgctgcgcttcctcgccggcacgccggcctcgacactgccccgctcgcaacgggtctcggcgcagcgcgtcgtgcagctggcgccgaccgtgcgccgcgacggcctggacgggggattgctggcctacgacggtcaactgatcgacgacgcccggctggtcaccgcggtggcgcgcaccgccgctcagcacggcgcccggatcctcacctacgtcgcggcgtcgcgggccacgggcacgtcggtgcggttgaccgacgtgcgtggcggcggctcgttcgacgtgtcggccggcgcggtgatcaacgcggccggcgtgtgggcgggcgagatcgacggctcgttgcggttgcggcccagccgcggcacgcatctggtcttcgacgccgccgccttcggcaatccgactgcggcgctgacgattccgattcccggcgagctcaacagattcgtcttcgcgatgcccgaacagctgggccgggtctacctcgggctgactgacgaggccgcgcccggtcccatcccggacgtgccggagccgtccgtcgaggagatcacgttcctgctcgacacggtgaacaccgcgctgggcacggcgctggccgccaccgacgtgagcggcgcctacgcggggctgcggccgctgatcgacacgggtgagggccgcaccgccgacgtctcccgcgaacacgccgtcgtcgaatccgcgtccggggtgatcagcgtgatcggcggcaaactgaccgaataccgttacatggcacaggatgtgctcgatcgtgccgtgcgggtgcggcggctgcgcgccgcgaaatgccagacccgcaacctgccgctgatcggggcgccggccaaccccgggatcaccggagcgccgcacgtcgcactgccggagtcactcgtgtcgcggtacggcgccgaggcggccaaggtcgtcgcgaccgccggttgcgagcggccgaccgaaccggtcgtcgacggaatcgacgtcacccgagccgagttcgaatacgcgatcacctacgaatgcgcgctggaggtctccgacatcgtcgatcggcggacccggatcggcctggtgccgcgcgaccgcgagcgggtggtggccgtggccgaggagtttctcgcccgcttcgggtagggcggctggtcaccccccacccgtcaggtattgatagttcctatcgaatgatagaaactgtcagttctggtggggtgtcgaaaggggacgagatgaccacgcgagtgcctgtgctcatcgtcggggccggcgtcggcggcctgtccatgtcggcgctgctgacccaacacggtgtccggtcgctgctggtggagaagcggcgcgaggtcttcctgtacccgaaggcccgcaacctgagctttcgcagcttggagatcctgcgcgggatgggtctgggcgacgaggtgcatgcggtcgccgagcacgtctcgaccgtggtggccaagccggcgctcaacagccccgaggagcgaccggcgctcgacctcgaggggatcttcgccggtctggagcggttcagccccgaaccggcggcccagtactgcccgcagagccggctcgagccgatcctgctcgccgcgacccggcgcggcggcagcgaggtgcgctaccggaccgagctgtcctcgatcgacatggacgaggccggcgtcaccgcggtggttcgcgacgccgactcgggcaccgccgagacgatccgcgccgactatctgatcggcgccgacggggtgcacagtccgatccgtaacctgttgggaatcaccacgtctggatacggcgcgctgcccatctacgtcgtcttcgtctacttccgggcgccctggcgaaagttcatcccgcacttgcacgacggcgacggcgtgcaggtcaagaacgccgacgtggacggcatcttcctggtcgccgagggtgacctcggcatgttcatcaccacctactttcccgacgacggcgagacggccgagcagttcacgccgcagcgctgccgcgagctgctcaccaaggcgatcggcgagccgctcgacatcgacgtcatcgaggtcgcggcatggcagccctacgagcaggtcgccgaccgattcgattgcgggcgagcgtttttggtgggcgattcggcgcacaccatgccgccgttcaaggccgggggagccaacaccgcgatccagagcgcgcacaacctggcctggaaactcgccgccgtgctgcgaggcgcggccggaccggcgttgctggacacctaccacgccgagcgccaccccgtcggggtcttcgccgcgcgccagtcgctcaccgggccgtcgatggccctgctgagaccgggtgggaagcggccgcaactgccggccgacgaagaggcaccgatctttgccctgatgatcggataccgctacggcgcgaacggcatcgagctggtggacgagttgcgcgcccagccgggcacccgggtgccacacgtctgggtgcgcgacggtgtctcgaccctcgacctggtgggcccggagttcaccgtgctcaccggcgacgaacgctggtgtgccgcagcggtttccgtgtcgctaccggcgcaccgggtgtgcaacgaccagtgggcggcgatcaccgggctggcgccggacggggcactgctgatccggcccgacgatttcgtcgggtggcgcgccgacgagctgcccaccgacccgcaaaccgctctccgccaagcgctttcgctgtgcctgggccgggcacgtagggcgcgagcagacgcaaaagcccctgatgcgcggcgtgtccccggncctnttcgtctccctgtcctcccggaaagtggggttacagcgggatgttcttgtgacggccgcggcgtgccggcgcctgggccagcgcctcggtgagcttgctgcgggtgtgcgccgggtcgatcttctcgtcgaccacgccgatctcgatcgcactgtccacaccgccggcgatcttctcgtgctcggcggccagctggtcgtgcagcgcctcgcgctcgtgctccggggcggcggccagcttcttcttgtgcaggatgccgacggcggccttggctcccatcaccgcgacctcggcgtccggccaggcgaacaccttggtcgcgttcagcgaacgggagttcatcgcaatgtaggccccgccgtaggtctttcgggtcaccagggtgacccgcggaacggtcgcctcgccgaaggcgtgcagcagcttggcgccgcgacgcaccacaccgccccactcctggtcgacaccgggcagatagcccggcacgtcgacgatcaccaccagcggaatgccgaaggcatcgcacagccgcacgaaacgcgctgccttctcggcactttcggagttcaggcaaccgcccagccgcagcgggttgttggccagcacgccgaccgtgcgaccggacagccggcccaacccgatcaccatcgacggcgcccagttcgcctggaactcgtcgaacggcgtctcgtcgtcgaggatcgcggtcacgatggggcggacgtcgtaggcgcggcggggcgactcgggcagcagcgcgtggatgtcggtgtcgccggcctcggccttggtgcggtcgaaatggccctgctggcagaacaatccgaccaaccggcgaccgcgctcgtaggcgtcgagctcgtcgtcggcgacgatgtggcacaccccggacttcttgtggtgggtctcggggccgccgagcgaggccatgtcgacgtcctcgccggtgacgctgcgcaccacgtcgggtccggtgacgaacacccggctctccggcgccatcaccacgacgtcggtcagcgccggcccgtaggcggcgccaccggccgcgaagccgaccaccaccgagatctgcgggatgtagccggacgcgcggatcatcgcctcgaacaccaggcccacggcgtgcaacgccttcacgccctcggccagccgggcaccgccggagtgccagatgcccacgatcgggctctgctcctcgatggcggtgtcgtaggcgtcgacgatgtgcgagcagccctcgatgcccatggcgccgcccatcacggtgccgtcggtgcagaacgcgatggtgcgcacaccgttcacggttcccgcggcggcaagcacgcccgagcggtcacgttcgtgcagcagcgcgacgctgccgtcgtcgaagaaattgctcaggcgcaacagcgggtcgcgggggtcgagcgactcgccaaccgtctcgggggccgtgatagtcatcgcagggtctcctgtattccggtgctgctcgggaccgtgggttcagtaccgtccgaaggcgatggcgacgttgtggccgccgaagccgaacgagttgttgatcgcgtactggtagttgcccggtcgcggtttgcccgccaccacgtccaaatcgatttcggggtcgaggttttccaggttcagggtgggcgggacgacctggtcgcgcagggccagcacggtcaggatggactcgaccgcgccgaccgcgcccaccgagtggccgagcgcggcctttggggcgtagacggcggcgttgccgccgtgcgggcccagcgcgttgttgatggccttgctctcggccacgtcgcccaccgaggtgccggtggcgtgcgcgttgacgtgatcgatgtcgccgggcgtcaggccggccagctggatggcgcggctcatggcgtgtccggcgcgttcgccgttggggtccggggcgaccatgtggtagccgtcggaggtgatgctggcgcccatgatgcgggccaggatgttggcgccgcgggccttggcgtgttcctcggtttcgatcaccatcagcgcgccggcctcgccgaacacgaagccggtgcggtcccggtcgaacgggcgacaggcgccgacagggtcgtcgttcttggtcgacatcacgatgcgcatctgggcgaacgccgcgatcggcaccgcctcgatcttcgtctcgacaccgccgcagatcgcgatgtcggcctcgccgaagacgatgttgcgccacgcctgggcgatgccctcggagcccgacgcgcacgccgagaccggggtgatgacgccggccttggcgtggtgttccagcccgaccgccgcggctgcgccattgggcatgtacttctgcacaccgagcggggagaccgccttcatgcctcgcgcgcgcatgtcgtcgtagctgaagaccatttcctcggatgaccccaggccggtaccgatggagaccatcagccggttgctgtccacctcgggcgagccggcgttctcccagacccgccggcccaagatggtggacatccgttgcaggtagcccgtccggcgcagctcgacgcgggtcagctgactgtcgaactcctccaacagatgtccgccgatgcgcaccggcaggtcgaactcctcgacgaagggatcgtcgagtgtgcggataccactttgactgtccagcaacagcttccaggtggtctcggcgtcagtcgccagcgcggtcgtcatggcgatgccggtgacgaccacgttcgggagcgttttcccggtaaccagctctgtcatgggtcttgcgaagattccttccctaacttgtccggcaactttgcgggccggtgcggcccgcatcgtcgccggacgtcgtgctcagtagcgcccgaaggccagtgccacgttgtggccaccgaagccgaacgagttgttgatcgcgtattggtagtcgccgtagcggggttcgcccgccacgatgtccagatcgatttcggggtccggggtttcatagttcaaggtgggcggaatgacgccgtcgcgcagggtcagcaccgtgagcaccgattccagcgcgccgaccgcgccgattgagtgtcccagcgcggacttcggcgcatacaccgccgcctcctgacatccggccacccggatggcgttggcctcggcggtgtcaccgatcggcgtcgcggtgccgtgcgcgttgacgtggtcgacgtccttcggggacaggcccgccaactccagcgaccgcgtcatggcccggcccgcccgcacaccgtcgcccgccggggccaccatgtggaacgcatcggacgtgatgccggcacccatcaaccgggccagcggcttggcaccgcgggccttggcgtgctcctcggtctcgatcagcatcagcgcgccggcctcgccgaacacgaacccgtcgcggtccttgtcgaacggccgcgacgcccgctcgggctcgtcgttgcgcgtcgacatggcccgcatcatcgagaaggccgcgatcggcagcgcgtcgatagggccctcgacaccaccgcacacggcgacatcggcgtcgcccatgacgatctggcgccacgcgtgggcgatcgcctccgagcccgacgaacaggctgacaccggggtgatcaccccggcgcgggcgccgagctgcagacccaccacggcggcggcgccgttgggcatgatcatctgcacggccagcggcgacaccttgcggggcccgccctcgttcatcaggtcgtagctctccacgatccgctcggcaccaccgaggccggtgcccaccacgaccgagaaccggtcggggtcgagctccgggttgccggcggtctcccacagctgggtgctgagcagcttggccagccgctggacgtaggacatgcggcgcaggtcgagcctgctcatccgctcgtcgatgggctccttgaggtggccaccgatccggaccggcaggtcccacttggtgatgtagtcgtcttcgaggacgtggatgccgctttcgccggcgagtagacccttccacgtgctctcgacgtccggcgcgatcgacgtcgtcgccgtgacggcggttaccacaacgctggggtaaccgccgttagcagtggaaggcttactcacttgctgtccgcttccagccttgccttgacgttggcgaccgcctcggggttctcggtctccagcttggcgcgcaacgcctcggcagcctcggggttctcttcctcgagcttctggatataggccacgacgtcaccgacggtgcgcagaccggcgaggtcctcgtcgggaatcttgacgccgtacttgtcctcggtctgcacggcgatctcgaccatcgacagcgagtcgatgtccaggtcgtcgacgaaggacttctccggggtgacctcggagggctcgataccggtcacctcttcgatgatctcggcgataccggcgatgatttcttcctggctgacagccacagcatttcccttcgtaatgtgttgtgattcagtcgaactgacgtgtgttatgcggttgtactggtcgagctggcttttaaagctcagccaaagcgtccaggtctgcgggtgacttcacggctcgtgccgaaaccccccgaagttctcgtttggcgatgccggtgagagtgcccgcgggcgggaactccacggccgctgcgacttccagctcacgcagcgtggcggtgcacaggtcccagcggaccggctgggtcagctgggcgaccagcgcctccatcgccgcggccgccgaggcgaccggcttgccgtcgcggttggacagcagcgtggcggtgggctcggccgtctggacggcggccgccgcggcggcgtagccgtcgagcgccgaggccatgtacttggtgtggaacgctccggccaccccgagggcgcgcacccgggccttcgccgggggatcctcggccagcttctccagcgcggccagcgacccggcggccacgatctggccggcggcgttgcggttggcggggaacaggtcgagctgctcgagccgggcgaggacctcggcctcgtcgccgccgagcaccgcggacatgccggtcggctcgaccgcgcacgccttggccatctcggcgccgcgggtggcggccagcgcgacggcgtcgtcagcggccatcacgccggcgatcgcgtaggcggcgatctccccgacggagtggcccgccacgaccaggtcggcgtcggcgagcaggccgcgccgggtcagctcctggtgggcgagcagcgtggcggcgacgaccagcggctgggtgaccgcggtgtcggtgatctcttcggtcgatgcggtggtgcccaggcgaaccaggtcgaggccgctggccttggaccacagcgccaactggtcggcggcgccgtcgagctccagccacggcgagagcatcccctcggtctgcgaaccctgtccgggcgcaagcaatgcaatcacgtgtttaagagaacactgtggaaacggttttggcgggtgtaacagattatgaacctcgtcttaggtttttgtgtacaccctacaaaatagctcggtaagctactggtttgatatcgtgccgcgatctgttgcccgggtcactatccgcccgattgcccccgcgcagcaccgttgaccggcagcggaacggcgggcatggcggcgccggcggcgctgggcgggtgcgtcgggtagttgagctgcccgaccgtcgcggccactcgcagcacatatgcgtcccgcggctgcatgggatcgcggccggtgaagtcggtgatccgcttgagtcggtagcgcacggtgtttggatgaacgaacaactttctggcacaagcctcaatcgcgccaccagaatctaagaaagcgtccagggtttcgatgagggtggggccggcgtcggccaacgggcccatcacgtcggtgtgcagcgccacgatcgccgacgcatcgcccatcagggcgcgttccggcagcagctcgcgggccagcaccggccgtggcgctccgcgccagccgccgaccgcgttcatcccggatatcgcctcgctggcgctgtggtaggccgccgtcagcatcggtgcggtgggcccgacgacgacagggccgtcggagaacgcctccagcagatcgcccaggaatttgtcggtcggtgacaattggccggaaacgatagcgaccagccaggtgccgtgcacgtcggtcagcgccgcccggccgtgctgcgcggcgatgtcgcggacgtgctgactggcgcgttcgctgtcgccggggccggtcgagccgtcgcggccgggcgccggcgtcccgaccacgaccgtcgccggggcggtggtgtcccagttcagcgccgcggcgcgggacagcagctccgggccggtgtcgccccggaccaccgcgtcgaccacgctggcttccatccggctgtcccaggtgccgcgcgcctcggcggcgtcggcgtaggcggtggcggcggtgaaggccaggtcgcggctgtatttcaggacgccgacggtcagggcggtcagctgctcttcggagcgggccagcagcggcaccacctcctcgaagaactccatggtgacccggaccatctccacgctgtgccgcagcgcgatgcggcgggccaggtcctggggcaccagctcgaaggcctgcgcggtgtgccggacgttgctcttggggtcctgcatccattcggcgaagttgaccacggccgtctgcaccaccagcgacacgctggctcgctgggaggcttccaggtcggcgaagaacggcaactggtcctgcatcaccgacaccgcctcggtggccagccggccggaatactgcttcagccggcgcagcaccgattccgggacggtatccagcgtctccagcggcgaccggggatgcttcgcgatcgggccggcgaacgggttgtcattcacccctaaaacctacgccatcttttggagacttcccccaaaggggcgggggtgtcgggctggtgggtgctcccggccggcgctcgggtggtgcggggccgcggcggctgcgtggggctttgccggccgagcgtgaagttagcttcacgctcggccccgaccgtgaagctaacttcacgctcggcggaggcgcggtgggcgtgggcgcggcggggtggtgggagcgtgggcgccccgccccgggtgccgttaggccacgccggggtcggacgtctgctcgggggcggccagcacgtcgtcgatgcggtactggcgtgcggcggcgaccggcaccgacgggtcgatctcgccgtcgcgcgccagcgcctcgagcaccgcgaccacctgcgactccgcgtcggtgttgaagtagcgccgcgccgcgggccgggtgtcggagaagccgaacccgtcggtgcccagcgtcacgtaggtgcccggcacccacggccggatctgctcgggaaccgcccgcatccagtccgacacggcgaccaccggcccgctggcatccgacagcgcctgcgtgacgtaggggacgccggcgggccggtccgggtgccgcagcctggcccggtcgatcgccacgccgtcgcggttcaactcgccccagctggtcaccgaccacacgtcggcggccacgtcccactcgtcggccagcatcttcgccgcgttcagcgccgacggcatggccaccccggaggccaggatctgcgccttgttggcgcgctgttcggtggccacgtggtagcggtagaggccgcgcagcaggccctcgggatcgaagttctccggctccggcggctgcacgtacggctcgttgtagacggtgatgtagaagtacacgtcctcggggttctcgccgaacatccgtgccagcccgctctccacgatgtaggcgatctcgtaggcgaacgccgggtcgtaggcgaccacggccgggttggtggcggccagcagcagcgagtggccgtcggcgtgttgcaggccctcgccggtcagggtggtgcgccccgccgtcgcgccgagcaggaagccgcgtgtcatctggtcggcggcggcccacagcccgtcaccggtgcgctggaagccgaacatcgaatagaagatgtagatcgggatcatcggctcgttgtgcgtggcatacgacgtcccggccgcgatgaacgatcccaccgatccggcttcgttgatgccctcgtgcaggatctgcccgacttcgctttccttgtacgccaacatcaattcggcgtccacggcggtgtacagctggccgttgcggttgtagatcttcagcgacgggaaccaggagtccatgccgaaggtgcgcgcctcgtcgggaatgatcggcacgatccgcgggccaatctccttgtcccgcaatacttctttgaaggtgcgcaccgtcgccatggtggtggcgacctcctgggtgcccgaccccttcttcagtgcggcgtagatgtcgcggccgggaagcctcaatgcctttgccttggtgcggcgttcgggcagaaagccacccagggtgcggcgccggtcgagcatgtagcggatctcgggggcatcggagccggggtggtagtagggcggcagatagggattctcgtccagctgggcgtcgctgatcggaatgcgcatcgcgtcccggaagtgcttgaggtcttccagcgcaagctttttcatctgatgcgtggcgttgcggccctggaagtgcgcgcccagcgagtagcccttgatggtcttggccaagatcaccgtgggctggcccttgtggtcgacggcggcccggtaggcggcatacaccttgcggtagtcgtggccgccgcgcttgaggttccagatctcggcgtcggtcatgttctccaccagcgccttggtgcgcgggtcgcggccgaagaaatggtcgcgcacgtaggcgccgtcgttggccttgtaggtctggtaatccccgtcgggcgtggtgttcatcaggttcaccagcgcgccgtcccggtcggcgtgcagcagggcgtcccactcgcggccccagaccaccttgatgacgttccagccggcgccgcggaagaacgactccagttcctgaatgatcttgccgttgccgcgcaccgggccgtcgaggcgctgcaggttgcagttgatcacgaacgtcaggttgtccagcgcctcgttggcggccacctggatcagaccgcggctttccggctcgtccatctcgccgtcgcccaagaagcaccacacgtgctgatcggaggtgtccttgatgccgcggtcatgcaggtagtggttgaaccgcgcctgataaatggcgttcagcgggcccaggcccatcgacaccgtggggaattcccagaagtcgggcatcagccgtgggtgcgggtaggacggcaggccgccgccggcgtggctgtgctcctggcggaagccgtcgagttggtcggcggtcaaccggccctccaggaaggcgcgcgcgtagatccccggggaggcgtggccctggatgaagatctggtcgccgccgccgggatgcgacttgccgcggaagaagtggttgaagccgacttcgtacagcgccgccgacgacgcgtaggtcgaaatgtggccgcccacaccgactcccggccgctgcgcgcggtgcaccatgatggcggcgttccaccggatccacgcccggtagcgccgttcgacgtcctcgtcgccggggaaccacggctcgagttcggtgggaatggtgttgacgtagtcggtggaggtcagcgacgggagggcgacccgctgctcgccggcgcgttccagcagccgcagcatcagatagcgggcccgtgacggcccggagcgctccagcagttcgtcgaaggactccagccactccgacgtctcttccgggtcgatgtcggggaggtaggacgcgaccccctcgcggatcacccggacgcggtcgggttcggccgggccggtggggtttgtggccagatcgtggcgcacgaattcggttgtcaacccactactcctgtaattggcgggatgtgtgccatggggtggttcgcaccccgaccaccatcgtgccgcaccggtgttcgacgcggatagtcgacgtctggtagccgactcggcgggcaacgccccggcgggtcggggacagccgcacaccccacccggtaacgtcaggaccgtgctcatccggtggcgtggcgtcccgcaggtgcaggtgggggctttcccccggcgtggtgcgttggccctcgggtgtgtggccgccgcgctgatcggcatcgtgggatgcacctccgtcaccaacggaaccgcgacgcccgacacccgggtggccccggcctaccggcagtcggtgtccgcgtcggtgtccgcctcgtcggtgacctcgagcgtccgcgaatcccagcgccagcagtcgctgaccaccaaggcggtgcgcaccgcctgcgccgcgctggtcaccaccagcaagaacgcgatcgacaagaccaacgaattcgtccaggcgttcaattcgggccgcggcacgggccccaccgaaggcccggccatcgacgccctcaacgacagcgccaacacggtggccaacagcttcaacgacgcgatgtcgcagcagatcaaggacgcgttcaacgcctatatcgacgccgcgcacgcggtggccaacgccatcggcacgcacgcgtcgacgtcggaattcaacaagcgcgtcgaccagctcaacgacacgaagaagaaggcgatccaactctgcctggcaacctagtgagccggaagtgtgaacgggatcgcggctgtgcgacgataatcggcaatcacacggtgtgcacggctggcgcacatggttgaaggaggctccacggtggtcgcggcggatcacgccccgagctacgctcgcaaactgggcatccaacgggaccaagttgtccaggagtggggctgggacgaagacaccgacgacgagatccgcgccgcggtggaggaagcctgcggcagcgacctgctcgatgaggacaccgacgaggtggtcgacgtcgtgctgctgtggtggcgggacggggacggcgacctggtggacacgctgatggacgcgatcagcccgctggccgaggacggggtgatctgggtgttgacacccaagaccggcaagcccggccacgtgctgccggccgagatcgccgaggccgctcccaccgccgggctgatgccgacctcctcggtcaacctgggcgactggagcgccagccggctggtgcagcccaaatcgcgcgccgggaagcgttgatgctgtcggtcggcacccccgccccggacttcaccctgcgcgaccagaaccagcagcgcgtcacgctgagctcctaccgcggctccaagaacgtgctgctggtgttcttcccgctggcgttcaccgggatttgccagggcgagctggaccagctgcgcgaccacctgcccgagttcgagaacgacgacagcgcggtgctggccatctcggtgggtccaccacccacacaccggatttgggcgctggagagcggtttcaccttcccggtgctgtccgatttctggccgcacggcgcggtcagccagagctacggcgtgttcaacgacgaggccggctactccaaccgcgggacgttcgtggtcgaccggtccgggatcattcgcttcgccgagatgaagcagcccggcgagtcccgcgaccagcggctgtggaccgacgcgctggcggcgctgaaggcctgaaagtttggggtcccggccgacgggcgtgtagcctgcggcctgcacaggggcgcgtagctcagtggtagagctctggttttacacaccagcggtcggcggttcgataccgtccgcgcccacccgatgaccggcccggcggccggccgcgcgcggcgcggagccggccgccgaagccggctcgaaatgccttggcggcgtggggttcccggccggtggccggtgggcggcgcccgacatccaggaccgcgcgccggccagcacggcggcgtgcaccgcccgcgcgatgcgggcgccgaacgtcgagcgcggcccgccgaacgcctccgccgccccgtcggtcgggcagtgcacgacgaccgcgtccgaggcggttccggtggcgcgaatcccggcctcgtgcaaggcctgcgccttggcctcggtggcggtggccacggcgttgaccaacgccgcctccgacagccgcaccggcgccgccaccacgatgttgatcgtccccacccggtgcggcgcctcgcggcggaagtggtggtcgggcgcggccgcccaggcggggctggagagcccgaccgtcgcggtcacctgcacgccgccgtcggctccgaggtggtggcgggtcacgtcgaccgcggtcaacagcccgcatccggtgccggcgagccccagcgcggcgccgatttcgaccaggtggcggtgggggtcggtccggtcgtaatcgagcgggaccgtggcgttgaccaaccagtcccgcgcgccgatgccgccgccgagcgggcccgacgagatgcacagccggggctcggcgaagctccagaccagcaccggcagcgaccgatggtgttcgacccgcgcggtcaactggggatgcacgggtctcatcctggcgggcgggcgtcagcgagcgtcacccggccggatttcgggccccgaccgtcgcggtgggcacatactcgcgcactatgaacgcgtgaaaccgttccgcatcgatgtccccgacgacgttctcgacgacctgcgcgcgcggctggcccgcacccggtggcccgaggccgaatgcgtggacgactggagccagggcatgccgctggcctacacccgcgagctggccgactactgggccaacgactacgactggcgcgcgcgggaagcggcgctgaatcgcttcgaccagttcgtcaccgaaatcgacggcctggacatccatttcatccaccagcgctcgccgcacgccgacgcgttcccgctgctgatcacccacggctggccgggctcgatcgtggagttccacaaggtgatcgagccgttgaccaacccggcgtcggggcgcgccgaggacgccttccacgtcgtgtgcccgtcgctgccgggctacggcgtctccgggaaacccacccgcgcggggtggggcgtggagcggatcgcccgggcctgggaaacgctgatgctgcgcctgggctatcaacgctacggcgcgcagggcggcgactggggcgcggcggtgaccacccagatcggccgcaatcgcggccactgcgtggccatccacctcaacatgccgatcggcaggcccggccagcaggcgctgaccaaccccaccgagcaggagcgggcggcgttggccgcgttggcgaatcaccgcaagtggggcaccggctactccaagcagcagtccacccggccgcagacgctgggctacggcctggccgattcaccggtgggtcagctggcctggatcgtcgaaaagttctgggactgggccgattgcgacgggcatccggagaaagcgttgagccgcgacgagctgctcgacaacgtgatggtctactgggtgaccaacaccgccgcctcctcggcccggctgtactgggagagcttctcggcgtggggcggcggggaccgggtcgaattgcccaccggcgtcgcggctttccccggcgaactgctcaaggcgccgcgctcctggtgcgagccggcctacaacatcacgcactggacggacatgccgcgcggcgggcatttcgccgcgttcgagcagccggagctgttcgtcgaggatctgcgcgtgttcttcgcgacggtgcgctgagggcgggctagctagaccacccggcggccctggcgcgcccgggatcgcatgtcccacaagtaaattcgatagccgaggatccacacccagtgcgggatcaaccggtcggccagccgcaacgagaacagcagccagccgaaccggcgctgctgggccggcgtccaatccagctgcatcatctcgcggaactcgggggccaagaaccccgtcgtcgcaaacaggttgaacggcccggccagcacccgcagcggccagggcaggaaggccagcgacgccaccccgtgcaggtgctcgcgcaccggcgggtcgatgcgcagctcgtcgagcgagcgtttccagtactcgtcgaaggcggcccgggccggcggccacatccgttcgggcacctgcagcgtggtgcccagccgcgcggcgtcgcgatagaccgcgtcggccgaggcctcatccagcgggccgtgcaggaactcgtgctggtcgacgaagtagcggtacaggcacgccgccacccacagctgcagcttggggtcaaaagcgttgtaggacaccgggcttgacggcctggaccgcacctgccggtgggcgacgtccaccgccgcgcagatcaacgcccggtcgtagtcggtgccgatggtcgcggcggccagataggtgccggtggtgcgggcccgcttgaacggatgcttgtagacgttgccgctgtccaccgggctttccagcacgccgtagccgacgccgggcagggacagctgcatgatgacgttggcggcgggcagcaacgtcgccgccggattcagcaggtcggcgacccgcttcgcgggccgcttcattgcgggccccgcctcgtcgattccatgaaccccagtatgagacgctgcgcaggtgttggcgacgcaccccctcggcgtgctgatcggttacctggccgaccgcgcgctgggcgacccgcgccggggtcatccggtggcgctgttcggccgcgccgtcgccggtctggagaacctcacctaccgcgacggccgggtcgccggcgcgctgcacgtcggggtgtcgatcggggcggtgggcctgctggggctggccgtgcaccgggccgccgcgcgcgccggtccgcgctggtcgatcgcggcgaccgccgcggccggatgggtctgctcgggtggaacctcgctgacccgcaccgggctggccatggccgagctgctgcagcgcggcgacgtcgacgccgcccgtcggctgctgccgtcgctgtgcgggcgcgacccggcggcgctggacgccgccgggctggcccgggccgcgctggaatcggtcgcggagaacacctccgacgcgcaggtggcgccgctgttgttggcggcggccggtggggtgcctgcggtgctggcgtatcgcggcatcaacacgctggacgcgatgatcggtcaccgctcgccgcgctatctccgattcggttgggccgcagcgaaattggacgacatcgccaactacccggcggcgcgggtgaccgcgtcgctgacggtgctgctggcgccggtggccggcggctccccgtcgggcgcggcgcgggcctggcgccgcgacgccgcccgccatcccagccccaacgccggcgtggtggaggcggcgttcgccggggcgctgggcgtgcggctgggcgggcccacccagtacgggcacgagctgcagatccgcccgaccctcggcgccggtcgcgagcccacggtgaccgacctgcgccgggcggtgcggctgtcggcggcggtgcaggccgccgccgtggccctggcggccgggctgctggccgcctaccggcggcgtccgtagcggtcggcgagcttgtcctgcaccgactgcggcgcttcgggtgcgggtgcggccggttgcctttccgcgcggcgggcccgcagctcggagtaggcgaaataacccaccccgatcggggccaggatgccgaacgcgatccactggatgccgtaggacaggaacgggccggcgtccagttgcggcacgccgaccacccccagcccgccgggctgaccgtcgaccaactgcagataggacccggcgagcggcaccttggtgagcaccgcgatctgctcggtgtcgatcgaatacacctgccgcacaccgtctcccacgaacgggtccttgccggcggcgggctcggagttgcgcagccgggcggtgatggtcaccgtgtcggcgggcgggcgggggatcggcgggacccgcgacccctccaacggccgcacgtatccgcggtcgaccaagacggtgggcccgccgtcgaccacgaagggcgccagcacctcgaacgccggtttggagtcgatcacccgcagccgggccagcacctgcacgtcggccagatagtggccggtggcgctcacctgccgccactgctcggccggggcggccgagttttgttgcggcagcagggttttcagcgggacgggcggggtggtcagggagtgttcgatctggtggttctgctgcgaggtcctgctgtgcttgcccagctgccagggcgcgagcacggtgaagcacaggtacgcgaacgcgaccaccaccagtgccagcacgacccagcccggccgcagcagaaacgacaagccgcgcagccaccggggcatcacgacgatccgttctgcgccagccgttcgtcgacccagtcgtgcaggccgggcagcgcggcctcgatgacggtgtagacgcgttcgaagtctttgctgtcgccgtagtaggggtcgtcgacgtcgggggtgtgcgcgccggtgcgcggatcgaacgaccgcagcatccggatgcggtcctcgtcgacgcccaggtgccgcagcatccgggcgtggttgcggtccagggccaccaccagatcggcggacagatgctcggcgcccacctgcgcggcgcggtgctcggtcgggtagccgtgggcgcgcagcacgccggcggcccgctcgtcggcgcactcgccgacatgccagttgccggtgccggcgctgctcacccgcacggcatcggccaagccgcggcggcgcagctggtcggcgaacatcttctcggccatcaccgaccggcagatgttgccggtgcagacgaacgtgacgtgcagcggttcagacacccagcgccctccgcagctcgtcgatggtggcgacgcgggtgacgccgtcggggtgcgagtcggcgtgcccgtagccccagccgaccaccacggtgtcgatgccgtgcgcggccgcgccgtgcacgtcgtggctgcggtcaccgaccatcagcacccgctcgggcagcggttccagctgcgccagcgcgtgcgcgagcacctcgaccttggccttgcgggaacggtccgggctggccccggcgatcacctcgaagtgatggtcgagcccgaaatgggcgaggatgcgccgcgccgtcggctccagcttggaggtggccaccgccagccgcatcccggcggcgcgcagatcggccagcagcgcctcgatcccgtcgaacagcgtgttcatcgcccagccgcgggcgccgtactcggcgcggaacgccgcgatcgccgcctcggcgtcctcgccgagttgcatggaccggaacgtgtcgtccatcggcgggccgacgatctgcgcgacgaggtcgccccggggcaccggcgcgccgatggactcgagcgcatgcaggaagctggccacgatgccctccgcggagtcggtcagcgtgccgtccagatcgaagatcaccagctgcgccgcgggggcggcgggatcggctgacgttgtgcctgtcacctcaccattgtcctcgatggccgcggcgggccgggacggtgttgctcggtgctgctccgggccgccgggccggccactaatgtttcacggatggcgagtctgaacctgagcccgccggcggcgcgctaccacggtgatcaggccgtcgcacccgggatgctggatttcgccgtcaacgtccggcacagccggccgccgcagtggctgctggatcggttggcggcgcggctgcccgacctggcccgctacccgggcgacgacgacgtgcaccgggcgcaggacgccgccgccgaacggcacggccgccgccgcgacgaggtgctgccgctggccggggcggccgaggcgttcgcgctgctgagcaacctgcgcccggcgcgggcggcggtcatcgcgccgtcgttcaccgagccggccgcggcgctgagcgcggccggggtgccggtgcaccacgtcgtgctggagccgccgttcggtctgcgcggcgtggccgtccccgaggaggccgacctggtggtggtgggaaatcccaccaatcccaccgcggtgctgcacggccgcgagcagctgctggcgctgcgccggcccggacggctcctggtggtcgacgaggcgttcgccgacgcgattcccggcgagccgcaatcgctggccggtgacgcgctgcccgacgtgctggtgctgcgcagcctgaccaagacatgggcgctggccgggctgcgggtgggctacgcgctgggcgcaccggaggtgctggcgcggctgaccgcgcagcgggcgcactggccggtgggcacgctgcagctgacggcgctggcggcctgctgcggccggcgggccgtcgccgacgcggcggccggggcggagcggttgagccggctgcgcgagaagatggcggccgggctggcgtcggtgggcgccgacgtgctcgacgggcgggcgccgtttgtgttgttccggatgccggatgcggtccgggtccgaaagctgttgcacgacaaggggatcgccgtccgtcgcggtgacacgttcgtcggcctggacgagcggtacctgcgcgccgcggtgcgcccggagtggccgctgctggtgcaggcgatcgcggaggtgcagcggtgagcgtgaaactcgccgacgtcatcgcggtgctcgaccaggcctacccgccgtggctggccgagccctgggattcggtggggctggtctgcggtgaccccgacgaaccggtggagtcggtgaccgtggcggtggacgcgacacccgcggtggtcgacgaggttccggccggcgggctgctgctggcccaccacccgctgctgctgcgcggggtggacacggtcgcggccagcacgcccaagggtgcgctggtgcaccggctgatccgcagcgggcggtcgctgttcaccgcgcacaccaacgccgactcggcgtcgcccggcgtctccgacgcgctggccgaggcgctgggcctgaccgtcgaggccgtgctggagccggcccggcccgcctccgatctggacaagtgggtcatctacgtgcccggcgaaaacgcggacgcggtgcgggaagccgtcttcgccgccggcgcgggccatatcggcgactactcgcattgcagctggagtgtcaccggcatcgggcagttcctgccccacgagggcgcctcgcccgcgctgggcagcgtcggccaggtggaacgggtggccgaggaacgggtcgaggtggtggcccccgcgcgggcccgggccgcggtgctgaccgccatgcgcgccgcccacccctacgaggagcccgcgttcgacatcttcgcgttgctgcccccgcccggcgacgccgggctgggccgcatcgggcggcttccgcagccggagccgttgcggcgcttcgtgtcccgcgtcgacgcggcgctgccggcgacgtcctggggagtgcgggcggcgggcgacccggaactggcggtgtcgcgggtcgcggtgtgcggcggggccggcgattcgctgctggccgccgcggccggcgccggcgtgcaggcctacctcaccgccgacctgcgccaccacccggccgacgagcatcgccgggcctccgaggtggccctgatcgacgtggcgcactgggccagcgaattcccctggtgcgcccaggccgccgacctgctgcggtcccggttcggtgaacggctcgacgtgcgggtgagcgcgattcgcaccgacccgtggaatgtcgggcacgacgggggtgagggatgatgaaagccgatgtagcacagcagcgttcactactcgaattggcgaacgtggatgccgagctgtcccggctcgcgcaccgggccgagcatctgcccgagcagcaggcctgcgagcggatgcagcaggaatacgacgccgccggtgaccggctgggcgcggtgcgaatcgccctggaagacatcgatgctcacgtgctgcggctggaagccgaagtcgacgcggtgcgccagcgcgaagaccgcgaccgctcgctgctgcagtccggagcgatcgacgccaagcagctggccgaccttcagcacgagctcgagacactgcagcgtcgccagaccagcctggaggattcgctgctggaggtgatggagcgccgcgaggagctgcaggcccagctggacggggagcagcaggcgctcaaggagctggaagccgagatggccaccgcgcggcgcgatctggacgccgcgcgcggcgagatcagcgagtcccgtgcgctgcattcgtcgcggcgcgacgcgctgagcgccgaactggaccccgagctgttcgccctctacgaacggcaacgcgcccggggagggccgggcgccgggcagctgctggggcggcggtgcggggcctgccggctggaaatcgaccgcggggagctgtcccggatctcggcggccgccgaggacgacgtggtgcggtgcccggaatgcggggcgattctgctgcgggtcaaggggtccggtcagtgaaggtcgtcatcgaagccgacgggggatcgcgcggcaaccccggcccggccgggtacggcgccgtggtgtggacaccggaccgcggcaccgtgctggccgagaacaagcaggccatcgggcgggccaccaacaacgtcgccgaatatcgcggcctgctagccggtttgggcgacgcgctgaagctgggcgccaccgaggccgaggtctacctggattccaaactgttggtggagcagatgtcggggcggtggaaggtcaaacaccccgacctgatcgagctgcacgcccaggcccgaagcctggccgcgcgattcgacaggatcagctacacgtggatcccccgcgagcgcaactcgcacgccgaccggctggccaacgaggcgatggacgcggccgccgcggccaccggcacggcggaaaagcccgggccggccgaacaatccgatccgaccgccgccgacgccgggaaaaccgccgcggcgccgtcacccgcggcgcccgggtggaccggcgcgcgcggcaccccgacccggctgctgttgctgcgacacgggcagaccgaattgtcggtgcagcggcgctattccgggcgcggcaaccccgcactcaccgagacgggacggcggcaggccgacgcggcggcacgctatctggccgcgcgcggcgggatttcggcggtgttcgcctccccgctgcaacgggcctacgacaccgcggcggtcgtcgccaaggcgctgggcctggacgtgaccgtcgacgacgacctgatcgaaaccgatttcggggcctgggaggggttgacgttcggcgaggccgccgagcgcgaccccggactgcaccggcgctggctgcgtgacaccagcaccgccccgcccggcggggagagcttcgactcggcggccgagcgggtgtcgcgggttcgccagaagatcatcgccgcacagcagggcagcaccgtgctggtggtgtcgcacgtgacgccgatcaagatgctgctgcgggaggcgctggacgccgggccgggcatcctgtaccggttgcatctcgacctcgcctcgctgagcatcgccgagttctattccgacggagccgcttcggtgcggctggtcaaccagaccggatacctgtaggacgccggaaagccaggcggacgggttagccgtcgccggcgggcgggtgcacggtgatggcctgctcggggcagttctgctcgccgacgccggcctgcacctcgagctcaccggagacccgcccgacccgcaccacgcagtggccgaactcgtcggcgtcgaagacgtcgggcgccagggtgtaacagcgtccgtggccggtgcagcgctcggcgtcgacgacgacgcgcctcatcgcgccctcatcgcactgggaagaccagcggcagcgactccaccgacctcagcgcggcggtgtaggtcagctgcgtgcccggtctgatctcgtaatccggtatgcgcctatggaattcgcgaagcgccacgcgcagctccatgcgggccagatgagagccgaggcagcgatgcgggccgccgccgaaggcccggtgccggttggggctgcgggtgaagtcgacgatctcggggtcggggaactcggccgggtcggtgttggccgcgccgagcagcgggctgacccgttcgcccttgctgatcgggcagccgccgacctcgacgtcttgcgttgcgacgcgagcgacaccgggaaccggtgtctcccaacgcaacagctcctcgacggcgccgggcagcacgtcgggccgctcgacaagctgacgacggtgctgggggtggcgcgccaggtagacgaaaaagcagtccagcgagtcggtgacggtgtccagaccggcgatcaggaacaggaagcagatgtcgagcagctcctcgcgggacagcggctgcccgcccacgtcggcggcgatcatcgcggacagcacgtcgtcacgcgggaccgcgatgtgctcgtcgatggccttgtcgaagtactcgtagatctgttgggccacaccggcggagctctcgtggcggcggtcgaaccccgagtcgcccgccgggcggatcaccccgtccttccacagcagaaatcggtcgaggtcctccagcggcagacccagcagctgcaggaacaccgtgcacggcaggggaaccgcgaactcggcgtggaagtcgcattcgccccgcggggcgaaccggtcgatcatctcgttgaccagctcggtgacgagcggttcgcggcgggccatctcgcgcggggtgaacagcgggtcgaggatgcggcggtacttggcatggtcgggcgggtcgatctgcagcgggatcagcggccgcacgttgcccaggtcgaccgcgtccatgttcgacgaaaacagttcggtgtgcttgagcgccatctcgatgtcggcgaggcggctgagcaccaccgcctgcgtggaccggaacaccgggttggactcgcgcagcgccttgtacatcggttgcggctccgcgactccggtgacggtctggtcgacgaaacctccggcttcggtcattgggtcagcctggcaccatcgtcggcgccaggcaatggcgtggccggctaactgtgcaggtgcagccgctcgccgtgcggtccgaagatgacgatggcctccaccggcccgtcgaccacgccgaaccagtgcggagtccacgtcgagaactcgaccgcctcgccgggatcgatggtgaagtcccggtcgcccaggatcagccgcatccggccggccagcacgtacatccagtcctgtccctcgtgcacgggcagctcggcgggcggggtgcgccgccgggcgctgacccggatcttgaaggcgtgcaggccgccggcggggccctggcgggtcagcggccagtaggtgacgccgtggtgggtgtgcgccgacccccgcacccgcgggtcgggcgcctgcgcgggctgcaacagctcgtcggtgctgaccgagagcgcccgggccagccgcggcaggtgatccagcgccagccggcgcttcccggactccaggcggctcagcgtcgacacgtcgatccccgcccgcgcacccacctcctgcaacgtcaggccgcgctgcacgcgcagctcccgcagccgccggcgcacctggacgtcgatgtcggtgtttgcctgcatggcaaacaagcttggcaaaacttgggcggctgggcaagctcgcggtatggacacttcgtgcgaacccggtgaggccgggcggttttgggaagaacgctatcgcggcgccgagcgggtgtggagcgggcgggtcaatccgcggctggccgaactggccgccgacttgccggcggggcgggcgctggatctgggttgcggggagggtgccgacgcgctgtggctggcgcagcgcggctggacggtgctggccgtggacatctcggccaccgcgctacgccgcgccgccgaggcagcagcgttgcggaaattattggcgcggatcgactttcagcgccacgacctcaacgagagcttcccggaagggatgttcgacttggtctccgcccagtatttccactcgccggtccacctcgaccgggacgccgtgctgcgccgggcggccacccgggtgaagcccggcggtgtgctgttgatcgtcgaccacggcgcggcgccaccgtgggcgcagcacgacggtcaccacattcccggtgtcgaggaggtgctcgggtcactgcggctggatccggacgggtggacccggctgcgggccgaggccgcggggcgcgaaatgaccggtccgaacggagaagtcgggacgttgatggacaacatcatgatgttgcggcggaccgaacaggcctacgcggcgtcgtgaaagatcaagcccatcgcgtagcgctggccggaacgcaccaccgagaccccgtggcgtaccggcgccgcggaccagccgcgggccgagcgcaccggacgttcccgggtggtgaagacatagccatggccctgaggtaattgcgttgcggtgccgcgggattgggcgcgcggccgctgctcgacaagcaggaattcgccgccggtatagtcggtctgcggatcgctcaggttgatcaccacctgaagcggaaacaccaagtccccgtagagatcctgatgcagcgcattccagtcgccggcaccgtatttgagcatcagggcggtggaccgttgctggccggcggcgtggcaggccgccagccagtcgtcgaggcggtccggccacacggggtcgcggccgagtttgccccaccagtcgcgggcgatcggcagcaaccggggatagagggcttgtttgagttgttcgatcggctcgggatagggcgcgcggaagtagcggtacggcccggcgccgtagcgtttgggggccatgtcgatggtcgaccggaacaggccgtcgtcggcgtacagttcgcgcagccgcgcggcttcccggggcgtgaccagccgcggcagcagcgccccgccgaattcgccgatcgcggcggcgatggcgtcccaatcgccggagtcgacgcgcctgtgccatcggtccatcaggtccacgatagggcccgcccggccgcggcgagggcgttgctggcaccggccgggtgcagcgggtaccgtggatcgtcgcggacgagttggccgggcggccgcggctcgtatcccgagtcgaggaaagtccggacttcacagagcagggtgattgctaacggcaatccgaggtgactcgcgggaaagtgccacagaaaacagaccgccaccctcgcggtggtaagggtgaaacggtgcggtaagagcgcaccagcaccccgggtgaccggggtggctcggcaaaccccacccgaagcaaggccaagaaggccgtgccgccggcacggccgcgcaggcgtccgagggttgctcgcccgagcctgcgggtaggccgctcgaggcacccggtgacggtgtgtccagatggatggtcgccgccgcggcgccggttttccggcggcgcggaacagaatccggcttacaggccaactcgtccgccccggcttcgctgcgggcggttgcgggctaatccgccttgtgcaccgccttgccgagtttgcgcagcgtgtcgtcgagttcgtcacggcagcgttgcgccagatcggcctcgcgctgatagagcagcccgtaggtgaaggtgtcctcgccggcggcgtgcgcggcctgcgcctcctgactcaggtgttcgcggctgaccacgctgtcttggtgatcgcccagcagtgactgcacggccttggcccgctcggccactcgcaccgctctggtcgccgtcgcggtgtatcgaagtcgcttggcgcgcttgcggattcgatgtatcgcctcgtcgcgcaggtgccggtcgccggggtgctcgcggtccacccgggcggcggccttggcggccttgcggaccttgcggtaggcggtgtcgatggtcaccggcgcctgttcctcggccccggggaagccggggcgccgggccgcgatcgcgtccagggagtcgagcagccggaagtagcgctgcgaccgcatggcgatcaacgaccggcgcagcccgacctggtagcggcgccgggcacccccgaccagacgttcgcgcaccggcccgcgcaccaactccggtgggagcgcgcccaagtcgcgctcgtagcgctcggcgagcacctcggcgtcgcgggccacccccaaaatgccggccagctcccgcaattcgtcgagcacccacccgtcgtcgcccaacccgaacgaatcctggtagtcgcgcagcaggctgcgcagcttgcgggtggtgacccgcatctggtggacggagtcgaaggcgtcggcgcgcacggcgcgatcccacaccagcagctcgcgaacctgctcggcgatcgcgcgctgcagcggatcctcgggcggccgcgcgccgttgggcgacggcgcgcggcccagcacccgcgccagcttggagccgtggcctgccggcaccgctccggcgtccagcagccggttgctcagccggttcagcagctcggcggcgccctcggcgtgcccgttgccgccgagcagctccaattcccattcccgccactcctgttgggtgggcggatgttgggtgggcacctgatcggtgggcgacgcggcggtgtcgtcgaaaccgccggaaccctcgtcgacaccgccggaaccgtcgtcggggccctcgggcgcgctcggcgtcgcccacgccgtgacgtggtcgttgctgaactcggccagcggctggcccgccgcgtcgtagagcacctgcgtgtcacgctcggtggtgatccgcgcgaccggccgcagcggacggttgcggacgatcgccagcaccacatcgaccaactcggtgggcacggtgtcggcgtcggaggcgtccagcggtgcccggacttcggtgcgcgcgtcgggcccggcgggcaacttcaggtgccatccggcgtccgagccgccggtgcgccggcgcagggtgatcttgttgcgcgccaagtcatgtgcgggcgtgtcgaaatacgtcgcgtccaggatctgggtcggcgactgctcgacccgggcgaccgcggcgatcccttcgaacgagggcatcaccgtggactcgaccacgtcgaacttgcgctccacctcgagatgacgcgaggtctgcggcgcttgtgcaggcatcttcgggctccatcggaggcgcgtcggaggcgcgtcgggggcgccgggcgcggccgtcaacatggtggacaggggcggatgagcacccatagcctgccataccgcggtgacggcgttacggcggcggaggcggcgggggagtcgaggtgtcgtcttcgggcagcggcgcgtaaacggccggcggcggggcgtagcgggcgatgttgtcgccgatgttggtgcacccgctcaccgtgacgcgccggccggcgcccacgcacacggtcgcgtccgcgcgatcggcgccgggcacggcgaccaggatcgcgggcacggcggccagaccgcagagcaccagcaatgccgcacggcaccggcgcgcattcatccgcgctccccttccgacgctttgattgccacctgattgcattgtgccgtcgtgagccggcggcgggcgggaatcggaaataatcgcctggcggccgcgcaattcttcgccgcgaatcggcgcccgcgcggcgaggaaacccttatggtttgccatacgcacacccgcctttcggcagaaccgacgaatggagcgttccatggcgccttttgctcgctcggcaccccgagtcatgggcgaaagaatcgcggccggcgcggccggggtggcaatgaccgtcgccggccttgtcgcgacgcttgtgctgacggcgggaccggcggcggccgactggccgatggacgatccggaaccggcgccggcgtcgctgccgaactgcacggcggccgacctggcccaggtgtcggcgggcgtcgccgcagccacgtcggcgtatctgttcagtcacccggacgtcaacgcctacttcaccagcttgaagggccagccccgcgacgagatgcgcgcgcagctcaagcagtacatggacgccaacccgcagacccactccgacctggagggcatccgccagccgctcaccgatttccaggaccgctgccggtgacggccccggccggtcagccggccggcggcggctgcagatgcatcgccagatcgctcagctcgaggatggtctgaatctcgctgtcccggaacggccgcccgtcgggatccagcaggtcgtggaaccattcgcggggcatcgccggatccggatgctcccaggaatcccacgggaaaaacgtctgggttttaccggcgaccaggccccagttgaacgcgccgacgttggcgcgcttggcgatcggcaggatggtttgcaccgtgctgcccagcggccgggccatgtactcggtgcacaggatcgggcgccccagcggcaccagatcggcgatgcgcttctcgaacgccgccggttcgccgtagcagtggaaggtgatgacgtcggagttgtcgagctggatgccgctgatgacgctgcgccgtgccgggtcggcccactcgccctgccacacgccgctggtcaacggttggcagggatccaccgagcgggcccacgcgaacacctgcggcagcagctcggcgacccggtccagcttgtcggtgcgctcgaccgaggcgtaggcgtcggcgggattgtccggctcgttccacaggtcccagcccaggatgcggtcgtcggtgcggaattgcgccagcaccccggtgacgtagccgcgcagggtgtgcaggtagccgtggtcgtccagccgcgccgcgcccgggctttgcacccagccggaattgtggatgccgggccggggcgcccgctgcggacccggttggggaaagggatcccagcacgaatcgaacaacacgaacagcggcttgatgccgtgtcgggccgcgatgtcgacgaaccgggccaggcggccctgaaacccccggtggtcctgttcccacagcaggtcgtgcaggaagacgcgcaccgcgttgaacccgttgcggcgggcccagcccagttcggtgtcgatgcggcgggggtcgaaggtgtccggctggaacatctccagctggttgatggcgttggaggtgatgtagttcgcgccgaccggccaatcctgcgcctgataccagcggttggcccgttcgggtgaccaccggcttgcctgcggcgacgtgcggggcggctgcgcggacgcgtgcggtgctcgggccaaagccatgcctcctgccaatagcagcggcaacttgaacaccagtcgacggtgcactaagtcaccacgattcccccggtcgatgtggtcccacccttgcgctagacaatccgtcttcggcaatcgtacatcgttgccacacaatgattttcagcccacgccagccgccgggcggtgaccgggacggttgcggtgcgcgctaaaacccttgctacgccgtcacagtagcgcagcggggcgagggccccaacgaccgcgtcagaagcagtgctcgtcggccgggaagaccccggcggccacctcgtgcgcatactgcgttgcggcgcggcgcaattcgccgccgatgtcggcgaagcgcttgacgaagcgggcggacttgccgctgctcatgccggccatgtcctgccaaaccagaacctggccgtcgcagttggggccggcgccgatcccgatggtcgggatggtgagcttgccggtgatctgggtggccagctcggccggcaccatctccatcaccaccgagaacgctccggcctcggcgacggcgatcgcgtcggcgatggtctgttcggccgcgtcgccgcggccctgcacccggaaaccgcccaggctgttcacgctctgcggggtgaagccgatgtgcgccatcaccgggatgcccgcggcggtcaggtgagcgatctgctcggccacccgttcaccgccctccagcttcaccgcgtgcgcgccgccctccttcatgaaccgggtggcggcggccagagcggcggccggcccggcctcgtagctgccgaacggcaggtcggcgaccaccagggcgtgcggcgccccccgcaccacgccgcggaccagcgggatcagctcgtcgatcgacaccggcacggtggtgtcgtagccgtagacgacgttggccgccgagtcgcccaccagcagcaccgggatgccggcctcgtcgaagatgcgggcggtggaatagtcgtacgccgtcagcatggcccacttgtggccctcggccttcatcttttgcagatggtgggtgcgaatcctggtgcgcggctgggcgggctggcccggttgggccggctgggcggcaccgtaaacattgtgctcagacatcgttgtcctagtgggtggtcgggtcgatcctcgtggccctcagttttgaaagatcctgagcgggtccccgggttcgtctgacgggtgtcattctgccatttcttttgcgcagtcgcaccgctgcggcggtgtgagacataccatgctgcgcatgcagcggctgagtggactcgacgccagcttcctgtacctggagacctcgtcgcagcccatgcatgtgtgttcgatcatcgagctggacacctcgacggtgccgggcggctacaccttcgagcggctgcgtgacgccctggtgcgccgcatccgggcgattccgccgtttcgggaaaaactcgccgacagcccgctgaatctggaccatccggtctgggtggacgacgaggacttcgacatcgaccgtcatctgcaccgcatcgccgtgccggcgccgggcgggcgtgccgagctgtcgcagatctgcggccacatcgcccagacgccgctggaccgccgccggccgctatgggagatgtgggtgatcgagggcgtggccggcaccgactgccaccgggacgggcggctggcggtgatgaccaaggtgcaccacgccggcgtcgacggggtgaccggcgccaacctgatgtcgcagctgtgcgcgaccgagcccgacgccgcggcgccggaaccggccgcgggcgtcggcggcggcgccgggtggcggatcgccgccggcggcctggtcagcttcgcggcccggccgctgcggctggccaacgtggtgcccgacaccgtgtcgtcggtgctggccacggtgcgacgggcgctcgacggcgcggcgatggcccgcccgttcgcggcgccggcgaccgtgttcaacgcccggatcagcaaccggcgctgcatcgcatatgccgaattgaatctcgacgacgtcaaagcggtgaagaaccatttcggtgtcaaagtcaacgacgtggtgatggccctggtttccggcgtgctgcgccaatatctggcggagcgaaacgcattgccgaattcgtcgctggtggcctcggtcccgatttccgtgcacggcaaatccggccggcccggccgaaatcaggtgtcggccatgttcgcgtccctgcacaccgaaatcgccgacccggtgcagcggctgaaagcgatcgcgcacgcgaattcggttgccaaagaacacagttcggcgatcggggcgtcattgctgcaggattggacgcaattcgcggcgccggcggtgttcggcatcgcgatgcggctctacgcgcggacccggttcaccgacagcatgccggtgcacaacttggtggtctccaacgtgcccgggccgcaggttccgctgtacctgctgggctgcgaggtcaaggcgatgtatccgctggggccgatctttcacggctccgggctcaacatcaccgccatgtcgttgcggggcaagctggacgtcgggctgatcggctgcccggacctggtgccggacctgtgggagctggccgacgagttcgcggtggcgatggaggagctgcgagcggcggcgcggtagccgggccgcggtgccgctgatcaggatcccaagtttcctctggcagcatatgtgggcatgggcctgtctcgtcgcggtaagagcgcgcgcacgctgctgatctggatgtcgatcgccgcggtcgcgttgctgttggcgggctgcgtccgggtggtggtgggacgcgccgtcatgtccgggcccaagctgggccaggccgtggagtggacgccgtgccgggccgccaacccgaaggtcaaactgcccgccggcgcgctgtgcggcaagctggccgtcccggtcgactacgaccacctcgacggcgacgtggcgacgctggcgatgatccgtttccctgccaccggggacaagatcggttcgctggtgatcaaccccggcgggccgggggagtcgggcatcgaggcggcgctgggcgtcgtgcagtcgttgcccaagcgggtccgcgaacgcttcgacctggtcggtttcgacccgcgcggggtgggcgcgtcgcgcccggcggtctggtgcaactccgacgctgacaacgaccggctgcgcaccgagcccaacgtcgactacagcccggccggggtggcccacatcgaggacgaaaccaaacagttcgtcggccggtgcgtcgacaagatgggcaagaagtttctggccaacgtcgggaccgtcaacgtcgcccgcgacctcgacgcgatccgcgcggcgctgggcgatgacaagctgacctacctcggctactcctacggcacccggatcggctcggcctacgccgaggcctacccgcacaacgtgcgggcgatgatcctcgacggcgccgtcgaccccaacgccgaccagatcgaagccgatctgcggcaggccaagggattccaggacgcgttcaacaacttcgccgccgaatgcgccaagcaaccgaactgcccgctgggcaccgacccggccaaagccgtcgacgtctaccacagcctggtggacccgatggtcgatcccgacaacccgatggtcggccggcccatcccgacgaatgacccacgcggactgagctatagcgatgccatcgtcggcaccatcatggcgttgtactcacccaacctgtggcaccacctgaccgacgggctgtccgaactcgtcgaccaccacggcgacaccctgctcgccctggccgacatgtacatgcgccgcgacgcgcacggccactacaccaacgccaccgacgcgcgggtggcgatcaactgcgtggaccagccgccgatcaccgaccgcgccaaggtgatcgacgaagaccgccgctcccgggagatcgcgccgttcatgagctacgggcagttcaccggcaacgcgccgctgggtacctgcgcgttctggccggtgccgccgaccagcaagccgcacaccatctccgcgcccgggctggcgcccaccgtggtggtgtcgacgacgcacgatccggcgacgccgtacaaggccggggtggatctggccaacgagttgcgcagctcgctgctgacctacgacggaacgcagcacaccgtggtgttccagggtgacggctgcatcgacaactacgtgacggcctatctggtcggcggcaccatcccgcccagcggcgccaagtgctgacgccccaggtttcgccgaacgtgcactggcggcgagcttctcgcggatttttcgcgctgagtgcacgttcggcggcggccggctcggcggcccggcccgagaccaaggcgtaaccgtttcgcgctgccacgggtatccggggctgcaacgatgacagccatgtcgcgcctgagatcgttgagctcggcgctgctctcattcggcctcgtcctcggtggaacgtcgggcgtcgggttgccggtggccggcgccaccccggagcccggcgccggccagaccccggcgccgaatccgccggcggccgcggcgccgcagggctgggggagctgcagccaattcgttacggacacaagcgatatcccgaccgcgcagtgcaccacggtgtcggtcccgatcgactacaacaaccccggcgccgggcaggccaagctcgccgtgatccgggtaccggcgaccggtcagcggctgggctcgctgctggtcaaccccggcggcccgggcggctcggccgtcgacatggtggccgcgatggcctccgacatggacaactcggccatccggcgcagcttcgacctggtcggcttcgacccgcgcggggtgggccactcgacaccgccgctgcggtgtcgcaccgacgccgagttcgacgcctaccggcgcgaacccatggtcgactacagcccggccggggtggcccacatcgagcagctctaccggcagctggcccagcagtgcgtcaaccggatgggcaccgcgttcctggccaacgctggcaccgcctcggtcgcccgcgacatggacgcggtgcgccaggcgctcggcgacgagcagatcaactacctgggctacagctacggcaccgagctgggcaccgcgtacctggagaagttcagcaaccacgtgcgggcgatggtgctcgacggcgccatcgacccgaccgtcgggccggtcgacgagaacatcaaccaaatggccggattccaaacggctttcaacgactacgccaccgactgcgcccgctcgccgggctgcccgctgggcaccgacccggcgcagttcgtcaaccgctaccacgccctggtcgacccgctggtcacccggccgggccgcaccgccgacccgcgagggctgagctacgccgacgccaccaccggcaccatcaacgccctctacacgccggcgcactggaagtacctgaccagcggtctgctcgggctggcgcgcggcaccgacgccggcgatctgctggcgctcgccgacgactatcagggccgcgaccgcaacggccactactccaacgaccaggacgcgttcaacgcggtccgctgcgtcgacgccccgaacccgaccgaccaggccagctgggtgagcgccgaccagaagatccgccaggccgcgccgtttttgagctacgggccgttcaccggcaacgcgccccgcgacctgtgcgcgctgtggccggtgccggcgacgtcggcgccgcacgccgccccgccgatgcccgcgggcaaggtcgtcgtcgtctccaccacgcacgacccggccacgccgtatcaggccggggtgaatctggcccgccagctcggcggcccgctgatcacctacgacgggacgcagcacaccgcggtgttcaacggcgaccagtgcgtggacaacgccgtggtgcgctatttcgtcgccggcacgccgccgccggcgtcgtatcgctgccagtcctgaccagcgccgcacgccccaccgcaacggttctgagcgggcatcggtaacacagaattaacagcggttgcctactgttcgagatatggatcgacagaaggaattcgtcctgcgcaccctcgaggaacgggacatccgcttcgttcggctgtggttcaccgatgtgctcgggttcctcaagtcggtcgccatcgccccggccgaactcgaaggcgccttcgaggagggcatcggcttcgacggctcctcgatcgagggcttctcccgggtgtcggaatccgacaccgtcgccaaccccgacccgtccaccttccaggtgttgccatgggcctcgcccaacggccaccaccactcggcgcgaatgttctgcgacatcaccatgccggacgggtcgccgtcctgggccgacccgcggcacgtgctgcgccgccagctgcagaaggccaacgacctgggcttctcctgctacgtgcaccccgagatcgagttcttcctgctcaagcccgggcccgacgacggcacgccgcccgtccccgtcgacaccgccggctacttcgaccaggccatccacgactccgcctccaacttccgcaggcacgccatcgaagcgctggagttcatgggcatctcggtggagttcagccaccacgagggcgcgcccggccagcaggagatcgacctgcgcttcgccgacgccctgtcgatggccgacaacgtgatgacgttccgctacgtcatcaaggaggtcgcgatcgagaacggcgcccgcgcctcgttcatgcccaagccgttcgggcagcatcccggctcggcgatgcacacccacatgagcctgttcgagggcgacgtcaacgcgttccacagccccgacgacccgctgcaactctcggacgtgggcaagtcgttcatcgccggcatcctcgagcacgcctccgagatcagcgccgtcaccaaccaatgggtgaactcctacaagcggctggtgggcggcggcgaggcccccaccgccgcgtcctggggggcggccaaccgctcggcgctggtgcgggtgccgatgtacacgccgcacaagacgtcgtcgcggcgcgtcgaggtgcgcagccccgactcggcgtgcaacccctacctgaccttcgccgtgctgctggccgccggcctgcgcggggtggagaagggctacgtgctggggccgcaggccgaggacaacgtgtgggacctgacccccgaggagcggatcgcgatgggctatcgcgaactgcccaccagcctcgacagcgcgctgcgcgccatggagtcctcggagctggtcgcggagacgttgggggagcacgtctttgacttcttcctgcgcaacaagcgcaccgagtgggcgacctaccgcagccacgtcaccccgtacgaactgcgcacctacctgtcgctgtagccccggcgccgtagcgcatttcccgtcccgggtgcgccggcgcggcgtcgggttgcgctaccgtcgtggtcgtgaccaaacccgcgacgcagcgcccccggctgcccagcgtcggccggctcgggttggtcgatccccaagcggccgaacggatggcgcagctgggttggtacgaccatgacgaccaggcccacgtcgatctgctgtgggcgctgtcccgggcgccggaccccgacgccgcgctgctcgccctggtccggctggccgagacgcccgacgccgggtgggacgaactgggcgccgccctgctcaccgaacgcccgctgcggggacggctgttcgcggtgctcggctcctcgctggccctgggcgaccacctggtcgcccaaccgcgatcctggaaactgttgcgcggcaacgtctctctgcccacccacgacgagctgtgcgcgatgttcaccggctgcgtcgacgaggcgctggccgaccccggctcggcgatggtgcggctgcgcaccctgtaccgggaccggctgctggtgctggccgcgctcgacctggccgccaccgtcgaggacgaaccggtgctgccgttcaccgtggtggccgcccacctgtcggacctggccgacgcggcactggccgccgcgctgcgggtggccgagcacaacgtgtgcggcgaccggacaccgccgcggctggcggtcatcgcgatgggcaaatgcggtgcccgcgaactgaactacgtcagcgacgtcgacgtcatcttcgtcggcgagcgcgccgacaccgtcaccacccgggtggccagcgagatgatgcggctggcgtccgaggcgttcttccaggtcgacgccgggctgcgaccggaaggccgcagcggcgagctggtccgcaccgtggagtcgcacatcgcctactaccagcgctgggccaagacgtgggagttccaggcgctgctgaaagcccgtgcggccgtgggcgacgcggagctcggccgacgctacctggacgcgctgatgccgatggtgtgggtggcctgcgaacgcgaggacttcgtggtcgaggtgcaggcgatgcgccggcgcgtcgagcagctggtgcccgccgacgtccgcggccgcgagatcaagctgggcagcggcgggttgcgcgacgtcgaattcgcggtgcagctcttgcagttggtgcacggccgcagcgacgagtcgctgcacgtggcctcgacggtcgacgcgctggccgcgctggggcagggcggctacatcgggcgcgaggacgcggccaacctcaccgcctcctacgaatttctgcggctgctcgagcaccggctgcagctgcagcggctcaagcgcacccacctgctgcccgaggccgacgacgaggaggcggtgcgctggctggcccgggccgcccacatccggccggacggccgccacgacgcggccggggtgctgcgcgaggagctgcggcaccagaacctgcgggtctcgcagctgcacgccaagctcttctaccagccgctgctggaatcgatcggcccggccgggctggagatccggcatggcatgacctccgaggccgccgagcggcagctggccgccctgggctacgagggcccgcagagcgcgttgaagcacatgtcggcgctggtcaaccagagcggccggcgcggccgggtgcagtcggtgctgctgccgcggctgctgaactggatgtcgtatgcgcccgacccggacggcggcttgctggcctaccgccggctgtcggaggcgctggccggcgagagctggtatctgtccacgctgcgcgacaagcccgcggtggcgcggcggctcatgcatgtgctggggacctcggcgtacgtgcccgacctgctgatgcgcgcgccgcgggtcatccaggactacggcgacgggccgtccgggccccggctgctcgagaccgacccggccgcggtggcccgcgcgctggtcgcctcggccagccggtactccgacccggtgcgggcgatcgccggggcgcgcaccctgcgccggcgcgagctggcccgggtggcgtcggcggacctgctcggcatgctcgaggtcaccgacgtgtgcaaggcgctgacctcggtgtgggtggccgtgctgcaggctgcgctggacgcgatgatccgggccaacctgcccgacgacggcccgcagcggggcaaggcgccggccgccatcgcggtgatcggcatgggccggctgggtggcgcggagctgggctacgggtccgacgccgacgtgatgttcgtctgcgagccggcacccggcgtcgacgattcggcggcggtgcgctgggcggcctcggtcgccgagcaggttcgcaccctgctgggcacccccagcgtggacccgccgctggacgtggacgccaacctgcggcccgagggccgcaacggcccgctggtgcggacgctggcgtcctatgccgcctgctacgagcagtgggcgcagccgtgggagatccaggcgttgctgcgcgcgcacgcggtcgccggggacgcggagctggggcatcggttcctgctgatggccgacaagacgcgctaccccgccgacggggtgtcgccggaggcggtgcgcgagatccggcgcatcaaggcccgggtggacgccgagcggctgccgcgcggcgccgaccccaacacgcacaccaagctgggccgcggcgggctggccgacatcgaatggacggtgcagctgctgcagctgctgcacgcccacgaggtgccggcgctgcacaacacgtcgacgctggagtgcctggacgcgatcgccgaggccggcctggttcccgccgacgaggtggacctgctgcggcaggcctggctgaccgccacccgggcccgcaacgcgctggtgctggtccgtggcaagcccaccgaccagctgcccgggcccgggcgtcagctgaacgcggtcgccgtcgccgcgggctggcccaccgacgagggcggggagttcttggacaactatctacgggtgacgcgacgcgcaaaagcagtcgtgtgcaaggtgttcggaagttgagtcaggaggccggcgcgttggacgccatattcgaggtgctcgacgcggcggaggccgaacgggtgaccgcactgtatgccccgttggccgatgcggtccgcgagctcgtcgacgccaccatccggaccgaggttgacgacgccgtcgtcgccgaagcccgctcggcgatcgaggcggtcaccgcgtcgctgcggcgacggacccggccggtgggggtgagctaccgggtcaacggccggccgctgccgttgggcaacgccgcgatcggcgtgtgcaatccgatcgccccgccgatcgtcgtgcaccacgagggcgacgggcgctgctggagcgagttcgtcctcggctcggcctacgaggggccgccgcggctggtgcacggcggcgtcagcgccctggtgctcgaccacatgctcggtgaggcggccagcgaagggctgtccaaggcgcggttcaccggcaccatcaccgtgaaatacctgcgcggcacgccgctgggcccactgcgctgcgacgcctggatcgaccgtcgcgagggcgtcaaagtctttgcccgaggcaccatttcggatgccgcgggagtcaccgtcgaggccgacggcgtgttcatcgagccggcctgggcgcgggagacgcagtgaggttctacgtcagcagcgccttcttgaacacccgggagatcatcgagatcgccagggccgcagacgaactcggctacgacgggatcggcatccccgaccatgtcgtcaacctggagacgctggacaccccctacccgtacaccagggacgggcagcggcgctggcagccgttcaccgactggcccgacccgtgggtgctcatcggggcgctcgcccaggtcaccacccgactgcggttcgtcaacaccgtttacatcccggcgatgcgcaacccgtactcggcggccaaagccattggcaccgcggcggttctggcgtcgggccgggtggagctgggcgtcggcgtcggctggtgccgcgaggaattcgcgttgatgggggagcggttcgaggcgcgcggcaaacgcaccgacgagatcatcgagctgatgcgggcgctgtgggcgccgggctggacggagttcgacggcgagttctactccgcgccgcggctggagatgcagcccaccccgccgccgatcccggtgtatgtgggcgggctgtcggacatcgcgctgcgccgcgccgcccgcaacgacggctggatcggcgacctgatcaagaccgagcgggccatcgaggcggtcggccggctgcgcgagctgcgcgccgaaaacggtttgacgatggacgatttcaccatcctgacgccgctgaccgacgcgttcaccaccgccgattaccgacgcgccgaggatgccggcatcaccgggatcatcaccatgccgtggatgttctacgctgggccgcaggcgtcactggacgacaagatcgacggcatgcagcggttccgcaaggacctcgcgctggacgggtagggctggacacctgcgccggcttcggctgagccccacgacacttacccggtggcgccgacacgccggcgcgggccgccatggcttacgtctcgcggaacccagcaggggcggcatcgacttagacgtcgctaaacgtcgtagtacagcgcgaactcgtaggggtgcggccggacctggaccggcaggatctcggtctcgcgcttgaagctgatccacgtctcgatcaggtcgggcgtgaaaacgcctccctcggtgaggtattcgtggtcctcttccagccggtcgatgaccgcggacagctgggtcggcgcctgcgggatgttggcggcctcctcgggcggcagctcgtagaggtccttgtcgaccggcgcctgcggctcgatcttgttcttgatgccgtccaggccggccatcagcatggccgagaacgccaggtacgggttgcccgaggagtcggggcaacggaactcgagccgcttggccttcgggttggtgccggtgatcgggatgcgcacacacgccgagcggttgcgctggctgtagaccaggttgatcggcgcctcgaagcccggcaccaggcgcttgtaggagttcgtcgtcgggttggtgaacgccagcagcgacggcgcgtggtgcagcaggccgccgatgtagtgccgcgcggtgtccgacagaccggcgtagcccgtctcgtcgtacatcagcgggctgccgtccttccacagcgactggtgggtgtgcatgccggagccgttgtccccgaacagcggcttgggcatgaacgtgacggtcttgccgttctgccacgcggtgttcttgacgatgtacttgtagagcatcatgtcgtcggccgcgtgcagcagcgtgttgaacttgtagttgatctcggcctggccgccagtgcccacctcgtggtggcccttctccaggctgaagccggccttgatcaggttggacagcatctggtcgcgcaggtcgacgtagtggtcgacgggggcgacggggaagtagccccccttggggcggaccttgtagccgcggttggggctgccgtcgagttcgttgggcgagccggtgttccaccagcccgagatggcgtcgatctcgtagaacgagccgttggtgcgcgagtcgaagctcaccgagtcgaagatgtagaactcggcctcggcgccgaagtacgcggtgtcggccacaccggtggagatcaggtagttctccgccttgcgggcgatgttgcgcgggtcgcgcgagtacggctcgagggtgaacgggtcgtgcacgaagaagttcaggttcagcgtcttggcctcgcggaacaggtcgatctgggccgtggccgggtccggcaggagcaacatgtcggattcgtgaatggactggaatccgcgaatggacgagccgtcgaaggccaggccgtcctcgaagacgctctcgtcgaaaaacgaaaccgggattgtgaagtgctgcatgatgccgggcaggtcacagaaccggacgtcgacaaattcgactttctcgtccttggcgagtttgaagacgtcgtcgggcgtcgtttccgtcacagaatgctcctttacttggtgagatccgcggcctgacgctatggagcagatgttgcccgtcagtcaacccgatgttgcgcgcacgttacgtgaccatgccacacgcaaaaagtggccgcgtcggcggcgggttctattgtggggccatggatcgcaagatcgtatcttttctgttcgcgcggcgcaccgtctgcccgtcccgccggtgccggaccgccgggcgccgcgacgccggtccggggcgatgacgccggaatcgcgatccgcatatccgggtgaaaatctcggcctgccgcagcgcgggcccagctcgttggcgccgatggggccccggctgggtgcgttgatgatcgactggctgatctcctacgggctggcggcgctggccatgcggttgggctggttctcggcatcggccctggccaccgccgtgctggtgatctggttcgtgctgggggtggtctcggtgcggctgttcggcttcacgcccggccagctggtgctgcggctgcaggtggtgacggtggacgggcgggggctggtcggcaccggccgcgcggtggtgcgcggtgtgctggtcggaacggtggtgccggcgttgttcaccgactgggacggccgcggcctgcaggaccggctgaccgcgacggccgtggtgcggcgctgagctctgccgatggcggcgacccgctgcgcccggccgcgctttgcgatcggcgcgggagctacttgcggcggacggtgcgctgcaccccgcgcatcttgccggcgttgggcagcgggcccttgggcatgacggcggccccggcccgcgaccccagggcggccagccgcgactcgagggtgtccatctgcttgacggtgatgttggccggcagccgggtcaggtggcgctccagcttggccagcggcacctcgtcttcgccgttgccgacgatgatgtcgtagatcggcacgtcgccgatcagccgggcggtgcgctttttctcctgcgccagcagcggccgcacccgggtcggcgagccctcgccgaccaggatcacgcccggccggccgatgacgcggtgcacggcgtcgaagtggccggtcgccgccaccccgggggtcacccgccacttgccgcgcagattgtccaaagcccatgccgccgcgccggtttggccctcggccttgcggtacaccgatttctgcgcgcggcgcccgaacacgatgaaggcgaccagcgcgcccagcaccacgccgaacgggatcaaggtgatcatggtcagcccgccggcccagacgcccacacccaccgacacgcccacgaccagcaggaaggcgccgatcatgtagggcagcaggcgcttgtcctcctggcgctggatgttgaacgcctgccacaactgggcgcggcgctcgcgcgcggcggccttgcgggcggcctgcgcctgcgcgcgggccgccttgttgtcggcggcagagcgggatttagccatagtcaaagaatacgtagcgccgtggcggctaggcgcgggcgcgggcggtctgccggtagagccgcccggcgcggtacgacgagcgcaccagcggcccggccagcaccccggagaagcccagctcttcggcatgccgcgcgaactcgacgaattcctccggcttcacccagcgctcgaccgggtggtggcgggccgacgggcgcaggtactgggtgatggtgatgatgtcgcagccggcgccgcgcaggtcggccagcgcggtgcgcacctcgtcgggggtttcgcccaagccgaggatgaggttgctcttggtgaccagcccggcctcgcgggccgcggtcagcacgtccaggctgcgccggtaggtgaaggccgggcggatccgtttgaagatccgcggcaccgtttcgacgttgtgcgccaacacttccgggcgcgacccgaacacctcggcgagccggtcgggccggccgttgaagtcggggatcaacagctcgacaccggtcgacgggttgagctccttgatggcgcgcaccgtctcggcgtacagccaggcgccgccgtcgggcaggtcgtcgcgggccaccccggtgaccgtggcgtagcgcagccccatcgtgcgcacgctgtcggccacccggcggggctcgtcgcggtccagctcggctggcttgccggtgtcgatctggcagaagtcgcagcgacgggtgcactggtcgccgccgatcaggaaggtggcctcgcggtcctcccagcattcgaagatgttggggcagccggcctcttcgcagacggtgtgcagcccctcgcgccggaccaggctcttgagctcggtgtattccggccccatccgggcccgcacccggatccacggcggtttgcgctcgatcggggtctcggcgttgcgcacttccaggcgcagcagtttgcgtccctcgggtgcgacagtcacatcgccgatgctacgcgggcgccgggtgagtgctcacgcaccggcagcaccccgtccagggcgtcgcagacggcgtcggcgaccgacgtcacgacgtcgtcgaccgcgaccgggcggcgcagttcggccgtcagcgacgtcaccccggcgtcgctgatgccgcacggcacgatggcgttgaaggcgcccagctcgcagtcgcagttcagcgcgaagccgtgcagggtggtggcgcgggacacccgcaccccgatggcggccaccttgcggtcgggccggccggcgtcgcccggcacccacaccccggagcggcccggcacgcggaccgtgtccaggcccaggtcggcgcacaccttgatcagcgcctcctccagccgtcgcacgtagtcgaccacgtccagcggttcggccaggccgatgatcggatagccgaccaactggccgggcccgtgccaggtgatcttgccgccccggtcggtgtcgaccacgggcgtgccgtccagcggccgctcgtgcggttcggtgcgccggcccgcggtgtacaccgccgggtgttgcagcaacagcaacgtgtcggggccgccggcgacccgggcgtcggccaggtcgcgttgctgctgccaggccgcgcggtagtcgacggtgccgagccggcggacatcgatcagggcgcggctggaccggatggaatcgatcacgttcgcgacggtactcggcccggcccggtcgggcccaatccgggcggggtcagtcgtgggcgggccgggcggtggcatagcccagcgcctcgccaatggtgttgtggtggaacacgaatccggtgcgctccagcgcggcggggatggcgcgctgcccggtcagcaggccctcgtcggcgaactccccgagcgcggcgcggacggcgaaaccgggcagcatcaacggggtcgggcggttgaccgcccgcccgaacgcggtggtgaattcggcgttggtgaccggggccggcccggtcatgttcaccgggccggacagcgcgggctcgaagatcgcgaacagcagggcccgcacctcgtcttccagcgtgatccacgacatgtactgccgcccactgcccagccgggtgcccaggccggtccggaacaggggccgcaaccggcccagcgcgccgccggcgggggagaacaccagcccggtgcgggccagcaccacccgggcgccgccgtactgcgccggcagcgtggccgcctcccagtcctggcacagctgggccaggaaaccggttccggcgcggtcgttttcgtcgaccacgcggtccttggtgttgccgtagaagcccaccgcgctggcgttgaccagggtcgccaccccggcgtcggcgacggcgtgcgcgaggacctcggtgggggtgatgcggctgtcgcgcaggctctgcttgaaggcccccgaccatcgccgcttgccgatgttcaccccgcacaggttgacgacggcgtcgacgccgcgcagcgcgtcgggatccagatcgccgctctcgggattccaggacagctcgtcgccgttcgccggcgcccggcgcacgatgcgcagcacccgatggtcgtcggcgcgcagggccgccgccagcgccgagccgatcaggccggacgaacccgcaatggcgatgacggccttttgcccagcgcgagccaacgttcgaccgcccttctcacagcccgaggtcggcctcgaatgctccctcttcgagccggtgcttgatggtggtcaggaagcggccggcgtcggcgccgtcgatcagccggtggtcgtaggtcagcggcaggtagcagatcgagcgcacgccgatcgactcgttgccgaactcgtcgacgatcacccgcggccgcttgacgatcgccccggtgcccagcatggcggcctgcggcgggaccaggatcggggtgtcgaacagcgcgccctggctgccgatgttggtgatcgtgaaggtgccgccggatagctcgtcgggcttgaggttgcccgaccgggcgcgcgcggcgatgtcggcgatcgcccgggccagcccggccagcgacaggtcgccggcgttgtgcacgaccggggacagcagcccctgttcggtgtcgaccgcgaagccgaggtgctcggcgtcgtagtaggtgatctccttggtttcctcgttgtaactggcgttgatgttggggtggatcttcagcgcgtcgatcaccgcgcgggcgatgaacggcaggaacgtcaggttcaccccctcgcgctcggcgaacgccgccttggcccgggcccgcaatccgaccagcctggtcatgtcgacctcgtgggtctgggtgagttgggctgtggcaagcagggattcgcgcgtcttggccgcggtgatctgacggatccggctggccttctgggtggtgccgcgcaggtgcgccagcgccggcgccggcgtcggcgcggcgggcttgcgggcctcggcggccgcgggggccggtgcggccgacggctgggcggcggcctgttgttgccgctgcttctgctcggcggcggccaggacgtcttgcttgcggatgcgaccgcccaccccggtgccggtgatcgaggacaggtcgatgtcgttctcggcggccagccgtcgcaccagcggtgtcacgtagggggtgccctcgccgccggcggccggctgggcttgcgccggttgggctttcggctcgggcgccggctgggcttgtggctgtggcgcgggctgcgcctggggttggggtgccggttcgggtttcggttcgggcttgggggccggcgggggttggggcgcggcgggggcgggcgcctgggcgccggtgccgatgcgggccagctcaccgccgaccggcacggtgctgtcctcctcggccgtgatgctgatcagcacgccggccaccggcgacgggatctcggtgtcgaccttgtcggtggacacctcgaccagcgcgtcgtcgacctggaccgaatccccgaccttcttgagccagcgggtcacggtgccctcggtcaccgactcgcccagctcgggcatcagcaccggggtggcggcgccgccaccggactcctgtggcgccggctgggccggtgcctgcggctgggccggggcctcgggctgggcctgggccggttcctgggcctgaggctcgggctgggccggtgcttggggctggctcggctggctgggggcctgcgccccgccgccggcggcgccgtcggccgcgtcgccgatcacggccagttcgccgcccacctccacggtgtcgtcttcctgcgcgatgatcttggtcagcacacccgcggcaggcgacgggatctcggtgtcgaccttgtcggtggacacctcgaccagcggctcgtcgagttcgaccgtatccccttcctgcttgagccagcgggtgaccgtcccctcggtgacgctctcaccgagtgccggcatctggacggagaaggccatctcttctgactcctcgatcgctcgtgggtcggggcgggtcgatcagctcgctcgcggaaggcgaagtcgcaatccaaaactatcctgtcactgcgcccgcgccggcacacatccagggcagatccggctcgcggctcgggtgaccccggtcacgcttgctaccgtgtggccaccgcggccccagcgccgcggcccacagcgggagccagaccggggaggtccgatgccggcaccacaacactcgccccagcatttcgtgcacagcgccgacggcacccgcatcgcggtctacgacgagggcaaccccgagggcccgaccgtcgtgctggtgcacggctttcccgactcgcacgtgctgtgggacggggtcgttccgctgctggccgagcggttccggatcctgcgctacgacaaccgcggggtcggtgcgtcgtcggcgcccaagccggtgtcggcctaccgcatggaccgcttcgccgacgacttcgccgcggtgatcggcgaactcagcccgggcgggcccgtacacgtgctggcccacgactggggctcggtcggggtgtggcactacctcaagcgtcccggcgccaacgaccgggtcgccaccttcacctcggtgtccgggcccagccaggaccagctggtcgactacatcttcagcgggctgcgggcgccctggcggccgcgcgcgttcgcccgcgcgctcggccaggcgttgcggctgagctacatgatcctgctgtccatcccggtgctcgcgccgttggtcctgcggctcaccctgtcgatcccggcgctgcggcgcaacgccgtcgacaacattcccgtcgagcagatccaccactccgaccgcctggccgccgacgcggcccgcgcggtgaaaacctatcccgccaactactttcgctcgtttgccatccgcaaacagggtgtggccgtcatcgacgtgccggtgcagctgatcgtcaacaccgaggaccggtacgtgcggccgtacggctacgaccacacgccgcggttcgtgccgcggctgcggcgccgcgacatccgggccggacacttctcgccgatgtcgcatccgcaggtgatggccgcggcggtgcacgacttcgccgatatggccgagggcaagccggccagccgtgcgctgctgcgcgcgcaggtggggcgtccccgcaaggcgttcggcgacaccctggtgtcggtcaccggcgccggcagcggcattggccgggcgaccgcgttcgccttcgcccgcgaaggcgccgagctgatcgtcagcgatatcgacgaggcggccgtcaaggccaccgccgccgagatcgccggccgcggcggcgtcgcgcacgcctacgtgctcgacgtgtccgacgcgcaggcggtggaggagttcgccgagcgggtcagcgccgcgcacggcgtgcccgacatcgtcgtcaacaacgccggtatcgggcaggcgggcggattcctggacacccctgccgaggagttcgaccgggtgctcgcggtcaacctgggcggggtggtcaacggctgccggtcgttcgcgcggcgaatggtgcagcgcggcaccggcggtcacctcgtcaacgtgtcgtcgatggccgcctacgccccgctgcagtcgctgagcgcctactgcacgtccaaggcggcgaccttcatgttctccgactgcctgcgcgccgaactcgacgccgccggggtgggactgaccaccatctgcccgggcctgatcgacaccaacatcatcaacaccaccagattcgacgcgccggcgggcgcccgggccgaacgggtcgacgaccggcgcggacagctgggaaagatgttcgcgctgcgccactacgggcccgacaaggtggccgacgccatcctgtcgtcggtgcagaagaagaagccgatccgcccggtggcgccggaagcctatgcgctgtacggcctttcgcgggtgatgccgcaggggttgcgcaacgccgcgcggctgcgggtgatctgaggctaaacgtccgaggctaacgtctgaggcgaagcgtccttggttaagcgccggtggccgcgccgcggcgcccggtcaacagcgtcgcgccgatcgcgatgatgcccagcaccgccagcggtatggtccacgcgcgccggccgcccaccgaggactggcactgcgccacatagtcggtgtgcgggacgatctggttgaggatcggaacgttggccacgctgttgtcgttggcgttgcgggccgcggagagatccgtcaccaccgcgttcccgcatccgatggagtggccgttgccgtcggaaaccgacaccggcgccagcagcccgatgactccggccagcaacagcacggcgcccacaccgatgatcagccgtcgcaccgtcatggtttcgcctttctcgtcgggccctgtccgggccgagcgatagcagattaaccgccgcgtgcccccggtaaacccgacccgttcagcgagtaacccaccgaatcgcgggtatccgcggcccaagccaaagacgtgaaggggtgggccggtgattactgccacgcgcgaggtcgccgcgccgtgtgagcgggtctgggaggtaatggcccagggctggacctacacgcaatgggtggtgggcaacagccgcacccgcgcggtggatgcggactggccgaatccgggcgcctcgatccggcattccgtcggggtgtggccgctcgtcatcgacgacgcgacggtggtggagcgctccgaccccccacatgagctggtgctgcgcgcccacctgggacccctgggcgccgcgcgaatcaccttgcggctgcacgcaacccgggtgggatgccgggtggagatgatcgaagtgccggcccgcggatcggtacggctgatcccgaatcagcttgcgctgctggcggtttacccccgaaaccaggagtgcctgctgcggctggcggcgctggccgaacggcaggagccgaatccggtgacctagctcatggcctccgacgcggtggtcatgtcgctgctgacgaagtagttcgcgagctttcctcggccgccgagcgtcacgccagcgtggcgcccggcgggccgagccacgccagcgtgacgctcgacgggcgcggcggaatgacgctcgacgggcgcggcgtgacgctcgacgggcgcggcgtgacgctcgacgggcgcggcggaatgacgctcgggcgggcggcgggatcgtgctggggcgcttagccgttcgcggcgatgtcttcgagcactgcgaacatggtgcgcgtcggcaccccggtggcgcctttgggcgaataaccccacgggctgccggtgttgtaggccgggccggccacgtcgatgtgcgcccagcccaccccgtcggcgatgaactcgcgcaggaacacgccggccaccagcatgccggcgaagcgctgcccgctgatgttcgacaggtcggccaccgtggacttcaggtcctccttgagctcgtcgggcagcggcatcggccagccgttctcaccgacccgctgcgagatcgccgccacccggtcgcggaactcgtcgctgcccatcacgccggggatccgggcgcccagcgcgacggtctgcgcgccggtcagcgtggaggtctcgatcaggtagtccgggttgtcctcgcaggcccgcacgatggcgtcggccagaatcagccggccctcggcgtcggtgttctgcacctcgacggtggtgccgccgtactgcgtcagcacatcgccgggccgctgcgcggtgcccgacggcatgttctccgccatcggcacggtggcgatcacgtcgatcggcagctgaagctgcgcggccagcgccacggtggcgatgacggcggcggccccgcccatgtccgaggtcatgtgatgcatcgaggccgccggcttgatcgagatgccgccggtgtcgaaggtgacgcccttgccgaccagcgccacctttttcgcctgcttggatttcttggccagccgcgaaccgcggtggatcagccgcaccagccgcggcgggcgcgacgaaccctggccgacgcccagaatccctccgtagccgcccttttgcagcgccttctcgtcgagcacctccacctcgaggccgacggactcacccaaagcccttgcccgcttggcgaattcgtcgggaaacaggtgactgggcggggtgttgaccagatcgcgggcggtggcgaccgcggtcgcgacggccgcaccgtgcgcgacctcctgcttggcgtccttggcggtggccagcaccgtgatcttttgcagccctttgtctttcggggcggtcttggcgctgcggaattcggtgaaccggtagctgcccaggatcaggccctcgacggcggccgaggccacgccctcgccgggcagcgccgccagcgtggtgaacaccgtctcggtgttggacagcgaccgcgcggccacccccgcggcacggcggacggtgtcggccggccactcggatcgcggcttgcccaggccgacggtcagcacgctggacaccggcagcgatcccaccaccagccggtgcagttgttcggcgccgccggtggccgccagcgcccgcaggccggattcgatctcggcgaccgcgtcggaggacaggaacgacccggccgacgcgacgacggcgcccggcttgtcgtcgtcgccggtggagacgacgggcacgatcagcacggtggacgcggcggcgcggcggggcagcgaggaggcgacgttgacgacgggggaggcgtaaccgggttctgtgctcatccgcatcaccctaacggtccgccggtcgcggctggctagggtgagaagtcagtgtcagggtgaggttgccgcgtgttgcggtggttggatcctgatcacctggtgtctggctcgtagggtgcttgccgcgttggggttggcgttcatgcgttttgtcgacgccaggtgtgaaggaccggccggcgtgacttgataggagcgtggcatcgcccccactgagatgtgtccgccgaccggcccaaccgtcacctcacagtgaaggaggcaacctccatggttgttgttggagccgatgtacacaagcgcacgcataccttcgttgcggtcgacgacgtggggcgcaagctcggtgagaaggtcgtcgcggcgaccaccgcggggcatgccgaggcggtgatgtgggcccgggaacgcttcggaaccgaggtggtgtgggcgatcgaggattgccggcatttgtcggcccggttggagcgtgacttgatgggctttggccagtcggtggtgcgggtgccgccgaagttgatggcccaaactcgggcgagtgcacgcacgaggggtaagtctgacccgatcgatgcgttggcggtggcgcgggggtttttgcgggagcctgatctgccggtcgcttctcatgacgaggtttcgcgggaattanagttgttggtggatcgtcgcgaagtccctgtggcgcaacgcactgcgacgatcaaacccggctgtgtggcgggtgcacgaactcgatcccgaccacgcacctaaggctggttcgctggatctggccaagcatcgccgcatcctgggtgactggctggtcacggtgcccggcctggtcgccgaactcgcccgtgacgagctggccgacatcacccggctcaccgagaccatcaacgcgttggccaaacggattggcgagcgtgtccgcgttgtggccccggtgctgctgtctcttcctggctgcgcggagttgaccgcggccaaactcgtcggggaggccgccggagtgacccgtttcaaaagcgaggccgctttcgcccgccatgccggggtggcgccgattccggtgtggtcgggaaacaccgctggacgagtccggatgacgcgctcgggcaaccgccaactcaacgccgctttgcaccgcatcgcggttacccagatccgtcttgacggcctcgggcagacctactaccggcaccgcatcgccgtcagtggttccaagactgaagccctgcgctgcctcaaacgccgcctggcccgcgtcgtcttccaccacctacacaccgaccaccaaaaccgaatccagccttgccaaccggcagcggcttgacataggagaaactcgtgagcaacgaagccgacctgctgcacggaccgctggaagaccgccaccgcgacctgggcgccagtttcgccgagttcgggggttggctgatgccggtgtcgtatgcgggcaccgtcagcgagcacaacgccacgcgcaacgccgtcggcctgttcgacgtcagccatctgggcaaggcgctggtccgcgggacgggcgcggcgcggttcgtcaactccgcgctcaccaacgacctgaaccggatcgggccgggcaaggcgcaatacacgttgtgctgcaacgaatccgggggagtcatcgacgacctgatcgcctactacgtcgacgacgacgagatctttttggtgcccaacgcggccaacaccgccgccgtggtcgaggcgctgcagggcgccgccccggccggggtgacggtgcgcaacctgcatcgctcgtatgccgtgctggccgtgcaggggccgcgctcggccaatgtgctcgccgagctggggctgccgagcgacatggattacatggcctacgccgacacctcgttccggcaggtgccggtgcgcgtctgccgcaccggctacaccggcgagcacggctacgagctgctgccgccgtgggagtccgccggcgtggtgttcgacgccctggccgcggcggtgtcgcaggccggcggccaaccggcgggcctgggcgcccgcgacacgctgcgcaccgagatgggttacccgctgcacggccatgaactgtcaccggacatttcgccgctgcaggcccgatgcggctgggcgatcggctggaaaaaggaggcgttcttcggccgcgacgcgctgctggccgaaaaggaggccgggccgcgacggctgctgcgcgggctgcggatggtgggccgcggcgtgctgcgggccgggctgacggtgctcgtcggtgacacgccggtcggggtgaccacctcgggcacgttctccccgacgctgcaggccgggatcgcgctggcgctgatcaacaccgacgccgacgtgcgggacggtcaggaagtcaccgtcgacgtccgcggccgcgccgccacgtgcgaggtggtgcggcccccgttcgtcgcggtgaaaacccggtagcggcgcggtcgcgcgggcaaaatccgatcggacgcccggatatacaatcagcggatgaccagtggctccctcgagttcacggtttcgcgctcgacacgtccggcgaccggcgccgaacgcgaaaccatcctggccgagccgggtttcggcaaatacttcaccgaccacatggtgtcgatcgagtacgacgagaccgaggccggacggggctggcatgacgcgcgcgtcatcccgtacggcccgatcgagctggacccgtcggcgatcgtgttgcactacgcgcaggagatcttcgaagggctcaaggcctaccgctgggcggacggctccatcgtgtcgtttcgcgcccaggccaacgccgcccggttgcggtcctcggcgcggcggctggcgattcccgagctgcccgaggagctgttcctggaatcgctgcgccagctgatcgccgtcgacaacgcctgggtgccggccgccggcggcgaagaggcgctgtacctgcggccgttcgtcatcgccaccgagcccgggctcggggtgcggccctccaagcaataccgctacctgctgatcgcctccccggccggcgcctacttcaagggcggcatcagtccggtcaccgtctgggtgtcgacggagtacgtgcgggccagcccgggcggcaccggggcggccaagttcggcggcaactacgcggcgtcgctgtccgcgcaagccgaggccgcggccaacgggtgcgaccaggtggtgtggctggacgccgtcgagcggcgctttgtcgaggagatgggcgggatgaacatcttcttcgtgttcggcagcggcggctcggcacggctggtcacccccgagctgtccggctcgctgctgcccggtatcacgcgagattcgttgctgcagttggcaattgacgccggcttcgccgtcgaggaacgcaagatcgacatcgacgagtggcagaagaaggccgccgccggtgagatcaccgaggtgttcgcctgcggcaccgccgccgtcatcacgccggtgtcgcacgtcaagtacggcgagacggagttcaccatcgccgacggccagcccggcgaagtgacgatggcattgcgcgacacgctcaccgggatccagcggggcaccttcgccgacacccacggctggatgacccggctcggctgatttgcgggctcgcggcctgcgggcgccggctgcccgcgactgtcggcgccccgcccgcgactgtcggctcgcccgcgactgtcggctcgcctgcgagcgtgaagttagtttcacgctgggctccgaccgtgaagctagtttcacgctcggcgggttgctgagccgccgagccggcacggccggccggccgagccgagccgacccgggctagacgcgcaccagggccgcgagcgctaccgcgctcaccgtcgcggtcagctcgatcgccgcgcccagcacgtcaccgctgatgccgccgaagcggcgcacgcagtgccgcaccagcaccccgccgcagcccaggcccagcagcaccgcgaccggtccgtgccacggccgcggcccggccaccagggacatgccgagcagcaccgcgacccaggccgccgccaccgtcgccggctgactgccggcgacggtggcgcccagcgagctgccggcggccgccggcaccgtccggcggcaggccagcaccgcggcgacccggccggcgaacaccgccacggccaccccgaccggaaccggccgccccgccgcgagcgcggagaacgccagcgcctgcgccatcaccaccacgacgacggcggccacgccgaacggtccggtcgagccgtcccgcatcaccgcccgggcgcggtccggggggccgtagcagcccaggccgtcggccgtgtcggcgacgccgtcgatgtgcaggccgcgggtgatcaacagcagcgcggccaccgcgagcagcccgcccagcgggctggaccggccgaacaccaccgcgccgccccacgccacggcggcggccagcgcccccagcgcgaggcccaccaccggcagcgccgtcatggcgccgcggcccatcggcccgcggccgcctgccggcacgggcagcaccgtgccgaacgcgaaagccgttgccagcgaacgcatcacgggtgagcggacgggtcggacacaccggcctgggcgaaggtcgccatcgacgacagggccgccaccgcggcccgcacgatgggcagcgccagcgcggcgccggtgccctcaccgagccgcatgcgcaggtcgagaatcggctccagatccagcgcggtcagcgccagcgcatgacccggctcggtggagcggtgcccggcctgccaccacagccgggcgcccggcgccaggtgctcggcgaccagcgcggccgccgtcaccgccatgccgtcgagcagcagcggggtgcgccgcaccgcggcctgcgcgcaaaaacccgccagcgcagccagatccgcgcctccggcgcagcgcagcagcgcgaccgggtcgggcaatacccgtcgcgcccgaaaaagcgcgtcgcgcaccgcggccgtcttccgcgcccacccggcgtcgtcgatgccggtgccaaaccccaccgccacgaccggctcgacgttggtcagcgccgccaccaataccgctgcggccgtggtgtttccgatccccatgtcgccggcgatcagcaggtccgcgccggcgtcgacctcctcgtcggcgatggccgcacccgcggacagcgcccgctcggtctcctcagcggtcaacgcgtcctgcaccgtgatgtcgccgctaccgcggcggaccttgtgcgcgccgatccgatcgtcgggcgggtctgcgtccaccgccaggtccgccacgcgcacgctcgccccggcgacgccggccagcgcgttgatcgcggcgccgcccgcgtcgaagttggcgaccatctgggccgtcacctccggcgggtaggccgagacgccgcaccgggcgacgccgtgatcaccggcgaacaccaccacccgggcccgctcgaactgccgcggcgggcactgcccctggcaggccgcgatccacaccgacaggtcctccagccggcctagcgcgccgcgcggtttggtcagggtgtcctgccgcgcccgggcggcggcggccgtgcccgggtcgggcggcgagacggtcgcgaattccatcagacccccggcgttttgatcggcaccggctggccggccaccaccagcaccacccggtcgcacagccgcgcgaggcgctggttgagactgcccagctcgtcggcgaaccggcgcgcggacgcggtggccggcaccacagtcagccccacctccgggctgaccagcaccagcgcgccggcgaactcggcgaccgcggccagcacgtcgtcgaccggggcggtcaccgagccgccctgccatccgtcgtgccggtccagcatgccggtcagccagccgcccaggtcgtcgaccagggtggggacctgcggacagcggcgcaattcggttgcgatgtcgtcggtttcgatcgtcgaccagtgcgcgggccgccggtcgcgatgctcggcgacccggtgcgcccaggccgcatcgtgcgcgccgggcggcccgggcgccaggtaacgaaccggccggccggccggcagcccgtcggcgacggcgtcctccgcccactgcgacttgcctgacctgatcccgccgagcaccagggtgcgcaccggtgtcagctggctttcgggtgaggtctaatcgacactgctgccgtgcttgacttggggtcgcggcgcccgcaaccgtcgcatctgcgaggcccggccggctgcgtaaaggcctagcttccaatggctttcggtgttgttggggaacttggcgtcgaccatcctgctgaccttgcggcccaggatcaggccgtcgatactcatcactgccattagcaccagcattgcgggagagatgtagagctgcagttgcgggacgccgaacatgatgaacatcaagaacagcgtcgacggcatgaacaggccgagcaggttgcgccgggagtccacgatgtcgcgcacgtagcgccgtaccgggccctggtcgcgcggcagcaggtagccctcctcgccggccatcatgcgttcccgccgctccgacatgcgggcgcgattggcggccttgtcggcgcggcgctcctcgcggctgagcttggggcccgccaacgtcttgcggcgggcccgcgcctcggaggcggtcatcggtgcgggtgcgacgggccccttgcgcgcgttgcggcgggcctcgctgcgcttgggggtggggcgacccttcgggccggtccggcgcggctcgcgggacgcggcgtccgcggcgccagcaacgtcggatccgcccgacgcggcggtctgctcgtcgaggtcttcgtcctggtccttctttcggcccaacagcttcacaggggccaggttacttcgcggccgggccgcgccggaattcgcctggaatgccttgctattagacctgcgttagtgcctcagttggccctactcttacacgtgatgaacggctgcctttgatggacgacgggtcgatggcctcggatgatgctgcctccagcctggcccccggccgccttcaattacccgcgatgcaagttctggtggcgcccgactgttatgccgacagcatgtcggcgctggaggcgtccgccgcgatcgcgaccggctggacgcggtcgcgtcccggcgaccggttcatcgtcgccccgcagtccgacggcggtcccggtttcgtcgaggtactggccagccggctgggcgagacgcgccggctgcgggtgtccgggccactgaaagccatggtggaggccgaatgggtcttcgatcgggggtcggcgaccgcctacctggagtgcgcgcaggcgtgcgggttggcgctgctcggcggtccacccaccccggagaccgccatggcggcccacagcaaaggcgtgggccagctgatcgccgaggcgctgcgggtcggggcgacccggatcgtggtgggactcggcggcagcgcgtgcaccgacggcggccagggcatgatcgccgaactcggcggcctggacaccgcccgccgccaactgggcaacgtcgaactgatcgccgcctccgacaccgaatacccgctgctgggcccgtggggggcggcccgggtgttcgggccgcagaagggcgccgacaccgccacggtcgcggcgctggaagttcggctgcaggcctgggcgctgatcctggaggcggtcgccgggcgcgacgtcagcgccgagccgggcgcgggcgccgcgggcggcatcggggccgggctgttggcgctgggcggccggtgcgagtcgggagcggccatcatcgccgaacacacccggctgtccgacgacctggacacggcggagttgatcgtcaccggcgagggccgattcgacgagcagtcgctgcacggcaaggtggtgggtttcctcgccgacgcggcccggccgcgcgggattccggtgatcgtgctggccggccaggtcgatctggacaccgcgaccgtgcgctcggcgggcatcatggccgcgctgtcgatggccgaacacgccggatcggcgcggctggcccaggccgacgccgccaatcagctgatgggtctggcctcggttgcggcggcacgactcgggaatagcggtccgtcaaggtaccgttgaagcagtggactttcgcccaagtccgggtcgcagtgcgcacgccagcgataccggaccggatcgaagccacccaacgatgaggcatgtaggagaagcaatgacggtgcaaaacgagtcgaacgccaagacccacggcgtgatcctgaccgaggccgccgccaccaaggcaaagtccctgctggaccaggaggggcgggacgacctggcgctgcgcatcgcggtccagccgggtgggtgcgctgggctgcgctacaacctcttcttcgacgaccggtcgctggacggcgacctgaccgcggagttcgggggtgtgacgctgacggtggaccggatgagcgcgccctatgtcgagggcgcgtccatcgatttcgtggacaccatcgaaaagcaggggttcactatcgacaaccccaacgccaccggctcctgcgcctgcggcgactcgttcaactagacccttcggctgatcgcgaaggccctctagtacgagccgccggtgcgcagcacgtacgagcacaccatgatctggccgcgctggaacagcagctgggcgatgccctgcacctgcccgcgcgccgggccgccgctcaccggggacacccgcatgctgaacaacgcctgcgcctggtactgcgacaggtaaacgatcttgtcgatcgaggtcacctgcacctcggagaactgtttgcggaacgcgtcgctgctgagcttggccagcgcctggtcggaccgcttgtcctggacgccgtcgtagaggccgcacagggcgttgcgggcgatctcgtcgatgtcgcgatgctcgagcgcgtccagatagccctggatcgccgttttggccgcgccctcggagaacgtcgccccggtgttggccccgttggtgcgcaccccgtacacgatggccaccgtcatcaccgcgaccagcgcaacggccagcgccaggccgacgatcagccgccgcttggatcgccgcggcgggtacggcgcgggcgcgggtgggggaccggcataattggctgaaccgggtggcgcctgcggggccgcggcgtagccggtatcgccggcgttggggtggtccgggaactcgagtggctgggattcgcttgggggagttggtccttggccgccgacggtgtggttcggcgagtgcggacctgccatcgtggttctcctacggtggtgacgggactgcgagcgggttcggcccgtcgagttgctgagccgttcccaaggtcgttcctaagggaggctagcgcagaccctgcaccgaccgtgcacgcagcgacggtcgaaacacctgagtaagctagataaccttactaacgaaggatggagatttcgtgacgatcgcggtgacagggtcgattgcaaccgacaatctgatgcgcttccccggccggttttccgaacacctgctggccgagcacctgcagaaggtgtccctcagcttcttggtcgacgacctggtgattcaccgcggcggcgtggccggcaacatcgccttcgccatcggggtgctgggcggcgacgtcgcgctggtcggcgcggccggcgacgacttcggcgagtaccgcgactggctgcagcgccacggcgtcaactgcgaccacgtgctgatctcgcagaccgcgcacaccgcccggttcgtgtgcaccaccgaccaggacatggcccagatcgcctccttctatccgggcgccatgtcggaggcccgcaacatcaagctcgccgacctggtgtcgtcgctgggcaagccggagctggtgatcatcggcgccaacgacccggaggcgatggtggtgcacaccgaggagtgccgcaagctgggcctgccgttcgccgccgacccgtcccagcagctgccccggctgtccggcgaagagatcgacaagctggtcgacggcgccgcctacctgttcaccaacgactacgagtgggagctgctgctgtccaagaccggctggtcggaggcggacgtgcagcagaaggtcgggctgcgggtgaccacgctgggcgccaagggcgtcgacatcgtcgagcgcgacggcaccaccacccacgtcggcgtggtgcccgagaccagccaaaccgaccccaccggcgtgggcgacgcgttccgggccgggttcctgaccgggcgcagcgccgggctgaacctggaacgctccgcgcagctgggctcgctggtcgccgtgctggtgctggagtccaccggaacccaggagtggtcctgggaccacgaggtcgccaagagccggctggccggcgcgtacggcgaggacgcggccgccgagatcgccgcgctgctggcctagctgtactgaccagcccgctcagagctgcaccgggtacaccggctcgctgatctgcggcaccacgctgtgctcgacgaagatggcgtgccacagcatgaagatcagcaccgtccacagccggcggctgtgatcgctgacgccgttgcggtgctcgtcgagcatccggcgcacggcgcccaggtccaccaggtgaccggcctgagacgacgccaccatcgagtaggcccagtcctgcagctcgccggcgcgcagccaatgccggatcgggaccgggaagccgagcttgggccggtgcagcacgtgcgcgggaacgatcggctccagcgcccgccgcaacgcgtacttcgtggtggtgcgggtgatcttggcctccaccggcaatcgggacgccacggcgaacacctcgggatccaggaacggcacccgcagctccagcgagttggccatcgtcatcttgtcggccttgaccaggatgtctccgcgcagccaggtgaacaggtcgatgtgctgcatgcgcgccaccgggtcccagccgatcgactgcgcgtacagcgccgcggtgacgtcggtgtgcgtccattccgcgcggaagccgggcagcacgtcgcgcagctgtgtatcggagaagctgcgggcgttgccgtagtagcgctcctcgagcgtcagcgacccgcggtgcagcaggctcttgccgcgcatcccgtccggcagcggcctggacaccttgcccatcgagcgccgcaccggccgcggcaggtagtcgaaaggccgcagcgacaacggttcccggtagatcgtgtagccgccgaacagctcgtcggcgccctcaccggagagcaccaccttgacgtgcttgcgggcctcccgggcgacaaagaacaacggcaccagcgccgggtcggcgaccggctcgtcgaggtaccagacgatctcgggcagggcggcgacgaactcgtcggggtgcaccaccttggcgatgtgccgggcgccgatcgcctccgccgaggccaccgcgacgtcgatctcggagaatccctcgcgctcgaaaccggtggtgaaggtgatcagccgcgggttgtgccggatggccagcgccgcgatggcggtcgagtcgatgccgccggacagaaacgccccgacggtgacgtcggcgcgcatgtgtttggccaccgaatcttcgagcaccgcggtgatctcgtcgtagcgggcctgttcggtgtcgcgggtgatgggcacggcggcgaaccggggcacgaagtagcgggtgacgtcgggcgccgcgccgggccggatccgggcataacagcccgattccagccgtcgcaccccgcggtgcagcgtctcgggctccggcacgtactgcaggacggtgtagtgctgcaccgcgcgctcatcgatcgcggtgtcgaacccgatcaactcggccagctccagcaggcacttcttctcgctggccaccgcggtgccgccggtgccggtcgccacgaacagcggtttgatgccgaaagggtcacgggcacagaacaattcgcgagtgacggtgtcccacaacgcaaacgcgaacatgccgcgcagccgggtcaacacatcggtgccccagtggtggaagccggcgacgatggcctcgccgtcgccgtcggtggcgaacaccgcgccgtggcgggcggccagctcgtcgcgcagctccaggtagttgtagatctcgccgttgaacaccagctcgtagcggtccggcgtctcgggcgggccccagcgcagcggctggtgcgaatgggcgatgtcgatgatcgacagccggttgaagccgaacacgacggagccgtcggcgcccgcccaggtgcccggctcgtcgggcccgcggtggcgcatcaggtgcgaggcgcgcgcgatcgcgtcgtcggcgccgacggcaccggctcgggcggcgacgaacgccagcagaccacacacggcgccccagtatgccgcacgtccaacgccgggaccgactggcgggccggggtttcgtcgcccggctcagacgcgtggtctacgctgcgtagtattcgatatccgagcaggaggcgccgacgtgacccctcgcgagcaggaccgttcgcaacctttgtcgcagggtaggtttccgggccgcgtcgggcgcagggtgctgcggccgttggcgctggccgtgacgctgggtgtgctggcgatcgtgctgagcggatgcagcagctgggccgacgcgctggcgctgggctggccgaagggcatcaccccgcaggcccacctcaaccgggagctgtggatcggcgccgtgatcgcctcgctggtggtcggggccatcgtgtacgggctgatcttctgggcgtcggcgttccaccgcaagaaggcgaccgacaccgagctgccccgccagttcggctacaacatgccgttggagctggtgctgacggtgacgccgttcctcatcatctcggtgctgttctacttcaccgtggtggtgcaggagaagatgctgcacatcgccaaggaccccgaggtggtggtcgacgtcacggccttccagtggaactggaagttcgggtatcagaaggtcaacttcaaagacggcacgctgacctacgacggcgccgacccggagcgcaagaaggcgatggtgtccaagccggaaggcaaggacgcgcacggcgaggagcgggtcggggccgtccgcgggctgaacacctcggaccgcacctatctgaacttcgacaaggtcgagacgctgggctccagcgacgaaatcccggtgctggtgctgcccaccggcaagcgcatcgaattcgacctggcgtccgcggacgtggtgcacaccttctgggtgcccgagttcctgttcaagcgcgacgtcatccccaacgccgaggcgaacaactcgatccacgtgttccaggtcgaggagatcaactcgcccggggcgttcgtgggccactgcgccgagttctgcggcacctatcactcgatgatgaacttcgaggtccgtgtggtgtcgcccaacgacttcaaggcctacctgcagcagcggatggacggcaagagcaacgccgaggcgctgcaggcgattggtcagtccccggtggcggtgaccacgcacccgttcgactccaagcgcggtcagttggccggaagccagtaggttaggacaccacatgcatatcgaagccaggctgttcgagttcatcgccgggttcttctttctgaccgcactgctctacggcgtgctgaccgcgctgttcgccaccggcggcgaggagtgggcggggaccaccgcgctggcgctgacgggcggcctggcgctcatcgtggccaccttcttccgcttcgtggcccgccgcatcgacacccgccccgaggactacgagggcgccgagatcagcgacggagcaggcgaattgggcttcttcagcccgcacagctggtggccgatcctgatcgcgctgtcgggttcggtggccgcggtgggcatcgcgctgtggttgccctggctgatcgtggccggggtgatgttcatcctgtcgtcggtcgccgggctggtcttcgagtactacctgggtcctgagaagcactgattcgcggcataaaggtcacaatccgatcacgtgatcggctgcgcagttcgccacggcgtctctgcccctttgcggttgggtagtgttttgcccaggcaaatgggaagtttcccggcgcgcccgcaatgaagtgaccgcggagttttacgcgcaggcgatgcagttcgaacagggtaggcaaaggcagagatgagcgggtctagacccccgggatgggaacctgaggaacccgatcctgctgccgacccgatcgaccaccagccggatcccggcggcccgcccgccgacgagttcccgggtgaggacttcccggccgggggagatcacgaggacgcggtcgaacccttcgacgacagcgtcgaattcgacgcggccgaccagacgggtcagaccgacgcctactcgcgggcctattcggccccggagtccgagcatttcaccagcggcccctacgtgccggccgatctgcgcctgtacgactacgacgactacgacgaaccggccgagctggacgaggaacacggcaccgcccgctggccgtgggtggtcggggtggcggccatcgtggccgccatcgcgctggtggtgtcggtgtcgctgctgttcgcccggaccgacaccaccaagctggccaacccgaacaccaccaccgcgtccacgccgccgctgcaggacgagatcaccaccaccaaaccgccgccgcccaccaccccgacgggtccgcgccaggtcacctactcggtgaccggcaccaaggccccgggcgacatcatctcggtgacctacgtggacgcgtccggccggcggcgcacgcagcacaacgtgtacatcccgtggtcgatgacggtcaccccgatctcgcaatcggatgtgggctcggtcgaggcgtccagcttgttccgggtcagcaggctcaactgctcgatcaccaccagcgacggaacggtgctctcgtcgaacagcaacgacgcgccgcagacgagctgctgatggtcagcagatattcggcatatcggcgtgggctgggcgacgacaccgtctcgcccgaggtcatcgaccgcatcctgatcggcgcctgcgccgcgatctacctggcgttgttgggcgtcagcgtggcggcctgcgttgcgctggcggacctgggcaggggatttcacaaggcggccagcagcccgcacaccacctgggtgctgtacgccgtcatcatcgtctccgcgttgatcatcgcgggggccatcccgatcctgttgcgggcccgccggatatcgcaggccgagccgacggcccgggcgatgacggcaccggcacgacccccggtgcggctgggcgccggcgtcgcgcggcccgcgaccgagcgggcgccgcacgcgccggcgacgaccccggacgtggggtggtcgggcgaggcggtcgatcgaatctggttgcgcggcaccgtcatattgaccggcaccatgggcgcggcgctgatcgcggtcgcgacggcgacctatctgatggcggtcggtcacgacggatcgtcctgggtgggctacggattcgccggggtgatcaccgcggcgatgccggtggtcgagtggctgcacatccgccagctgcgcggggcggtcgccgagcagtaaccgccgtcgcggccgggccccgggtcacctcggcgatccggtcggccgcgggtggcgtagcgtcgagcgcgagcggtttcgttgtcagcggtgcgctaccgcgctcgcgggtgcacccaccggcaatgcgattcctcctttcgcccgcccgcgaaggatgccgaccgggaagggcgccgcacgtgggttccgcagcaagacgccgacgcgccgatcccgtccggctgtcggtggggtgcgaactgggccgcgccatcgacggcgcctggtggccccgcgccgaccgcatcaccaacgaattgcccgagctggtcgcggtgctcaccccgctgctcggtcagatcggcgcgatcaacgtcaactggccgccgctgcagcgaccgccggacttcaactggccgggctgggaacgcaagcgccagcacgtgatgacgctgatcgggggagacgcgcggatcaacctgctgatcatcccgtacgcgacctacagcgcgctcgcgcggatggtgctgcgctgcgcagccgggctgcctgtcgagccccgggaccggggcaagccggcgttcctgacggccggctcgatcctgcgggccgccgagcaacaacgcgtcgacagcgcgccctgaggctcaccgggcctcagggcgcgctgccgcgtcgctagtgctggccgtcctcgccgttggtggagccgttggtggagcccacgatgctgtcctgatgttcgcgcagggcggtcagggcacgctgctcggaggcgtgcgcggcctcccgcagggccgcatcctcggacggcggatcggcgtacaggaagctgccgatgccgggcgacccggccgagcccagcttgttcatcttcttgggcagcggtgcgccctggtactccagcggcagcgggtgaccgtgctcgtcgaccgggcccagcggctggtgcagctcgatgtaggcgccgtgcggcaaccgtttgatgatgccggtctcgatgccgtgctcgagcaccgcgcggtcgctgcgctgcagcccgatgcaccaccggtaggtgacgaagtacacgatcggcggaacgatcaccatgccgatgcggccgatccacgtcgtcgcgttcagcgagatgtcgaacttcagcgcgatgatgtcgttcatcgcgctcagcgtgagcaccatgtagaaggcgatcgccatggcgccgatcgacgtgcgcaccggcacgtcgcgcggccgctgcagcaggttgtggtgcgcgtagtcaccgctgaaccgcttctccaggaacgggtagatgatcagcagcacgaacaccgcgcccatgatcagcgccaacccacaccaccgccggaatggtgtggtgccagaagtagaactcccacggcggccagatacgcgccaggccctcggtccacatcatgtagaagtccggctgcgagccggccgagacgtgagatggcttgtaggggcccaggttccagatcgggttgatctgcagcagaccacccatcaggcccagcacgccgacgatggcggcgaagaacgcgccggacttgaccgcgaacaccggcatcacccgcaccccgaccacgttgtgctcggtgcgacccgggccggggaactgggtgtgcttctggaaccacaccatggccaggtgcagcccgatcagggccaggatgatgccgggcagcagcaggatgtgcagggcgtacatccgcgggatgatgtaacccgctgcggcgcactcgcttccgacaccgccgcaggggaagtcacctccgaacagggcccagtgcaaccaggtcccgatcaccggcatacccaacgtgatcgaggacagggcggcgcgcaacccgatgcccgacaacaggtcgtcgggcagcgaatagccgaagtaaccctcgaacatggccaggatcaacaacagtgagccgatcacccagttggcctcgcgcggccgccggaaggcgccggtgaagaagatgcgggccaggtgcaccatgatcgcggcggagaagatcagcgcggcccagtggtggacctgacgcacgaacaggccgccgcgcacctcgaaggagatgtccagggccgacgcgaaggccttcgacatctccacgccgcgcaacggttggtagacgccgttgtaggtgacctcggccatggacgggtcgaagaacaacgtcaggtacaccccggtgagcagcagcacgatgaagctgtacatcgcgatctcgcccagcaggaacgaccagtgggtggggaagaccttgttgagctgtctgcggacggccgccgacgggtggtagcgcgtgtcgatgtcctcgccttgacgggccaggacgtcgccgatcttcgggggactcaatttcggactcatgttgtcgtcctctcccagaatgccggtccgacgggttcgacgaagtcaccgttggcgaccagatacccgttggtgtcgatggtgatcggcagttgcgccaacgcccgcgcggccggcccgaagatcggcttggcgaaatgcagcgcgtcgaactgcgactggtggcaggggcacaggatccggtaggactgctcctcgtacagcgatgcggggcaacccagatgcgagcacaccttggtgtaggcgaagaactcgccgaagttgaagctctcctggccctgccgcttgaccacgcggggcatgtcggtgggccgaatcctgatgagcatcaccgggtttcgcacaccctggttgatcgcccgcagcttctcctgcgattccggggtggtgccgtcgccgtcggactcgcgccacgggaacacggtttccatgccgccggcgtcgaggtcctcgggccgcatcttgacgaacggggccccggtgtaggtgccggtggcgcgggccaggtagatggtctcgcccgggtagcgcggggtccagcccgacgtccacagcacggctttcttcccgttggcggtgggcaccaccggcttccacgggttcttgatcaggcccccggcaaacgcgaccagggtggacaggccgaacgcccccaggcccacgcccaacgacagcccgaccatcttgcgccgcccgatggtggacccgttgtaggcgtcggccaggttcgccaccaccgtcttgcggtcgatctcgcgggaggcgccgtcgtgccgctgctggatcgaaatctcttctgggataaagcgtttctggtacaggatggtgccgatcccgatcgacaggatggacatcccgaaggtcaggccgtacagcggggtggccaggtcgtacaggaagctgccggcggcctccttgggcttgtactcccacggccagaacaagaagatcagcagcagcgccagcccgaagccgccgcccagcaaaagccacagggcgacgccgcgctcggcgcgcttctcggccttggtgtcctctaccggccaccggggttccttgaacaccgtttcgacgccgtcgagcttgccgcccagcgtcaccagctcctgctgcgacatcgcggccagcgccgcttcgtcgggctcgttgggcgccccggctcccttgtcggtgtcagagccgcgaacgtcgccgtcgctcattttgcgccgctcctcctcttcggttcggccccttcgccgttgcgcggctgggggagaccccactgcatcgtccgggtgcggctcatgcgcgtgccccgatccacagcgccagcccgatggcggccaccatgccgatgatccaggccgccatcccctcgggggcggggccgaacccgcccaggccgtagccgcccggctggcgctcctcggtcaccgccttgatgtagccgatgatgtccttcttggcctcgaacgacagctggcggtcggagaacttcggcatgttctgcggaccggtccgcatcgccgccaggatctgctgctcgttggcgggctcgaggtccggcgcgtacttgccggacgacagcgccccgcccttgccggtgaagttgtggcacgacgagcagttcagccggaacaggtcgccgccgcggcccaggtcctcgccgcgcagcgagcgcatcgccaggctgccgtccgggttgcgcaccgtggtggggccgccgccgttggcctgcacgtaggcgcccagcgcgtcggtctgcgcctcgtcgaacaccggctccttgcggggcgcctgggcctcgccggtcatcgcgggcatccggccggtggacacctggaagtagacggcctcctcaccgacaccgatcaggctcggcccgcggtcgggcacgccctgcaggttggcgccgtggcaggacacgcacgacgtgtcgaacagctgcttgccggtgcgcagcagcgccgagttcgactcgtcggcgacggcgacctgcggccgcggcgtcaggatggcggccagtccgccggcgatggtcagcgcgatcagcaacagcaggccgccggacaatcggcggcgcagccgccgtcgcgaacggtcggttcgggtggaccgcagcttcttcaaccgagcactcctgttcgtccagcgtccgctcatcggatgaaatagatcacggtgaacagcgcgatccacacgatgtcgacgaaatgccagtagtacgagacgacgatgctggccgtcgcctgcgccggggtgaacttgctcatcgcggtgcgggccagcaggaagatgaaggcgaccaacccgccggtcacgtgcagatcgtggaacccggtggccagatagaacacgctgccgtaggcgctgcccgggatggtcgtgccgtggcccatcaggtggtagtactcgtagccctgcccgagcacgaagaacaggcccatcaagaaagtgatcacataccagcggcgcagcccgaacacgtcgccgcgctcggccgcgaacacccccatctggcaggtgaacgacgacgcgatcagcaccaaggtcaccggcacggcctgatacaggttgagctcggtcggcggcggcggccacttgccgcccgactgggcgcgggcggtgaagtacatcgcgaacaggccagcaaagaacatcagctcgctggaaagccagacgatcgtgccgacactgaccatgttgggccgattcagcgaatgaacccgcgacgtaattgcagtacctgaggtcccgacagcgctggtcacatccgcaagtatgacgctttgtagttgttgaactccacccgggtctggaatttcgcgatttgtggcggggcgcgtcacgccccggcgccgaccgggcccttcgcggcgaggttggggccgctgtgcccggcgtgggaccatcggcgcgtggcgttgtcatctgagtcgtctgcggcttccgcagcccggcggccctccggtgggccggcgacgtcgtggcgccaggtgctggcccggctgaccggcggtgacgacctggcccgcggacaggcggcctgggccatggaccagatcatgaccggcgaggcgagcccggcccagatcgcggccttcgcggtggcgatgcaggtgaaggtccccacctcggccgaggtcatcgagctggccgaggtgatgctgaaccacgcgctgccgttccccgccggcgcgatccgcgacgacaccgtcgacatcgtcggcaccggcggcgacggcgtcaacaccctcaacctgtccacgatggcggcgatcgtggccgcggccgcgggggtaccggtggtcaaacacggcaaccgcgcggcgtcgtcgctctcgggcggcgcggacacgctcgaggagctcggggtacggatcgacctgggccccgagcaggtcgcgcgcagtgtcgccgaagtcggcatcggattctgcttcgcgccgctgttccacccgtcctaccggcatacctcggcggtgcgccgcgagatcggcgtgccgacggtgttcaatctgcttgggccgcttaccaatccggctcgaccgcgggccggattgatcggctgcgcgttcgccgagctggccgaggtgatggccggggtgttcgccgcccggcgctccagtgtgctggtggtgcacggcgacgacgggctcgacgagttgaccaccacgacgaccagcaccatctggcgggtgcaggccggcacggtggaccggttgacgttcgatccggccgggttcggtttcccgcgggccgagctcgacgatctgttgggcggtgacgcgcagaccaacgccgcggaggtgcgggcggtgctggccggcggccagggcccggtgcgcgacgccgtcgtcctcaacgccgccggcgcgatcgtggcgcacgccgggttatccagccgcgccgaatggttgccggcctgggaggacgggctggcccgcgccagcgccgccatcgactccggcgcggccgaacagctgctcgcgcgttgggtgcggttcggtcagcagctctgacgcccgcagggcctgctcgcttgccagccgggccgagcgcgccgccgccgcccacgccgcccaggccccggccgagcgcagcggggaggcccagcccgccgcgtccggggtgccctttacccggacgatgcgcacccccggggcctccagccagcgcgcgatcagcgccgtctcctcgaccagcgcgccgcccagcggccccggctcgggccaaatcgcttgcgccgcagcggtgatcgcgtcaaccaccggcatcggtggcaccccgcgccgggcgttgcccgccgcggcgagccggccgtagcggacgacggccagctgatagccgccctgcccgtcgggcgcggcggcaaccagctccggcaacgaggccagggcccgcagccgctggccgcgccacagcgtctcgaccgcggtggcggtgcggtcgcgcagccgggcggcgctttcgaagtgacgccgctcggccagcgcagcgacctggtccaccgcggcggccagcgcgctgttgtcggcgccgtcgatcaacgccgcgaccctcgccaccgcggccgcgtattgggtggccgtgacgccgcgggcggccgggcacggcgccacctccgcctccgggcacagcggcccgtgcaacgctgcccggcccagccggttggtgcaggtgcgcagcccggcgaaccgggccagcagctcggcggtgtcggcggcgtcggcgcgggcccggaacggcccgacggcccggtcgtgccgcggcgcccggaccaccgcgagccgggggtacgcctcgtcggtgagcgccacccaccaccaccgctgcgggaagcgggagcgccggttgtagggcggggcgtgggcggccagcagccgcagctcgcgcaccccggcctcgagcgcgtgcgcgcactcgacgtggtcgaccgcgccggccagcgcgaccatctccttcatccggccgcgcggatcggcgccggtgaagtactgggcgacccggcgccgcaggtcgacggcggtgccgatatagagcacctcgcccgacggcccgcggaacaggtacacccccggccggcgcggcaacccctcggccagcacccgtttgcggcgctgggtgggcgtcacgtcgggcaggtagccgcgcaggtcggcgtaggtgtgcacgccctggttgccgacccgctcgatgagggcgtgcagcacgtcgacggtggcccgggcgtcgtcgagggcgcggtgggtgggttgggtggttacggcgaacagccgggccagcgaggccagccgcacgctgggggcctcctcgcggctgagcacccggcgggccaaccggaccgtgcacagcacccgcggtcgcggccaggcgatgtcgcactgctgcgcggccgcgcgcaggaacccgacatcgaaaccggcgttgtgggcgaccagcaccgccccgcggtccaagccggcgaactcgaggaacatcggcagcaccgcgtcgatggccggcgcgtccgacaccatcgccgtggtgatgccggtcagtcgcatgatctggggcgggatgctgcgctgcgggtcgaccagggtggcgaactcgccgagcaccacgccgccgcgcaccttgaccgccccgatctcggtgatggcgtcgggcgcggtttcctcggtgctggtgctgcgtccgccggtggtttccaggtcgaccaccacgaaggtggtgtcgcgcagcgcgacctcgtcggggccgaacgccggtcccacgtcggcgaagctcagctgagtcgcaccgtcggaggccacggtggtgacggtaggcagcacgaccgacacccgggcggctgccacgccggtccgggccgtcggggtcggcggtcgatgtcggtggccgccgttaccgttcggtcagcccggcgcgatgtgcgccggcccgctccgcggagccagaccgagaggacggaccgatggcatcgagaactggacccaccgacaggggtgcgacggcgggtgcggcgccggccgcgacgcccgagccgggggcgccggtggtgatcgactgcgacgactgcgcggcgcgcggacccggatgtcgcgactgcgtggtcagcgtgatactcggggtcccggataccttattgcaggacgagcgagcggcattggaggttttggccgatgccggcctggcaccacggctgcggctcgtcccgattcgtcgggattgcgggactggtgtagcctaaatgccttgtccgccaaaggccctcggctcaggcggaatggcccacatcaaaatgacagaattctttctaatttcttaaccgcccgctttggacaaacgccgatatcgtttcgtaacctgtttgagacctaaacccgctcgacgaccgcgattcgtcgatggccgtttaaggaagcaaatcttgaggcttgactctaggtacccggttgcgcgtgccctgacacgttcggccctggggacgctagctggcttcgcgatcctgttcggtatcgtcaccgcgcccgcgtgcgccgacccggccgaagacgccatggcgaaactcaacgagctgtcccgtcaggccgagcagaccaccgaggccatgcacagcgcccagctcgacctgaacgagaagctggccgcccagcgcgccgcggagaagaagcacgacgacgaccaggccgcggtggacgcggcgaaagcgcacctggcgtcctaccagaacgcggtcaacaacctggccgccgcgacctacatgggcggtcgcgtcgacggcatggaaaccatcctgaccgccgggtcgccgcaggggctgatcgacaagctggccgtgcagcggctgatggccacgcagatggccagccagatgaagagctaccggatcgccggcgagcaggccgccaaggccgagcgcgagtccgcgaagtcggccgccgacgccaagagcgccgccgagcaggccgccgcggtgcgagcgagcttgcagtccaagcaaagtcagctgcaggtgcagatcgcggtggtcaagtcgcagtacatgtcgttgacggccgaccagcgcaccgcgctggccaaccccggaccggccgtcccggccgccgcgacggcacccggtgcgccggcgcccgaagcggcgccgcccggcacgcccccgggcgggccggggccgggtgaggctccgcctcccggcggcgcaccgggcatggctcccggcggcgggggagtcggcggcggcgaccgcgccaccgtcgtgcaggccgcgctgacccaggtcggttcaccttatgtctggggtggcgccgcacccggcgggttcgactgctcgggcctggtgatgtgggcgttccagcaggccggcatctcgttgccgcactccagccaggcgttggcccatggcggacaaccggtttcgctgtcggacctgcaacccggcgacgtgctgaccttctactccgacgcctcacacgccggcatctacatcggcgacggcatgatgatccattcctccacctacggtgtgccggtgcgggtggtgccgatgaactcctccggcccgatctacgacgcccgccgttactagacgcccgcggctcgcggtcctgctggcctgggtgttcgtcgtcgaactcgtggtggccgcggcggtgccgttcgacgccgaacgtgacggccggacccgtcccgcccagctggtcagccccgtgcgcagccaattcagcgcgtcgagcaggtcgctggtcgtcggcgatcgcaccgtccgactgctgggtctgggcggcccggccagtgaccggttgctggcccgggtggccgcgggcatgggcgcggcgatcactgccgtggaggcgttctggggcgccgactggagccgggagatctcggtggtggccgccggcaccgacgaggaattccgcgccgccgcgggcgggggcccggcgacgcagtgggccgacatcgcggccgtcaccgtctccgaccgggtcgatccggtgcgccggatcgcgtccggccagcgcatcgtgttcgccccgggtgccgccaacatgagcccggcgtcgttgcgaatcgtgttggcgcacgagctttttcactatgcttcgcgcgcggacacggttgccgacgcgccccgctggctcaccgaaggggtcgccgacttcgtcggtcggccgccggcgccggtgcccgccgatgcgttgctgccgctgacgctgccgtcggacaccgacctggacgtgccggggccgcagcgttcgtcggcctacgaccgcgcctggtggttcgcccggttcgtggccgacagctacggaccgccgaaactgcgcgagctgtacctggccacctgcggcctgcggcgcgccgatctcgccaccgcggcccaagaggtgctggggaccagcccggccggcctgctcacccgctggcatcagtggctgacccactaggggccggcccgcggcgccgccaggctagcctgacccagtgagtcgggtcctgctggtaaccaacgactttccgccccgcccgggcggcatccagtcctacctcggcgaattcgtcgggcgactggccgccgccggctcgcacgagctgacggtgtatgcaccgcactggaagggcgcgcaggctcacgacgaggccgtcggctaccgggtggtgcgccacccgggcacgctgatgctgcccgggcccgcggtcgacgcccggatgcggcggctgatcgccgagcacggcatcgacactgtgtggttcggcgccgccgccccgctggcgctgctggcccaacgcgcccgcgccgccggggcccgccgggtgctggccagcacgcacggccacgaagtggggtggtcgatgcttccggtggcgcgctcggtgctgcgccgcatcggcgaacagaccgacgtcgtcaccttcgtcagccgctatacccggtcccggttcgcgccggctttcgggcccagggcgcggctggaatacctgccgtccggcgtggacaccgaccggttccggcccgatccggccggccgcgcgcggctgcgggagcgctacgggttgggcgagcggcccaccgtggtgtgcgtgtcacggctggtgccgcgcaagggccaggacatgctcatccgggcgatgccctcgatcgtgcaacgggtcgacggcgccgcgctggtcatcgtcgggggcggtccccacctgcaatcgctgcgcgccctggcccgcgactgcggggtggccgcgcaggtgaccttcaccgggggtataccggccaccgagctgcccacccatcacgcgctggccgacgtgttcgccatgccgtgccgcacccgcggcgccggcctggacgtcgaggggctgggcatcgtctacctggaggcctcggccagcggtgtcccggtgatcgccggcaggtccgggggagcaccggaaacggtgcagcacaacaagaccgggttggtggtggacggccgctcggtgaccgagatcgccgacgccgtcaccgaattgctcagcgacccggaccgggcggccgcgatgggcgcggccggccgccagtgggtgaccagccagtggcgctgggacaccctggccgcccggctggccgggctgctgggcgactagcggcggccagcgggccgggccgcgccgcggccgtcacgcggggcctcgagcgtcacgccagcgtgacgctcgcgcgccggcgccacgccagcgtgacgctcggcgccgaagagccgtcagagccgtcagtccttggcgtagatggcctcgaggtcggaggcgaacttctcggccaccacgttgcgcttgaccttcatcgtcggggtcagctcgccggtgtcctcggtgaaatcgaccggcaggatgcggaacttgcggatcgattcggcatgcgacacagcctgattggcgtccttgatggcggcgtccacctcggcgaccagatcggggtcggtggtcagatcggccaccgacgccccggcgcccttgtggttgcgctgcttccagccgtcgaaagcctcggggtcgatggtgatcaacgcgccgatgaacggcttgttgtcgccgaccaccatcgcctgactgatcagcgggtgcgcccgcagccggtcctcgagcacggcgggggcgacgttcttgccgcccgcggtgacgatgagctccttcttgcgcccggtgatcttcaagaacccgtcctcgtcgaggacgcccaggtcgccggtcttgaaccagccgtcggtgaaggcgtcggcggtggcctgttcgttgcgccagtagccggtgaacaccacgccgccgcgcaccaacagctcgccgtcctcggcgatgcgcatgctgttgccgggcaacagcgttcccacggtgccgatcttgacgttgccgacctggttgacggtgatcgccgagctggtctcggtcaggccgtagccctcgtggatggtcaggcccacgccgcggaagaagtgcccgagccgcgagcccagcggtgcgccccccgacacggacgcgtggcagtcgccgcccagcgccgcccgcagcttgtggtacaccagccggtcgaacaacgcgtgcttggcccgcagcagcggaccccgccggccgcggtcggccgcctcgctccagtcgacggcggtctgcacggccatcgcgaagatgcggcccttgccgtcgttggcggcgttttgctcggcggtgttgtaaaccttctcgaacacccgcggcaccgacaccaccacggtcggcttgaacacggcgaacatcggcagcaggttcttgatgtcgctggtgaatcccacggtcaccttgttggcgaacgcggacagggtcagcgagcgggccagcacgtgggccagcggcaaaaagatcagcagccgctgtccctcgtcgagcagcgtcggcaggctctccttggcgccgcgggtctcgtagagcaggttggaatgggtcagctggcagcccttgggccgcccggtggtgcccgaggtgtagatcagggtggccggatcctgggcgcgcagcccgtccagacgcgcggtcagctcggccggctccacccctgcgcccgcctcggccagtacgtcgagggccttggggccggagccgtcgatgtgcagcacccggcgcagggcgggcagctcggcggtcagctcggtgaccatcgccgcgtgctcgtcggtctcggcgaacgccagcaccgcctcggagtcctgcagcacccagcgcacctgctcggccgaggacgtctcgtagatcggcacggtgaccgcgcccaccgccaagatcgccaggtcgaggatcgcccattcgtagcgggtggccgagaagatcgacacccggtcgccggcctgtacccccagtgaaatcaaacccaatgcggccgaacggatctgagccgccgcttcggcgcaggtgacgtcggtccactccccgtcgacttggcgttggtagatgacgaagttcggatcgtcgcgctcgtgctcgaagaccatcgtcgcgatgttctcgttttcgccgacggagaagcgggcggggacgctgtactcacgcactctgatgacctcaatcgacctcgtgacgtttcccgggagccgggttgctgccgaccagcctaatccgcgcatccacccagcacggcgacggtgggtgagcgcgggacccgattgcccctgcctgccctgggtccggcgccgccgggcggtgtgtgaagctgtggtcatgcacagcatccagatcgcggacgagacgttcgtcgcggccgacggcgcccgggtgggcgccgcggtcgccgaccgggcgagctggcggcgctggtggcccgacctgcgcctgcaggtcgtcgaggaccgcggcgacaagggcatccggtggtcggtcaccggcgcgctcaccggcaccatggaggtctggctggagccgctgaaggaagggctggacggcgtcgtgctgcactacttcctgcacgccgagccgaccggggtggccgcctggcagctggccaagctgaacctggcgaaaatgacgcaccgacgccgggtggcgggcaagaaaatggccttcgaggtcaagacgacactggaacggtcgcgaccggtcggagtttctccggtagtttagccgggtcaggtgcgcgcggagagtaccgtgtcggaccgagacccgcggggttcccgcacggcagttcccaggaggccgggggcgatccggcgcgggagagagggcaacaaccaggtggcggagaagacgacccaaaccatctacatcgaagccgacccggacaccgtgatgaaggtgatcgccgacatcgattcctacccgcaatggatctcggaatacaaggaagccgaagtcgtcgaaaaggacgccgacggctaccccaaggtcgcgcgcatcgtcatggacgccaccgttctcaaggacaccatggtgatgtcctaccagtggcccaaggatcggcggtcggtcagctggacgctggtgtcgagctcgctgctgcgggccctggagggctcataccggttggcgcccaagggatccggtaccgaagtcacctacgaactctcggtcgacctggccatgccgatgatcggcctgctcaagcgcaaggccgagcggcggctgaccgacaccgcgttgaaggatctcaagaaacgagtcgaggctgagtgagtccggtgcatcgtcggcgcccaccccggcccggatcagtctcttcgttggcaaaggcggggtaggcaagtccacgctggcctgcgccaccgcggtggccgccgccggcgcgggacagcgggtgctggtggtctccaccgaccaggcgcattcgctgggcgatgtgctgggcgtccccgtcccgccgagtcaggccgagctggtccgggtgctcgccgacctggagaccggacgggccgaggccggcggcggattcctcgacgcgctggcgctggacaccctggccctgctcgaggcccgatggcgtgacgtggtcgccaccctggaccggagatttcccgactccgagctgagcaccattgcgcccgaagagctttcggcgctgccgggtgtgcaggaggtgctcggtctgcacgccgtcggcgagttggcccgctccgggcgatgggaccgggtggtggtcgattgcgcctccaccgcggacgcgctgcgcatgttgacgctgcccgccaccttcggcctctacgtggagcgggcgtggccgcggcaccgccggttgtcgctgaccgccgaggacgcccgctcggccgcggtggtggagctgctcgagcgcgtcagcgccagcgtggaggcgctcagcgcgttgctcaccgatggcgacctggtcggtgcgcacctggtgctgactcccgagcgggtggtggccgccgaggcggcacgcaccctggggtcgctggccctgatgggggtgcgggtcgaggagctgatcgtgaatcaggttctgctgcaagatgactcgtacgagtaccgcaacctgcccgagcatccggccttctactggtacaccgaacgcatcgccgagcagcaaagcgtgctcgaggagctcgacgccgccatcggcgaggtggcgctggtgctgaccccgcacctgtccggcgagccgatcgggcccaaggcgctgggggcgctgctcgacgccgcccggcgccggggcggggccgcgccgcccggcccgctgcggcccaccgtggacctggaatccgggacgggacttgggtcgatctaccggatgcggctagcgttgccgcaactcgacccgtcggcgctgacgttgggccgggtcgacgacgacctgatcatcagcgccggcgggttgcggcgcagggtgaggttggcgtccgtgctgcggcggtgcacggtgctggatgcgcatctgcggggcagcgagctgacggtgcgttttcgaccagatccggaggtgtggcctaagtgagtggggctcatcccgacatcggtccggagctgcgcaggctcgcccagtcgatcctggacggcatcgaccccgccgtgcgggcggcggcggcgctgacggccggcgccggcccgggaaccggtaagtgccagcaggtctggtgcccggtgtgtgcgctggccgcgctggcgaccggcgaccagcacccgttgctcaccgcgatcgccgatcacagcatcgcgttgctggatgtgattcgcgacatcgtcgccgacatcgaccgggcgtctggcccgacacccgaacccccacccgacggcccgcccggcggcgcccccgacacccccgacaccgggcaggccccgcggacccggtatcagcccatcccggtgaccttcgaggagtgagccggccgcgccgcaggtggtcccttcttatccggatgggtacagttggcgcagaacatcagcgggtgcagccgagagggaggggccatgtggtactggctattcaagtacgtgctcctcggcccgctgctgtctttgctgggacggccgaaagtcgaaggcctggaacatgttccgagctccgggccggcgatactggccagtaatcacctggcggtgatggacagcttctaccttccgctggtggtgcgacggcggatcaccttcctggcgaagtcggaatatttcaccggcaccggcctcaagggctggtttcagcggtggttcttcaccgccgtcggccaggtgccgatcgaccgcaccgacgccgacagcgcccaggccgcgctgaccaccgcgcagcaggtgctggcccagggcaagctgctgggcatgtaccccgagggcacccggtcacccgacggccggctgtacaagggcaagaccgggctggcccggctggccctgcagaccggggttccggtgatcccggtcgcgatgatcggcaccaacgtcgtcaacccgcccggctccaacatgttgcggttcggccgcgtcaccgtccggttcggcaagccgatggacttctcccggttcgaggggctggccggcaaccgcttcatcgagcgggccgtcaccgacgaggtgatctacgagctgatggggctctcgggacaggaatacgtcgacatctacgcggccagcctcaaaaagggcggcgccgaggcacccggcggcgaggccgcgcggattcccgagacggccgcgggttagccgattgcggtgaccggcgtcagctgctgcggcgccgcgtcccgcgaggcggcgcgggcggtgaccgtgacgcccgccgcgacgatgaccgccagcgcccaccacacgtaggacatcccggcgagctggcgccaccacaccgcgctggcctcgtgatgcttgggcagcaggtcgatgggcgtccacctcatcagggccaccccgacgacgctcagcaccagcagcgccgcgttgcgccgccgccagcccaggacgccggtgaccagcaccgtcggcaacacccacacccagtggtgcgaccacgacaccggcgagaccaccaacccgaacagcgcgacgcacaccagcgccagcgtcggctcgtcggcgcgcagcacccgccgcatcgcccacaccgtcaccgccagcaccagcagcgacgccgccacccacagcagcgaccgcggctgctgcgccagccccaggcgggccagcgcgccggcgatgttctggtcggtgttcagcgacgcggaaccgatccggtcggtgtggtgcacggtgtgcgtccagtactcccacgagtcggtgtaggccaggacgaaaccgagcagcgtcgcccccgcgaacgaggccagcgcggtgagcaccgcgcggtggtcgcggcgcagcaggaaatagagcagaaacaccgcgggcgtcagtttcagcgccatgcccagccccagcagcaggccgcgcggccacggcgtgcgccgcggcaggcagtcggcgatcaccagcgtcatcagtaccacgttgatctggccgaaggcgaagttcgaactgatcggctccagccagatcgtggcggccgccgcgaccaccacggccagccaccaccggcgcagccaggccgggccgggcagcagcgccgaggtgctccacacgtcgaggcgggccagcacgatcacggtcgagacgaccagcaacaccaacgtcagggcggtgatcgccacactggccgtcggcatgtgcatccaggcgaacgggcagaacacgatggcggccagcggcggataggtgaacggcagatccacgatcggtgtgtggaacagcacgtctccgcggtacagcgggcggccgtccatccaggcccgggcgcccatctgatacacgtcgatgtcgatgcgatagggggtgtgcccgaacaactgccacgccgcgtacccgagggcggcggcggccgtcagccacgccaacccccaccacagcgcccaccccggtcgtttgcctgggaagccggccccgggtgcttgccgcgtactcatgtcgcacaacagcgtaatgggtgcgcaggccgccacccctgctgcagcgcggctcccacgccccggacccgcgctggcgtacgtttcaagggtgctccactcgttcgtgtccgaggtcacccggtggttcgcacatgacgtctacgaccggggacacctgcccctgctgtgctgcctggtcgccttcatcctgacgttcttcgtcacccgctcgttcgtgcggttcatccggcaccgcgccgagaccggccggccggcccggtggtggcacccgcgcaacgtccacgtcggggggggcacatccaccacgtgacgttcggggtggtcctgacgctgctgtccggcctgacgctggtgacgctgtccatcaacgggcatgagcccgaattcaccgttgccgcaacgtttttcgggatcggcgccgccctggtgctcgacgagtacgcgttgatcctgcacctgtccgacgtctactggtcggaggacggccgcacctcggtggacgcggtgttcgccgcggtggcggtgggcggactgttgatcatgggcctgcacccgctgatgttcttcctgccgatgtggcacggcgccgactcgatgatgctgcgcgcgctggtcggtggcgccatggtgttgacgttgccgctggccgtggtggtggtgctcaagggcaaggtgtggaccggcctgctcggcatgttcctcgtcgtgctgctggtcatcggagcggtccggctgtcgcgcccgcacgcgccctgggcccgctggcggtattccacccagccggagaagatgcgccgcgcgctgcagcgggaaaggacgctgcgccgcccggtggtgcgggccaagctgtatctgcagtgcgccatcgccggcacgccccgatttcccgacgagcgcaccgtcgatgccacgctcgaccacgaggtccatccggcaccggcgcccaccggtcccatcctgatcggcaggtaagccggccgtaggcttcccgggtgcggtatttctacgacaccgaatgcatcgaggacggccgcaccatcgagctgatctcgatcggggtggtcgccgaggacggccgcgagtactacgcggtgtccaccgaattcgatcccgagcgcgccgggccctgggtgcgcgccaacgtgctgcccaagctgccgcccccggcgtcgcaactgtggcgctcccgcaggcagatccgcgacgacctggaggagttcttcggggtccgcgccgcgcagagcgagccgatcgaactgtgggcctgggtggcggcctacgaccacgtggccctgtgtcagctgtggggcccgatgccggatttgccgcgcgccatcccgcggttcacccgggaactgcgccagctgtgggaggaccgcggctgcccgcggatgccgccgcgctcaccggatgcccacgacgcgctggtcgacgcccgcgaccagctgcgccggttccggatcatcaccggggccggctgagacgtcgcctgaggcgcccggctgaggcgcccgcgcgttcccgcagctcaaccctgaccagcagacttcgcgaccgggttaccatggaccgatgaactggaccgtcgacatcccgatcgaccagctgccgccgctgccgccgctgccgggcgatctgcgggcgcggttggacgccgcgctggccaaaccggccgcccagcagcccagctggcccaccgaccaggccaccgcgatgcgcacggtgctggagagcgtgccgccggtgacggtgccctcggagatcgtccggctgcaggagcagctggcccaggtggccaggggtgaggcgttcctcctgcagggtggggactgcgcggagacgttcaccgagaacaccgaaccgcacatccgcggcaacatccgcaccctgttgcagatggccgtcgtgctcacctacggcgccagcatgccggtggtcaaggtggcccgcatcgcggggcagtacgccaagccgcggtcggccgacatcgacgcgctggggctgaagtcctaccgcggcgacatgatcaacggcttcgcgccgaatgcggctgtgcgcgaacatgatccgtcgcgactggtgcgcgcctacgccaacgccagcgcggcgatgaatctggttcgggcgctgacgtcctcgggactggcttcgctgcacctggtgcacgactggaaccgcgaattcgtccggacttcgccggccggcgcccggtacgaggcgctggccaccgagatcgatcgcgggctgcgcttcatgagcgcctgcggggtggccgaccgcaacctgcagaccgccgagatctacgccagccatgaagccctggtgctcgactacgagcgtgccatgctgcggctgtcagacagcgatgccggcgagccgcagctctacgacctgtcggcgcacaccgtgtggatcggcgagcgcacccgccagctcgacggcgcgcacatcgcgttcgccgaggtgatcgccaacccgatcggcgtcaagatcggcccgacgatcaccccggagctggccgtcgagtacgtcgagcggctcgacccgcacaacaagcccggccggctgaccctggtgagcaggatgggcaacagcaaggtgcgcgatctgctgccgccgatcgtggagaaggtgcaggccaccggccaccaggtgatctggcagtgcgacccgatgcacggcaacacgcacgagtcgtccaacggctacaagacccggcacttcgaccgcatcgtcgacgaggtgcagggcttcttcgaggtgcaccgcgcgctgggcacccatccgggcggcatccacgtggagatcaccggcgacaacgtcaccgagtgtctcggtggggcgcaggacatctcggacatggatctggtcggccgctacgaaaccgcttgcgacccaaggctgaacacccagcagtcgctggagttggccttcctggtcgccgagatgctgcgcgactaggaccgtaccgcaatcctgttccccggcgggctcgccggcccgaccggagccgtctcggagcggtgtcgctttgcggcgaaccgggcccgtaggttgccccacacgatgcgcggtaacagagcgggatcccgcagccgcgacggcgggtcgatgaagttgaagacgcgaaagcagcgttcggtcagcacgacatcctgggttgacgcattcaatgtcgccctggatatccagccttgcagccgctgccgcaccccgtggtagacgccggacgtggtccggtctctggcctgattgacggcccacgtcgcgccgatgtactgggccgtcgcccggaaaaagcgttgcgccagcagggcatctcccgcgcgcaggcactcgcgcagggtcagcgcttccagcgcggcgatcgtcatgccttggccgtaggtcgggtcgagactgcacagtgcgtcgcccatcaccagcagacccgacgggaactcggccagctggtcgtagcgccgccagaacgcggcggtgtggtggtatgtcacggcttccccgatggggtaggcgcggcgcaggccctcgacgatggccgggggcagcgacggctcggccatcgcgagcatcgcggcgaaatcggttggtggctcgccggtgtcggccggcacgccgatcgccaggatgaacgtgtcgtgttcgttggcgagcagcaagccccccggcctgccgccccccgggttgaacatgaccagccgctgggcgatcgacgcctcgggcatgctcaactgttggctcgcgtagccgtatcgggccaccgcccgctcctcggtcggccgttggtagcccaggctctccagaaatgccggcgtgcgggccgagcgccccatggcgtcgacgaccaaatcggcatccagcgccatgagaaaaccgctgtagcgccgggtgattcgcacgccgttgacgatgtccgcggtgttgaggaggtcgcacacgtcgtgtccgtcgaggaacgtcacgttcggcagggacttgacgcggcggcgcaggtgaaactccatgaacggccgggtcgtcatgtgcagcgccaatgcgtccggatcggcgaacgcgcccgagttcttcatttcgtagcgcccgaagcgcacgtagaaccgcgacaggtcaccgtcatcgacgacgaccgcccccgcccgggccaggtcatcgagcagaccgggaaacaattcctccaggacttgtaggccgcggctgtagaagttgtgcacgtgacggccctgggggatgcccctgcggtggcacggatagtcgggcaatttgtcccgctcgaccacgctgaccgaatcgtagaactccgaaagtacgcgcgcggcaagcaaacccgcgatgccggcacccagtaccaccgcgtgctcaccgagccggttcggcgagtcgacgccctgcgttgtcgaacccatacgaaaggacggtacaccaaaattaagaaaaataagagaaccttgtgatcactttaagatcgtgtcgcccccgggggcgcgatccacgcggctgagccgccgcgccttccgatggacgcgcgccgcgccggaaagctagaacagtccgttcaggttgcgcccgatggtccaggccgcggtggcgaccatcccggtgaccgccagcaccagcgccaaccagaccagtaccatgcgccggttgtgctggcgggcccagacgaactcgctgatcgggatgccggcgaattcgcctgtgacagactggtattcgtagtcgtcctcgtcgtcatcgggttcggccccgacgtgtgccgggggatcgggctgcggccactcctcgggtccgcgggtcaagtggcgggtgggatgccgcgccggcggctcggcggcgggcgcccgccggccggcctcgcggtgcagcgccgctgaccggtgtaacgcggagttgcgcggggccggcacccgaaagccgggcagcgcaagctcatcggcgatcgcgtccagatcggcgcccatctcgaccgcgtcggcgtaccggtcggccgggtcgcgggccgtcgcgcgctgcacgaagtcgtcgaactgcgcgggcacgccgtcgatggccgcgctggggggcgggacatcggcgtccagccgccgataggcgatcgccaacatcgagtcgccggtgaagggggtgcgcccggtcagcagctcgtaggcgacgatgccggcggcgtacacgtcgctgcgcggggtggccgcgccgtcgcgcacctgttcgggcgacaggtacgccgcggtgcccaaaatcacgctggcagaggtgattccggcggccgcgacggcccggaccaacccgaagtcggcgatcttcacctcgccgtcgtcggagatcagcacgttctccggcttgacgtcgcgatggaccaggccggcccggtgcgcggcggccagcccgcccagcaccggacgcagcaccgccgccaccgcgtagggcggcatcggtccgcgttcgcccagcagctcgcgcagcgtcccgccctcgatgagctccatcaccagaaacggatgccgcgcgtccaggccttggtcgtagacggccaccaggcccggatccttcagccgggccaccgcgcgggcctcgcgctggaaccgggtcaggaattggtcgtcgccggcgtaacgcgggtccatcaccttcaccgcgacgggacggtcgagccgggtgtccacgccgcggtagacggtcgaggtgccgccgctggcgatcttggactcgatcagatagcggccgtccagcaacgtgcccgcaaaggagccgggcgattcagcttgggcctggcgacgatgcgggccgggcgggcccgaggaggagccgggcggttcagcgtgggccacggggccatcgtaggggcgaggtggtgattgggcgccggaacacgggctcaacgcgcgcatcaacgcctacacttgcgcgagtgagcagtattcctgccggcgacgatgtgctagatcccgacgagccgatctacgacttgccgagggtcgccgaattgctcggagtcccggttaccaaggtgcaccagcaactccgggagggacacctggtcgcggtccgacgcggcgaggccctggtggtgccgcaggtgttcttcaccaagtccggcgaggtggtcaagagcctgcccgggctgctgacgatcctgcacgacggcggctatcgcgacaccgagatcgtgcgctggttgttcacccgggacccgtcgctgacggtgacccgggacggcagccgcgacgccatcagcaacgcccgccccgtcgatgcgctgcacgcgcaccaggcccgcgaagtcgtgcgccgggcccaggcgatggcttactgagccggctgcggaacccggtacaggctgtaccaggcgaccagcgcgacggcggtggccagcgaaaagtgcagccacgagtacatgccgtgggagccatcgggtttgaagatcaccatcacccaggtcgacaggccgccgatgatcgccaccgcgcggcgggactgcgccagcggggccagcaccgccagcggccacgagtagtaccacggcaacgcggcgggcacgaacagcaccacgatcagcatcgagatcgcgatgccggtgagcgcgtcgcggtcgtcgcggcggaaccgccaccacagcagcggcagcgagatcgcgatgatcgcgatgccgaccagccgggtgacccgcaatatcgggtagaaactcaccggaaagaacccgctgccgatcgcgtggatcaggttggcggccgcggtcggcacggtcagccagttgatgatcttcaccgatccggccagcgcggtcagccagcccagccccaccccggccaccgcggacagggcggcgaacaccaccgcgaagatcagcagcgaggccgcggtggccgcgaaaaatgctggcaccggccgatatccgcgccgatcgcgcagttggcgcgcccacacccacaccaggaagggcagtgcgatgccggcggtggccttgaccgcgatggcgacggtgatcagcgtgacgccggcgacggggcggccgccgaacgtcagcgcgatgccggcggccatcaacccgaccatcagcatctcgttgtgcaccccgcccatcagatggatgagcaccaacgggttgagcacgcaaatccacagcgccgtcggctcgtcggcgcccaggtggcgcgccaggcggggggtcgcccagatcagtagcaccaggccgggcagcatgcacagccgcagcagcgcggtgcccgccaccacgttgttgccgaccaggatggtgatgatcttggccaccaggatgaacaccggaccatagggtgcggtggtgatcgaccagatcggactgacgttgtccagcaagctgttcgggttcgcgaccggaccgaccgcgtagggatccaggccgtcgcgcagcagcgcgccctgcgccaggtacgagtaggtgtcccggctgaacacgggcaccgacaccagcagcggcgccagccagaagccggtggtggccttcatgacgaactcggttgcctcgccggccaacacgcgacggcccaggctcagccaggcgatcagcatcaggccgacgccggtccacagcacgatcgacgacagcaccaggccgtggccgaaacgcagccaggacatgtgaatcgactcgagcagcgggtcgtgctgacgggtgctgcccgctcccagcccgcccagggtgatcagcaccgatcccaacatccccagcttcgcggggccggagtcggcgctaccggcgaacgccttcagccgcgaaaaccattgtccgcgagagggtttggccgccggtgggtcggcggccggggtgtcggttccggtggccatcggttcaggccgaccggttggtggccagcttggccaattcggacaaccccgccttggcggcggtgttgatgggtgcggccgccagggtggccagggcccgctgggtcagcgtggcgatgcgctgctcggcggcggccagcgcacccaccgactcgatcacgtcgcgcagccgatccacttcggcgtcgctcagctgtgcgccgatggagtctcgtaacagcttggcggccaacggatccgacttctccgccaactccaccgcctcggccaacagcacggtgcgcttaccggatcgcaggtcgtcgccagacggtttgccggtcaccgcggggtcgccgaacacgcccagcacgtcgtcgcgcagctgaaacgccaccccgaggtcggtcccgaactggctgaacaggtcgtgcacgtccggccggtcggcggcggccgcgccgagctgcaacgggcgcgacacggtgtagcaggcggtcttgaaggtgtcgacgttcatcgccgaggcgatcgaggcggcggcgctggcctcggcgacgatgtcgaggtactgcccgccgagcacctcggtgcggatgttggcccacacccgccgcacccggcgcgccgcctgcggtgtcaggtcgacaccgaggacgatgtcgtcagcccaggccagggcgagatcgccgagcaggatcgccgccgacatcccgaaccgctccggcgagccctgccactgccggtctcggtgcaacgacgcgaaccgcacgtgcgtggtgggccggccccggcgggtggccgagtcgtcgatcacgtcgtcgtgcaccagggcgcacgcgtgcagcagctcgagtgcggaaaacagcagcagcgcttggtcatcgggcgcctcggtggccaccgcgcgccagccccagtaggcgaaggcgggccgcagccgcttgccgccgttcagcacgaactcttccagcgcggcgatcaggccgctgtagtcgtcaccgatgtaggcggtctcggcgcgccggtcatgcagataccgccgcaattgctcggtgatggcgccggtcaactcgacggttgccgccgcttctgaagctcgtaggctcagcgcggcgcccctttctgctcggctggctgggtgttgcaggcccgaccagtgtattcgccgcgtcgcccgagccggtctccgcggccgacggggtgcccgccgcgcccagttgcttcgactgcctcactaacccgcccctatgctggcgggtgcgctggggctggcgcggacagtgcgcgcacagcagacgccccgggccaatacccgtcggatggagagaagccgcgtgaccctcaacaccattgcgctcgagctggtgccacccaacgccgacgaaggtcgggagcgggcactcgaagaggcgcacaaagtggtgcggcattccgcggagtcgggtctggacggccggatccggcacgtgatgattcccggcatcatcgccgaggatgacgatcgcccggttccgatgaagcccaagctggacgtgctggacttctggtcggtcgtcaaaccggaactgccggggatcaagggcttgtgcacccaggtcaccgcgttcatggacgaacagtcgctgcacggacgcctgaccgagctgtgctcggccggcatggaaggcgtggtgttcgtcggcgtgccgcgcaccatgaacgacggcgagggctccggggtcgcccccaccgacgccctgtcgatctaccgcgacctggtgaccaaccgcggcgtcatcctgatccccacccgcgacggcgaacagggccgcttcagcttcaagtgcgaccgcggcgccacttacggcatgacgcagctgctgtattccgacgcgatcgtggggtttctgcgcgagttcgccaggcagaccgatcaccggccggagatcctgctgtcgttcggcttcgtgccgaagatggagagccgggtcgggctgatcaactggctgatccaggacccgggcaacgccgcggtggcccgcgagcaggagttcgtcaagacgctggccgccagcgaaccggcgcagaagcgccggcagatggtcgacctgtacaagcgcgtcatcgacggcgtcggcgacctcggcttcccgctgagcattcacctggaggcgacctacgggatctccggcccggcatttcagaccttcgccgagatgctggcctactggtcgccccggccgagctaggggctattcgggtgggggttggtcgcgcggggcggtcaaccgcggtgaccggtcccggctgacccaggccagcagccccaccaccccggccgcagcgaaggacgcgatgcccagccacaccaccgcgccggtgaacgaccgggtgttggggtcggtgtagcgggcctgggcggtcatggtgctcaccacgcccggcttgagcttccaggacaccacgtcgggctccacccggtcgccgttggtcgaggtcaccacgccgggaaaggccaccgtcagctcgacgtcggcctccgggtcggtcagcgaggtcaggtccgcgcggccctccaggagcaccaggttgccgttgcggcgcagcgacaggttgaccccggcggcgtcggagttcatgttggccagctgcggcagctcggcgaacgtcaggtcggagaacaccgcctgggagccgacgtagccgtcgctgtcgtagttcgacaccgccaccttctggctgaacggcaagttgttgctgtccagctgcgggccggtgtccttgggggtcttgggtttcgcggcggcgacgatctcgccggacaccaggtcgtcgggggagatggtgagcgaggcgcgcacgcgcaggcatccggtggccagcggcaccaccagcagcagcatcgcgaaggccagcaggcgccgccgtcgcatccgggcggcctgggatccgcggcggcggggcggggcagggcgggcgcgcaccaggtcatcgtgccagatccgccgtgccgctcagtgcagccttgggtcgcgtgccgaatgttgcggtgtcacagcgggagttcgcggcccaggatcgcgaacggccgggggtcgccggcgaagtggtagcggcggatgatgtcggtgaaacccagccgccggtacagccgccaggcgcggttgggctcgccgttggtttccggtgtggacagcagcacgttcttttcggcgcgaccggcgagcagccgtcgcgccagcgcctcgccgagcccgcggccttgggcgcgggggtggatgtgcagctcggtcagctcgaaataatcgttcatcagccgggcgatctcctgcggcggcgagccgccgcgctgcagacccagcaccacctgctgctgccaccattgccccggcgccccggggtagccgtaggccacgccgagcagcggggcgctggccaactcttcggccgacggcatctgatcgtcgtcgtccacctcggcctcgacgacggccgccccttgccagccgcggcgccggatgtgttccagccacatggcggcgcgctggttctcggtgtcgcgcgggtatcgcatcgcgtccacgtacaccgccagggcgtcgccgagtcggcgctccatgtcgtgggggagcagatcgatgaggaatatcgccaacccgcggtgccctcctcatccagcgatctcgtccagcgatctcgtccagggatccgttgcttcgcggtgtcggggtcgccccggaaatggtctccgtgggaccgggccgctagcgatcattatcggacgggggcgcggcggtcggtaagcggtcggcgcacccggtttcggaagccggtttggaagccggttcgggaagccggttgtagcgcacgggcgttgcggtccggcggggtgcccggatgcgggcgggatagaatcggcgcggaaccagtggtatggggcagatcgacctcgtatcattcaattagttgcccgcgcaacgggcatccgcgtgctaccgatagtcacgtgtcaacttgtcggcaaggagggacgaatgccactctccgatcatgagcagcggatgctcgatcagatcgagagcgctctctacgccgaagaccccaagttcgcgtcgagcgtccggggcggaaggttccgcgcgcccaccgcgcgtcggcgtctgcagggcgtggcgttgttcgtcatcggtctggcaatgctggtttccggggtggccttcaaggccacgatgatcggaaacttcccgatcctcagcgtcttcgggttcatcgtgatgttcggcggtgtggtgttcgccatcaccggtccacggttgcccggccggcccgacctgtccggcccggcccccacctcgctgcggcagcgccgcaacaggagtggaggctcgttcaccagccggatggaggatcgcttccgccgccgcttcgacgactgacgtccacccacacacccgcggggtagccgagtcggctgccccgcgttgttttcccggccccggtggccgccgagggcagacggcggggctggacggcgcgcaactgtcgatgccgttttgcgtcccaatcgatccccaaccgaggcgcgggccgcccattgcccccactgcgccccaccggaaatccccacgtttccccacccgcggcatttagcctggtcaaccaggtgattgcggcgtcccgaaagacgccgcagcagggcggcgacacaccccggcggccacaatgttcaccttttgacgtcggacaacccgaaaaacgccaccccgacacccacggaatggggcgaagtgggggattgtggggtatggtggctgcagtgtttgggtgacctcgaacgggaggtgagctggtgtttctcggcacctacacgcccaaactcgacgacaaggggcggctgacgttgcccgccaagttccgcgacgcactggcagggggattgatggtcaccaagagccaggaccacagcctcgccgtctacccgcgggcggaattcgagcaactggcccgccgggcgagcaaggcctccaagagcaacccggacgcccgggcgttcctgcgcaacctcgccgccggcaccgacgaacagcatcccgacgcccagggccgcatcaccttgtcggccgaccaccgtcgttacgcgagcctgtccaaggactgcgtggtgatcggggcggtcgactacctggaaatctgggatgcccaggcctggcaggactaccagcaaacccacgaagagaacttctccgcggcaagcgatgaagcactcggcgacatcatctgaggcgcatgcccgtgcaacgtggcctctgcccgaaccgaccctggcgtacttccccaacgccaggttcgtgccttcggacagggacctcgatgcaggggcagctcgcccgatccggggaggcgttgcggtggttgacgattcaccggacttcgggcacgtgcccgtcctgctcgagcgctgcgtcgagctgctcacccccgcactgacccgtcgtcaccccgacggctcgggcgcggtcctgctggacgccaccctgggcgcgggcgggcacgccgaacggttcctggccgacctgcccgggctgcggctgatcgcactcgaccgcgatcccagcgcgctcgagatcgcccgggaacgcctggcgcggttcgccgaccggatcaccctggtgcacatgcgttacgacggcatcgccgcggcactgaccgaatccggttacgccgcaaccgaatcggtcgacgggatactgttcgacctcggggtgtcgtcgatgcagttggaccgccccgagcggggcttcgcctacgcccaggacgccccgctggacatgcggatggacccgggatcgccgctgaccgcggccgacatcctcaacacctacgacgaggccgagctggcggacatcctgcaccgctacggcgaggagcggttcgcgcgccggatcgccgcgcagatcgtgcgccgccgcgccaaagagccgttcacctccaccgcggacctggtttcgcttctctaccaagccattccggcaccggcccggcgcaccggtgggcatccggccaaacgcacgttccaggccctgcggatcgccgtcaacgacgaactggacacgctgcgccgcgcgcttccggccgcgctggacgcgctcgccgtcgacgggcggatcgtggtgctggcctaccagtccctggaggaccggatcgtcaagcggttgttcgcccaggcggtcgcctcccgcaccccggtggacctgccggtcgaacttcccggccacgagccacggttccgcgccctgacccacggtgccggacgcgccgacgccgccgagatcgaacgcaacccgcgcagtgccgcagtgcgattgcgggccctgcaacgaacgcaagcaccgcaggcgaccgggaaaggcgattgatgagagcagagcgcgagacggcgaaacggcgcggcggcagcgatcgtcggggcgcccgcgacggtgccgcccgccgcggcaggcgtccggcggccgacgccggcgcggcgcggcgcgcccgcggtggccgggcctcggcgcccgcccgggaatcccgcgcgcccaagccgggtccgcagaccagccccgtcgcgcggccggccgagcgatcggcccggcccaggaacaccagccaggccaaggcgcgggccaaggctcgtaaagccaaggcgcccaaggtcgttcggccccggctgaccgagcggctggccgcccggctggcagcgatcgacctgcggccgcgcaccctggccagcaaggtcccgttcgtcgtcctggtcatcggtgcgctgggcgtcgggctcgggctcaccctgtggctgtccaccgactccgccgagcgctcctacaagctcagccacgcccgggagcggacccggttgctgcagcagcagaaggaggcgctggagcgcgacgtgcgcgaggcggaggccgcacccgcgctggccgaggcggcccgcaagcagggcatgatcccgacccgggacaccgcgcacctggtccaggatccgtccggcaactgggtggtggtcggcacgcccaagccggccgacggggtgccgccgccgccgctgaacagcaagctgcccgacgaggcgccgcagccgccgaagccggcgccgccggccgccgaggtcccgatccgggtggagcccgcccccggcggacccgtcccggccaggtccgggcccgaggcgctgctgcgcgcgccggacggcgcctccacgctgggcggtcaacacctggcgccggcggttccccctgtcccgggcgcgccgcccggtgtgcccggcggtcccgtcgccgcgccgcccgcgctgcccggcggtccggtcgccgctgtgccacccgcattgcccgccgtgcccaccggcccggccaccggtcgcccgccgggcctgacgcccgggctgccgatgccggggttgccgatgccggccgggccggcggtggctccggcccccgcggaggtctcgattccgttggggggcttgcccgttccggctcccggccagctgcccgccccgctgccgccggaggtgccggtgccggtgcaattgggccgcccgggcgcggccccccagccggtggtcccggccgccccgctgccgcaaccggtcaacggcgcccagcccgggcccgcccccgtcgcgacgccgggtgccccgaggtgagccgcggcgactcggcgcgggcccgtcggtcccagtcggtgcggccgacgcgtgggccgcgtaaggacgtgcagggcaaggcgattcgacagcccaaacgccgcggcaaggccaaccaggccgaggccgcacccgggcactcggcgcggcagcggcgcacccgtcagatcgcgcaattgacctctcggggtggatcattcgtgttccgtcaccgcgccggcaacgtggtgatgctggtggcgatggtggtggccgccgcccagctgttcgtcctgcaggtgaccaacgcgtcggcgctgcgcgcccaggcggccggacagctcaaggtcaccgatgtggaaaaggcggtgcgtggcagcatcatcgaccggcacaaggatcagctcgccttcaccatcgagtcgcgggcgctgaccttccagccgaagcggattcacaagcaactggaggaggccaaggccaagaacccgtcggctcccgacccccagcagcggctgcgcgacatcgccaaggaggtgtccggccggctgggcaacaagcccgactccgcgaccgtgctgaagaagctgcaaagcgacgagaacttcgtctatctggcgcgcgccgtggatcccgctgtggccagcgcgatctcggacaagttcccggaggtcggctccgagcgtcaagatctgcggcaatacccgggcggatcgttggcggccaacatcgtcggcggcatcgactgggacggccacgggctgctgggtctggaagagtcgatggactcggtgctatccggaaccgacggctcggtcacctatgaccgcggctccgacggcgtggtgatcccgggcagttaccgcaaccggcatcgggcggtcaacggctcgatggtgcagctgacgctggacgacgacatccagttctatgtgcagcagcaggtgcaacaggccaagaatgtgtctggcgcgcacaatgtttcggccgtggtgctggacgccaagaccggcgaagtgctggccatggccaacgacaacaccttcgacccgtcccaggacatcggccgtcagggcgacaaacagctgggcaacccggcagtgtcctcgccgttcgagcccggttcggtgaacaaggtgatcaccgcgtcctcggtcatcgagtacggcctgtcgaatcccgacgaggtgttgcaggtgcccggctcgatccagatgggcggggtgtccatccacgacgcgtgggaccacggcgtgatgccctacaccaccacgggtgtgttcggaaagtcctccaacgtcggcactttgatgctggcgcagcgggtcgggccggagcgcttctacgacatggtccgcaagttcgggttgggccagcgcaccaacgtgggcctgcccggtgagagcgcggggctggtgccgccgatcgaccagtggtcgggcagcaccttctcgaacctgcccattgggcaaggtctttcgatgacgctgctgcagatgaccggcatgtaccagacgatcgccaacgacggggtgcggatcccgccgcggatcatcaaggccaccatcgcgcccgatggcacccgcaccgaggagccgcgcccggagggcgtgcgggtggtatcgccgcagaccgcgcagaccgtgcgcaacatgctgcgcgccgtcgtgcagcacgacccgatgggttaccagcagggcaccggcccggccgccgcggtgaccggctaccagatggccggcaagaccggcaccgcccagcagatcaaccccgcctgcggctgctacttcgacaacgtctactggatcaccttcgccgggatggccaccgtcgacaacccccggtatgtcatcggcatcatgatggacaacccggagcgcaacgccgacgggacgccgggccactccgcggccccgctgttccacaacatcgccggctggctgatgcagcgggagaacgtgccgctgtcgccggaccccggcccgccgctgaccctgcaagccacctgaccgagcgccgcccgcggatcgcccgccggcccgccccggctaggtagggtgtcatggccgatcatgaggatgacgcggcgccggagggaggtgtgagcagaagtggtgtcggtgcccacggggttgcgccccagcgccgtcccgggcgtgcggctgcccgcgctggccgaccaggtcggcgcggtgatggccggcccggaccggcgcgccgccgtccccgacgtcaccgtcaccggcgtgaccctgcgcgcccaggacgtgctgcccggcgacctgttcgccgcgctgcccggtgcgacgacgcacggcgcccggcacgccgccgaggcgatcgagcgcggcgcggtcgcggtgctcaccgatgccgcgggtgtcgcgcagctgaccggcggccggaccacgccgacgctgctgcaccccaggccccgcagcgtgctcggccagctggccgccgccgtgtacgcgcacccgtccgagcggctgaccgtcatcggcatcaccggcacgtccggcaagaccaccacgacgtatctggtcgaatcgggtctgcgcgccgccggccgcacggcggggctgatcggcacggtcggcatccgcatcgacggcgccgacatccccagcgcgctgaccaccccggaggcccccgccctgcaggcgctgctggccgcgatggccgaacagcgggtggacaccgtcgtcatggaggtctccagccacgcgctggcgttgggccgggtggacggaacccgtttcgcggtcggcggtttcaccaacctgtcgcgggatcacctcgactttcaccccaccatggccgactacttcgaggccaaggccttgctgttcgacccgaactccccgctgcgggcgcaccgcgccgtggtgtgcatcgacgacgaggccgggcgcgaaatggcggcccgcgccggtgatgcggtcacggtcagcgccgagggacaaccggcgcactggcgggccgtcgaggtggcgccgctggggaccgggggacagcagttcaccgtgatcgatcccgccggcgtccagcaccgggcgggcattcggctgcccggccactataacgtcgccaattgccttgtggcgctggcacttctggatgcagtgggagtgtccccggagcaggcggcgccgggactgctgcagaccagggtgccgggccggatggaggagatcgacgccggccaggactttctggcgctggtcgactacgcccacaagccgggcgcgctgcgcgcggtgctgagcagcctcaagcgcccggatcgccggctggcggtggtgttcggcgccgggggcgagcgcgacccgggcaagcgggcgccgatgggcgcgaccgccgccgagctcgccgatctggtggtcgtcaccgacgacaatccgcgcggtgaggaccccgcggcgatccgccgcgaaatcctggccggtgtcaccgaaagtggttgcgccgcagaggttgtcgagatcggcgaccggcgtgcggcgatccgccacgccgttgcctgggcgggaccgggcgacgtggtgctggtcgcgggcaagggtcatgagaccgggcagcgcaccggcgagcacacccgcccgttcgacgaccgggtggagctggccgaggcgctgcgcgaggccgtcgggcctcgaaaggcgcagggatgatcgagctgaccgtcgcccagatcgccgacatcgtcggcggcaccctggccgacatcaccgcaccggacgccgcgcgccggcgcgtcaccggcaccgtcgaattcgactcgcgcgccgtcgggcccggcgggttgttcctggcgctgcccggggcgcgcaccgacgggcatgaccacgcggaggccgcggtggccgccggtgcggtcgccgtgctggccgcccggcccgtcggcgtccccgccatcgtcgcgccgccggtggacgccgcggacgcgctggccggggtgctcgagcacgacgccgacgggtccggtgccgcggtgctggcggcgctggccaagctggcgcgggcggtggccgccgagctggtcgccggcgggctgaccatcgtcgggatcaccggatcgtcgggcaagacgtcgaccaaggacctggtcgcggcggtgctggcgccgctgggtgaggtggtggctccgcccgggtcgttcaacaacgagctggggcatccctggacggtgctgcgcgccacggccgacaccgactacctggttctcgagatgtcggcacgccaccccggcaacatcgccgcgctcgccgaaatcgccccgccggccgtgggggtggtgctcaacgtcggcaccgcacacctgggcgagttcggctcgcgggaagccatcgcacgcaccaaatccgaactgccgcaagcggttccagcgtccggcgtggtggtcctcaacgtcgacgaccccaccgtggcggccatggccgaggtgaccgcggcccgggtggtcagggtcggccgcgccgagcacaccgaggccggccccagtgacgtatgggccgggccggtgtcgctggacgagttggcccggccggggttcacgctgtatcaccgccacgccggtgggacacgacaggcgcgggtgcaactcggcgtctccggcgaccaccaggtcggcaacgcgctgtgcgcggccgcggttgcgctggagtgcggcgcgacggtcgagcaggtggtggccgcgctcgccggggcgggcccggtgtcgcggcaccggatgcaggtcagcacccgcggcgacggcgtcacggtgatcgacgacgcctacaacgccaatcccgattcgatgcgggccgggctgcaggccctggcctggatcgcccgcggcggggcggaaccgggcgccccggcccggcgcagctgggcggtgctgggcgagatggccgaactcggcgacgacgcgatcgccgaacatgatcgcatcggccggctggcggtgcgcttagatgtgtctcgactcgttgtcgtgggaactgggaggtcggtgagcgccatgcaccacggtgcggtcatggagggttcctggggttcggccgacaagggagccgtcaacgtgcccgacgccgaggcggcgcttgagctcttgcgggccgagctgcagcccggtgacgtggtgctggtcaaggcatccaacgcggccgggctgggcgcactcgccgacgcgctggcccgtgacgatcgcgagggcgactcagccggcgggacccgccgatgagacagatcctcatcgccgtcgccgtcgcgctgaccgtgtcgatcctgttgaccccggcgctgatccggttgttcacccggcaaggtttcggtcaccacacccgcgaggacggcccgcccacccaccacgccaagcggggcacgccgtcgatgggcggggtggcgatcatcgcgggcatctgggccggctatctgggaacgcacctggccgggctggccttcgacggcgagggcatctccgcgtcggggctgctggtgctgggcctggccaccgtgctcggcatcgtcggattcctcgacgacctgatcaagatccgcaggtcgcgcaacttgggcctgaacaagaccgccaagaccatcgggcaggtcgcggccgcggtgctgttcggtgtgctggcgttgggattccgcaacgccaacggcctgacgccggccagcgccgacctgtcctacgtgcgcgagatcgccaccgtcacgctggcgcccgggctgttcgtgttgttctgcgtggtggtcgtcagcgcctggtccaacgcggtcaacttcaccgacggcctggacggactggccgccggcagcatggcgatggtcaccgcggcctacgtgctgatcacgttctggcagtaccgcaacgcgtgcgtcaccgcgcccgggctgggctgctacaacgtgcgggacccgctggatttggcgatcgtcgccgccgccaccgcgggcgcctgcatcggctttctgtggtggaatgccgcgcccgccaagattttcatgggcgacaccggatcgctggccctgggcggcatcatcgccggcatctcggtcaccagccgcaccgagatcctcgccgtcgtgctgggctcgctgttcgtcgccgaggtgagctcggttgtgttgcagatcttgacctttcgcaccaccgggcgccgggtcttccgaatggcgccgtttcaccaccatttcgagctggcgggctgggccgagaccaccgtcatcatccggttctggttgctcaccgcgatcgcctgcggcctgggcgtggccctgttctacggtgagtggctggccgcgatcggtgcctgatgagtgctgctgagccggccctggccccgctgtcgccgggggcgccggtgctggtggccggcggcgggatcaccggcagggcggtgctggcggcgctgaggagattcggcgcggcgccgaccctgtgcgacgacgaccccgccaccttgcgcggatacgtggactccggcgtcgacaccgtctccacatcggcggccgccgaacggatttcgcgctatgccctggtggtcaccagccccgggttcgcgccgaccgcaccgctaccgctggccgccgccgcggcgggggtgcccgtgtggggggacgtggagctggcctggcgcctcgacgtcgccggccactacgggccgccgcgccgctggctggtggtcacggggacgaacggcaagaccaccaccacgtcgatgctgcacgccatgctgaccgcggcgggccggcgaagtctgttgtgcggcaacatcggtagcccggtgctcgacgtgctcgaccaacccgccgagctgctggccgtcgagctgtccagcttccaactgcattgggcgccctcgctgcggccggaggggggagcggtgctcaacatcgccgaagaccacctcgactggcacggcacgctggccgactacgccgcggccaaggcccgggtgctcgacggccgggtggccgtcgtcgggctggacgacagccgggccgcggcgctgctgagcaccgcccgggcgccggtgcgggtcggtttccggctgggcgagccggccgccggggagctcggtgtgcgcggcggccagctcgtcgaccgcgccttcgccgacgacctgaccctgctgccggtcgactcgatcccggtgcccggaccggtcggagtgctcgacgccctggccgccgccgcgctggcgcgctgcgtggacgtgcctgcatcgcccatcgccgaggcgatcgtctccttccgggtgggccggcaccgggccgaggtggtggccgtcgccgacgggatcacctacgtcgacgactccaaggccaccaatccccacgccgccgaggcctccgtgctggcctatccccgcgtggtgtggatcgccggggggctgctgaagggcgcgtcggtcgacgccgaggtggccaggatggcgtcctggctggtcggcgcggtgctcatcggccgagatcggcgagaggttgcagaggcgttatcgcgacacgcgccggatgtccccgtcgtccacgttgtgacaggcgaggatgctggtatggatgcgacgcctgtggtgtttggtgccaatgtgacaaaagtgaaacatttgggcggggatctcggcgctgcggtcatgagcgcggcggtggccgccgcccgtgacctggccaagcccggtgacaccgtcctgctggcaccggcgggagcgtcgttcgaccaattcgccgggtacgccgaccggggcgaagcgttcgcggccgcggtgcgcgcggctatccggtagggcggggcgtgggtaacgcactgacccggctgctgggccggggtaaggacaccaccaagaccgccgagccggccgacgacgacggcgcggcggccgaaaccggcgcggtcccggactgcgcgccggaggccgccgacgagcaggaccagcaggccaccgacgagcccacgaagacgtcccagaaggcgtcccagaaggcctccaaaaaggagtccaagaaggcgccgaaggacaagccgacggacgggagctcgcacagccggttcggggcctggctcagccggccgatgacgtcgtttcacctgatcatcgccatcgcggggctgctgaccacgctgggtctgatcatggtgctctcggcgtccggggtgcgctcctacgacgccgacgggtcggcctgggtgatcttcggcaagcaggtgctgtggacggtgatcgggctgatcgcctgctacgcctcgctgcggatgtcggtgcggttcatccggcgcgtcgcgttcaccggctacgtcgtcaccgtcatcctgctggtgctggtgctggtgcccgggatcggcaacctggccaacggatcgcgtaagtggttcgtcgtcgccgggttttccatgcagccctccgagctggccaagatcgccttcgccatctggggcgcgcacatgctggcggcccgccgcctggaccgggccagcctgcgtgagctgttgatcccgctggtgccggccgcggtgatcgcgctggcgctgatcgtggcgcagcccgacctcgggcagacggtttcgctgggcatcatcctgctggccctgctgtggtacgccggcctgccgctgcgggtgttcatcacctcgctgctggcggtgttcatggccggcgcggtgctggcgatgtcggccggataccgctccgaccgggtgcggtcctggatgaacccggagaacgacccgcaggacaccggctatcaggcccggcaggcgaaattcgcgctggcccacggcgggatcttcggcgacgggctcgggcagggcgtggcgaaatggaattacctgcccaacgcgcacaacgacttcatcttcgcgatcatcggcgaggagctcggcttcatcggcgccttcgggctgctggtgctgttcggcctgttcgcctacaccgggatgcggatcgcccgccgctcggccgacccgttcctgcggctgttgacggccaccaccacgatgtgggtgctgggccaggcgttcatcaacatcggttacgtgatcggcatcctgccggtcaccggcattcagctgccactcatctccgcgggtggaacatccacggcggcaacgcttttcatgatcgggatcatggccaatgcggcccgtcacgagcccgaggcggtggccgcgctgcgcgccggccgcgacgacaaggtgaaccggctgctgcgactgccgctgcccgagccgtattcgccgacgcggctggaggcgttccgcgatcgcaagcggaccggcccccagccggccccgaaatcggccccgaaatcgcgcccggcgccgcgcaagggcgccaagccggccgggcgcaagcccacccgcaacgccggccgcaacgccacccgcaatgccggcttccatgccgacgcgccgctgccgcccccgctgccccgcacggccggccgggcgggccgccaatctgggggtaacacgcgcgcccgggcaaggcatcatggatctggccagcgctatgccagtctgggagccaactccggagcaaaccaggcagccagttcgcgcgccggccagcgtcagccacggcgcgcacgggcattggaaggtcagcgttacgggtgaacgacacggtcaagaagccgaccggcgggcggggggacgatcctctgcccgccggtgccgcgttgtcggccgttgcacctcatgagccggtgtcggtggtgctggccggcggcggcaccgccggccacgtcgagccggcgatggccgtcgccgacgcgctgaaggccctcgacccccacgtccggatcaccgcgctgggcaccgcgcgcgggctggagacccggctggtgcccgagcgcggctatgacctcgagctcatcacgccggtgccgctgccgcgcaagcccaccggcgacctggcccgactgccgtcgcgggtgtggcgggcggtgcgcgaaacccgggccgtgctccacgccgtggacgccgacgtggtgatcggattcggcggctacgtggccctgccggcctacctggccgcccgcggcgtctcaccgcgcaagccccgggtgccggtggtgatccacgaggccaacgccagcgccgggctggccaaccgggtgggcgcccgcaccgcgcagcgggtgctgtccgcggtgcccgattgcggcctgcccggcgccgaggtggtcggcgtcccggtgcgcgaggccatcacctcgctggaccgcgcggcgctgcgcgccgaggcgcgtcggcacttcggattcgccgacgacgcccgggtgttgctggtgttcggcggctcgcagggcgcggcctcgctgaaccgggcggtgtccggcgccgccgcgcagctggccgccgccggcgtgtccgtgctgcacgcgcacggccccaaaaacacgctcgacctgcgcgaaccacagcccggcgacccgccctacgtggcggtgccctacctggaccgaatggacctggcctacgcggccgccgacctggtgatctgccggtccggagcgatgacggtcgccgaggtgtcggcggtggggttgccggccatctacgtgccgctgccgatcggcaacggcgaacagcggctcaacgcgctgccggtggtcgacgccggcggcggcatggtggtcgccgacgccgacctgacgccggagttggtcgcccgggaggtggccggcctggtgggcgacccgccgcggctggcggcgatgacgacggccgccgcgcgggtcgggcatcccgacgccgcgcgccgggtcgcccaggcggcgctggacatcggcagaacggcgcggctcgcccgcggcgcgaccgggggcaggccgtgaccaccgaccagctgcccgccgagctggaacgggtgcacatggtcggcatcgggggagccggcatgtcgggcatcgcccgcatcctgctcgaccgcggcggcctggtgtccggctcggacgccaaggagtcgcgcggcatccacgcgctgcgcgcccgcggcgcccagatccgcatcgggcacgacgcgtcgtcgctggatctgctgcccggcggccccaccgcggtgatcaccacccacgccgccatcccgaaaaccaaccccgaactcgtcgaggcgcggcggcgcggcattccggtgatcctgcgtccggccgtgctggccaagctgatggacggccgcaccaccctgatggtgactggcacgcacggcaagacgacgacgacctcgatgctgatcgtcgcgctgcagcactgcgggcgcgacccgtccttcgcggtcggcggcgagatgggggaggccgggaccaacgcccaccacggcagcggcgactgcttcgtcgccgaggccgacgaaagcgacggctcgctgctggagtacacgcccgacgtcgcggtggtcaccaacatcgagaccgatcacctggacttctacggcagcgccgacgcctacgtcgcggtgttcgacgcattcgtggagcggctggcccccggcggcgcgctggtggtgtgcgtcgacgacccgggcgcggccgcgctggcccggcgcaccgccgaactcggaattcgggtgctgcgctacggatccgggtcgcacggccaagccccgtccggccaaccgctggccgccaccctggtgtcctggcagcagcagggcaccgaggcggtcgcccagatccggctggccggcgagcagcaacatccgctggtgatgcggctctcggtgcccgggcggcacatggcgctcaacgcgatgggcgcgctgctcgcggcgatcgagatcggcgcgccgaccgaggcggtgctggacgggctggccggcttcgagggggtgcgccgccgcttcgaactggtcggcaccgccggtgggccggcccccagctcgacggtgcgggtgttcgacgactacgcccatcaccccaccgagatcgccgccacgctggcggcggtgcgcaccctgctcgagcagagcggcggcggtcgcagcatcgcggtgttccagccccatttatattcgcgcacaaaggctttcgccgaggagttcggtcgcgccctggacgccgcggacgaggttttcgtgctggacgtctacggcgcgcgcgaacagccgctggccggtgtcagcggagccagcgtcgccgagcacgtcagcgtgccggtgcgctacctgccggacttctccgcggccgccgagcaggtcgccgcggccgccgcgcccggcgatgtcatcgtcaccatgggggccggcgacgtcacgctgctgggccccgagatcgtcaccgcgctgcgggtgcgggccaaccgcggtgcgccgggggcgttgcgatgacgcagccggaccccgaaccgaccgggtcgggcccggccgacgtggtgggcgaggccgtcaccgaaccgctgttcgtcggcaccggcccgcagcagcgcgccgatggcggggcggagcaggccgaggtggaggggccgcgccggcgggcccgccgcgaacgagccgaacgccgcgccgcgcaggcccgggccatggccatcgaggaggcgcgccgcgaggccaagcgcagggccgccgggcggccggtcaaccagcccaaacccgttgcgcgcggcgtggttcggggcctgaagatgttgatggtgaccatcctgctggtggtcgtcgggatcggtctggccctggtcctctacttcacgccggcgatgtcggcgcgcaacatcgtcgtcgtcggcaccggcgtggtgacccgggaggaagtgctggacgcggcgcgggtgcggctgggcacgccgctgctgcagatcgacaccggccaggtcgccgaccgggtggcggcgatccggcgggtggccagcgcacgagtgcagcgccagtacccgtccgcgctgcggatcaccatcgtcgagcgaatcccggtggcggtcaaagactttcccgacgggccgcacctgttcgaccgcgacggcgtggacttcgcgaccgggccgccgccgccggcgctgccctacctcgacgtcgccgacccggggcccaacgacccggcgaccaaggccgccctgcaggtgctgaccgcgctgcggcccgaggtcgagggtcaggtgggccggatcgctgcgccctcggtggcgtcgatcaccctgaccctgggcgacggccgggtggtgatctgggggaccaccgaccgcaccgacgagaaggccgagaagctggcggcgctgctgacccagccgggcaagacctacgacgtgtccagccccgacctgccgacggtcaagtagcgatgttcgtcacgcccacgccgccgggatccgccatacccagcgctcaccgccgccgcggtgggaaaaatgcccaaaatttgcgggacgcgcgtcggcgcgcctgccgggttagcgcgcgccgtgcccataccgttctggttgcgcggaactacttgacataactctaactctatggttgaggttgagggtttgccgggagggccgccgacgtccggaggagcccaccgccgggagagcagccaagcccatcagggaggaagacgaatgatgacccccccgcacaactacctggccgtcatcaaggtcgtgggtatcggtggcggcggcgtcaacgccgtcaaccggatgatcgaacagggactcaagggcgtggagttcatcgcgatcaacaccgacgcgcaagcgctgttgatgagcgatgccgacgtcaaactcgacgtcgggcgcgactccacccgtggactgggcgccggcgcggaccccgaggtcggccgcaaggccgccgaggacgccaaggacgagatcgaggagctgctgcgcggcgccgacatggtgttcgtcaccgccggcgagggcggcggcaccgggaccggcggggcgcccgtcgtcgccagcatcgcgcgcaagctcggcgctttgaccgtgggcgtggtcacccggccgttctcgttcgagggcaagcggcgcagcaaccaggccgaggcgggcatcaacgcgttgcgggagagctgcgacaccctgatcgtcatccccaacgaccggctgctgcagatgggcgacgcggccgtgtcactgatggacgccttccgcagcgccgacgaggtgctgctcaacggtgtgcagggcatcaccgacctgatcaccacgccggggctgatcaacgtcgacttcgccgacgtcaagggcatcatgtccggcgcgggcaccgcgctgatgggcatcggctcggcccgcggcgagggccgctcgctcaaggccgccgagatcgccatcaactcgccgctgctggaggcctcgatggagggtgcgcagggcgtgctgatgtccatcgccggcggcagcgacctggggctgttcgagatcaacgaggcggcctcgctggtgcaggacgccgcccaccaggacgccaacatcatcttcggcaccgtgatcgacgattcgctgggcgacgaggtgcgggtcaccgtcatcgcggccggcttcgacgccgccgggccggggcgcaagccggtgatcggcggcagcgccgacaagggggagaagaccggcggtgcgcaccggatcgagtcggccaaggcgggcaagctcacctcgacgttgttcgagccggtcgacgcggtcagcgtgccgatccacaccaacggctcgacgctgaatatcggcggcgaggacgacgacgtggatgtgccgcctttcatgcgccgctgaggccatggactcgacccgcctggcggacaagcgctttgcggatactggtcacgtgagcgttcgcatccgccgggtgacgaccacccgcgccggtggtgtctccaagcccccgttcgacagtttcaacctgggcgaccacgtcggcgacgacccggcggcggtggccgccaaccgggcccggctggcggccgccctcgggctcaagcccgaacgcgtggtgtggatgaatcaggtgcacggcgaccgggtcgaggtggtccacgggccccgcgacggcgcggtggacgcgaccgacgcgctggtcaccggcaccgcgcggctggcgctggccgtggtgaccgccgactgcgttccggtgctgctggccgacgcccgcgccggggtggccgcggccgtgcacgccggtcgggtcggggcccagcgcggcgtggtggtgcgcacggtggaggcgatgcgggcgctgggcgcgcaacccgccgacatgtcggccctgctcggcccggcggttagcggcgccaactacgaagtgccggcggcaatggccgacgaggtcgaggcggcgctgccgggcagccgcaccaccaccgcggccggaacgcccggactggatctgcggaccggaatcgcttgccagctaagggaattgggtgtcaccgcaatcgacatcgatccgcggtgcacggtggccgacccggcattgttcagtcatcgccgcgacgcgccgaccggacggttggcctccctgatctggatggagtgacggcgatgacggcaggaacaccggccccggacagcgccggcgaccgcgaaacggaattgacgcacgccctggcggcggtgcgctcgcggctggcggcggccgccgaggcggcgggccgcaacgtcgcggaaatcgaagtgctgccggtcaccaaattcttcccggcgaccgatgtcgtgacgttgtcccgattgggttgtcgcgccgtcggcgaatcgcgcgaccaggaagcgacggcgaaggtggccgaagtcacgcgcctgttggcgacgtccgcgcggacgaacgtggcgattccgcgctggcacatggtgggccacatccagcggaacaaggcccggtcggtggcccgctgggcgcacaccgcgcactcggtcgacagcacccacctggtgtccgcgctcgaccggggagtggcggcggccctggccgacggcggccgcaccgacccgatgcgggtgtacgtccaggtcagcctcgacggcgacgagtcgcgcggcggcgtggacatctctcggcccggggccgtcgacgaggtgtgcgcgcaggtcgcggcggcgaacaacctggacctggtcgggttgatggccatcccgccgctgaactccgatcccgacgaggcgtttgaccggctgcaatccgagcatcggcgggtgctcgagacgcatcgcaacgcggtggggctgtccgccggcatgtccgacgacttcgaaattgccgtcaaacacggttcgacatgtgtgcgtgtcggtaccgcgctattgggccgtcgcccgttaccgtcaccgtaagtagtcactgcagtaacagcttcatcactaacaccagcaatctcaggggctagaagggtcaacgcaatgagcacactgcacaaagtcaaggcgtatttcgggatggccccaatggacgactacgaagacgagtactacgacgaccgggcgccgtcccgcggtttcccgcggccgcgattcgacgacgggtacggccgctacgacggtgacgactacgacgacccgcgccgcgagccggccgactgcccaccgcccgccggctaccgcggcggctacgccgaggagtcgcgctacggcgccgtccacccgcgcgagttcgagcgccccgagatgggccggccgcggttcggctcctggctgcgcaactccacccgcggcgcgctggcgatggacccgcgccggatggcgatgatgttcgaagagggccacccgctgtcgaagatcaccacgctgcggcccaaggactacagcgaggcccgcaccatcggcgagcggttccgcgacggcaccccggtcatcatggacctggtctcgatggacaacgccgacgccaagcggctcgtcgacttcgcggccgggctggcgttcgcgctgcgcggctccttcgacaaggtcgccaccaaggtgttcctgctctcacccgccgacgtcgacgtgtcgccggaggagcgccgccggatcgccgaaaccggtttctacgcatatcaataacctcgaccgcccggcgccgccgccgccggcggcgcgatgccccgtcggaccaggtgagatggggcatcgcgcccggagtcggtaggctggcaggcgccgcgcaggtccgcggcgcttggctctcatccgccaggtcatcggtaaggtcggggcacttcagttggtgttgttctttcagatcctcgggtttgcgctgttcatcttctggctgctgctcatcgcccggttcgtcgtcgaattcatccgctcgttcagccgggactggcatcccaccgggatcaccgtggtggtgctggagatcatcatgtcgatcaccgatccgccggtgaagctgctgcgccggctgatcccgcaactgaccatcggagcggttcgcttcgacctgtcgatcatggtgctgctgctggtcgcgttcatcgggatgcagttggcgttcggcgcggcggcctgatccggtcctgatccgatcctggtccggcttgtcccgcgcggcgccgttcagcgggggtgacgtggggccggattccggcccggagacggttcggccacgttttagcgtcggtttggttccgccgatttaaaaattctaaggtttcggattttattggcctcactgtttgaaattggttcttatttattgggctaatcggcgaccgtcgcgcctggtgtgacaggatggacggcagttgcacgacggctaccactgcgttctacactttccagaacgttcgacaggaacttgaggggacgaaacaatgccgcttacaccagccgacgtccacaatgtggcgttcagtaagccaccgatcggcaagcggggctacaacgaagacgaggtggatgccttcctcgatctggtggaagccgagctgacgcgactcatcgaagagaacagcgacctgcggcaacggatcgaagagctggaccaggagctcgccgccggtggcggtgccgccgcgccggccgccgccgcgcccactcaggccattcctgtcgccgagcccgagccggtcaaggccgcgccggccgccgccgtcagcaacgaggagcaggccatcaaggccgcccgggtgctgagcctggcccaggacaccgccgaccggctgaccagcacggcgcaggccgagtcggagaagatgctggccgatgcgcgggccaacgccgaccagatcctcagcgaggcccgcagcaccgccgagaccacggtcgccgaggcccggcagcgcgccgacgcgatgctggccgacgcgcaggcccgctcggaggcccagttgcgtcaggcccaggagaaggccgacgccctgcaggccgacgccgaacgcaagcattccgagatcatgggcaccatcaaccagcagcgcacggtgctggaaggccgcctcgagcagctgcgcaccttcgaacgcgaataccgcacccggctcaagacctacctggagtcccagctggaggagctcggccagcgcggctcggccgcgccggtggattccagcgcggatgcgggcgggttcgatcagttcaaccggggcaacaactagccgctgactgggctctgagtcgtgccggtcacgcgccgagcttcggggttggcacactaggtctgaaacaaggtctgcaagaccgcggtcccgctcgtcgcctggaggatgactgatgctcatcattgcgctggtattggccctgatcgggcttgtcgcgttggtgttcgcggtcgtcaccagcaacgagctggtcgcctgggtgtgcattgccgccagcgtggtgggcgtggtgctgttgatcctcgacgcgctgcgggagcgccagcagcgcgacctgggcggtgacgaggctcacgaggacgctgacgaggacgcggacgaggcgggcgccgacgaggacgacttcgtcgactatcccgaggacgcgcccacccaaagcagcgcagacgccgacgccaccgaaagcaccgaagccaccgagccgtccgatcagtcagggcaggccgggccgtccgaggaatccgccgtcccagccgacggccgcggcgacgaggccacgcactgacgttccgcgcgctcagccggtcggtgtggccagcagctcacgcacctcgtcgtcgctgacctggtgaaagtcgccgtacacctgcccgacggcctcgaatcccggcggcgtgctcaggcacaccacctcgtcggcctcgcggcccagctcgcggcaggccgactccggtcccaccggcacggccacgactatcgatttgggcgtcgcgccggtcgggccggacctcaacgcgcgcaccgcggccagcatgctggcgccggtggcgatcccgtcgtcgaccaggatcacgaccttgtcccgcaggtcggccatcgggcgatcgccccggtaggcgtgctcgcgccgcgccagttcggccgtctcgctgtcgatcaccgcgcgcacctgctcgtcggtgatgcgcaggctgctcaccacgtcgtcgttcatcaccacgccgccgccgctggccagggcgcccatcgccagctccgaccagttcggcaccccgagcttgcgcaccaaaaacacgtccagcggggcgtgcagcgccgcggcgatctcccaggccaccggcaggccgccgcgggccagcccgaacaccagcacgtcgccgcggttgcggtagcccatcagctccccggccagggcgcgcccggcctcacggcggtcgcgaaaactgcgcatcgccgttcgccggagaaagccgttcggtcggttcatcggtggtgtcccaaaggtgtcttccaagcctactggcagctacgcccgcgcatcggcgagccggcctcgctgccgtcgttccaggggatggcgccgacggccggcaacacgtcgacccggcgaccggacaggtcgtggcgcacccgcacggtccggtcgtcgagtcggatgtcgcattcgccggggccgtcgcgaagggtgttgtgcagcttggtgtttcgcagcatcacccacttgtcgagcttgttgtcggccatggggataacgctctcggatgtcgcctgctcggccggttacccgatcggccggccctcacacgcgcagggtgcatcggcagcgagaaagctctggaacaagacgaaaaatatgtgtgatcgcggcgtcgccgctgaacgcactccatcggctcgctcgcctcagtggtgtgtccgaggggggacttgaacccccacgcccattagtagggcactagcacctcaagctagcgcgtctgccattccgccactcggacaagaccaaccggcatgggttggcagctaaggctatcggattgcccgccgctaacccaatccagctgctcgggcccgggcccgggagccctccggcaatggtaggaaaggaggttgtgaccatccagagcggggcgagcgaggtgacggccaacccgagcgacgacgtcgtcgaggtggtcagcaccctgatccggtttgacaccaccaacaccggcgaaccggagaccaccaagggcgaggccgagtgcgcgcagtgggtcgccgagcagctggccgcggtgggctatgcgccgcattacgtcgagtccggcgcgccgggccgcggcaatgtgttcgtccgcctgccgggtgccgacagttcgcgcggcgcgctgctgatccacgggcatctcgacgtggtgccggccgagccgaccgagtggagcgtgcacccgttctccggtgcggtcaaggacggtttcgtctggggccgcggcgcggtcgacatgaaggacatggtcggcatgatgatcgtggtggcccggcacctgaagcgggccggcatcgtgccgccgcgcgacctggtgttcgcgttcatcgccgacgaggagcacggcgggacgttcggcgcgcagtggctggtcgacaaccggccggagctgttcgccggggtcaccgaggcgatcggcgaggtgggcggcttctcgctgaccgtgccgcgccgcgacggcggcgagcgtcggctctatttgatcgagacggccgaaaaggggctgtcgtggatgaagctcaccgcccgcggcccggccgggcacgggtcgatggtgcacgaccaaaacgccgtcaccgccgtcgccgaggccgtcgcccggctgggccgccatcagtttccgctggtgctgaccgacaccgtcaaccagttcctggccgcggtcagcgaggagaccggactgacgttcgacacccaatcgggcgacctgcgcggcgtggtcgaaaagctgggcccgatggcgcgcatgctcaaggccgtgctgcacgacaccgccaaccccaccatgctcaaggccgggtacaaggccaacgtcgtccccgcgatcgccgaggcggtggtggactgccggatcctgccgggccgcaaggcggcgttcgaggccgagatcgacgagctgatcgggccggacgtgacgcgggaatggatcaaggacttctcgtcctatgagaccggcttcgacggcgacctggtcgacgccatgaacgacgccgtgctggcgctggaccccgacgcccgaaccgtgccgtatatgctgtccggcggtacggacgcgaaatcctttgcgcgcttgggtattcgctgtttcggtttcagtccgctgcggttgccgcccgacctggatttcaccgcattgttccatggtgtcgatgagcgggtacccatcgatgcgctgcggttcggcaccgacgtgctgacccacttcctgacccactgctagttgaccgacgcaagccgatcacacgagaggaccgctatgagcacagctcctgacccgtacgcatcgctgcccaagctgccgaccttcacgctgacctcgcaatcgctgaccgacggtggaaccctggccaagccccaggtcagcgggatcatgggcgccggcggggaagacgtcagcccgcagctgagctggtcgggtttcccggccgagacccgcagcttcgccgtcaccgtctacgaccccgacgccccgacggcctccgggttctggcactgggcggtggccaacctgccggccgacgtcaccgagctgcccgccggtgccggcgacggcagcaatctgcccggcgacgcgctcaccctggtcaacgacgccgggcagcgccgctacatcggggcggcgccgccgcccggacacggcccgcaccgctactacatcgccgtgcacgccgtggacaccgaaaagctggacctgcccgaggacgccagcccggccttcctcgggttcaacctgttccagcacgccatcgcgcgcgccgtcatccacggcacctacgagcagaagtaggtcagcaccccggccgctgccgccgttccgggcgccccggccgctccgggcgcgaaatcacttgcgccacattcgtcccggtgttcccagcgcggcggtttttgtcgtaggcccgccgtagtgtttcgaacatgcattcgagcactcgggaggagatccgggcggacgtcgacgcgctgcgcgccgcggtctcccgcgtgctcgggcattcgtatgacgcgctgaccacgccggagcggctgcggttgctggagatcttcgaacgcgagacgcgccggctgcgcgcgcccgggcaccagctgatcaaccagcttgccgagcagtcggatcccaccgaactcggcggcaggctgtcgttcgcgttggccgagcggctgcacatcactcgcagcgacgcgagtcgccggatcgccgaggcggccgacctgggcccgcgccgggcgctgaccggcgagccgttgccggcgctgctgcccgccacggcggcggcccagcgctacggggcgatcggcaccgaccacgtggcggtgatccggcagttcttcgaccagctgccggaggcggtggacgtcgagacctgcgagcacgccgaacggcaactggcggcccaggcaacacagttccggccggatcaactgtccaagctggcccgccggctgatggactgcctcaaccccgacggccgctacagcgacgaagaccgggcgcgggcgcgcgggctggtcctcggcaaccagcaggccgacggcatgtcccggctgagcggatggctgaccccggaggcgcgcgcgagctgggaagcggtgctggccaagctggccgccctggggatgtgcaaccccgacgacgacgcgccggtggtggacggaccgccgccggaagcggcggcgcagcgcgacagccgcagcgcggcccagcgcaaccacgacggcctcaacgcggcccttcgtgcgctgctggccggcggaaagctggggcagcacaacgggttaccggcatcgatcatcgtcaccaccaccctgcgggacctcgagtccgcggccggtaaggggctgacgggcggcggcaccctgctgccgatgtccgatgtgatccgcctggcccgccacgcccaccattacctcgccgtcttcgacaacggcaagccgctggcgctgtaccacacgaaacgcctggcctcgccggggcagcgaattgtcttgtacgccaaggaccgtggctgttcgcacccgggctgcgacgtttcgggctattcctgcgaagtccatcatgtcaccggttacgccaaatgcggccgcaccgacatcgaccaactgaccttcgcctgcggcggccatcacccgctggccgagcagggctggatcacccgcaagaacggccggggcgagaccgaatggatcccaccaccgcatctggagcgtggtcagccacgggtgaactcgtttcaccaccccgaggacatgctgtgcgacaccgaagaccagcaagatcaggctgaccaacaagacggagccgacgaggaggacggcgccgcgtgagtcaacccgattcgcgcgccgacgacccgacggcatcgcgcagcgaggcgaacccgccatcgcgcagccgctgcgcgatgccgtcgtgaatctgcttggcccacaagcctcctccgtacacgaagcccgtgtagccctgcagcagggaggcgcccgcggtgatccgctcccaggcgtggtcggcggtctcgatgccgccgacactgatcagcaccaggcgatcgccgacccggccgtagagccggcgcaacacctcgaccgcgcggcgggccaccggcggcccggagatgccgccggcacccagctggtcgacccccgcggtgcgcaggccgtcccgcgacaccgtggtgttggtggcgacgatgccggccaggccgagttcgacggccaggtccgcgatgtcgtcgacgtcggagtcggacagatccggcgcgatcttcaccagcaccggggtggacgtctcggcgagaacggccgacaggatcggccgcagcgaccccaccgcctgcagatcgcgcagcccgggcgtgttcggcgagctgacgttgaccaccagatacgacgccagcgggccgagcagccgcgcgctggcccggtagtcatcgaccgcctgatccggcggcgtcgctttggtcttgccgatgttgaccccgatcgggatgtcgggctgtcggcgggcgagccgcaccgccagcgcgccggcgccgagattgttgaagcccatccggttcagcagcgcccggtcggcgggcagccggaacagccgcggcgccggattgccgggctgcgggccggcggtgacggtgccgatctcggcatatccgaaacccagcgcgccccaggcgtgcagccccagcccgtccttgtcgaagccggccgccagccccagcggccccgggaagcgcaccccgaacaccgtgctggccagcacgggatccgtcggagccagcagtcggcgcagcagtcgccggggccagccgacggccgtgacgccgcgcagcagggcgaacaccagcgtgtgaatccgctcggcgggtaccaggaaaaacagttgccgcgccacgccataccagcgatggccgccgccgcgtggtgccgggggcgccccgctcacagttgcggctggtcgggccgccgcccctcgaagccgccagcatcgacgcgagatttcttgcggcgcaacaacactcgcctgctgccgtcggtgtacagccgcaccctggtcaactcccagccgcggtattcggcctcgatggacaaccgggtggacgcgctgacccgggtcacctccggcggcagacgcagcggcacccactcgtattcatcggacagctcgctgtcccagcccgcgggcaaacgggcgcgccgcgccgccgtcaacgtttacccgccgcgtggtcgatcacctgaactcccgcgccggacccggacaccacgtacagggtgtccgacgcttcgtcgaaggccagggagttcggttgctgcacggtcgggtaacgcaccttttcgacgggaattccggtggacagatcgtaaccaatgacgatattggaaacggtctgcgaaacccaggctaacgcgcgggaaccggccaggccgtagggcgcctgagaaaccgggtaggcctgacgcaggatcagcggatccacgccgtacaccagcaactggccgccgcgggtgtcgaccaccagcacccgccccgccgcgtcggcggccatggtggtggcgccccggccggcccgcagcgcctgctgggcccggccgtcggcgccgatcgtggtcaccgaggtctgcccgcggtccagcaccaccgtcgtattgccttgggtgacaagcgaatcgacccgcgcgaagatcttgttccggttggcgacggccgcggtagacccagtggtagacccagtggtaggcccagcggtaggcacggccggcgtcggggaggccagcgtgtagacggcgccgtcggcgctgcccaacaccaggaccccgtcggcgcgttgggccaccgcggtgaactcggtctgcgccgcatcggcgacgcccacccgcacgacgcggccggtggccagatccagcacgaagtagccgccgcgtgtggccaggtagaccgtgccgcggccgtcgccggtcaacgcggtcgccgggccgggcagggcggcgacccgcggcgggacctgcgggtcgccgaacagggtgacgctggccggatcggaagccgcggccagcaccgccagctggtgggtgccggcgtcgaacaccgccgccgcggcgtgcgcggccagtggccgcaccgacccggccggctgctgcgctgacggcggcgacacggccgcgcccgcgggttcgatggtcgggggcgcgccgcgcagcggattcgacgaacacccgctcagcaaaagcgcgacaccccaaatgcagccttgaatcgccagcttgtggcgccctcgccggagcagcgcgtgtggtaacagcaatgggtttccctgggtgcgacggcgggacaagacaaattttagggaacggtttcgcatccaaccgggccgtgctgcctgcgtccgggcccgggggcgaggtatggtcggcctatggccgtcaccgctgaccgtcatatggcgcagaaagagtttgctgtcgaagacatgtcgacaggaattttcgctagcggatatggacaagtcggagatggacgcagtttttcgttccatatcgaaaaccgctcacttgtcgtcgaggtttaccggccgcgcctggccgggcccgttccgcaggccgaagacgtggtcgccaccgcagtccgcagcctggtcgacatcgacctcaccgacgaacgcagcttgaccgctgcggtgcgcgactccgtggcgcacgccgagcccgtctcccggtagtcgtttcgggtccgggcgccgcccaccgggtagcgtcggggtcgacatgaccgtcatcctgttacgacacggccgctccacctcgaacaccgcgggcgttctcgccggccgttccgacggcgtcgacctcgacgacaagggccgcgaacaagccgccggcctgatcgaccggatcggtgacctgccgatccgcgcgctgatcagttcgccgctgctgcgctgccgccgcaccctcgagccgctggccgacacgctgtgtctggcgccgctcgtcgacgaccggctcgccgaagtggactacggcgaatggacgggccgcaagatcggcgagttggtgagcgagcccttgtggaaggtggtgcaggcccaccccagcgcggccgtattccccggcggtgagggcctggcgcaggtgcaggcgcgcgcggtggcggcggtccgggaacacgatcggcggctggcggcagagcatggcgccgacgcgctgtgggtggcgtgcacacacggcgacgtcatcaaggcggtgatcgccgacgcgtacggcatccacctggacggcttccagcgggtcaccgccgacccggcgtcgatcagcgtgatccggtacaccgagctgcgcccgtttgtgttgcacgtcaaccacaccggcgcgcggctgtccgcgccgctgcgggccggaccggcgccgccaccagaccagcacgacgaccaacaccacgacaaacaccacgacacaggcgacaaagcgcacacggatcctaagtccaacggcgaatcgcaggcggcgccggcgacctcggtgccgtccagcgacgcggtggtcggtggttcgacggattaattcggctgccacctcgatcggatcgcacagcgatggcggcagccggtattttggaggttgccatggcccgcgcaattcacgtcttccgcacacccgaccgcttcgtggccgggaccgttggccagccgggaaaccgcaccttctacatccaggcggtgcacgactcccgggtggtgtcggtgatcttggagaagcagcaggttgcggtgctcgccgaacggatcggcgcgctgctgctggaggtgaaccgcaggttcggcacgccggtgccgccggagcccgacgaggtcgaggacctgaacccgttgatcacgccggtggacgccgaatttcgggtcggcaccatgggcctgggctgggactccgaggcgcagaccgtggtggtcgagctgctggccgtcaccgacgcggagttcgacgcctcggtggtgctcgacgacaccgaggagggccccgacgcggtgcgggtgttcctgacgccggagtcggcgcggcaattcgccacccgctccaaccgggtgatctcggcaggccgtccgccgtgcccgctgtgcgacgaaccactggacccggagggccatatctgcgcacgcgccaacggctatcggcgcagcgcgctgctcgggtctgacgatgaccccgagatatgacgaccgtgaggtgttgcgcgacggcgagctgacggtcatcggacggatccgctcggccagcaacgccaccttcttgtgcgaggcgacgctcggcgaccgcgccgtgcactgcgtctacaagccggtcgcgggggaggcgccgctgtgggactttcccgacggaacgctggccggccgcgaactgggcgcctacctggtgtcgacgcagctgggctggaacctggtgccctacacggtgattcgggacggcccggccggtcccggcatgctgcagctgtgggtgcggcaacccggcgatgcggtcggtgaggtcagtgaggccggcgagtcgggtgctgaacagcccgatccgggaccggacctggtcgacctgttccccgtcggcgcctcgccgccgggctacctgccggtgctgcgcgcttacgactacgccggcgacgaggtggtgctgatgcacgccgacgaccctcggctgcgccggatggccgtgttcgacgtgctggtcaacaacgccgaccgcaagggcgggcacatcctgtgcggcgtcgacggccgggtctacggcgtcgaccacggggtgtgcctgcacgtggagaacaagctgcggacggtgttgtggggctgggccggcaagccggtcgacgacgacaccctggccgccgtcgcctgcctggccgaggcgctcaccggcccgttcggcgacgaactggccgagcagatcacccgggcggagatcgccgcgctgcgcctgcgcgcgcacgcgctgctggacaatccggtgatgcccggccccaaccggcatcgcccgatcccgtggccggccttctaggcttcccgggctttcgggcttttccggccgggcgtcgccgtcggcgatactgaagcggtgaccccccgcaacccgtcggacgagatgaccgacgccgcgctggccaccgatctcgccgccgaggcgggggaattgctgctgaaggtccgcgacgaggtcggcttcggctatccgtgggcgctcggcgacgcgggcgacagcctggcgaatgcgctgatcctgggacggttgcaggccgagcggccggacgatgccgtgctcagcgaggaggcctacgacgacctgtcccggctgcagcacgaccgggtgtggatcatcgacccgctggacggcacgcgcgagttctccacgccgggccgcgacgactgggccgtgcatgtcgcgctgtggcagcgcccgaccaacggccggcgcgagatcaccgacgccgcggtgttgccggcccgcggcaacatcgtctaccgcagcgacaccgtcaccgccagcgccgcgcgcgtcggcgtcaccgacaccatccgcatcgccgtcagcgccacccggccacccgctgttttgcaccggatgcgccagcggttgcccatccagcccgtcgcgatcggttcggccggcgccaaggcgatggcgatcatcgacggcgtggtcgacgcctatctgcacgccgggggtcagtgggagtgggactcggccgccccggccggggtggtgatggccgccgggatgcacgcatcgcggctggacggttcgccgatgcgctacaaccagctcgacccctacctgccggacttcgtcatgtgccgcgccgagctggcgcccgtgctgctgggcgcgatccgcgacgcatggcgctaggtgatcgagcatccagtcccgccacttgcccagccaccgggcacggccgccgacccccatttgctgccacagcggctgcgcggcccgcagccgggcggccaccgcctcgactgcggcgggccccgccaccggggcgcggcccacgacctgtccggtggcagggcaggtgacgacgatttcttggggagtggccgggccccgcggtgtcggttcggtcggttgtgtcggtcgacatgacaaccaccccgttcggcggcgaccggatttgctcgatacccgacccagcaaaccacaaatcgggcgggggcgatagcgcggccggggcgccgcgcggcgggcgacgcagccccgccgagcggccccgcctaggctgattgtcatgcggtcgtggtcctccccacaggttccccaattaccgggacgcggccccgagcttcggctgtatgacacctccgatcggcaggtgcgccccgtggcggccggcgccgggcccggctcggccgccaccatgtacgtctgcggcatcaccccctatgacgcgacccacctgggccacgccgcaacctatttggcgttcgacctgatctaccggcagtggctcgacctcgggcacgacgtgcactacgtgcagaacgtcaccgacgtcgacgatccgctgttggagcgcgccgcgcgggacggcgtcgactggcgggcactggccgagcgcgaggtgtcgctgttccgcgaagacatggccgcgctgcgcatcttggcgccccgcgactacgtcggggcgaccgaggcgatcgccgacgtggtcgagctggtcgagaagatgctggcgtccggcgcggcttacgtcgtcgacggcgaattccccgacatctactaccgcgccgacgccacgctgcagttcggttacgaatcgggctacgaccgcgagaccatgctgcgactgttcgccgagcgcggcggcgacccgcagcggcccggcaagaccgacgcgctcgacgccctgctgtggcgggcggcgcggcccggcgagcccagctggccgtcgccgttcggcaacggccggccggggtggcacgtcgagtgcgcggcgatcgcgctcagccgcatcggcagcggcctggacatccagggcggcggcagtgacctgatcttcccgcatcacgaattcaccgccgcgcacgccgaatgcgtgcgcggcgagcggcgattcgcccgccactacgtgcacgccgggatgatcggctgggacgggcacaagatgtccaagagccgcggcaacctggtgctggtgtcgcagctgcgcggccgcggggtggagccggcggccatccggctgggcctgctggccgggcactaccgcggggaccgctactggagcgaccaggtgctcgacgaggcgaccgcccggctgcggcgctggcgcaccgcgaccgcgctgcccgccggaccggacgccaccgacgtgatcgcccgagtgcgccaatacctggccgacgacctcaacacgcctaaagcgcttgccgcacttgatggttggaccaccgatgcgctcgactacggcggccacgacaccgcggcgccccggctggtggcaagcgccgtcgatgcgctcctgggagtggccctgtagccgatgcgcctcggtccgtcctgaaagaggctgccgcgcaatatcattcgatgggcgcctggacgcgagcccgaagcgacagcggccggctcgtgccgcgcgtttcgatgacgggtccggtgcatacgcctagggcgccgtttcggcaagtcgccggtgaacagctcggcggttcggggcggttatccacagccgggcggcattggcgatttctgttgtcggtatcgcgcggttgaatgtcgagcgtggagctggaccgggcggtgaggcggcgaggcggcgtgtgtcgacgtcaccgcaaattgtgtcgatgtttgctagaaattgatcttggtacgtcccgtaagcctatgaaacagctgtataactgcaacaataattaacacagacgtcgaaacagggcggctcacaaaatttgctgtgaagtctagcccgggagtatatttctcggcaactgctggaccctagaaggagtaagtccggtgcatacgacgagtgggctcgcggggccgtcaccagacggtctgtcgcgtcgaccgccgcgtcgtgatcgtcggccacaagagcgtcgcgtggccgctaccgctcgggtcgaatgtgggcccgagtcggattttggacgcgctccactgggctcgcgcctggcttcgcggaacgcgaacgcgccagtgctttcccacaccagctaggggtttccgatgcctggggaagtcgggtcgtggcccatcgtgggccgagaggcggagctgcgccggtcactggcggcgctgagcaacgcggagttccacggggtggcgttggtcggcgacgccggtgtgggcaagtcgacgctggcgcgcatgctggccaagaccgtcgagtctgcggggcgcacggtccgatacgcgctgggcacccagacgggctccgccgtgcctctgggcgcgttctcgcatgccgtcagcctcacggcggtgaacgaacccgcggtcatgctggccgcggcgcacaacaccttgagccaggacaagaacttggtggtcgtggtcgacgacgcgcaactgctcgacccgttgtcggccaccttggtcaaccaactcgcggcctggcgcagcgcgcggctgatcgtgacgatccgctccggcgagccggtactggatgcggtgaccgcgctgttgaaagagcgcctgctgctcacggttcacctcgacccgttcacccgcgaacagaccgagctgctggccggcacggtgctgggcgggccggtcgatccccgggtggtcgacgagctgctgcagcgcagctccggaaacccgttgctgctgcgtggctttctgaccgcggcccgcgacaccggggcgctgttccgcaccgcggaaggctggcaactgcggggaccgctgcgcggggatcgcgaactgcacgacgctctggagtaccggctgcagtcgctgagctccgaggagcgcgaggtggtggagattctggccaccgccggcttactcaactgggacatactgcgtgacatctgtgatgccgaggcggtggcggccctggagcgccgcggcttgatccggttggcgaccgacggatctcacgccgtggcacagctgacccacccgatgctcggcgaagcggcgacccgccacgccggcatggtgcgcacccgccaactcaacggcaaactggcgcgagcgctgcaaaaacatgagcggaccgggagccgacacctgcggttgtcccatctgcaaagccggatccgattggcggagttcatgctgcacagcgacatggagcccgacctcgacgtgatcaccgaagccgcgcgggacgcgctggcgatgtcgaacgtgcagctgggcgaggaactcgcgaggttcgcactcgatcgtggtggtggcctccctgccgcgttggtcctcgccgaggcggtgagttggcagggccgtggcgaggaagccggtttcgtgctggcccacgccgaacccgacggcgacgacgactggctgatcgcgcggtggggctgcctgcgcgccgccaacctgttttggggatgcggtgacgtcgaagccgcccggcgcgaagccgacaccgtgaagaagcgtgtttcgtccgaggccggcctgcacctcatcgacgcgctcgagctgtccatggccttcttccgtggcgacgtcgagacgacgaccgagctcgggcccggcctgtgcgaatccgatgcggtcccaatggcgacgacgtgggcggcggtgccgacctgcgccgcgttggccgcggccggccgctattccgaagtcggccgcatcgccgacatcggggtgcgtgccgccgtgtcgtgcgggatgggattgcatcgattcaacatcgggatcagcgagatcatcgcggcgacggacgccggggacgaccgcgcggccgaacggatctacaagcgctacgccgcgatggccgaaggccttcccggcgcagaggccatggtcgacgcgatgcttgggctcgtccggctcgcccgcggcgaattccccgctgcgtgcgccgcgttcacccgttcaatctccttgttcgccaagggctttccgtcgccctggctggtggtcgtgggtgccttccaagcccaggccgagggggcgcgcggcgacagcacggcggccgccgcggcgttatggcgggcggaccgggcctacggaccgcacgcggcggtgttcctccccgaactcgagctcgcccgggcctgggaaagggccgccgccggcgacacccaggccgccacgacccatgccacgcaggcggcggagatagcgcgcgccgccgggatgcacgcggcggagatgcggacacgccatgccgcggtgcgattcggcgaccgttcacagaccgcgcggctggagcggcttgctcgcatcctggatacaccgctggccgaagcggccgcggaccatgcccgcggtctgacgcaacgcgacggcgatctgctcgatgccgcggcgcaaaaattcgccgacctcggtgccctggcgtgcgccgccgacgcggcggctcaggcggccggcgaacatgcccgtcggggtgaccgcgggaagaaattcgaatcgtcggcctgggcgcacgcgttggccagccggtacgagctgcacacgccggcggtcgaggcggcggcgcgcccgctgcccttcagcggacgggaacgtcagatcgtgaatctggtggcggccggcctgtccaaccgcgagatcgccgatcggctggtcatctcggtgcgcacggtggaggggcacctctatcgccttttcaccaaactcgggatcaacagtcgcgagcagctcaccctactggtggcccgagagccgcgcgggcgaagagagttattgggccacagcaacccgtcgcttggtgatcaggacgacgttcacccccacgcgggctaagttcttatcggcaccctatggagcctttgagagtcgctactctatctcgacgcgcgcaccactcgacttgccgacagagtccggcgacgcccgctccacccgccatacgctcccgcgcatgacaggcagtcggaagcatacggcggtaaccgctcgtgatggcgacccgtccggacccgcggctgcggtttcgttgcggagatcccagctgggcgaggacgcaccggggtcggtttgttcgggcaggaccgcgatttcggacagctccttccggctttatctggctgcggctcgttccggcttcatgtagtgccgggccgcccagcaggtgagggagatatatccgtgacgcagcgggtaaatgggtcaacctggcccattgtgggacgcgatgtggaatttcggcgatcgctcgcggcgctcaacaacggggaattccacggggtggcgttggtcggcgacggcggtgtgggcaagtcgacgttggcgcgcatgctggccaagacggtcgagtccgccgggcgcacggtgcgattcgcgctcggtacccagacgggctgggcggtgccgctgggcgcattctcgcgcgcggtgagcctcggggtcgggcacgaaccggcgatcatgctggccgccgcgcacaacaccttgggtcaggacaagaatttggtggtggtggtcgacgaggcgcagttgctcgatccgttgtcggccaccttggtgaatcagcttgcggccgggcgcagtgcgcggctgatcgtgacgatccgctccggtgagccggtgctggatgcggtgacggcgttgttgaaagagcgcctgctgttgacggtgcacgtcgatccgttcacccgcgaacagaccgagctgttggccggcgcggtgttgggtgggccggtcgacacgcggttggtggatgagctgttcgagcgcagcgcgggaaacctgttgctactgcgtggttttctgacggcgggcgtggaaagcggcgcgctggttcacaccgaacagggctggcaactgcagggtccgctgcgcggcgatcgcgaactgcacgatgccctggagtaccggctgcagtcgctgagttccgaggagcgcgaggtggtggaagtactggccaccgccgagctgctggagtgggagatcttgcgcgacatctgcgatgccgacgcgatggcaagcctggagcgccgcggcctgatccagttggtgaccgacggatcgcacaccctggtgcagttgaatcacccgatgctcggcgaagcggcgacccgccacgccggggtggtgcgctcgcggcagctcaacgggatcctggcgaagaccctgcgcaagcacctacgggcggcggggcggcgctcacaaatctccgacccccgcggtcgaatccagttggcgcagttcataatgcgcagcgacttggagcccgatctggatgtggtcatcaaggcggcggccgacgcgatggccatgtcgaacgtcgtgctgggcgagcagctggcgacgtttgcggtcgaccgtggtggtggcctgccggccgcgttggtgctcgccgaggcggtgagctggcagggccgcggcgaggaggcagattccatcctgctgggcgccgacgtcgatgatgccgacgaatggctgatcgcgcgctggggctgcctgcgcgccgccaacctggcctggggatgcggggacgccgagggtgcaacgcgggtactggccgaggtgaaacagcgcctggcgaccgagggcagcctgcagctgatcgatgcgctggatgtgttgatcgggttcttccgcggcgacatcgcccggacgatcgaattcgggccgcgcctgtgcgaaccggatgtcgtgccgatggcgaccgtgtgggcggccgtcgcgacctgtggcgccttgaccgcggtggggcgtttttccgaggtcggccgcatcgccgctgccggcgtgcgcgcgacggcgcagtgccgggcgggagcgcagcggttcgccatcggactggccgaggtcatggccgcgaccgctgccggcgactatccggcggccgagcgaatccacaagcgttacgccgcactggcaaccggccttcccgcagcggaggccatggtcgacgcgatgctcggcgtcaccctcgaccggtcgatttcccagctttcccaaggctttccattaccgtggcagctcgtcgtgggcgccttgcaggcacaggccgaaggggcccgcggggacagcgcggcggccgccgtggcgctgcggcgggtcgaggaagcctacggaccgcacgtcgcggtgttcctgccggaactcgagctcgcccgggcctgggagcgggcggcggccggcgatacggcgggcgctcagacgcaggcaatgcaggcggcgcagactgcgcggaaagccggcatgcacctggtcgagatgcgggcccgccatgcggcccttcgcttcggcgatcgtgcgcaggccgcgcgagtagacgagttggccagcatcctgaactccccgtcggcccaggcggtcgccgaccatgcccgcggtctggctcagcacgacggcgatctgctcgacgccgcggcccaccgcttcgccgacctcggcgccttggcattcgccgccgatgcggcggctcaggcggccagcgaacatgcccgccggggcgaccgtcgcaaggaggtcgagtcgtcgacctgggcgcacgcgttggccggccaatgcgggtcgcgcaccccggcgctcgacgcggcggcgcgcccgcttccgttcagcggacgggaacgtcagatcgtgaatttggtggcggccggcctgtccaaccgcgagatcgccgaccggctggtgatctcggtgcggacggtggagggacacctctatcggctcttcaccaagcttggcatcaacaatcgcgaccaactcatccaactgatccgccgcgacgcatcgtgaccacacacgctcttcggacactcgggtggggtcgcggccgatcgggtgcggctgccgcggaggtcgcctcgacctggcggggcccaggccgtccatgatccgaaagacgctcgtgcgcaaccgcatagccccggtgctgcccgccgcgactccggggcgcggaatgcatgcctttcgctgatcgccgacccgtcgagcgctcggtgaccactggtcaaaaccgccgcccgcgggccgttacgcaccaccggaaggatgactactcgatctgtgcgcgcgtggcactcaagtcgaatcaatccgtccgtgaggcccgagcgagcaaacttaagctgccgcacatgacatcatgcctggcgggcatggccggttggactcgcatggttgcggaattcggccggatcctccagcacccgccacaatgcctcgaccgggccggggcgggcacgtactacacccacgccgtttcttgaggttgaaatcatgtctcacagccaccggttggtcgaccatatcgtcgggtatcttgcgtcgatcggagtggactgcatcttcggcgtcgatggcgccaacatcgaggacctgtacgacgccgcattcctgcactcggacatggacgcggtgctggccaaacacgagttctccgccgtggcgatggccgacggatacaggcgcagcggcggcggcttcggcgtggtggccacctccgcgtggggcgcgctgaacttcgttgccggccttggggaattgtttaccagccgcgtgccgctactggcgttggtgggccagccgccgtccacgatggatggtcgcggcggctttcaggacaccagcggccgcaacggttcaccgaatgccgaggcgctgttctccgaggtatcggtgttctgccgacgagtccagaccccggcggacatcgcattggcgctgcccgccgccgtggcggccgcgcgaaccggtggccccgcggtgctgttgctgcccaaagacattcagcaagctgacgtgaccagcaacggctacctgcccgagcccggaatcgagcggccacgagacatcggtgatccacgcccgatcgtggcagcgctgcgccgggcgagcggtccggtgacgatcatcgccggtgagcaggtggttcgagacgatgcgcgagccgaactggcgtcgttgcgggcggtgctgcgcgcgcgggtggcgtgcgtgccccatgccaaggatgccgccggcacaccgggtttcgggttgtcgtcggcgctcggcatcaccggcatcatgggccaccctggcgtggtggaagcggtggccgacagcgcgttgtgcctggtggtgggcacccggcttgcggtgaccgcccgcgctggcctggacgatgccctggccgcggtgcccaccatctcgctagggtcggcgccgccgtacctggcctgcactcacatccacacggacgatctgcgggcttcgctgcgaatgctgacgggcgcgctgaccggccgtgagcgcccgaccggaatccgggtacccgatgcggtgtccagaaccgagttgaatccgccgcgattcgacggccccggcgtgcgctaccgcgaagcgatgagcatgctcgaccgcgtattgcccgacgggtccgacatcgtcgtcgacgtcggcagttgcggtgcggccgccgtccactacctaccggtccggcgcggcggccgattcgtggtcgcacccggcatgggctacagctttggcgccggcatcggaatggccgtgcggcggaggaaattcgggcggcgcggacatgtcgtggtgatagccggggacggcgcgtttttcatgcacggcatggaggtgcataccgctgtgcaataccgactgccggtggcgttcgtcttgatcaacaacaacgcgcaggccatgtgcgcgatgagcgaaaagttgtgctacgggaatcggcacagttacaacacgttcgcgcccagtcggctcggcgccggcctcgccgcaatgttcccggaacttccctcggtcgacgtcgacgacgtcgatggcttccgcgctgccgtgcagtcggcgctggaggtcgacgggccgtcggtgatcggcgtcgaatgctccgccgaggaagtgccgcccgtctcgacctttctcgggcttgtgacgccgaaatcagttgagtgccaacatggcatggcgcaggacagaatcgatgccatcgtcggcgcctgacggcacgccgaccccaccggcaccggcgccctgtcaatgcatgcccgagcccaggtagagccccgatagagaccagatagcgaatgctcgacgcagggttcaacccctggcccgtcggggatccgctctgtcgtcgtcatgatcgcctcaaacctccgctctcgacggaaacgcctgtcgcagaatcgattccgcaagaccacgtgcatatcaggtgagagcttgtttgtcactacgtaagccgcgctgcgggcttgcgttcgccactctatgtactcgcagttactacgctacccggcttgatgggccatgcaacaggattgaaacccatacgctcccggtcatatcgagatcgttgctcggtcaagcccccgagtgcccggtcgaaaccaacaggcgcaccgaagtgcccgactcatgtcaaacgaggacctggaggacgagtgagtaccaatccgttcgacgacgacaatggcagctttttcgtcctggtcaacgacgaagaacaacacagcctgtggccggcgttcgccgacattccggccggctggcagatggtttacggcgaagcggatcgcgctgcgtgcctggactacatcgaacagaactggcccgatatccgcccgaagactttacgggacaggctggcggcgcagcgccgcggtgctggcaagtaacccgcaaaggaattccgatgacgatcgatgaccgggctctgcacgttgggcgagaacaactgacggaactcgatggtgggccattcccgctgacacgcggacagctcgacatctggctcgcacaggaaacggatcagcagggtgcgaggtggcagctgggctatctgctgcgaatcgaaggcaccgtcgacccgtggttgctggagcacacgatccggcaagtggtgcgcgaggccgaaccactccgagccgcctttttccaggtggatggccaggttttccagaaggccgtcgattacccggacgtcgagctcgcgtgctatcagcggatgggctcgcaagatcccgtccaggaagcctatcggctggcagcctcgattcagcgcaccgtgatgccgctcgatggcccgctgttcaaatttgcgttgttgcagacccgcgtggacgaattctatctattcgtgtgctgccaccacatcgtggcggacggaatcggtcttgctctcatttgccaccgcatcggggatgtctacaacgcgttggcctcgggtgcgccgattccccccgcctatttcgggtcgctgagtgatttgattgcctgcgaggccgaatacgaagcgtccaccgattatctcgatgatcgggcctattgggccgagaacctgccctcggaaagcgaaccgggttaccggctcgcgcccgcctcggagcgggaaccgtacgaatcttccgcaccgatcgagttggaccccgtcgccgtcgccgggatacagaagttgtcacagcagctgggggtgcgtcgctcgtcggtgctggccgcggcgtgcgcgctgctggtgggcgggtgcgacctggaaaattcggagatcgtgttcgagtttccggtgagtaggcgggtgcgtccggaagcgcagacggtgcccggaatgattaccggattcgtccccctggtcctgaaagcttcgccgggctcgtcggtcgcgagtttttgtgagcatgtcgacacacggctgggagaagcgctccaacatcagcggttcccggtgcacaccatcgagaacaagcgtcgcgggtccacgcagacgtcaaatcgggtaattctcaatttcattccgacgacaaacctggccaacatcgccggtgccagggtttcgggaaccctgacccataccaacctcgtcgaccagcttggactggacttcttcagcgaccacgatcggctattcctcggcatgcagcccggcgcgacaacgggtggattcggcggcgccgggcaatggctttctgattgtgacgtccacgatgtggtcgggcggttggagcgggtgttggtggcgatgacggctgatccggggcggcggttgtcgtcggtggatgtgctgggtatgggtgagcgggtgcggttggatgagcttggtaacaaggcggttttggccggcccgcagggtgtttcggtgtcgattccggatttgtttgctcggcatgtggccgggacgccggatgcggtggcggtgagcttcgatggccgttcggtgagctatcggcagctggatgaggcgtcgaatcggttggcgcatctgctggtcgctcgcggggtgggcccgggtgagcgtgtggcgctgctgttttcgcggtcggtcgatgcggtcgtggcgatcctggcagtgctcaagacgggggcggcgtatctgccgatcgacccgggcgtgccggacgagcggatcggcttcgtgcttgccgatgccgcgccgatcgccgcgatcaccggcaccgggctggcggagcggttggacgggcatgacgtggcggtcatcggcgtcgatgatcccgacgtcgttccggctgtcgacgcccagccgagcacgggtctgccggggccggcccctgacgatgtcgcctatgtgatttacacgtcgggcaccaccggtgtgcccaaaggcgttgcgatcacacatcgcaacgtgacccagctgttggggtcgttggatgccgggttgccggccccgggcgtgtgggcgctgtgccattcgttggcgttcgacgtgtcggtgtgggagattttcggcgcgctggtgcgcgggggggcggttggtggtggtgccggagtcggtgaccgtttctccgcaggagctgcacggcatgttggtggccgaacaggtcagcgtgttgacccagaccccctcggcggtggcggcattgccggctgacgggttggagtcggtggccttggtggtggtcggtgaggcgtgtccggtcgaggtggtggatcggtgggcgccgggtcgggtgatggttaatgcctacggcccgaccgagaccaccatgtgcgtggccatcagcgcaccactaaagcccggatcgggtgtgccacccatcggtgcgccggtatcgaccgccgcacttttcgtcctcgatcggtggttacgccctgctccccccggagtggttggggagttgtatgtggccggcgccggcgtggcggtcgggtatacgaaccgggccgggttgaccgggtcacgtttcgtggcctgcccgttcggagcacccgggacgcggatgtatcggaccggggatttggtgcgttggcgtgccgatgggcagctggattatctgggtcgggccgatgagcaggtcaagatccgcggctaccgcatcgagctgggtgaaatccgttcggcgctagtgggtttggacggggtggagcaggcggcggtgatcgcccgcgaggaccgccccggcgacaaaagactggtcgcctacgtcaccgaatcagcaaccgggaccgccgaccccgccgagatccgcgcccggctggcgcaacggctgcccgaatacatggtgccggccgcggtggtcgtgctggaaacgctgccgctcaccgcgaacggcaaactcgacacccgcgccctgcccgcgcccggctaccagaattccgatcaccgtgcaccctccagtccggtcgaggaaatcctggccggcgtgttcgccgacgtgctcggactggaccgggtcggcgtggacgactcgttcttcgatctgggcggggattcgcttgtggcgacacgtcttatcgccgcgatcgaaacgacgctgaatgccgacctttcggtgcgtgcggtgttcgaggcgccgacggtgagccagttggcgctgtgtgtcggttccgatcggggccggcgggaaccgttggtggccgtggagcggctggcggtggtgccgttgtcgttcgcccagcagcggttgtggttcatcgaccaactgcaagggccttcgccgatctacaacatggcggccgcgttgcggctgaccggacggctcgacgccgacgcgttggggacggccctggccgatgtggtggcccgccaggaaaccctgcgcaccctgttcccggccgtcgacgggatacccgaacaggtggtgatcccggccgagcgggccgacttcggctggcaggtcgtcgacgccaccggctggcctacggaccggctacagcaggccatcgaggccacagtccgccactcgttcgatctggccaccgagattccgttgcgggcaaggcttttccgcatcgccgacgatgagcatgtgctggtggccgtgctgcatcacatcgccgccgatggtttgtcgatggccccgctggtggccgatctgggcatggcctatgccagccggtgtgccgggcatgcgccgggctgggcgccgttgccggtgcagtatgccgactattccttgtggcagcgcgcgctgctgggcgatgtggccgatgccgagagcccgatggctgcgcagttggcgtattgggagcagcagttggccgggttgcccgagcggctggcgttgcccaccgaccggccctatccgccggtggccgattaccgcggggcgagtgtgatggtggagtggccgaccgagctgcagcagcgggtgcgcacggtggcccgcgagcacaacgccaccagcttcatggtgatccaggccgccctggccgtcctgctggccaaactcagcgccagccgcgatctcgcgaccggattcgccatcgccgggcggcgtgagccggcgctcgacgagttggtcgggttcttcgtcaacacgttggtgctgcgggtcgacctggccggtgatcccagcttcaccgaatcgctggctcaggtgcgcgcgcgcagcctggccgcctacgaccaccaagacgtgcccttcgaggtactggtggaacggctcaaccccacccgcagcctggcccatcacccgctggtacaggtcgtgctggcctggcagaacttcgcccgagaagacggcgtccccgccgggttggcgttgggcgatctgcaggtcacaccgctggcagcggacacccaggtcgcccgcatggacctgacgttcacgttgggcgaacgctggacttccgccggtgagcccgccgggatcggcggctcggtggagtttcgcaccgacgtgttcgacgcggaaaggatcccgacgctgatccagcggttggaacgggtgctggcggcgatgaccgccgatcccggccagcggttgtcgtcggtggacctgatggataccgatgagcacatctacctcgacgagatcggaaaccgggaggcgttgacgcaaccggcggctcgggtgtccattccggcgatgttcgccgatcaggtcatccgtgccccgcaggccgtggcgacccgctgcgccggtcactcgatgacctaccggaagctcgacgaggcgtcgaaccggttggcgcacttgttgatcgaggcgggcgccggccccggcgaatccgtggcgctgctgtttaaccgtcgcgcggaggccgtcgtcgctgtgctggcggtgctcaaaaccggggcggcctatctgccgatcgatccggcccacccgaccgcgcgcatcgagttcatggttgccgatgccgcaccgatcgccgcgatcaccaccaccgagctcgccgagcgactggacggatgcggcctgccgatcatcgacatcgcggatccccgtattgacagctacccgcacacggcgctgccggtgccggatccggacgatatcgcctacctgatctacacctccggcaccaccggtgtccccaaaggcgttgccatcacccacaacaacgtgaccgagctgctcggttctcttgccccggatttggcgcggcccgggcaggtgtggtcgcagtggcactcctacagcttcgacatctcgggctgggagatctacggcgcgctgctgcacggtgggcggctggtggtggtgcccgaggaggtggcggcatccccggacgacttgcacgccttgctgattgacgaaaaggtcaccgtcctctgccaaaccccctcggcagcggggacgctgtcgccgcaggggttggagtcggtgaccctgctggtgggcggcgaggcctgcccgtccgaactggtcgagcggtgggggcccggacgcgtgatgatcaatgaatacggccccaccgagacgacgatgtgggtggccttgagtgcgccgttaacggcggggtcgaccgggtcggacgccgtgccgatcggctcacccgtgcccggggcggccttcttcgtgctggatcagtggttgcgcccggtgccggccggcgtggtcggcgagttgtatgtggccggtaccggcgtcggggtcggatacgtgcgccgggcggggctgaccgcatctcggtttgtggcctgtcccttcggcgagtcggggacgcggatgtatcgcaccggggatttggtgcggtggggcgccgatgggcagctgcggtatctgggtcgggccgatgagcaggtcaagatccgcgggtaccgcatcgaactgggcgaaatccgttcggcgctagccggtttggacggtattgagcaggcggcggtgatcgcccgcgaggaccgccccggcgacaaacgcctggtgggctatgtcacggaatcagtcaccggagccgctgacccggccgatattcgggcccggctgggtcagcggctgccggcctacatggtgccggcggcggtggtggtgctcgacgcgttgccgttgacggtcaacggcaaactgaatgcccgggccctgccggcgcccgagtacatcgagcgcgaaaggtactgcgccccagctactcccaccgaggagacgctggccgggatctacgcccaggtgctcgggctcgagcgggtcggggtcgacgactccttcttcgacctgggcggggattcgctctcggcgatgcgggtcatcgccgccatcaacaaaaccttggacgccggcctcgcggtccgcacgttgttccacgcaccgtccgtcagagggttgtgccggcagctgggccagggcgccgacgaggtggaaaaccaggtggaaatcatcccccgtcgagttcctcaaggagggcaccggcgctccgctgttctgcattcatcccgcgagcgggctgagctggccgtatcacgctctcggtaattacctgggctgccccatcattgggattcagcaatccctgcagcggggcgaggccgaaccggcgtcaatccgcgacatggcgaaaaactatgccgaccggatccagggcgttgatcccaccgggccctacaacctcctcggctggtccttcggcggcgtcgtcgcccatgagatcgccatcgaattgcagcgacgcggctgtccggtccggcatctcatcctgctcgacgccctactggtcatccccagcagcgacgtcctgaacagcgatgtcttagtggagcaggcactcaacgaagtcctgcggttctgtggcatacaggttcccgagggcgatgagccgcttacctacgagcgggccgaaaaactgcttcgcgaacgagggatcgaagagctaccgcgctacaagccgttgctcgattcgattgtccgcaacgacaatacgaacctcgcgttggccagagcgcacgaaccgggcgtcttcgatggtgatgtgaagttgttcgccgccgcgcgggagaagggcgaccagaactcgtcgtcgctgcgaagctggcgaccgtatgtcaccggcgaaatcagcagctacccggtcgactgtacgcatcagcaaatgatgagtaccgagtcgctgatccagtacggccagcaactcaaggttgtcctcgagggtggcggttgacgatgtccgtagcgccgaccacgcggctgtggtctcgccagttcgtcgccgtgatcgtcgcgatcggcggcatgcagctgatggtggcgatggacggtcccgtcgcggtcttcgcgctgccgaagatccagaacgaaatgggcctgtcggatgcggcgcggagctgggtgatcaccgcctacatgctgaccttcggtggcctgatgctgttgggtggcaggctgggcgacaccatcggccgcaagcgcgctttcctcgtcggggtcgcgctgttcactttcgcctcgggcttgtgcggcatcgcctgggccggcggcacgttgatagcggcacggctgctgcacggtgcggccgccgcgatcatcgcgccgaccaacttggcgctgatagcgaccacctttccgcgggggtcggcgcgcaatgccgcgacggcggtgttcggcgcgatgaccggtctcggcggagtgctgggcctggtggtaggcggggccctcaccgacgtgtcgtggcggctggcgtttttggtgaacgtaccgatcgggctggcggtgatctatctcgtcctcatcactcgacaggaaacccagaccgagcggatcaagctcgacgtcaccggggcggtgctggccaccgtgaccggaacggccgccgtgttcggcatttcgatgggcccggaggcgggatggcgctcgcccatcacgatcgggtcgggcgtggtggcgctggccgctttcgtcgcgttcgtcgtggtggagcgcaccgccgaaaaccccatcgtgccgttcaacctgttcttggaccgcaaccggttggccgcgttcgcggccatgttccttgccggcggggtgtttttcacgctcaccgtgctggtcggactgtatgtgcagaccatgatgggctacagtccgctgcgcgcgggcgtcgccttcatcccgttcggcctcgcgatggccatcggggtgggcgtggcgtcgaagctggtgacgtggttcccgccacgggtggtggtgatcgccagtggcggcctgattctgggcgcgacgctgtacggctcgaccttcaatcgcggcatgccctacttcccgaatctcgttgtgcccctgattgtttgcgctatcggcatcggcgcggtcttcgtcacgctcacgctgtcggtgatcgccagcgtcgacgtcgaccggatcgggccgacctccgcgatcgcggtgatgctgcagaccctgggcggcccgctggtgctggtcgtcgtgcaggtggcgatcacgtcgcacgcgctgcgcctgggcggcacgctgggtccggtgaagtccatgaacgccgcccagctgcatgcgctcgatcgcggttacacctacggcctgctgtggctggccggggtcgtcgcgctgctcggtggggtggccctgctgatcgggtacaccgccgcgcaggtggcccgcgcccaggaagtcaagaaggccgtcgacgcgggggagttgtagccgcccgggaccggccgaagcaatcggtatcggcgaaaaacacgttcgcagaacgtgttccgatccggccccgccggtcttcggatgcgtaagtttctgccgcggacaccgccaccactcggtcggtttgcgccgaccactctatgtgcggcccctgactacgctaccgacttgataaacctgacaacgggattgaaacgcacgacgctcggggtcatgcacttcgccgagaccgttttcgggcgcccggtccgcaacagctagtgcaccgcaccgttcggctcttgccacagcgaactctggaggactggtgactacctacccgatcgacgacgttattcagcgctcgccttccaccgattcgtcccccccgatccgcaccacacccgtcgttccggtcgccgtgatcggcatggcctgccggctacccggagccgtcgactccccggagcggttgtgggaggcattgttgcgcggcgacgacttcgtcaccgaaatcccgcccgaccgctgggacgccgacgaatactacgaccccgagccgggtgtgccgggccggtcggtatcgcgctggggcgcattcatcgacgacgtcgccggcttcgaccccgagttcttcgggatcaacgagcgaccgcgatggacccgcaacaccgcttgctgctggagacctcatgggaggcaatggaacacgccggtctcaccgaggagcgcgtcgccgactcccgcaccggggtgttcatcgggttgacgcacggcgactaccaattgctggccgccgacacccgctccgtggaaggcgcctatggcttctccgggagcaacttcagcctggcttccgggcgcatcgcctacgctctgggcgtccacggtcccgcactgacggtggacaccgcgtgttcgtccggcctgaccgccatccacctggcctgccgaagcctgcacgagggtgaaagcgatctcgccctggccggcggcgccaccctggcgttggacccgcgcaagttctccgccgggtcggccgagggcatgctgtcgcccaccggacgctgccgcgccttcgacgtcgcggccgacgggttcgtgggcggcgagggcagcgtcatgctgctcctcaagcggctgaacgacgcgctccgagacggtgatcggatcctggcggtggtgcgcggcacggccgccaatcaggacggtcacaccgtgaacatcgccaccccgtccaagagcgcgcagaccgcggtgtaccgggcggcgttggccgccgcgggcgtggacgccggcacggtcggcatggtcgaggcgcacggccccggcaccccggtgggcgacccgatcgaatacgccagcctggctgaggtctacggcatcgacggcccctgcgccctggcgtcggtgaagaccaacttcggccatgcgcaggcagcctccggagcactcgggatgatgaaggcgatcctcgcgctgcagcacggcgtggttccccggaacctgcacttcacccagctgcccgacgacctggcccgcatcgacaccaaactctttgtgccgcagcagaccacaccgtgggtcagcaacggcggccacccgcgacgtgccgccgtctcgtcctacgggctgtcgggaaccaatgtccatgccatcctggaacaagcacccgagcctgctcccgaaaccgttgcacccgaacatatctcggcagaatcgccattgctgttcccgctgtcgtccacctcggccgacgaactgcgccgcaccgccggccggctggccgactgggtgcacgcacacgacgatctggcgctgcccgacctggcctacaccctggcgcgccggcgcgtgcaccgccccgtgcgcaccgccgtcctcgcgggcgaccgggcccaactcatcgaggccctgcgcgaggtcgccgacggcgacaccccctacccggccgcggtcggacggggcgaccgggggccggtatgggtgttctccggtcagggttcgcagtgggcggcgatgggcgccgacctgctggccaccgaacgggtgttcgccgccaccgtcgcgcaggccgaaccgttgatcgcccgggagtccggattttcggtcgccgaggcgatgtcggcgccgcagacggttaccggtcaggaccgggtccagccgacgctgttcaccatgcaggtcgcgctggccgccaccatgaaagcccacggggtgcgtccgggcgcggtgatcgggcactccctcggcgaggccgccgccgccgtcgtcgccggcgccttgtcgctggaggacggggcgcgggtgatctgccggcgctctcggctgatgtcccgggtcgcgggtaccggtgccacggcatccgtggaactgcctgcacagcaagtgctttcggagctgacggcacgcggaatcagcgatgttgtggtggcagtggtggcctcaccgcagtccaccgtgatcgccggcgccgccccaacggttcgcgacctggtcacggcctggcaggagcgcgacgtgatggcccgcgaggtgcccaccgacgtcgccttccactcgccccaggtcgatccgatcatggacgacctgaccgacgcgctcgccgagatcagcccgaggccacccgaggtgccgtactactcggcgaccctgttcgacccgcgcgagcagccggtgtgcgacgcccgctactgggcgaacaacatgcgccgcatggtgcgattcgccacggccgtccaggccgcattggaggacggctaccgggtcttcgccgaactggcgccgcacccgttgctcgtccgcgcgctcgaacagaccgcccgcagccgcgaaataccgatggccgccctggccagcatgcgccgcggacaagcgctgccacacgggctgcgcggctttgtggcggacctgcacaatgccggcgccgcggtcgatttctccgtgctctacccgaccgggcggctggtggacgcgccgctgccgacctggacgcaccgccggctgtggttgaccgacggcgggctggagtccccgacacatggcggctgcaccgttgcggtccatccgctgctcggcccgcacgtccacctgcaggaggaacccgagcgccacctgtggcaggccgacgtcggcaccgccgcccagccctggctcgccgaccaccagatccgcaacgtggtggtgctgccgggggccgcctactgcgagatggctttggcggccgcgcgatccgtgctgggcgcggcggccgaggtccgcgacatccggttcgagcaggcgctgctgctggatgagcagaccacgatcgacgcctcggcgtcggtgtcctcgccgggagtcctgcacttcaccgtgcagtcgcatcagggcggcgaacaggcgcggcacgcgtcggcggtgctgggtgccgcggtcgacgagcagccggccgcgcacgacctgtccgcgctactggccgcgcacccgcatgacgatgacggcgccgaggtgcgccggcggatggaccgacgcggcgtccagtacggtcccgcgttcgccggcctgggcgccgtccataccggcgacgagaccggcaccgtcctggccgaggtggcgttgccgcgccaaatccgctcgcagcaagccgcttacggcgtgcacccggcgctgctggacgcctgttttcagtccgtcgaagctcatccggctgttcgggcgctcggcgacggcgcgctgggattggtgctgggcatccgtcgcctgcgcgcctacagcgcggcacgcaacgcccactactgctacacgcgggtgaccaaggccgacacgtccggcgtcgaggccgacatcgacgtgctcgacgaacacggggcggtcctgctggccgtgcagggtctgcgagtgggcaccagcgcatccgagagcggcaccagagaccgcgtgctggccgaacggctgttgaacatcgaatggcggcaacgggaattgcccgagccggagcacgccgacgccggaagctggctgctgatcggcactaccgccacggccgacgtactggccagcacattggccgacacgctgaaaaaccgtggggcgcaatgcaccacgatggcctggccgcagcaggccgaccacaccgtgcacgccgaacagctgcgaaaccactggcgtggcgacggattcaccggcgtggtggtgctcaccgggccgaaaaacggtgataacgaccaggagtcggcactgctcagccgggaccatgtgcaacatctggtgcgcatcgcccgcgagctgacggacctgcccggcgaaccgccgcggctgtatgtcgtgacccgcaacgcccaaaccgtgctgcccgacgacgtgcccaacctgggccaggcggggctgcggggcctggtccgggtcatcggcatggaacacccgcaattgggcgccggccagatcgacgtggacgaatccaccgacgcggaagcgctggcgcggcaactgctcgccggctgtgaggaggacgagacggcgtggcgagacggcgcctggtacaccgcccggttgtgccccgctccgctgctacccgaggagcggcacacggccgtcgccaaccacgagtgcgacgggatgcgcctgcagatccgcacccccggtgatctggagtcaatcgaactcgttgcctgcgaccgcattccaccggggcccgaacagatcgaggtggccgtcagcgcgtccagcatcaacttcgccgacgtgctggtcgcattcggccggtaccccgctttcgaggggcggctgccggaactgggcaccgacttcgcgggcgtggtgaccgcggtcgggccggacgtgaccgaccacaaggtgggcgatcatgtcggcggcctgagcgccaacgggtgttggggcaccttcctcacctgcgacgcgcgcctggccgtcaccgtgccgcccggactggccgacgaccaggcggcggcggtgacgaccgcgcacgccaccgcctattacggcctgcacgagctggcccgaatcggggccggtgaccgggtgctgatccactccgcgaccggcggggtcggacaggcggcgatcgccatcgcccgcgccgtcggagccgagatcttcgccaccgccggcagcgagcaacgccgacaattactgcgcgacatgggtatcgagcacgtctacgactcgcgaaccgtggagttcgcggacctgatccgccatgacaccgacggctacggcgtggacatcgtgctcaactcggtcaccggcgccgcccagcgcgcgggcatcgaattactggctttcggtgggcgattcgtcgagatcggcaaacgcgacatctacggcgacacccgattgggactcttgccgttccggcgcaacctgacgttctacgccctcgacctggcgttgatgtcgttcagccacccggacagactgcgcggcttgctcaggacggtgtaccggctcaccgcggacggagcgttgccgatgccggaaagcacgcattatccacttgccgacgccgccagcgcgattcgggtgatgagcgccgcccagcacaccggcaagctcgtgctcgacgtcccggacgccggccgcagccgcgtggtggtgccgccggcgcaggtccgcgccttccgcagcgacggcgcctacatcgtcaccggcgggctgggcggcctggggctgtttttggccgagaagatggcttctcccggttctcgcgccggctgcgggcgcatcgtgctgtgctcgcgcgcgctgcccaatcccaaggcgctggcgacgctcgaacggatccgccagatgggtgccgacatcgtggtcgagcgcggcgacatcgccgaggccggcacggcgcagcggttgctcgacgtagcgaccgccaccgggcttccagtgcgcggcgtgctgcatctggcggcggtgatcgaagacgccacgctggccaacatcaccgacgagctcatcgagcgggactgggcggcaaaggtttacggcgcatggaatctgcacttagcgctgcaagagtccggcgccgagcagtcgctggactggttctgctcgttctcctcggcggccgcgctggtcggctcgcccggccagggcgcctacgccgcggccaacagctggctggacgccttcacccgctggcgccgggcccggggcctgaaggccaccgccatcgcctggggcgcctgggcgcagatcgggcgcggtgccgccctggccgatagtgccgatgttgcgatcactcccgacgagggcgcttacgcgttcgaagcgctgctgcgccacgaccgcgcctgcaccggctacgccccgataacgggcacaccgtggttgaccgcattcgcgcaacgcagtccgttcgccgaggcgttccgcgccaacgggcaaagcgcaacgggcacaagcaagctgcgtgccgagctcgaggagctgccgccggaagagtggtccacccggctgcggcggctgatctcggatcaggtcagcctgatcctgcgccgcaacgtcgaccccgaccgcccgctgcccgagtacggcctggactcgttgggcggcctcgaactgctcacccgcatccagaccgagacgggcatccgggtgtcgcccgccgacatcgccgccatcggcaccatacgcggtttggcggacctgctgcgggacaagctgacgcccgcgggcgcggcccaggcggaaagggtttagctcatgaggatcgacttacgttgcggcacaaaggaggagaagtgagcgcacccgagaaccttgacttcttcaccgacaagtcggttgtcgacgacccctacgactactacgacgcgatccgtcgttgcccggtgtggcgtgagccggcgcacggcgtggtgatggtctcggggtacgacgaggccctcgcggtgcagcgcgacaccgaccacgccctgtcggtatgcaacattgtcagcgggccttggtcgggaattccggtcaacaccggcagcgacgacatctcggaactgatcgagcggtaccgcaagaaggtcacgttcggcgattacttcatcacgttcgatccgccgatgcataccgcgcaccgctcgctgttgagcagattgttcaccccgaagcagctcaagaacaacgaggacttcctgtggcggcttgccgacgaacaactcaaccgcttcatcgcgaatggcaagtgcgagatggtcatcgactacaactttccgttcacgctcgacgcgatcacggacctgttggacgtgccggaggccgaccgtgagcgattccgccgcgccgcgatcgccagcaggctcgaaggtgatcgcagcggcttcgtcggggtgaaagaggagtggttcgtcgagtacgtcgaggaacggcggcgcaatccgcgcgacgacgtcctcaccgagttggcgctggcgaaggttcccgacggcacgacacccgaaccgatcgatgtcgcccgcgttgccacgttcatgttcgccgccggccacggcacgacgatcgacctgctgagcctgtcgatgctcacgctcgcggagcgaccggacttgcaagacctgctccgcgaggacaactcaaagatccccgccttcatcgaggagatgctgcgcatcgaaagcccgatcaaatcgaatttccgtctcgcgcggcgcaccaccaggatcggcgacgtcgaggtgcaggccggcaccagcattctggtgatgaacggtgcggccaaccgtgatccgcggcggttcgacgaacccaacgaattccgcctcgaccgcccgaacatactgcatcacatggcattcggccgcggaattcacacgtgcccgggcgctccgattgcccgcgccgaggtgcgggtcagcctggagcggatcctcagccggatggccgacatccgcctttccgaggccaagcacggtccggcaggcgctcgccggctcagatgggatcccaccctgttgttccggcgcctcaaggaattacacctcgagttcaccccgattcggtgagccgttccgatgcgaagaccagctggagatacccaccgaatggccacgcaagcggtgacccgatcggccgtcgcggtttgcggcctggcactagcgtttaccgcggccgggccggcgtccgccgatcgggatctgagtccgttcgtcaacacaacctgcgattacgggcaggtgatgtcggcgctgcaggcggcagatccgcaggccgccgcacaattcagcgcttcgccggagagcgtctcgtttctgcgtcagttcctcgcgtcaccgccgggtcaacgccagcagatggcccagatgttggcgagccagccgggggccgaccaacagttcgggcttgtccagcgggtcttcagcacctgcaacaactactgagcaggttctccgtggccaccctcatcgaaggcttccccctcatcagcacgctgcgcgacgcggtgttcctcaccgcaaccgtcagcgagatcgaagcgttgacaccgcgaatgcgccgcatccggttcagcggcccgcgactgcaaggactgggctggaccccgggtcagcacatccggctgcaggtcgaaagcctgcgggagtccatgctgcggctgcacccataccccgtgctgcgcacgtattccatctacgccgccgaccccgaccgcggcgcgctggacatcgtgatggtcgaccacgacggcgacccaaagggcgcgacgcccgccagacgttgggcgatggccgccaccctcggagatcacgtccgtatgacccggccccagggcaagttcgtcatccgggacgacgcgccctatcacgtgttcgtcggcgaggaaaccgcgtcggtcgcgttcgccgcgatgcttcgctctttgccccccaccgccgaggtctacggagtggtggaggccgcaaccgaagccgaccacctgccccgggcccggcccctcgaacgggtcgagcgcggcggcgccccggccgcgaagtccgccgtgctcgccgacgcgctgcgccgccttccgctgccggaccatccgggcgtcgcctacctcgccggcgaggcccgcaccgtgcaagccctacgccagatattgatcaccgaacgcggctggaagcgaaaccaggtacgcaccaagcctttttggtcgccgggccgcaccggcatggagtaatcatggtcgagacgtctatttcggacctgctgtgtgaacgggccagtctgcagcccaacgacacggcgttcacattcatcgattacgagcgggactggaacggggtcgccgagaccctgacgtggtcgcagctgtaccggcgaacggtgaatgccgcacgagcgcttcaacattgcggggcgacgggcgaccgcgccgtgatcatggccccgcagggcctcgactacatcgtggcgttccttggcgcgttgcacgcgggacaggtcgcggttccgctggggggcgtcagcgacgagcgcgtcgactcggtgctgcgtgacgcgtcgccgaccgtcatcctcaccacgtcctccgccgcggaaaccgttgcggggtatgtcaagtcgcaatccggccgaccggtgccatccgtcgtcgaggtcgacctgctggatctggacacccaagccgcctccggcgccgggggccagaatcgcccggagctggcctatttgcaatacacgtccgggtcgacccgtcaacctgccggggtcatgggctcgcagcggaacctgctggccaacttcgggcagatcatgtccgacttctgcgcggagtacggggggtcgccccgccggacaccaccatcgtgtcgtggctgccgttttatcacgacatgggtttgatcctgggcgtgtgtgcaccggtcctgggtggtattcccgccgtgctgaccagcccggtgtcgttcctgcagcgaccggcccggtggatgcagttgctggccaaggaaagtcacacattctcggcggcaccgaacttcgctttcgagttggcggcgcgtaaaacatcgggcgaggacatggccgggctggacctggccgacgtgctggtgatcctcagcgggagcgaacgggtgcatcccgcgacgctgcggcgtttcaccgagaagttcgcgcgcttcaacctgcccggcaaggcggtacgccccgcctatggactggcggaggcgacggtctatgcgttgagccgcacaccggcgcagccgcccgagatcgcgcacttcgattccgagaagctggtcaccggcaccgcggagcggtgcgaaagccccaccggcacaccactggtcagctacggggtgccgcggtcaccgatgatccgcatcgtcgatcccgacaccgggatcgagtgtccggaggggaccgtcggcgagatctggatccacggcgacaacgtcgcgatgggctactggaagaaaccgcaagagaccgaacgcgccttctgcggtcggctggccgccgcgtcgtcgggcgcgcccgaagcgtcgtggttgcgcaccggcgactcgggcttcttgtccgatcgcgagctgttcatcatcggccgcatcaaggacctgttgatcgtctacgggcgtaaccactcacccgacgacatcgaagcaacggttcaggagatcacccggggccggtgcgcggcgatcgcggttccgcaggggggcatggaaaagctggtcgtcatcatcgaagtcaagaatcaggacccgtcccgcgaggccgcggacaagcttgcgctcgtcgagcgcgaagtcacctcggcgatctcgaactcccacggcatcggggtggcggatctggtcctggtggctcccggctcgataccgatcaccacgagcggcaaggtgcggcgcgcgtcgtgcgtcgagcaataccgccaaggtcagttcgcccggctgagccgttagcccggtgacggcggggttcgccgccgacacggcgggggagggcggcaatggtcttgcgcgccaacggcaaccggccgcgggctggtctcttattcgggtgacgggtgatttcgtccgtcagtccgcgccgtcggcctttttccgtccgccccagggctttcctacggggcgccagcaaaactggttgctgccctgacggtgccagagataggtgtcgagatcacccaagttgctgcgcgccacaaacttccacatcggaaaatctgacggagtcgattttcggtgcatcatccctccctcagaaaaggcgttgcagcgcgttgagaagcgcaattgaccggaccggagcggatcgaattcgacacggttcgataacgaccggccttgtgcgacaagcgtctaccaacgccgccgggcgtgacggcacgccgccgtccgtcgtctcgcgtcgccgcgtggcatgcgcgattccgtgtcatgctcggagcctatggtcgcggccgctactactgggacggcgcgagccaaatagagtagtgcgagaggcgatttagggtagtgagatcgaattaacttggcacacggcgaataacgccaccgctaaccgccgccaaagacgaaaaacacaggcatactcgacatccgcaaaataagccgcaaattcgcgccagcccgcaccagccggcccgaccgcgatccgtccgaccgcaccggtacgtttgcgtcatgacatcgctgcgggacaaagtcgtcttcatcaccggcggcgcccggggaatcggcgccgaggtcgcccgccggctgaaagcgaaaggcgcccggttggtgctgaccgacctcaacgacgccgaactgacctcgcttgccgcggaactcggcgaggagcgggtgctgacggccgtcgcggacgtgcgcgatctgtcggccatgcaggccgccgccgaccgcgccgtcgagcgattcggtggcatcgacgtggtgctggccaacgccggcatcgccagctacggctcggtggcccaggtcgacccggacgcgttcaggcgagtcctcgacatcaacgtgctcggcgtctttcacaccgtgcgagcgaccttgcccgcggtgatcgagcgccgcggctacgtgctgatcgtctcgtcgctggccgcctacgcggcctgcccggggctggccccctacaacgcgtcgaaggccggcgtcgagatgctggccaacgcgctgcgactggaagtggcccggcacggcgtcaaggtcggctcggcgcacatgtcctggatcaacaccgcgttggttcgcgacacccagaacgacctgccggccttcgatcgactgctcgccagcctgccctggccgctgaacaagaccacgacggtcgacaaatgcgcggccgcgttcgtcaagggcatccagcgccgccgcgcccgcatctactgcccacggtgggtggcgctgttccgctgggccaagccggtgctgtccagtcggctcggcgaaatgccgctgcactcaccgaccgccgagctgttgccggcactggacgcccaagtcgccgcgctgggccgttcgatgtcggccgccaacgtggagttgttgcggccggatcgcgggtcggcgcgcaactagtcgacgctcggcgagcgaaatacctagcgcccgaagccgggccggcggcggcgcagataccgctcgaactcggcggccagcgcgtcgccgtcgatcttgcccagcgcgtcgttcatgtcgacctcggcgtcgccgcgctgttccagcgactgcacgtattcggcgagatcctcgtcctcggcggtcatctcggtgaccgcctgctcccattcctcggcgtcggtcggcaggtcggccagcggcacctcgatgtcgagcacgtcctcgacgcggcgcagcaacgccaccgtggccttcgggttgggcggctgggacacgtagtgcggcaccgccgcccagaacgtcaccgccgggatcccggcggccacgcacgcgtcctggaacaccccggcgatgccggtggggccctcgtagcggctctcctcgaggccgaagcgtttggccgactcgggcgagtaggccgcgccggacaccggcaccggccgggtgtgcggggtgtcggccagcagggcgcccaggatcaccacggtgtccacgttgagcttgtcggcgatggccaccagttcggcgcagaaggtgcgccagcgcatgttgggttccacgccgtgcatcaacaccacgtcgcggtcgctgcccggcggccggcagtgcgagatccgcatcgccggccacaccagctcgcgggtcaccccgtccacctgccggatcaccgggcggttcacctggtagtcgtagtaggcctcgtcgtcgatctccaggatcgggtcggcctcccagatggcctcgaggtgctcgagggcgtcgctggccgcatcgccggcgtcgttccagccctcgaatgcagccacgacgacggtgtggtgcagttcgggcaacgcggcctggccactgggtgcgccatagggtgggccgtcgggcggggtcacagatttagcgtacggccttccccgcgacaatgtccgaggcggcgtggccgtgtatcggcggccgatcggcggtttacccgcgcctttgcataggcggactatccttacggcgtgactgccgccgacgaacacgccgcgacgggcaccgcgtcaatggcggccgacccgagcccggacggtttcaccaaccggcgtcgacaccgtcgcgcagaaatacgcccggccgcaatctcgttaaccttggtaactatcatgtcgccgacaggatctgcgagctgtcgatcccggcgatgagttgggcgtccgaacgtcgatcgggtgacgacgtagacttttctggtcgagaggcgttgcaacggatccgggttcccgccggcatccgccacgctcggcgaagtcaaggacgccttccgttatggaaggagtgcacgtgaccgcccccgtgaccaccccggcgtcggacagcttcgcgccgaacatccgccccgactgcaccgacgaactgacggcggcgctgcgccagcggatcatggtgatcgacggcgccatgggcaccgcgatccagcgggaccgccccgacgaggccggctaccgcggcgagcggttcaaggactggccgagcgatctggtcggcaacaacgacctgctcaacctgacgcagccgcagatcatcgagggcattcaccgcgagtacctcgaggcgggcgccgacatcctcgagaccaacaccttcaacgcgaacgcgatctcgctgtccgactacggcatggaggagctgagctacgaactgaactacgccggcgccgccctggcccgtaaggccgccgacgagttcagcaccccggacaagccccgctacgtcgccggggcgctggggccgacgtcgcggaccgcgtcgatctcgccggacgtcaacgatcccggggcccgcaacgtcacctacgacgagctggtcgccgcctacctcgaggcggccaacggcctggtcgacggcggtgtcgacctcctgatcgtcgagacgatcttcgacacgctgaacgccaaggccgcggtgttcgccctcgagacgctgttcgaacagcgcgggcgccgctggccggtcatcatctcgggcaccatcaccgatgcctccggccgaacgctgtccgggcaggtcaccgaggcgttctggaactcgatccggcacgccaagccgatcgcggtcgggctcaactgcgccctgggcgcgccggagatgcggccctacatcgccgaggtgtcgcgcatcgcggacaccttcgtctcctgctacccgaacgccggcctgcccaacgccttcggcgagtacgacgagtccccggagcgtcaggcctcctacatcgccgacttcaccgaggccggcctggtcaacctggtcggcggctgctgcggaaccgcgccgccgcacatcgccgagatcgccaaggtcgtcgagggtaagccgccgcgcgaggtgccgcagattccggtggccacccggctctcgggccttgagccgctcaacatcaccgacgactcgctgttcgtgaacatcggcgagcgcaccaacatcaccggctcggcccggttccgcaacctgatcaaggccgaggactacgacaccgcgctgtcggtcgccctgcagcaggtggaggtcggtgcccaggtcatcgacatcaacatggacgagggcatgatcgacggcgtcgccgcgatggaccggttcaccaggctgatcgccgccgagccggacatcagccgggtcccggtgatgatcgactcctccaagtgggaggtcatcgaggccggcctgaagaacgtgcagggcaagccgatcgtcaactcgatctctttgaaggagggcgaggagaagttcgtccgcgaggcgcggctgtgccgcaagtacggcgccgcggtcgtcgtgatggccttcgacgaacagggtcaggccgacaacctggagcgccgcaaacagatctgcgcacgcgcctaccgcgtgctgaccgaagaggtcggcttcccgcccgaggacatcatcttcgacccgaactgcttcgcgctggcgaccggcatcgaggagcacgcgacctacggcatcgacttcatcgaggcctgcgcctggatcaaggagaacctgccgggggtgcacctctccggcggcatctcgaacgtgtcgttctcgttccggggaaacaaccccgtccgcgaggcgatccactcggtgttcctgttccacgccatcaaggccggcctggacatgggcatcgtcaacgccggggcgctggtgccctacgactcgatcgaccccgagctgcgggaccgcatcgaggacgtcgtgctgaaccgccgcgaggacgcggccgaacggctgctggagatcgccgagcggttcaacaagtccgcagatgcttcggaggattcggcggcggccgagtggcgcggcctgccggtccgcgagcggatcacgcacgccttggtgaagggcatcgacgcccacgtcgacgaggacaccgaggagttgcgggccgagattgccgccgcgggagggcggccgatcgaggtgatcgagggcccgttgatggacggcatgaacgtcgtcggtgacctgttcggctcgggcaagatgtttttgccccaggtggtcaagtcggcccgggtgatgaagaaggccgtcgcctacctgctgccgttcatcgaggcggagaaggaagagtccggcgtgtccggttccaaggacaccaacggcaccatcgtgatggcgaccgtcaagggcgacgtccacgacatcggcaagaacatcgtcggggttgtcttgcagtgcaacaacttcgaggtgatcgacctcggtgtgatggtgccggcccagaagatcctcgatgctgcgaaggagcacgacgccgacatcatcgggctgtccggcctgatcaccccgtcgctggacgagatgtccaacttcgccgccgagatggaacgcgagggcctgcagatcccgctgctgatcggcggcgcgaccacctcgcgcgcccacacggccgtgaagatctcgccgcgccgttccggcccggtggtctgggtcaaggacgcctcccgctcggtgccggtcgccgccgcgctgctggacgacaagcagcgtccggcgctgctggaggccaccgagaaggactacgcgtcgctgcgggaacggcacgcccagaagaacgagcggccgatggtgacgctggagaaggcccgcgccaaccggacgccgatcgactgggacggctacacgccgccggtgcccgcgatcggtgcgggaatacgggaatttcaggactacgacctcgccgagctgcgcgagtacatcgactggcagccgttcttcaacgcctgggagatgaagggccgcttccccgacatcctcaacaacccggccaccggcgaggcggcccgcaagctctacgacgatgcccaggagatgctcgacaccctgatcgaggagaagtggctgacgcccaacgcggtgatcgggttcttcccggcgaacgcgatcggcccgggtttcgaagacatcgagctgtacaccgacgacacccgcaccgaggtgctgaccacgctgcacaacctgcgccagcagggtgagcaccgcgacggaatcccgaaccggtcgctgggcgacttcatcgcccccaaagaaacggggcaccgggactacatcggcgccttcgcggtgaccgcggggctgggcagccaggagaagatcgcggagttcaaggcggccctggacgactacagcgcgatcctgctggagtcgatcgccgaccggctggcggaggcgttcgccgaacggatgcaccagcgggtccgcaaggagttctggggctaccagcccgacgagcaactggacaacgacgcactcatcgacgagaagtaccggggaatccggcccgcgccgggctacccggcctgcccggagcacaccgagaaggtgacgttgtggaagttgatggacgtcaaggagcgcaccggcatcgagctgacggagtcgatggccatgtggcccggcgccgccgtcagcggttggtatttctcgcatccgcagtcgcagtacttcgtggtcgggcggttggcccaggaccaggtcgccgactacgcgaagcgcaagggctggacgctggccgaggccgagcgctggctggcccccaacctcggctacaaccccgaggactgagcggtacgccgccggctagacgcgcagcacggaacccaaggcggacaacgggatatgcgcctgcacggtgccgccgtccatgaaccactgcggcagaccggtggcgaagttgatcggttcgtcgtggccgacgggatagtccggcatgtacaggatcaactcgtcgggggtgatagcccaggccttgtacgccccggagtagaccttgtccggcgtccaccggtcgacgacgaacgggtaggtgcccgggtcgtgcggcggcggtgcctggttgagtgccgtctcgataaacggttgcgccagtgggggaatggcggtcagcgggtttgacgtcgtcaggtccgcgagttgtacccttcggccgcttgccatgtcgaaggtgaaggtccggtaggcgttgttgggcttgggcccgtcggcgtgataggcctcgtggaacaccgcgctgagcaggctggcatgccggaacacctcgaagttctcctcgccgtaactgtcggcggccatgctggagttggcatttcgccagttgttgaccagcgtgcgcaggtagtcgcggatcaccggtccggtggtcgggttgtcgaccaggtcgtcgggcacggcgaccttgatgtcgcggacggcgttgcgttccgacgtgaccgaggtgtggcagtactggccgtcccagtcgccgcccagctcgccgcagaacgacggtgctgacgcgtgggccttgccggtgccgggaatggttgcggccgtgagcaataccagcgccgcaaggatccgggggatcacagcagctgcactttgcttgcgcgccaacgaccgtcgaccttttccatggtcatcttgatccggctgcggtcgatgcgcgggtcgggcgcggcggtgttggtgacggtctggtcgatgaacagcagcaccacgaccttgccggtggaggcggactgaatggccgaatccaccaccacgccatgggcggtggccttgttgtcgatcagcaattgccggagcttgacactggactgggtgtacatgtccttgaactccccggtcgcaccgtcgagcacctgcttgaagttctcgtcgaccttgttggaatcgatgctggtgagcacctgcgcgtaggcgatggcggcctgctgggcctgttcaccggccgccttcacctgatgctcctgccattgccgccagcccaggaagcccgaaacggcaagggaggcagcgagtaacaacggcagcacgctgcgacgcaggtagcgccgccagggccgcttgcggcgctcgcgaccgcgacgcttgccggtgagcagttcgcccccgtcttcggcttcgtcggtttcggcctcgtcggtttgctcgccggcctgctcggcgatcgcgttctcgacgtcgtcgcccgcgtcatcggccggctcggtctcggcggccgtgtcgggcttcgggttcttctcggtggtcacgatcacgatcatctcctagggatcggctcggctggtttccggctcagtgcggcggttcgatcggcagctgcgggccgccgtaaggggtggggatggtgtagcggccccggggtgtgggatcggttcgccggcccaggtctgcccccggcggcgggccggcggtgtcgtcgccgcccggtcgcggcgcgttcttggcgccccggatggacaccgcgggatcgtcgtcgcggcagtaggtgtacatgaacggctcgtagtagtcggcggcggaggaggcgtgcgccggtgtgccgtagtcgcacacatagcgggggtagaggtcggccgtcgcccacacgccgtggtcgtgaaagacgctcgtcaccgcgtccagcaccgagccgcggtaatcggggaacagcgcgttgagcgccgggacccgcagatagagaagctgcgacatggtggccatgctgcccagcaactgcaccatggtgtcggagttgtccgcgaacagattgtcgacggccgaaagtgtttgcggcgtctgggaagtcaaccggcggtagccggcctgcatccgggcgacacctgtcagcgtgtggttgagttcggttgcggcggcgcctaatccgttgttcttgtcgctggccagattcagcacgacgcggctggtcttgatgatgctggtggtttcaggcagcaccgagtcgagcgtggagagcaggaacagaccgccgtcgacgatcgccgtcaacttcgctgggccctccttgctcaggctcagctcctttttgatcagctcgatcttgcgcggatccacctgggccagcaatccgtcggcgtcaccgagcaattgggccaggctgaccgggacggtggtgcgctcggaggtgatgaagctgccgtcgtgcagatagggcccggcgtcggaggcggcctcgaaattgatgaattgctcgccggccggcgacagcgccgacacgtgcgcgacggtgttcgccgggatgcgcaccttcgacgtgatggtggcgacggcgttgacgccgttgtcggtgatctgcagcgactcgattcgtccgatccgcaccccgcgcagcgccacatcctgattcggcagcaacccaccggattccggcaactgcacggtgacgcggtaggacgacgcgaacggcgtcacccgcaacgcgccgatcaacagataggcggtcgcgacgacgaggatcagcaccaaccccgccacggacagccagacctgctgtcgatgacccgtgcgcaccgcacggacaacgagattggcgaagccggcgacggcgcggatcatggcggcgatcccggctgcggcgggataggtccgggggcgacgtcgatctggccggggacggtgggatccggcacgacgggaacctgcggcgagttgggcccgcggccgaccacgcgctcctgcagccgccacagcgtgtacttgagggtgccgaccagcaggttgacgttgtagtggtgcggcccgtgcagcccgatgtcgccggggaagccgatgtcggggagcgatcccagcatgatcttgtccacgctgacgttcaccgaaatcgagtttcccgccgtcgatttgaccaacgccgggatcagccggttgatcgattgccagctggtgtccgggctcatcgcgacgtcgttggcggccccggcgatcgtgttcaggtcgcggatcatgctgcgcccgctggtgtcggtcccgcccagcgcggggaagcgggccagcagccgcgaggtgtcacccacctgctgggcgacctcggacagctcgctggtgttgtcggccagggccgaggtggcgggaccggcggccgtcatcagatcggtgatggtgtggttcttggcgtcgagttggtcggcgagagtggacaattgcgtcaacgcggccgagatctggtcggaccgggcatccagcgtcccgagcagctcgttggacttgcggatcaggtccccgaaggcctggccctggtcgccggtcgccttgccgaagccgttgatgatgttggtgaaattgcgcaccgcgccgccgttcaccagcaccgccgccgagctgagcaccgactcgaccgtcgcggccgccgcggtggactccaggccgatggtgtcgccgttcttcagcaggggcgcgtcgtgatcgcccggcgggggtttcagcgcgacgaacacgtcgcccagcggtgtggcggtgcgcaattcggccgtgctgccccggggcagttgcactccgtcgcggatgcgcagccgggtgagcgcggtgtagttgcgggccaccatcgattcgagctgcccgacatccgcgccggcgagtttgaccttggcgttcatcggcaggttgagcgcgttggagaacaccgcgttcagcgaataaccccccgatcccagccccggggccggaagtggcaggctggcaaggccattcgtggcgcagccggcggtggccatcgtcacagccgtcgtcacagccatcgccgcggccagcgccgtgagccttccccgcgcgcccgtcgccgtcatttctgtcccatggcggccaggccgtcgagcacataggtcagcccgaagtccgggccgaagtcctggatcgtgccggtgctgcagccgagttgtcgcaggcccatcaggttgcagatctctttggtgtactggctgtcgaacagcaaccggtcggtgaggaagcgggcgcggacgctgccgttcgcccggtcgatcatgttgtaggcgttgtcggccaccaggggggccaggtccagtagctcggccaggtcgcgccgctggtctgtcacggtcttcagcgtgtcgttgccgctgagcgcggcgtgcttgatgttgtcgcggttggcgtcgagcaggtcgccggcccgctggatcagctggtcgagtttgtgtccggtgttgccgctgccgaggtcctcgtcggccatgatctggctgacttggtggatggtggaggcgaattcgcgcagtttggtgttgttactggccacggcgtcgaacagggtgctgaggttcttgacgatcgtggtgatctgttcgcgggtggccgcgccgccgtcactggacagccgcaacgccttggacagctcgccgagggccgccttgatcttttcgccgttgccgttgaccacctcggcaccgtcgcccagcacgtcggcgatcgggccgccgccgtggccgtcgccctccagcgacttggtcaccttgtccaaaacattgaggacactgctgaattcgacgggcgtcttggtccgcggcaacccgatggtgtcgtggttacccaggacggggccgccgcggtagggcggcgtgagttcgatctgccggtcggtgaggatggaggtcgacacggtgacggcctgcgcgttggcgggaaccttgacgccgcggtcgacggtgaactcgacctcgacgtagccgcccctggggttgatcttggtgatcttgcccaccggcatgcccagcaccgccaccacattgccctcgtaaagccctgaggcgctgtcgaattgggcggtcaccgtgatcgtgtcgtcgtcggggcgcagcagccaccatccgatgccgacggcggcggcgaccacagccacgccggccaccacggccagcgccttcgtgccgagccgcgtcacttgcagtccttgaagtactggatcatgccgaactgcttggcacggccgctgatcgcgcacatccacgagtcgatcagcgggacgttgggcgcgttgaaattgatcgcgttgccgtcaccggtgaggttggccgcctcgcggaagaagatcgggctgacctgcagcaggctgtgcagcaggtcgtcgtgcgcggacaccaggccggtgaaatcgcggatgtctttgagcagcgcgtccacccccgaccggtcgtcgaccaccacccgactgagggtgtcgaccaggctggacagggatcgcatcatggcgtggaagaccgcgcgccgcgccacgaattggcccagcaggtcctggccctggtcgacgagcgcgccgatgccggcctgctggcggcgcagcgtgttggtcacctgttcggtgctgcgcagcagctgcccgagttgatcgcgccgggtcgcgatgatcgacgacagcgtgtcgatgttcgtgatcgcctgcggcacaacggccggcaggccctcgagttgcttgcccaacaccgccagcgactgggcgaaccggtcggagtcgacctgctcgaaggtggtggtggcgtcctgcaatgcggcctgcaggtcgtaggggacctcggtgtgcgccaggtcgaaggtgttgccgggcaggcgcgccgggccgttgggttccagcgccaggtagcgcgaacccaggatggtggtgacccggatctgggcccgggaatccttgccgaagctgatgttgtcgcgcaccttcagacccgcctcgacgtggtcgccgacgagcttcatgctggtgaccgtgcccaccgggatgcccgccaccacgatcgggttgccggcgcgcagcgacgccgcttgcgcaaactcggccgtgtagtgccggtatccggcgccgagcgcgtgcaccaccagcatgaccgcgatcaccgccgcgaccaccgcgacggcgacgaacccgagccaggtcttgttgtagctctccagcgggcgcttcgtcagtgccgaaagccgttgccgcacagacctgtcgagcatcgatcctgccgtggtcccggccatcaactcaaccatcgacggtgctcctgcatctcggggtgtgccaggcccggttgccgggtgtggcggcgttgatgatgatcggcacgacgtcgttgagccccggaaaaaatcccatgaagttcacgtcgcacacgtaggcgttgccgtaggcgccctggttgcccacccgggtgagccccttcaacagcagcgggatgttgtcgccgaagaaggccacctgcggttcgacgtccatgatgtgtttggtgacgcccggttggcggtcgatgaactcacgcagcgccgggtacacgtcggcggccgaggccgacagccgatcgctcagccgggccagcgaccccaccgaggccaccaggtccgggcgtcgccggtcgagttccccgaccacgctgcgggtctgggtgatgaccccgtcgaggttgtcgttctgcgccgccaggttgcccaccaccttgttcaggttggtgatcacgttgccgagcgcctggtcgcggcccgcgaaagtctgtgtgagcgtggaagtctggccgaccagggtggtcagcgacgacgtgtcgccctgcagcgaggcgatgatgcccttggtcaggttgtcggcgtcgtgcgggttgagcaagctgaacaacggttcgtagccgttgagcagcgtggtgacgtcgaaggagggttcggtgcgttccagcggaatggtgctgcccggcggaagctgcgctggattgccctccttgcccaacgacaggccgagatagcgctggccgacgatgttctggtaggtgaccgacgccagggtgtttccatacagccgctgttcggactgcaccacgaaggagaccttcgccaattttccgtccagttcgatcttttcgacccggcccacccgcaccccggccatccggacgtcgtcaccttcgcgcagcccgtacacatcgctgaacaccgccgaataccgggccgtatcgccggccacgtcgcggcgcaggctcacatacaccagccaggtcagcgtcagcgagacgatcatgaacagcgtcagcgcgatgagcgggccgcgaaacctcatttgccctccccgggtcgaggcgcgggcgacggcccgggcggatgcgccagcgacaccgtcgttccgcgggcgaccgggcccagcagcaactcggtggcctccgacgcgggtccaccggtgatcgcgcccagcatggttcgttcgtattggctccccacgggacccacgttgccgccgaacgacggccggaacgaggactggggaatccacggggccttgggcgccaccggcgcgacccacggttgctgcggttgcggtgtcgccggcgcccccggtgacgggttgtccggattggcgctcccgggcaccggcggcgacggggtaatccccggggccagtgggggattggggtcggtcaaattcggggtggggttgatcagcggcgggcccaccgcgacgaggttcccgtccgggccgatcaccgtgcccggcggcggcgccagatccttgggcggctgatagttctgtggcagcagcacgtcgggcaggtcgggccgcaccggaatcagcggtgcggtgaagcagctgggccccttcagctctccgtaatgcgggcagtcggcgcgggtgtaggtggagctgggggtgaaggtcagcatcgcgcgcatgttgcccaggttggtctgcgggttccagacctgctccatgaactggttggccaggttgtccagtttggtgaccgcgggcacgaagttgttcgacttctgcgccaacacaccgagcaccggtgtgaaatctgcggtgatcctgatcaattggtcgatgtggttgtcgaaggactgacgcgtcgtccccaccgtgtagtcggcgcccgacagcagcgacgccagctggccgcgtgtctcggcgaaggtctgcatcggctcgacggcctggtgcaacgcgtccaacagatccggcgccgtctgcgccaggccccgcgtcgcatccagcagggccgacaccgtggacgggccggtgtcggtgctgacaatcgaattgagttgatcgagaaggcgattcagttgcgccccggcgttgagcaggctgacccgccgatgatcggtagccgcccccagggcggccagaattcccaccgacctgtcatcgcggccgcgccccgcggcggcgagcagatcgcgcagcttgctgaccgtcgtctggaacaacacggtgggcagccgcttgtcctccggaatatgggcgccgtcgcggattttcgtgccgggcccgttacccaccagttgcaccgacgacacggcgaacacgttgctgggcaccactcgtgcggtcacactggccggaatcgacttggcgtagtcctctttcaggttgatgtggacatagttgggcttgccgtgggccgcggggacgacgtcgtcgaccatgccgaccagcacgccgtggtatttgacgtccgacttctgcggcaggccgtcgcccacgttgaccaggtcggccaccacccgcacgtaatcgtccagcctgccagtcgatttcaccaacatcacggtggtgagcagggcgctgaccaccagcaccgcgatgccgatgccgaacagctgccggtccgaggggccgcgtccgtccagctcaaaggaattgggcatcgtccaccgacctcgccaccggcctacccgccgaaccttgcgccggaatcgacgccccacagcgccatggtgagcagcatgttcacgatgatcaccaccgtgatgctggcccgcatgccgtgccccgcggccaccccgacgccctcgggcccgccgctcgcgtaatacccgtagtagcactggatcgtggaggcgatccacacgaagacgaccgccttgaacagcgagtagacgatgtcctggccggccagcatcagggtgaagtagtgcaggtaggacccggtcgagccgccactgccgatgctcaccacgatctgggtgcttaggtaaccgatcgccaggcatgccgcgtacagcgggacgatcgccaccaccgacgcgatcagccgggtggtcaccaagtaggggatcgggcgaatggcaatcgattccatcgcgtcgatctcctcggcgatgcgcatggatcccagctgggcggtgaagcggcagccgccctgcatcgcgaaggccagcgacgccatcagcggggccagctcgcgggtgttgaccaacgaggagacgaatccggtggccggtcccaggccgagcaggtcgaggaagttgtagccctcgatgccgaccagtgcgccgaccgtcatccccagcaccacggccacgcccgcggtgccgccgcccaccacgatcgacccgttgccccaggtgatgttcgacagcagccgcaggaactcgccgctgtactggcgcagggccagcgggacggccaccagcgcccggacgaagaagaccagcagatggccgagccggatgaccgggaccttgcccctgcggtagagccgcgccagcggcaccgagatcggcgcgaagggttggtatgccgaggccgtcacgtcacagccccgtcctgggcgacaacatgatgtagagctggctgatcgcgacattgacgatcattaacagcagaatcgcctccaccacagcggcgttcaccgagttggccacgccggtcggtccgcccttggtggacaagcctttctggctcgacacgatcgccacgatggcgccgaacacgatcgccttgagcagcgccaggatcatgtcaccggtcgtcgcgaacgacgcgaaggtggacacgaaactgcctggcgccccgttctggaagtacacgttgaacatgtagctggcgaagaatccggcgaaacacacgacgccggtgagggccacgccgatcatcaccgccgcggcgaagcgcggcaccaccaggcggcggaccaccgagacgcccatcacctccatcgcgtcggtctcttcgcgcatggttcgcgaacccaggtcggcggtgatcgccgacccgaccgccgacgccatcagcaccgcggcgaccagcgacgcgccctgccggatcacggcgagcccgctggccgcgccggccagcgaggtggcgcccacctgcccggccagcaacgcgaactggatggacagggtgacgctgatcggcagcgaaaccaggatggtgggcaacacggcggtgccggccatgaacgcgccctggcggacgaattcctgccattgaaatcgcccggtgatcaggtcgtagaagaagtactggatggtgcgcacccccagcacgaactgctcgccgaccgtcgtcagtgaggccaccgggtgacgtttgacgtagccgaccgaccagttccggatggcagcaacgccgtcgacgccgtcgagtggcgtggtcaaggtcgcggtcatcgcggcgtgaccagcggtccgttcagcaaacccatggcacaggtcattgcgtaccagctaccgcgttcatcggccctcttcccacccctgaatcctgagtgccgcgcgaacgtcgttgggcgccattgactctaactttattaaaatagtgtcaacaagccccacaagtccgcagttcattggcgtgtgctgcatcacactagcctacgtgagaggggctttcaatagtgtagagtcactcatctcagttcgtcgctggacggcgccgtggggtttgaatgtcggattgacgaaggtgatggcatgccctcagcaaatagcagctcgttgcgggaccggcgccgggccgagctgctctcgcagatccagcagaccgcccaccagcttttcgccgagcgcggcttcgaggcggtgaccaccgaggacatcgccgcggccgccgggatctcgatcagcacctatttccggtacgcgcccaccaaggagggtctgctggtcgatcccgcccgggaggtggcggccacaatcgtgggcgcgtaccgcaccaggccggcgcacgagtcggcggtcgaagcgttgatccaactgttcatcacgcatgccaaggaggtcggcgcggcgggcgacttcgatacttggcggcacgccgtcgcgaccgcgccccacctgctgcgtaagtccgtgctgatgagcgaaaccgatcacagcaacctgatccaacaggtcgcgcagcgaatgaatgtcactgcggcgcttgacattcggcccgccctgctggtgcacacgagtttggccaccgtccaattcgtcctcgacggatggctgagctcggacatcgacgagagccggccctttcacgagcaattggaagaagcgctgcgcatcacgctcgccggattcgaccggcccagcgatgccacgcccggccggcgctaaaccgccgtgactttgccggccggcgcgtgaaacaatcgctggccgtgaagaccttcgaggatctgttcgccgagctgggcgagcgcgcccgcacccggcccgccggcagcgcgacggtcgccgcgctggatggcggcgttcacgggctgggcaaaaagatcctggaggaggccggtgaggtgtggctggccgccgagcacgaatccgacgacgcgctggccggagagatcagccaattgctgtactggacgcaggtgctgatgaccgcgcgcgggctgtccctcgacgacgtgtaccggaagctgtgacgatgctgcgcgtcgcggttcccaacaagggcacgctgagcgagccggccaccgagatcctcgcggaggccggctatcggcgccgcaccgattccaaggacctgaccgtcattgatccggtcaaccaggtcgagttcttcttcctgcggcccaaagacattgccatctacgtgggttcgggcgagttggacttcggcatcaccggacgggacctggtgggtgattccgatgccccggtgcgggaacgcctggcgctgggattcgggtcgtcgagctttcgctacgccgggccggccgggcgggactggaagatcgccgatctggccggcaagcggatcgccaccgcatatcccaacctggtccgaaaagacttggcagagcgcggtattgaggccaccgtcatcagactcgacggcgcggtggagatttcggtgcagctcggcgtggccgatgccatcgccgacgtggtcgggtcggggcggaccctgagcttgcacaacctggtggccttcggtgagccgctgtgcgattccgaagcggtgctcatcgagagcgaccggggtggccaggacgacacacaggccgcacgcgatcagttggtggcgcggatccagggtgtggtgttcgggcagcaatacctgatgctcgattacgactgcccccgggcggtgctggacaaagccacggcgatcacgccggggctggagtcgcccaccatcgcgccgctggccgacgcggactgggtcgccatccgggcgctggtgccgcgccgcggcgtcaacgagatcatggacgaactggccgccatcggcgccaaggcgatcctggcgtccgacatcaggttttgccggttctgatcgcactccgtaccggccgggtgcgggccgcgtgggcatcgtgccgcccgggtcgctgtgttagcgtccggctcaggggattgcccgggttggcgaatgggccgtccctgcaccggccgccggttgttcaccctcggaggaggatccccgtgacacacgcgcttatcgtattgctggctttgctgatcggtgtcgtcgccggattgcggtcgctgacggcgccggccgtagtagcctgggccgccctcatcggttgggtcgatctgcacggcacctgggcgtcctggatggccaacatcatcacggtgatcgtcttcaccgtgcttgccgtcggtgaactggtgaacgacaagctgcccaagaccccggcccgcacggcggcgccgatcttcgcggcccggatcgtgctcggcgggctggccggggcggcgctgggcgcctggccgcattggaccttcaccgcgctcggggccggtgtcatcggcgcggtgctcggcaccctgggcggctaccacgtccgtcggcggctggtcgccgcgaccggcggcaaggacctgccgatcgcgctgctcgaagacgtggtggcgatcgcgggcgggttcgccattctcgcggcgaccgggcacgtgctgactgattatctgctgacggccgttaagtgacagcccctaactgacagtccttaagtgacaaagcatttcgacgcgatcatcgtcggcgccggccaggccggcccgccgctggccgggcggttgaccgcggccgggcagcgcgtcgccatcatcgaacgcaaactgatcggcggcacctgcgtcaacaccgggtgcattcccaccaagacgctggtcgcctcggcgcatgcggcccacctggcccgtcgcggcgcggactacggcgtcgggaccggggcggtcagcgtggacatggcgaaagtcaaggcacgcaaagacgagatcatgctgggcgaccgcaagggcgtcgaagactggttggccggcatggccggctgcaccgtggtccgcggccacgcccgcttccgggatccgcacaccctgcaggtcggcgaggacctgctgcgggccgagcgcatcttcctcaacgtcggcggccgcgcggtggtgcccgacatccccggcctggccgaggtcgacttcctcaccaacgtgtcgatcctcgaactcgacacgctgccaacacatctcgtcatcgtcggcggaagctacatcgcgctggagttcgcccagatgtaccggcgcttcggggccgcggtgaccgtggtggagcgcggcccgcggctggcctcccgcgaagacgaggacgtgtcggccgcggtgcaggaaatcctgcgggccgaaggcatcgacatcgtcgtcaacgccgacgacgtgcgaatagccaagaccggcaacggtttcgaactgaccccgcgtgacggcgccccgcccatccggggcagccacctgctgctggcggtgggccggcgacccaacaccgacgacctcgacctggcggcggccggcgtgcggaccgacgcccgcggctacatcctcgtcgacgaccagctgaagaccaacgtcgaacacatctgggcgatgggcgactgcaacggcaggggcgcgttcacgcacacctcctacaacgacttcgagatcgtcgccgccaatctgctcgacgacgatccgcgccgggtgagcgaccggatcaccacctacgcgctctacatcgacccgccgctggggcgcgccgggatgaccgtcgcgcaggtccgtgcatccgggcgcagggccctggtcgggaagcgcccgatgaccagggtgggccgggcggtggaaaagggtgagacacaaggcttcatgaaggtggtggtggacgccgacacccgggagatcctgggcgccgccatcctgggcgtcggcggcgacgaggcgatacacggcatcctggacgtcatgtccgccaaggcgccctacaccacgctgtcgcgcaccatgcacatccaccccaccgtcagcgaactgatcccgacgatgctgcaggaaatgtcgccgctggcctagccggccaggtcgacggggtcggacagagtcgaattgtcttgcgtgccaagcgtatccggccagccggggtagggcggcggggttccgtcgaacagcgggcagagctgctgatgcggacaccagtcgcacaaccgtgactgggtgggacggaaatcgcctgtccgaccagcggtttggatggcccgccagatcgccatcagggtcttctcgaagcgcagcagctcgtcgtactcgggtgagtagtccagcacctgaccgtcggccagatagatgagccgcagccgggtgggcggcacaccgcgcgaacgcaacagggccaccgcgtagaacttcatctggaacatggccttgaactcggccagggctcgtgcagccggcggcgccttgccggtcttgtagtcgaccacccgcagctcgccggtggcggcgacatcgatgcgatcgatgaatccgcgcagcagcgttccgtcggcgagttcgacctccacccgctcctcgcagcactgcgggtcgaaacgggtgggatcttccagccggtaataaccggcgagcagcgcctgcgcctcggccagcaattggccgtgctgggtgggatccaggtccgccgtcagctccggcgtcgcggcgaggagctgttcccaggcggggtccaccagcgccagggccgtctcggggccgcgctgggcggccggcagctcgtacagctgctgcagagcggcatgcaccagcgagccgcgcagctgggcgggcgacggcgcctcgggcagccggtcgatggcccggaaccggtacagcagcgggcactgcttgaagtccgccgcccgggacggcgacagcgccgggcgcgacacctggcccgccggccgcgccgccgactgccgtgcctccggctggacgatcatgttcggcagcctaggaccgggcgccgacaacccccaagcaccggttgcggcgagtcggctggcacgctggaccgcgtgtccgttaccggcccgttcaccgtgggtgagcgtgtgcagctcaccgacgccaagggtcggcactacacgatggtgctcgccgccggcgccgagttccacacccatcgcgggtccatcccccacgacgcggtgatcgggctcgagcagggcagcgtggtcaagtccagcaacggcgccgtctacctggtgatgcggccgctgctgatcgactacgtgatgtcgatgccgcgcgggccgcaggtgatctaccccaaggacgccgcccagatcgtgcacgagggcgacatcttcccgggggcgcgggtgctggaggccggggccggctcgggtgcgctgacctgctcgttgctgcgcgcggtcggaccccaggggcgggtgatctcctacgaacagcgcgccgaccatgccgaacacgcccagcgcaacgtgtcggtgttcttcgggggcgaggcaccggacaactggcaactgatcgtcgacgacgtcgccgactcggatctgccggaccggtccatcgaccgcgccgtgctggacatgctggcgccgtgggaggtgctggagtcggtcgcgcggctgctgatccccggcggggtgttgatgatctacgtggccacggtcacccagctgtcgcgggccgtcgaggcggtacgggcccagcagtgctggaccgaaccacgctcctgggaaaccttgcaacggggttggaacgtcgtcggtctcgcggtgcggccgcagcattcgatgcgcgggcacaccgcctttttgatcttcacccggcggctggcgcccggcgtcatcgcgccggcgccgttgggccgcaaacgcgaaggccgcgacggctgatccgacggcccggctagcccaagtcgtcgctgcgaaccagcgagcgccgcaccgagagcagctcgaactccggatgcgcggccaccagccgttcggccgcgtccaggacgtcgacggcatggccgcggtcgccggacaccgtggcgacgccgatgcccgcccgtcgatacaagtcgtgcgaacccgtctcggcggccgagacgctgaacttgcgctgcaactccgcgacgacgggacggatgaccgaccgcttctgcttgagcgagcggacgtcgcccagcaagacgtcgaactcgagccagccgacccacatcccgcggctcacccgggcggggtttgggtgggcgcgggttccggcggcggggcgggttcggccggcggtgccggggcccccgggccctcgggagccgcagacgtcggcgcctgcggcgacttgccaagggccaacagcgtttcggcggtgtgccgggacagctgccaaccgccctggaagggagtgaactccatggggaaggtgaagttggcgttgttgggctggttggtgtggacggcgatgctggccttcacgttcgacgggttctggtccgaccacgcgatgtcattcgcggtgaaagtcatgggtaggtagccgttgtcgcgcaaggcattggtgaacttgtccagcgtggccgcgctctccggcgtcgcgccctcgaccagactcaccttgttggcgcccgggacattcgggtcggccagccggccgagcacatcggtgagggcttcggggggcggcaggggagtcgtggccggcggcgcgatcggagtcgacgtggcgggcggcagcgacgaggcggccgacgtctcgcttctcgggtgcgacgtcgaacacgccgccagtccgaccgccgccagcgcggtggcggcgctcaacgctacggacagtgctcggtgcatccagtcggtcggccggctaggcggctctggccgctgcgcggatcggggaactcgctaaggtcgggccgatgggtgcaaccgaagtcacacctgcggcgccggcgccgacggctgcgaccggagccgagcccgtggcgaggctttttgcggtcacggcgttcctcccggccctttcgatcatcaggattagtggccgagattaccagcgtgacgaaaatcttaacttttcgtgggtatttgactacccacatcaatcggcaatcgccggtagctttgaagtatccgccgcgccaattcggtgtgggaaaggagcgcaagatgggtagctcagagcgttctgaagctttcgggaccccccgcgaatcagacatgtccagcggcgacgaggccgagctggaggaactgcgtcgcgaggcggcgatgctgcgcgagcaactcgagcacgccgtcggctcgcacggcggcgcccgctccgcgcgtgacgtgcatcagctggaggcccgcatcgactcccttgcggcccggaactcgaagctgatggagaccctcaaagaggcccgtcaacagctgctggccctgcgcgaggaagtcgaccggctcgggcagccgcccagcggctacggcgtcctgctcgccacgcacgaggacgacaccgtcgacgtgttcacctcgggccgcaagatgcggctgacctgctcgccgaacatcgatgtttcgttgctgcgcaagggccaaacggttcgtctcaacgaggcgctgacggtggtggaagccggcaccttcgaatcggtcggcgagatctccaccctgcgcgagctgttggccgacgggcaccgggccctggtggtcggccacgccgacgaggagcgcatcgtgtggctggccgagccgctggtcgccgacaacctgcccgacggtcacccggacgccctcaacgacgacacccggccgcgcaagctgcggcccggcgactcgctgctggtggacaccaaggccggctatgccttcgagcgcatccccaaggccgaggtcgaggacctggtgctcgaggaggtccccgacgtcagctacgaggacatcggtggcctgacccgccagatcgagcagatccgtgacgccgtcgagctgccgttcctgcacaaggagctctaccgcgagtacgcgctgcggccacccaaaggcgtgctgctctacggcccgcccggttgcggtaagacgttgatcgccaaggcggtggcgaactcgctggccaagaagatggccgaggtgcgcggcgacgacgcccgcgaagccaagtcgtacttcctcaacatcaagggccccgagctgctcaacaagttcgtcggcgagaccgagcggcacatccggctgatcttccagcgcgcccgcgagaaggcctccgagggcacgccggtgatcgtgttcttcgacgagatggactccatcttccgcacccgcggcaccggggtcagctcggacgtcgagacgacggtggtcccgcagctgctgtccgagatcgacggcgtggaggggctcgagaacgtcatcgtgatcggcgcctccaaccgcgaggacatgatcgacccggccatcctgcggcccggccgcctcgacgtgaagatcaagatcgagcgcccggatgccgaagcggcgcaagatatcttctcgaagtacctgaccgaggagctgccgctgcacgccgacgacctggccgagttcggcggcgaccgcaccgcctgcatcaaggcgatgatcgagaaggtcgtcgagcggatgtacgccgagatcgacgacaaccggttcctggaggtcacctacgccaacggcgacaaggaagtcatgtacttcaaggacttcaactccggggcgatgatccagaacgtcgtcgaccgcgcgaagaagaacgcgatcaagtcggtgctggagaccggccagccgggtctgcgcatccagcacctgctcgactcgatcgtcgacgagttcgccgagaacgaggacctgcccaacaccaccaaccccgatgactgggcgcggatttcgggcaagaagggcgagcggatcgtctacatccgcaccctggtcaccggcaagagctcgagcgcgtcgcgggccatcgacaccgagtccaacctgggccagtacctgtagcggtcgcgggtgccggctgccggctccgcttccgcgacactgcaactacgcacacgacacgccgtggcgggtgtgcgtagttgcagtctcgtgctcgtgggccctgcccgccgtcaggccgtcaccagcgaatagctgttggtcaggtcgtcctgcagcacccgcgcgggccggctggtggtgtccacccgcagctcgctggtgagcacccgaggttggtaactccacccggcgggcaggtcgaggcggccggcgaggccgggtagatccgctcgcgacaacgtcgggtcggacacctggctccaggtctgcatcacccagtgctggttctcggggtcgatcagctcgtaaatctcctggcccgcgtcgaagacgaagacggtgtggcgattgaccgtgttggggatgcagggcgcgggattcatcgacgacaacagcacggtggcctgctggatcatctcgatgccgccgaaggttttggtgatccgggggccttgcggctgcttctcgatgccgttcatcagccagtagcgcggaccgttgagcaacgccatggccgccccgtgctccttggcgatcgcgtgcgggtcgagcgccgaccacagctcggccggacagtcgttgagcggaaagctgttgtaaaccgttgcctgcgggcccgcctcacccggagtgacgagcaggacttcgccgtaacgcttccccgccaggtccagggcatgtttcccgacggcgccatcggatccgggtgcggacacagggtgaaattaatcactggtgtcggtgccgtcaacaagcagcgtcccgccccgctgcgcggggcgcatcgtcgtccggcggggtttgatgggccggctcctcccgccccgctgcgcggggcgcatcgtcgtccggcctacgcttaggtcatgcaacggattatcgggacggaggtcgaatacggcatttcatcgccatcggacccgactgccaacccgatcctcacgtcgacgcaggcggtgttggcgtacgcggccgcagcgggcatccagcgcgccaagcgcacccgctgggactacgaggtggagtcgccgctgcgcgacgcccgcggtttcgacctgagccgctcggccggcccaccgccggtggtggacgccgacgaggtcggcgccgccaacatgatcctcaccaacggggcgcggctctacgtcgaccacgcccacccggaatactccgcgcccgaatgcaccgacccgctcgacgcggtgatctgggacaaggccggcgagcgggtgatggaggccgccgcccggcacgtcgccagcgtgcccggcgccgccaaacttcagctctacaagaacaacgtcgacggcaagggcgcctcttacggcgcgcacgaaaactatctgatgtcgcggcagacgccgttttccgcgatcatcgccgggctcaccccgttcctggtgtcccgtcaggtggtcaccggctccgggcgggtcggcatcgggccctccggtgacgagcccggcttccagctgtcccagcgctcggactacatcgaggtcgaagtcggcctggagaccacgctcaaacgcggcatcatcaacacccgcgacgagccgcacgccgacgccgaccggtaccggcggctgcacgtcatcatcggcgacgccaacctggccgagacgtcgacctatctgaagctgggcaccacggccctggtgctcgacctgatcgaggaaggcccggcgcacggcatcgacctcagcgacctggccctggcgcggccggtgcacgcggtccacgcgatcagccgcgacccgtcgctgcgcaccgccgtggcgctggccgacggccgcgagatgaccgggcttgcgctgcaacgggtttacctcgaccgggtggccaagctggtcgacagccgcgaccccggtccgcgggcggccgacatcgtgcagacctgggcgcacgtgctcgaccagctggagcgcgacccgatggaatgcgccgagctgctggactggcccgccaagctgcgcctgctcgaaggattccgccagcgggagaacctgagctggtcggcgccgcggctgcacctggtcgacctgcagtactccgacgtccgactgggcaagggcctctacaaccggctggtggcgcgcggctcgatgaagcggctggtgtccgaacaccaggtgctcgaagcggtggacaatccgcccaccgacacccgcgcctacttccggggcgaatgcctgcgccggttcggcgccgacatcgccgcggccagctgggattcggtgattttcgacctgggcggcgattcgctggtccgcattccgacgctggagccgctgcgcggcagcaaggcgcatgtcggagcgttattggactcggtggatagcgccgccgagctggtcgaacaactcaccagctagacgccggttcaggcgggcaacgtcggagttgaccggtagggtagagaagaccaacgggcagcgtggcttggcaatcgaactcgataattgaacaagccactcaacaggcccagacgaagcaggaggcggcgatggctcaggagcagaccaagcgtggcggtggcggcgacgacgaggacgacttcgccagcagcacggccgcgggccaagagcgccgggagaagctggccgaggacaccgacgatctgctggacgaaatcgacgacgttctggaggagaacgccgaggacttcgtccgggcatacgtccaaaagggcggccagtgacctggcagttccctgatcgcctgtccaccaattccgcacttccgggccccgcattctccggacaacccgccgtagatctgtcgtcattcgccgacttcctgcgccgccaggcgccggagttgctgccggcggccctcggcggggcgcagtccggcccggcttcgtcgagcggcggcacgggtcagctgccgcacgggaccaccatcgtcgcgctgaaataccccggcggcgtggtgctcgcgggcgaccggcgttcgacgcagggaaacatgatcgccgggcgcgacgtcaagaaggtgtacatcaccgatgactacaccgccaccggcatcgccggcaccgccgccatcgccgtggagttcgcccggctgtatgccgtggaactcgagcactacgagaagctcgaaggcgtgccgctcacgtttgccggcaaggtcaaccggctggccatcatggtgcgcggaaacctcgccgccgcgatgcagggactggtggcgttgccgctgctggccggctacgacatcgacgcgcccgacccggaaggcgccggccgcatcgtgtcgttcgacgccgccggcggctggaacctggaagaggagggctaccagtcggtggggtcgggctcgatcttcgccaagtcgtcgatgaagaagttgtactcacaggtcgtcgacgccgactccgcggtgcgcgtcgcgatcgaggcgctctacgacgccgccgacgacgactccgcgaccggcggaccggatctggtccgcggcatctatcccaccgcggtcaccatcggcgccgagggtgcgctcgaggtgccggagagccgcatcgccgagctggcccgcgaggtgatccaaagccgttcgcgggcagacactttcggccccgacgccgcgggtggtgacaagtgagcttcccgtatttcatctcgcccgagcaggcgatgcgcgagcgcagcgagctcgcgcgcaagggcatcgcccggggtaagagcgtggtcgcgctggtctacgccgggggtgtgctcttcgtcgccgagaacccgtcgcggtcgttgcagaagatcagcgaactctacgaccgggtgggcttcgccgcggcgggcaagttcaacgaattcgacaatctgcgccgcggcggcatccaattcgccgacacccgcggttacgcctacgaccgccgcgacgtgaccgggcggcaactggccaacgtgtacgcgcagacgctgggcaccatcttcaccgagcaggccaagccctacgaggtggaactgtgcgtcgccgaggtcgcgcactacggcgagacgaaaccgcctgagctgtaccggatcacctatgacgggtcgatcgccgacgagccgcatttcgtggtcatgggcggcaccaccgagccgatcaccaccgcgctcaaggattcctacgccgagaacgccaacctgcgcgaggccacccgcatcgcggtgcgggcgttgcgggccggcagcgaatcctccaacggcgaccagtccgccctggacgtcggcagcctggaagtcgccatcctggatgtcaaccggccccgccgggcgttccgccggatcaaccggcccacgctggagaatttgctgcgcgaactcgactcgaacggttcggacggcaacggcgacgcgccggagctcaacggcggctcctccgactagcgccccttcgcccgcacccgaaaacgccgcccgacaccgccgccggaaaccgcgcccggaaacttcgtcacaccgataggcgcggcttgcccaccgccgcggtcggacaaccagtacgctcgattacgtgcagcggcgaatcatgggcatcgagaccgagttcggggtcacgtgcacattccatgggcatcgccggctcagcccggacgaggtggcccgctacctgttccgccgcgtcgtgtcctggggccgcagttccaacgtcttcctgcggaacggcgcccggctctacctcgacgtgggcagccaccccgagtacgccaccgccgaatgcgacaacctggtgcagctggtgacccacgaccgcgccggggaatgggtgctcgaggacctgctcgtcgatgccgagcagcggctggccgacgagggcatcggcggcgacatctacctgttcaagaacaacaccgactcggcgggcaactcctacggctgccacgagaactacctgatcgtgcgggccggcgagttctcccggatctccgatgtactgctgccgttcctggtcacccgccagctgatctgcggggccggcaaggtgctgcagacgccgaaggccgcgacgttctgcctttcccaacgcgccgagcacatttgggagggcgtctccagcgccaccacccgcagccgcccgatcatcaacacccgcgacgagccgcacgccgacgccgagaaataccggcggctgcacgtaatcgtcggcgactccaacatgtgcgaaaccaccaccatgctcaaggtgggcaccgccgcgctggtgctggagatgatcgaggccggcgtcccgttccgggacttctcgctggacaacccgatccgtgcgatccgcgaggtcagccacgacatcaccggccggcggccggtccggctggccggggggcgtcaggccagcgcgctggacatccagcgcgagtactacagccgcgccgtcgaacacctgcagacccgggagcccaacgcccagatcgaacagatcgtcgacctgtggggccgccaactcgacgcggtcgaaagccaggacttcgccaaggtggacaccgagatcgactgggtgatcaagcgcaagctgttccagcgctaccaggaccgctacaacatggagctgtccgacccgaagatcgcccagctggacctggcctatcacgacatcaagcgcggccgcggcgtcttcgatctgctgcagcgcaaggggctcgccgcccgggtcaccaccgacgaggacatcgccgaggcggtcgacacgccgccgcagaccacccgggcgcggctgcgcggcgagttcatcagcgccgcccaggccgccggccgcgacttcaccgtcgactgggtgcacctcaagctcaacgaccaggcgcagcggaccgtgctgtgcaaggatccgttccgggccgtcgacgagcgggtcaagcggctgatcgcgagcatgtagcgacgcgtgcgtcgctgcaagcgccgggtgctgaccatcgaataacctggtgccgatggcgacgtcaaaagtcgaacggctggtgaatctggtcattgccctgctgtccacccgcggctacatcacggcagaaaagatcaggtcgagcgtggcgggttactcggagagcgtcagcgccgaggcgttctcccgcatgttcgagcgggacaagaacgagctgcgcgacctgggcatcccgctggaggtggggcgggtctcgccgatggaccccaccgagggctaccgcatcaaccgcgacgcctatgcgctcgcgccggtcgacctgaccccggacgaggcggcggcggtggcggtggccacccagctgtgggagtcgcccgaactgatcaccgcgacccagggcgcgctgctcaagctgcgcgcggccggcgtcgacgtcgaccccctggatgacggggcgccggtcgccatcgcctccccggccggagtgcccggactgcgcggctcggaagaagtgctcggaatcctgttgtccgccatcgactcccgtcaggccgtgcagtttccgcaccggccgtcgcgggccgagccgtacgccacccgcaccgtcgagccctggggcgtggtcacccagaagggccgctggtatttggtgggccacgaccgcgaccgcgacgccacccgcaccttccggctgtcccggatcggaccgggcgtcaccccgatcggcccgcccggcgcggtcaccgtgccggacggcgtcgacctgcgcaggatcgtcgcccagaccgtcaccgacgtgtccgcgacgccggccggcgggcaggcccgggtgtgggtggccgacgggcgggcgaccgcgctgcgtcgggccgggcggcccgtcggcacccggcaactgggcggccgcgacggcgaggtgatcgagctggacatccgcgccaccgaccaactcgcccgcgacatcgccgggtacggcgccgacgcggtggtgctcgagccgcagtcgctgcgcgacgacgtgctggcccggctgcgcgcgcatgccggtgccgatgccgtcggcgccggccggcccggcggccgcgggggagtgtcggcatgacgcccatctccacccgtctggtccggctgctcaacatggtcccgtatttccaggccaacccgcgggtcacccgggccaaggccgccgccgacctcggggtgtcggccaagcagctcgaggaggacctcaaccagctctggatgtgcggtctgcccggctatttcccgggcgacctcatcgacttcgagttctccggcgacaccatcgaggtgaccttctccgccggcatcgaccgcccgctgcggctcacctcgccggaggccaccggcctgctggtggcgttgcgggcgctggccgacatccccggcgtcgtcgaccccgaagcggcgcgcagcgcgatcgccaagatcgagggcgccgccggagccgtcgggcacgacaccacccaggcggcgaccgccgtcgatgaacccgctcccgcggagagccgggccgccgccgcggtgcgtgcggccgtgcagtcccgacacgcgctggccatcgattactactctgcctcgcacgacacgctgaccagccgggtcgtcgaccccatccgggtgctgctgatcggcgggcacagctacctggaggcctggtcccgggaggccgagggagtccggctgttccgcttcgaccggatcgtggaggccagcgagctcgacgagccggccgcgccaccggaaccggtgctgcacgcgccgcccgacacctcgctgttcgacggggacccgtcgctgccgtcggccacgctgcgggtggcgccgcacgcgtcctggatgttcgagtactacccgatgcgcgacgtgcgcgagctgcccgacggctcctgcgaggcggtgatgacctacgcctccgaagattggatgacgcggctggtgctgggcctgggatccggcgtgcaggtgctggcgccgcactcgctggcgcagcgggtgcgcgaggccgcggcggccgccctcgcggcgtatgaggccctgagctgagaaaatccgggacgtcccgcccggcgccggcgcggcgcgggcccaccgccagttcacgtcactgcggtaacatcgggtgaacgtctggaggtaatcaaagtgggcagtcttagtccgtggcactgggcgatcctcgcggtcgtggtgatcttgctgttcggtgccaagaagctccccgacgcggcgcgttcgttgggcaagtcgatgcggatcttcaagtccgaactgcgcgagatgcagagcgagaacaagacggaaacgtcggcgctgggggcgcagagcgagtcctccgcggccaaccccacgcccgtgcagtcgcagcgcgtcgaccctccggcgcccagcgagcaggggcacagcgaagcacgcccggcgtcgtagcccgccgtcccgtcgcggtgcccgagcgcccctgaccaagctccgaccgagcatcgtgaaagcattcaaggtttcagcgcgcacatccggcctgctgaagcgtctcaatccgcgcaacagacgcagccgcaccaatccggacgcgaccatgtcgctggtcgaccacctgaccgagctgcgcacccggctgctgatctcgctggccgcaatcgcgctgaccactatcttcgggttcttctggtactcgcatgcgatcttcgggctggaaagcctcggcgagtggctgcgccatccctactgcgcgctgccgcagtcggcgcgggcggagatcagcgccaacgggcaatgccggctgctggccacggcgccgttcgaccagttcatgctgcggctcaaggtggggctgacggccggggtggtgctggcctgtccggtgtggttctaccagttgtgggcgttcatcacgccggggctgtaccagaaggagcgccgcttcgcgatcgcgttcgtgatcccggccgtggcgctgttcgtggccggcgcggtgctggcctacttcgtgctgtccaaggcgctgggctttttgctgacggtcggcagcgacgtgcaggtgaccgccctgtcgggggaccggtatttcggcttcctgatcaacctgctgatcgttttcggggtgagtttcgaattcccgctgctgatcgtcatgctcaacaccatcggcgtgctgacctacccgaggctcaaggcgtggcggcgcggattgatcttcgccatgttcgtgttcgccgcgatcttcacgcccggctccgatcccttttcgatgacggcgctgggcgtggccttgtcggtgctgctcgagttcgccatccagatcgcccggctgcacgacaagcgcaaggccaaacgcgaagcccaggccgtgattcccgacgaccaagcctcggtcatcgaaccgcccacggccataccggagccgtcgctgtcggccggccagcatgacgatgtcacctgacccgtcggcacccgacgccgcgaccgaactggtcgagctcacccggttcagctccgaactgccctttgcgctcgacggctttcagcggcgggcctgcgcggcgctggaacgcggacacggcgtgctggtctgcgcgccgaccggggccggcaagaccgtggtcggcgaattcgcggtgcacctggccctggcggccggcggcaaatgcttctacaccacgccgctgaaggcgctgagcaaccagaagcacaccgatctgaccgcccgctacggccgcgaccgcatcggcctgctcaccggggacatgtcggtgaacgcggatgcgcccgtcgtggtgatgaccaccgaggtgctacgcaacatgctgtacgcggattcacctgcgctgcaagggctttcgtatgtggtgatggacgaggtgcatttcctggccgaccggatgcggggcccggtgtgggaggaggtcatcctgcacctgcccgacgaggtgcgggtggtcagcctgtcggcgacggtcagcaacgccgaggagttcggcggctggatccagaccgtgcgcggtgacaccacggtggtggtcgacgagcaccggccggtgccgctgtggcagcacgtgctggtgggcaagcgactgttcgacctgttcgactaccgcaacgccgaagcacccgggcagccgggcgcgggccgcgagccgcgggtcaacccggatctgttgcgccacatcgcgcatcgccgcgaagccgatcggctctcggattggcaaccgcgccgcggcgccggacgcggccgtccacccgcccgggccggacggccgcgcttctaccggaccccggggcgcccggacgtgatcgccaccctggacgccgaggggctgctgccggcgatcaccttcgtgttctcccgggccggttgtgacgccgccgtccagcaatgcctgcgttcgccgctgcagctgaccactcaggaggagcgggtccagatcgccgaggtgatcgagcaccggtgcggcgatctcgccgacgccgacctggcggtgctcggctactacgagtggcgcgaggggctgctgcgtggtttggccgcccaccacgccggcatgctgcccgccttccggcacacggtcgaggagttgttcaccgcgggcctggtcaaggcggtgttcgccaccgagacgctggcgctcggcatcaacatgccggcccgcacggtggtgctcgaacggctggtcaagttcaacggcgagcagcacgtggcgctgacaccgggggagtacacccagttgaccggccgcgccgggcggcgcggcatcgatgtcgagggccacgcggtggtgctgtggaatcccaccgaggaaaccaccgagccgtccgcggtggccgggctggcctccacccgcaccttcccgctgcgcagctcgttcgccccgtcctacaacatgacgatcaacctggtccagcagatgggccccgagcaggcacatcggctgctggagcagtcgttcgcgcagtaccaggccgaccgctcggtggtcggcctggtgcggggcatcgagcggggccaggcgatgctcgacgagatcgccgccgagctgggtgggcccaaggcgccgattctggagtacgcgcggatgcgggcccggatctcggagatggaacgcgcgcaaacccgtgcgtcgcggctgcaccgacggcaggcggccagcgatgcgctggccgcgctgcgccgcggcgacatcatcaacatcgcccacggccgccgcggcgggctggcggtggtcctggaatcggcccgcgacagctccgatccgcggccgttggtgctgaccgaaaaccgttgggctggacggatttcctcggccgactattcgggcaactcggcaccggtcggttcgatgccgttgccgaagcgggtcgagcaccgccaaccgcgggtccggcgtgacctggcgtcggcgctgcggtcggcggccgccgggctgagcattccggccaagcgtcgccgcggggactccgacgaggggttccacgacccggagctggcgtcgctgcgcgaacagctgcgccggcatccgtcgcaccacacgccgggcctcgaggcgcaggtccggcaggccgagcgttacctgcggatcgaacgcgacaacgcgcaactggagaaaaaggttgccacggctaccaattcgctggcccggaccttcgaccggatcgtcgggctgctcaccgagcgtggcttcatcgaacgccgcgacggcgatccccgggtcaccgacgacggccggttgctggcccgcatctacagcgagagcgacctgctggtcgccgaatgcctgcgcaccggcgcctggtcggggctgaagccggccgagctggcggcggtcgtgtcgtcggtgctctacgagagccggggcggcgagggcccgggtaccgcgttcgcggccgaggcgccgacgtagccgttgcggcaggcgctgctgcagacgtcgaggctgtcgtcggcgctgcgcgccgacgagcagacgcaccggatcgcgccgagtcgcgagcccgacgacggcttcgtcgccgtcatctaccgctgggcgcggaccgcggacctggcggcggccctggcggccgccgaaccggccggcaccgggtcgcccctgctggcgggggatttcgtgcgctggtgccgccaggtgctcgacctgctcgaccaggtgcgcaacgccgccccggaccccgagctgcgggctaccgccaagcgggcgatcaacgacattcggcgcggcgtcgtcgcagttgacgccgggtaggctaggccggagctaccgttaagcgccgagagttcatgccgagatacaaggggctgaggagaaagatgagcggaccgcagggatcggaccagcagtggcaaccgcccggtcaaggtcaaggtagcgaccactcgtcagacccgacccaggtggcgccgacctggcaggaccacgccacccaggaggcgtcctggcaggccccggcctacacgccgccggccgagtacccgcagtatcagcagccgggcgagcaggcctatccgcagccgtacccgcaacagcagggctacgcccagcccgggcagtacggtcaatacggccagcccggccaatacggccagcccgggcagtacgcccagccgggccagtacggccaacccggccagtatccacagccgggccagtatccgcagccgggccagtacgggcaatacggccagccgggtcagtacccgcagcagtaccagccctatgagcagcccggcaagaagcgccccgtcgggctgatcgccggggtggccggcgggatcgcgttgttgctcatcgccgtcgtgctggtgctgggtttctggcagcccgggttcttcgtcaccaccaagctggacgtcaacaaggcgcaggccggggttcagcaggtgctgtccgacgagaccaacggctacggagcgaagaacgtcaaggacgtcaagtgcaaccacggccagaacccgacggtcaagaagggcgccacgttcgactgtgacgtcagcatcgacggcgcgcccaagcacgtgacggtgaccttccaggacaacaagggcacctacgaggtgggccgcccccagtgaccggttagccgggcagcgcgtcgagcgctttctgcagtcgggcgatcgacgagccgacgccgagctcggtggccagctcggcggtgcggtgcggatcggcggcgaccagcggcactgcatcgctgggcgtcgacagcttgacgggcgcatcggtggccacccgcaccaccgcgcccgccgcctcgatgtagtccagcgcccccagcagcttggcccgcaggcccttggccatcttcgatttcgggtcgtgggcggcggccagcacccgctccagcgaaccgtgctgggccagcagggtcgcggcggtcttctcgccgacgcccggaacacccggcaggccgtcggaggggtcaccgcgcagcagcgcgagttcggcgtaggccggcccggcccggtcgaccggcacgccgtagtgttcggccacctcgacggggccgaacagggtggctttgctcaggccgcggccgaggtaaagcacccgcaccggcacgggatcgtcggacaccacctgcagcaggtcgcgatcgccgctgaccaccaccaccgggtcgtcgcgctcgcgggccgccaaggtgcccagcacgtcgtcggcctcgaatccctcggccccggccgtcgggatcccgtacgcctcaaggagttcggcgatcatgtcgatctggggcgtcagatcgtccggcacctcctcgacgtccggctcgcccgccggctccgcctcgggcacccggtgggccttgtaggacgggaccaggtccacccggaattgcgggcgccagtccaggtccaggcagacgacgagacggctgggccgttgctgggtgatcaccacggcgagcgaatcgaggaatccgcgtaccgcgtttaccggccggccgtcgggggcggtgatcgaggacggcaccccgaaataggagcggaaccacatgctggcgccgtcgagcagcaccagtggcaatcgcatgccggttatcttgtcacgccgcgtgttgccaggccgtcgagcgtcgagttgttgcggcccgttctcgcttaccttctagcgctggatgcaacagcctctagctgaggggttgttgatgaggtcgtcgcggtatgccgttgtgggtcgtcggttctgggaattggtgcgggccggaatgtctgcggatgacgctggggtggctgtcggcgtgtcgatggccgcagggcggctctggtttgctgatgctggcggagtgagaccacgattcgttgaccagtccatcccgcgacggcgtcctcggttgacggtggaggaacgcgaggagatccaagacggtgtggctcgcagcgagtccatccgtgtgatcgctcgccgactgggccggcatccgtcgacggtgatgcgtgagatcgagcgcaacgcgatctgtcgtggccggtatcgggcgcggtatcgattcggggtgcgctggcgtggtggtcacgatccccggccgcgatatcgcgccagcttggcgcacacgcgtgcgcacgttaaggcgcgccgttcgcggcccggcaagctggcgaccaatcagctgctccacgacgaggtacagacgcggttgaatgagcagcacagcccgcagcagatcgcttggcggctgcggcgcgactttcccgacgatgcggagatgtgggtgtctcaagagacgatctatcaagcgatttacgttcagggcaaagggaatttgcgacgtgagttgcacacctgcttgcgtaccgggcgggccctgcgcaagcctcggcgtcgtcctggtgagcgtcgcggacacctgcgcgacatggtcaacatcagcgagcgcccccctgaggtcgccgaccgcgccgtgcccggacactgggaaggcgatctcatcctgggtagcaccgcgtcgggttcggcgatcggcacggtggtcgaacgaacgacgcggttcgtgatgctgctacacctgcccgacgggcatggcgccgaggcggtgcaggaggccatcgtcgccaagatggccggactgccggcgaccctgcgccagaccctgacgtgggaccagggcaaggagatggccaaccacgccgcgatcgcagcggccaccgaactggacatctacttctgcgatccacactcgccgtggcagcgtggcaccaacgagaacaccaacgggctgcttcgccagtactttgccaagggcaccgacctctcggcgttcccggccgactatctcgactacgtggcatccaaactcaaccgcaggccacgacagacactcgactggaaaacaccagccgaagccctcgatgaattactctgcaaaccgttcacaccaccggctgttgcttagagcgctagaaagcgcccctcgaaatcgcccaacaagtccacggtcggcgcgcaggttagcctggctgccatggaatcccaccgtttcgacgcggacgtgtatgcgcgccggctggcggcggccgcctcggcgaccgccgccgccgggctgggcggcctggtgatcacgccggggtatgacctgcgctacctggtcgggtcgcgggcgcagaccttggagcggttcaccgccctggtgttgcccgcctccggtgagccgaccgtcgtggtgccgcggctggaggtggcctcgctgaaggggtcggcgatcgccgaactcggtctgccggtgcgggattgggtcgacggtgagaacccctacgaactggtggccgcggcgttgggcggggcgcccgccgcgaccgccgtcaccgactccatgccggcgctgcatctgctgccgctggccggcgtgctcggcgtgctgccggtgctggccaccgacgtgttgcgcggcctgcggatggtcaaggaagagtgcgaggtcgacgccttgcggaaggctggcgcggccatcgaccgggtgcacgcccgggtgccgtcgtttctgataccgggccgcaccgaggctgacgtggccgccgatatcgccgaagccattgtggccgaagggcattcggaggtggccttcatcatcgtcggctccggcccgcacggcgccgacccgcaccacgggtattcggatcgcgagctgcaggtgggagacatcgtcgtcgtcgacatcgggggctcctacgagccgggctatcattcggattcgacccgcacctacagcatcggggagccgagtcccgaagtggcccaacagtattcgattctgcagcgcgctcagcgggcggcctgtgatgcggtccggcccggtgtgacggccgagcaggtcgctgctgccgcccgtgacgtgctggccgccgcgggactcgcggagtatttcgtgcaccgcacggggcacggcatcgggctgtcggtgcacgaagagccttacatcgttgcgggaaacgacctgccgctcgccgcgggcatggccttctccatcgagccgggcatctatttcccggggcggtggggcgctcgcatcgaggacatcgtggtcgtgacggacgacggcgccctggctgtcaacaagcggccgcacgaactgatcgtggtgccggtgccgtagcgctgtgcatgaacgacttgtggcgttgagccgccgcggttagcttggcggagcgatcattgggtgagtagcggcgacgcgcgggcttgagcgaaaattccgcacgtggctcccttggcggttgatccggaggcgatgtatgccgccggcagcgccgtggcggccatcggcgattcgttggcggcgaacctgacaatcttgacggccggcttttcggcccacacgggtgttgaccgtgccggcgaggtgttcggcctggggtatcaagactcggccgagtcgatgttgaaggcggcggccggcgtcgtcaacgcgtgccggaaatgcggggcgctgatccagcaaggcgcgtcgaactattcggcggccgaagcggcctcgacactcggcggcggaagcggcgctttgccggcggcgtccgcgcccgctgaccttgccgcgcccgggcccccggggacctggggtaagggagggccgccgccactgctgtgggcggtcatacaggcgctcgtctccgaggtgtggcccgacggagacgtggcgggcctgcacgcggccgcatcccgttggcacggcttcgccgcggcaatgaacggggtgcagggaaccctcaacgcgtccaaggcgctgttcgacagtcaacacattcccgaaggcgagaagatcgatcacgctctggccgaaataggcgctgccgcagcggctatcggtcagcagtgtgacgccctggcccgcaccgtcgacgaattcgcggaccgggccggccacgcgcaacaggcgatccgggatctgctgcatcggatcgaagcgctcggcgacatcggtcacgacatcatgctcatcatcgacggcgacgcgtgggacgagatccaaaagatcgcccgggacgtcaacgccgtgctgcagcatctcgggcaggaagcccgcgccttcgagcaggagatcaggctgctcatgcaagcggccgatcgcgagatcgtcacctgccagaagtatgcgcgtcgcggactgatcacgtttttgggagaagacgtcggtaatccggtggcgaccgcgctcgacttcgggatcaacgtccaggagggcgttgtcaagggtgcggtcggcatggggttgggcctcgtcgatctgagcccgcattggatcgccctcgatcccgagggcgcgggcgcgacctggggtggtctggtcaagaacgcgtggaaggaaagctttgtcaacgccgccgtcaatccccaggaattcgcgcaagcacggctgcaggagctgaaaggccttgtgcacgccgacgattggacccgagaccggccggggttgggagccggtgaagtcgcgttcgatgcggccacgctggtcgcgcccggtctcggtgaggcgggcgcggcagcggacggcgccagcgcggccgcccgcggcgccgaggcggaggcggatgccgccggcgcggccgggcgggtcggcgggctcgccggcgcccggggcgcgctgacggacatcgccaagtcaaccgccgatctgccgaagaacctcgagggtgtcaccaaggacttgcccgagatcaagcctccgacgggtggcgctccggtggttttggggcccggcggcaagccgatcgaggcgccggtcgaatcggcgccgcgtccggcggacggcacgccgggtgcgcagcggagctcgccgcccgtggcaacgtccccggcttcccccggccgggcaggcgattcgggcgctggcccgcacggtccgagttcgtcgcccgctccagctgcgccgccgggtggccccgtcggcgctcacgatcgggcgcccgcgccagcccccgcggctccggcgggcggtcctggtggcctgggtggtgtccatgatccggcgcccgcgccagcgccggccactcctttcggaggctctggtggtccgcatgatccggcggccgagcccgagcccgcggcagcccccgccgcttcgggcagcccgggcgatccggcgtccgtgccgtccggcggtccgcacgagcccgcatcggttccggcggaggagccgcgtgagccggtatccgtgcctgccggcggcgtgcacgacccggtcgctgagccgacgggtggtccgcatgagccagcatcggttccggccgccgggtcgcgtctcgcgtctgtgcacgccgctgcgggcgacggcctgccgtcggctactcctgagctgttcgaccacacgccgtcacaggtgcccgtgtcggccggtggatcgtccggtgaggctgcgtctgtcggcgcgcattcaccgtcgtcggcttcatcagcggctccgcacttcgagtccccggggcgaccctcagaagtgccagcgccgaacggcggcgcgcacggtcctggcgagagtggccctccgggcgggcacccgccgggcgagccaccgcacggcggcaagccaagtggtgatggggacggccatggcggtccaccggacggcaaggatcctgatggtcatcacgtgtcggggcacggccatgatggatcatccggcggcgagccgcaggatccagtgcattcgaaggatccgtctggcgacgggtggcatcggctgccagatgagccacttgacccgcattacggcgaaccattggacgagcattgggatttcgccgacgacccggtcgatcttgacaagattaatagcgacgtccgcaatctaattcgggatccggaagcgctatacggccgagatccggaggggcatccgtatacgcaagagcaatacgcggaacgtttcaacagcatgggcagtgaaggtcaacattggatgagctttcccggcaatcacggcgctgtcccgcagacgcgtgtcgcttacacggatgccgcatcctacttgcgggattatggtcccttgctcgatcgcatcggcaagacaaacggaaagtacttggcagttatgcaggatggacaagcggcatcatgggagcagcgagccctccacgtcaactcccttcaagatccctaccacgcttatacctttgaacacctaccggacaattggactatcgaagtgtcggaggtcgcgcctggggtgggtcaaccgggtggttccttgcaggtacgcgtattcaactcagagggtcggccgatgacggttgaagagctcactgagcctgacattggagtgttgagatgacaagcggcatacaactttcccaacgccttgaggaatgggcgaagctagccgattacactctaacacctagttcaagtactagagatgggcggcccatattttggtcggggctgggtgaaagtcgcctcttcgtcggaaagaagccagacggctggctcgtgattactgattcggaccgaatggaatccgaatggttcgtcttagcagctccgtcaatcgacaccatcgagaagtacttgttcggaaaattcggcatgtacatccggggcacgaggaatctgcctcggatcggtgtgccagtctcggcgggcgaccaacactccgacttcaacatcgaaactcgcgaatacgaaggcgtcgaacgtttcgctctagttgcgcccgatggctcggcgatagcggtcggtagtgccgacaaaataactgcaacagccgatctcaagaaactcgcactctatctgaacgcaacaatagaccagattgaagcgtccatgctcgatccagacggaaagcctcttttcgagcggcgatgaccgaattgtccaggtccgtcgatgactacgcgccccggtccggcagatggcagagcgtgctacaccgcccggattggccgcccaataccatgtactcgagggaaccggtcgcgaaatccccgcgggcaaggattgggtcgttcagcatgggccggccaaagaagcattcggacagcctggaggcggcgaccaatggatcgtcctcgacagagcaacaaccggcccgttccggtcgacgagttgattcgtagacgacttctcagagagataacgccgccgaaatgataaactggcgatcggataccgagggagttaaacggtggctttagaaaaagatgaccccgatgtttccgagttggtcgcccggtattacacctggcggcagatatatatttgcgcaggccaggcgcctccgggcgaagcggcatgggacgacggtcgcttattctttcgcgtcggctttcctcaccctgactggtggggatatatacttgcaagcgctggcggcgattacgcagtatctagggtatcgactgaacgcagtgcggttcctatcgaatcgcttcaaggaactttctcacggattcgggatgcgggcaaattcttgatctatgaagtggcagagtctctgcgaattaattgcagactggaccctttaagctggaaatgggatgatgaaggccttgatccaaaagtcgacgcgcaaattgaaagtgatcgaattgtcaagtatgtgctccggagtgatccgcagtcgtacttcattatgacgcggggcgatacgccgtatagtcacatcctgccactttcttacgacgagctgaacgcatcacttctcgaaggattcccggacaacgtcgtctcacgattcaagtctgaaatgaattgacgacgcgtacgccccggtccaacagatccgatgacccgagcacccgctcgatctgaacctcgatgaccacccgtcgcgggttgggccgcggcgtgcggtagcgctgggcgtaacgcagctcggcgtcgcgcaccgcgtcgacatcgctgttcaccttggaccggccctccagcgacaaccaccgcgccccgtcgacctggctgagcacggccagcccgccacgatcggcgttgatcgccttctgcgacccgccggtggtgatcacccgggcgatgtgcgtcttggggtcgaaggtgaaacccaccgccaccacgtgcggcgaattgtcggcccgcagcgtggtgagcatggccagatggcgctccgacagaaacgccaacgcgtcgtcggtgagccgggtagtggtattcgccatcaccgcccacgctagcgcaggtaataatcgcagccgtggacgacacgggcgcagctccggtactaatcctgggcggccgcagcgaaatcggcgtcgagctggcccgacggctggcgccgggaacgacggtcgtgctggcggcgcgcaacgccgaccgggtcaacgaccaggtcgacgcgctcaaagccgccggcgcctcggccgtgcacacccgggaattcgacgccgacgacctcgcctcgcacggcccgctggtcgcctcggtcgtcgccgaccacggacccatcggcaccgcggtgctggccttcggaatcctgggtgatcaggcccgcgccgaaaccgacgccgagcacgcggtcgccatcgtgcacaccgattacgtcgcccaggtcagcatgctcacgcacctggctatcgcgatgcgcgcagccggccggggccaactggtggtgttctcctcgatcgcgggcgcgcgcgtgcggcgggccaactacgtctacgggtcggccaaggccggcctggacggcttcgccagcggcctggccgacgcgctgcacggcaccggcgtgcggctgctgacgtgcgcccgggattcgtgatcggccggatgaccgaaggcatgacgccggcgccgctgtcgagcacgcccgcgcaggtggccgccgcgaccgcgcgtgcgctggcgaaaggccgtcgcaccgtgtggattccgtgggcgctagggcccgcggccaccgtgctgcgcatgctgccccagttcatctggcgcaggatgccgcgatgatccgcaccggcgaccacgcggcccggcccgaagcggagccgcgcccatgatcgtcgtggtcggcatcggcgccgacggcatggcgggactcgccgaggcatcgcgcgccgaacttcgaagcgccgcagtcatttacggctccaagcggcaactggatctgctcgacgacacggtgcgcgcaccccggcggcaatggccgtcaccgatgcttccggcgttgcagagcctgctggacgaccacaccggtgacgtccacatcgtggccagcggcgacccgctgctgcacggcatcggcggaacactgatccgcctgcacggcgccggccgggtccgggtgctgccgcacgtgtcctcggtgacgctggcctgcgcgcgcatgggctggaacgtgcacgacaccgaggtgatcagcctggtcaccgcgccgccgcacactgcggtgcgccgcggcggccaggcgatcatcctgtcgcagggcgcagccacccccaccgagctggccgcgctgctgaccgcgcacggccgcggtgattcgcagttcaccgttctcgaaagactcggcgccccagacgaacaccgccgcgacggcaccgcccgcgactgggccgacgctgcgggagacatcgacgcgctcaacgtgatcgccgtacgctacctgcccgacgagcgcgtctggccgctgcccgacgacgccttcacccacgacgggcagatcaccaagcagggaatccgcgcggtgacgctggccgcgctggcgccgcggccgggggagcggttgtgggacgtcggcgccggctcgggcagcatcagcgtggagtggtgcctgggcgggaacggttgccgcgcaaccgcattcgaacgcgacgcacagcgccggcgcaacctggcggccaatgccgcggcattcggcgcagccatcgacctgcgcggcgacgccccggacgctttcgacgacgccgagccgccgtcggccatcttcatcggcggcggactgacccggcccggcctgctcgacgcctgcttcgaccacctgcccagcggcggacggctcgtcgccaacgtggtcaccaccgagtcggaagccgttgtcatccaagcctatacgcggttcggtgggcagctgcgacgcttccagcactatcacggcaaggcgttgggcgccttcaccggctggcacccgcagttcccggtcacccagtgggcggtgacccggtgaccgtctacttcatcggcgcgggcccgggcgccgcggacctgatcaccgtccgcggccaacggctgctgcaaagctgcccggtgtgcctgtacgcgggttcgatcatgcccgacgacctgctggcactgtgcccaccggacgcgagaatcgtcgacaccggcccgctgacgctggatcagatcaccaccgagctccgccgggcgcacgccgccggccacgacgtggcgcggctgcattccggcgacccctcgctgtacagcgcgctggccgagcaatgccgccggctcgacgcactgggcatcggctacgaaatcgtgccgggcgtaccggctttcgccgcggccgcggccgcgctcaagcgggagctcaccgttcccggtgttgcgcagacggtgacgctgagccgggtggccaccttgtccacggcgatgccgcccggcgaagacctggccaccctggcccgaaccggcggcaccctggtgctccatctggccgccgcgcagatcgacagcatcgtcgggcaacttctcgacaacggccgtcaatcccagacaccctgcgcggtagtcgctttcgcgagctggccgcagcaaacggtgctgcgcggcactctcgacgacatcgccgcgcagatgcacgacgcccgcatcaccaagaccgccgtcatcatcgtcggcgacgcgctgaccgccggcggattcaccgacagctacctgtattcgaccggccgcgcccgcggaagcaggcactgatgcgactgctgctgctcggcggcaccggcgaggcgcgcgccctggccaaagccctgcacccgcggatcgacatcatcagctcgctggccggccgggtgcccgatccggcgctgccggtcgggccggtgcggatcggcggcttcggcggcgtcgacgggctacggcggtggctgcgcgacgaacacatcggcgccgtggtggacgccacccaccccttcgcctccaccatgacggcacacgccgcccaagcctgcgccgagctggggctgccacacctggtgctggcccgcccggcctgggacccgggagcggccaccgtcgtcgactcggatacccacgccgcggaagccgttgccgagcaaggctattcgcgagtgtttctcaccaccggccgctcgggggcgcgggcgttcaaggacagcgacgcgtggtttctgatccgggccgtcaccgaaccggatgcgaccacactgccgcgtcgtcaccgggtggtgctttcccgcggcccctatcgctacgacgacgagctcgccctgctgggcgagcaccggatcgacgccttggtcaccaagaacagcggcggtcagatgacccgcgcgaagctggatgccgctgcagcgctggacattccggtggtgatggtggcaaggccggcgctgccggccggcgtgtcggcggtcggcagtgtggccgaggccgccgaatgggttgcggcgctggcgatcaaggactagccggtcaggtcgctgcgctcgccgtcggccagcagcgcgtcgcgggcccgggccacccgcgatcggatggtgcccaccgggcagccgcacaccgcggcggcgtcggcgtagggcagcccgagcaactgggtgagcaacagcgcttcgcgctgttcgggattgaggctggcgatcatcgtcgtcacctcgaccagatcctcgaatccgcgggcgtggcggtcggtgcgcagcacgtgttcgggatcggcgcccaccgcggcgcgcggccgcgactgcaggtgacggatgtggtcggccacgacgcggcgcgcgatggacagcagccaggtccgggcactcgagcgtccggagaaccgctcgatggcgccgatcgcgcgcaggaacgtctcctggggcagatcgtcggcactgcccgcatcgcacagatacgcgacgaaccgccacacgtcttgctgggtggccttgatgaacgcctcgagcgcccgggcgttcccgcgcgcggcggacaacgcgagctcggttaccgcctcgtcgtcgctcggcgcgatcatgcccaaccaccttaattgcgcgggttttccgatcctacgacgggtcgtcgtagacgatgcggtggggtcgggggccgcgcgattgatgggccgcaggtgtccgcgccgccggcccgcgggagcgtcagcggcccaggccgcaaagccggcgtccgccgtcgcgtcggaggagccgggccggcgcgatcccacccgttcccgcgccaccagcaacgcgaaggccaggccgagcagcagcggcatgtggctggcgatgcgggtggcggtcacctccccgtcgaaggcgtcgacgatgacatagcccagcagcgcaaccgaatacacgccggtgatcgccgccacccccgacgccgaggcgggccagacgccggcggcgatcatcgccagcccgagcgccagcaaccacgccgtggactcgtgcatcaggtgctcgccggacatggcgccgtgcatgtggccggcgaccatgccgaaatcgatcccgctgatctgggcggcggcgatcgccacctggaacaggccgactccgatcagcccccagcggcggtagtgcgaccgcaaccagcgcatccaggccgggcgcccggtcggctgctcgccgatgctggccatgatcttgtccaccaggtcgggtccctcgcccggcgtcaccgaggccagccgacgggtctgcaccgccgccccgatcagccaggagcggcagccccggcacgcctcgaggtgggcatcgacctgctgcgcgagcacctgaggacgctcaccgtccagccgagccgacagcgcctcccgggcaacgtcacaccgcatccctgcatcgttgcgcatggcgggtctgcgcgcaaagactcccgcgagttggggcgccgcgcgaatttgcgtggaaccaaacggtcccggtgaccgacctgtgggggaaagctcgccagcccatccacgagattcaccgaagaggtattcgtgttgttgcccgaaggcccccgacgatgaccgcccccgtctggatcgcgtttccccccgaagtgcactcgacgctgctcagcagcggtcccggaccggcgccgctgctggccgcggccaccgcctggtcgtcgatgagcaccgagtacgccgccgcggcggccgaactcgacgggttgctggccgccgcgcacgccggcgcctgggaaggacccagcgccgagcagtacgtggccgcccacgccccataccacgcctggttgctggagagcgcggccaagagctcgaccgcggcgagcctgcacgagacggcggccggcgcctacaccgccgcgctggccgccatgccgacgctgggtgagctcgcgaccaatcacgcggtgcacggggcgctggtcgccaccaacttcttcggcatcaacaccatcccgatcgcggtcaacgaagccgactacgcgcggatgtgggtgcaggccgccacgacgatgtcgacctaccaggccgtcagtcagtcagcgcttgccgcggttccgccgaccacgcccgcgccgacgatcgtcgccccgggcgccgaggcgggcgccgccaccgccgcggcggtccagagcgccgcagcggccccggccaccgattccggctccaatctcaaccacgccgacacgtcgagcatccagcagcaggccagcacggcggcgcagtcctatccgtcctggcaggatcagctgaccgcgtggctgaagcaatacacgcagaatttcgcctggccggtgtccaaggacctcaatcccggcggctggccgttcccgccggtgccgttcgtcaacggcctggcctcgttcttcggccagctcgggttctcgccggccctgtcgaccgccttgggctgggccatctttcacacgttgatgatcttctggccgtttatgcaggcggcgatccagatggccgtggtgctcgcgccggtggtggtggcggcgatcggcgcggccgcggcgggcggggcggcggccgcggtgaccgcgatcagcgtcgcggccccgctgtcgatggccgcgccggtcccggtcgccgccgcgccggcgccggttgccacccttcccgcgcccaccatcgccggcgcgccggccggcgtgagccacgtgccgacaacggcgtccgccccggccccgacgatggccggatccgccggcggcggaccggtcggcgggggacccggtgtcggcttcggccccaccgccaccgacggaatcggcgccggcatgtccgacgccctgtacgcggtcggactgtcgggtctgtcggcgcgcggcagcgcgagcagccggtcacgccgtaagtcggaggaaccggcgcccgacgacctcgacgcgcccgccgcggccgcggcggcggccgcgggcagcaagaaggcgcgggcccgtcggcgccgccgcggcaccgccaccgaccgcgcctaccgttacgaatacatggacctcgataccgacggcggccccgaagacggtggcccggaagacggcgcggtggcctccgaggcgagtgccggccaactcggattcgccggtgccgcaaccaaatccgaagcggcgaggcccgccggattggcgacgctgacccgcgacgggttgagcgagggccccggcgtgccgatgatgcccagcacctgggaccgcgactgagcgttacgtctcgtagcgccggggcgtgaacacccggtccgcggaatcgtctgagtaccactgggtttgcgaggacccgacgatcaacagacagcgcatgtcgatctcggcgggatccagatcggccagccgcaccacccggacgtcttcgtcggggccggacacgtcgcggccgatgaccaccggcgtgccgggttcgcgacgggccagcagaatgtcgcgcatcgcgccgacctgccaggtccgcgtcttggacgccgggttgtagatcgccagcacgagatcggcggccgccgcggcctccagccgcgccgcgatcacctcccacggcttgagccggtcggacagcgagatcaccgcgtagtcgtgccccaacggcgcgccgacccggctggcgaccgcctgggcggccgtcatcgccgggatcacccgcacccgcacgcccggccactgcttggcctcctccagcaccgcggtcgccatcgcgaacacgccgggatcgcccgacgacaccaccgccaccgcccggccctgctcggccagcgcgcaggccagccgcgcccgttcgggttcgtcgcggttgtcgctggggtggcgccgttgaccgtcgcgaaccggcacccggtccaggtaacggccgtagccgacgagatcggtcgccgcggccaactcgcggcggctctgcggcgtcatccactgcgcgtcgccggggcccaggcccaccaccgcgacggtgccggcgcccggcgcgcgccgcgcgcgctgcccgcccggcaggatggccagcgagaagtacgggacaccggccgcgtccacgtccgcggcgggcacgatgcgttgcgcggacgtgctggcccgctccacatagacggcgtcgtcgagctgaccggactgtgaaagagcttcccgcacagcgtgatacgagcgtcccaacttgaggacgacggcggcgtcggcgtcggcgaggcgccgggtcagctcggagaccggcaatgtgcccggcagcaccgacagcacctcgtcgccggccaccaacggggtggcgatggccgccgaggcggcgctcaccgaggtcacgcccggcacgatgacggcgtcgaaccgctgcgtcagccgggtgtggaggtgcatgtaggagctgtagaacagcgggtcgccctcggcgagcagcgccacgtcgcgacccgcgtcgaggtgcgccgcgatgcgcgcggtggcctcgacgtagaagtcctcgatcgcgccggcatagccgccgggatggtcggtcacctcggtggtgaccgggtacaccaggtgctcctcgatctggccgggccgcaggtacggttcggcgatgccgcgggcgatgctgcggccgtgccgggcgctgtggtaggcgaccacgtcggcctcgccgatcacccgggcggccttgacggtgaccaactccgggtcaccgggccccagcccgacgccccacaacgtccctcgcgggttggccggtgccgtcattcgcggtcgctcgcgatcgcgttgacggccgcggcggccatcgcgctacccccgcggcggccccgcaccaccaggtacgacatgccgcgcgggttgtcgacgagctcctgcttggactgcgccgacccgacgaatccgaccggcccgcccagcaccccggccggcgggtccaccccgtcgtcgaccagctcgagcagccggaacagcgcggtgggcgcgttgccgatggccagcacggcgcccggcagccggtcggcccacagctcgaccccggccgccgagcgggtggtctgccggcgggcggccagttcggccgacaggggatcggcgaccagggacaccacctcgttgtcggccggcaaccgcgccgcggtgatcccggcggccaccatcgacgaatcgcataacaccggggcgccggcgcgcagggcggtgcccacccgctcgacgacatcgtcggtgaacgcgacgtgctcggccacgtcgacctgcccgcaggtgtggatcagccgcaccaccacgcgggccacatcggcggggaagcgggccaagtcggcttcggcgcggatggtcgcgaacgacaggcgatagatctccgccgcatcgcggatgtagtcgagcacccgattaccgtagctgccggtatccctcgccggtcgccagcagcacctcgccggcgagcggactgccgcaggcgcgttcgcacccgacgaaatgacggtgccccggggcagtcccctcccgcaccgccagcgcggcgtcggcccgcacgtcggcggtcgagcgcgcgcaccccgggctgccggtgcaggcgctgacgctcagccagggcgagttctcgtcgaacaccagacccaacggcgccagcacccgcagcgcggcgtcggccacctcttcgcgaaggtcacccaccagcaccgagcgccacggcgtgatcaccagcggcgcctgcagggcggccagatactccgcgacgcgggccgacagcagccccagcggcaccgcggcgcccagcgtcacccggccgtcgtcctgtgttatccagcccaccgggggtttggtgacggcgggataggcgatcggcccgcactcggcgccgggcagcagctggtttgggtcgtccaattcctggacgcgccaagcacttccgcggacctgcacgaaccgcgtcgcgacgccgaccagcgtcgcgaccacctggtcgggcggcagccggacagcggtgtcgcgcccggcgagcaacaccgcgcagccatcgggcagtacatgcacgccgacgtcggcgcgcagacccgacacgtcggcgcgcccgtcatcgaggctgaaccagaaccggccgcccagctcggacagtcggggctgcgcgcggatcgcggcgtccaactcgccgacccaccgcctcacgtcgaggttgccgccggaccgccccgacagcggtgaggccacgatgttgcgcacccgctcgtgcgtcgccgacggcaacagacccgcggccgccagcgccccggccgccgccgtcacgtcggtgaggccgcgcagctgcacgttgccccgcgcggtgagctccagcgtcggcgaacccaaccgatcggcgatgtcgcacaacaccgtcagctgggccggtgtgagcatcccgccgggcaaccgcacccgggccagggcaccgtcggcggcctggtgcacctgcagcgcacccgggcatgcgtcggcgtcgcgcgtcctggccacccgtccacggtacggcccggcgccgggggattgccttcagcgagacctaaacccttacccaaggcatcgaccgcccctaccgtcggcacggtgagcattgccaccgcgctcgacgctgcgccgaaacgccttgggggcgccgcatccggcgcgccgggcgggctgtgggcgcgccgcaaatgggaagtggtgcgcctggtttccccgctggcgctgctggcgctgtggcagctgggcagcgcgatcggcgtgatcgcgcaggatgtgctgcccgccccctcgttgatactgcaggccggcgtggagttgacccgcaacggccaactcgccgacgcgctgcacatctccaccgtccgcgtcgtcgaggggttggcgctgggcggggtgatcggcatcgtggcgggcgccgccgtcggcctgtcccgctgggtcgaggccaccgtggatccacccctgcagatgatcagggcgctgccgcacctggggctgatcccgctgttcatcctgtggttcggcatcggcgagctgcccaaggtcttgctggtggcgctgggtgtggtcttcccgctgtacctgaacaccttctccgcgatccgccaggtcgaccccaagatgctggaaaccgctcaggtgctgggtttttcgttctttcagcggttccggcggatcctggtgcccggaacggcgccgcaggtgctggtcggtttgcgccagtcgctggcgatcgcctggctgacgttgatcgtcgccgaacagatcaacgccgacaagggcatcggcttcctgatcaacaacgcgcgcgatttcctgcgcatcgacatcatcatcttcgggctgaccatctacgcgttgctgggcatcatcaccgacgcggtcgtccgcctcatcgagcgccgcgccgtgcgctaccgacactgacaccgaaaggctcaggcttgacactgaccgcagaatccggcccgctcgccgggtcgcgcaccgatgttgccggcgaactgcgccacgtcgacaagtggtacggcaaccgccatgtgctccaagacgtttcgctgcagataccgagcggtcagatcgtcgcgctgatcgggcgcagcggctcgggcaaatcgacggtgttgcgggtgctggccggtctgtcacacgaccacaccggccggcggctggtggccggcgcccccgcgctggccttccaggagccgcggctgttcccgtggcgggatgtgcggaccaatgtcggctacgggctcacccgcacccggctgccgcgcgcgcaggtgcgtcggcgcgctgagcgggcgctggccgacgtcgggttggccgaccacgcccgggcctggccgctgaccctgtccggcggtcaggcgcaacgggtttcgctggcgcgggcgctggtcgccgagccgcggctgctgctgctcgacgaacccttcggcgccctggacgcgttgacccggctgagcatgcacaccttgctgctggacctgtggcgacggcacggcttcggggtgctgctggtcacacacgacgtcgacgaggcggtcgcgctggccgatcgggtgctggtgctcgaggacggccgcgtggtccacgagctggccatcgacccgccccggcgcacacccggggagcccggcgcgcacaccgagcggtatcgcgccgagctgctggatcgtctcggcgtgcggcagtgatccgcggcgtcgtcgcgctgaccgcgaccgtcgggctgctgctgaccggatgcgtttcccggacaacgacttccggacccacaccaccaccggccgcggtgccgttgtccgacctgtccggcctcaccctgcaggtcggcgaccagaagggcggcacggaggcgctgctgcgcgccgccggtcagctggacaaccttccctaccgggtcgccttctcgacgttcacctcggggccgccgcaggtcgaggcggctaccgcgggcaagatcgacttcgcgatcaccggcaacaccccgccgatcttcggcgcggccagcaacgcccggatcaaggcggtctccgcctacggcggcggcggggcgggcaatcgcattctggtgcacgcggattcgccgatcacctcggtctccgacctgcgcgggaaggcgatcgccgtcgccaagggcagctcgtcgcacgccaacctgctggcccaattggaccgggcggcaatcaaacccgccgacgtcaagttcgtctacctgcagcccgccgacgcgctgtccgcgttcagccagcaccaggccgacgcctgggccatctgggatccctacacggcccaggccgaacagcagatcccggtgcgcagcatcgccgaggcgcagggcgtcaccaacggcgactggatcggcgtcgcatccgaccaggcgctggccgatccgaaacgcaacaccgccctgggtgacctgctggtgcggttcgaaacggcggtgcgctgggcccgggcgcatccgcaacagtgggcccaaagctacgctgccacagtcggattggaccctcaagtggcggcggtgtcgcaggcccggagcctgcggttgcccaccgaactcggcgatgacgtggtggcctcggaacagaagctggccgacctgttcgccgcggccggccaactgcaatccgcgccgaggttcgccaactgggtggaccgccggttcaacgcggcattgcggccgggcctggtcagctgaaccccatgctcggcacggattgggggcagcgcggggcgggcaccctgctgcggtgaggacgctgcgctacgccccgggccgctgggccgacgtcttcggcgaaccggcatcacccacggtcttgctgtggcacggcgcgcaaaccgacgcccgcgccgccgtcggcccgctggccggcctgctcgccgcccacggtctgatggtggtggcgcccgactggaactcccacgccgccgacggcggacgcgccgacctgttgcgatcgctggacttcacccgcgggctcgccggtgactccggggcggtggcgctggtcgggtggtcactgggtggggccgccgcggcgggcgtcaccctgcaggcggatcgattcggcgtggcgcccctgcacaccttctgcctggccggcgcgttcatggttcccgacccgctcaccggccgggcggccaccgacacggtgccgcccgatcgcagccgcaccgcgttcacgctgctgcacggcgtcgccgacgatgtggtgccggtgagtgccagccgggatttcgccgcacacctgcagcggatcggccggccggtgcagctcgtcgaggtggccgccgatcacgggtcgatcgccggcgccgactacgacccggtcgccgaccgctaccaacccggcgcgcgggaagagacactgcgggtcgccggggaggtcgccgcccggatcgcggcgacgctacggtacttgggtggctgagccgaccatcctgctgctgtcgacatccgacacggacctgatcagcgcccgttccagcgggaaaaactatcggtgggccaacccgtcgcggctgtccgacgacgaactgcccgatctcttggccgacgccgccatcgtggtggtgcgcatcctcggcggttaccgcgcctggcaacacggcatcgacacggtgctcgccagcggcgtgcccaccgtgctggtcagcggtgagcaggccgccgacgccgagttgaccggcctgtccacgccggccgccggcatcgcggtgcaggcgcacatctatttagcgcacggcggcgtcgagaatctgcgccagctgcacgcctttctgtcggacaccgtgctgatgaccggattcggtttcgccccaccggtcatgacgccgacctggggcgaaccggcgcggcccaacgcgattgacaccgacggcccgaccatcgccgtgctgtactaccgcgcccaacacctggccggcaacaccggctacgtcgaggcgctgtgtgcggccatcgaggacgcgggcgcgcgacccatgccgatctactgcgcgtcgctgcgcaccgccgaacccgaactgctgcaacggctgcgcgaggccgacgccatggtggtgaccgtgctggccgccgggggactgaaaccggcggaggcggcggccggtggttccgacgacagctggaacgtcgaacaccttgctgcccttgacatcccgattctgcaagggttgtgcctgaccaccccgcgggcccagtggttgcagaacgacgacggcctgagcccgctcgacgtggccagtcaggtcgcggtaccggaattcgacggccgcatcatcacggtcccgttctccttcaaggagattgacgacgacggcctgatctcctacgccgccgaccccgagcgatgcgcccgggtggcggggctggcggtgcggcatgcccggctgcgccacgtcggcccggccgacaaacgggtggccctggtgttctcggcctatcccaccaagcacgcccgcatcggcaacgcggtggggctggacaccccggccagcgcggtcgccctgctgcgggccatgcgcgcgcacggctaccgcatcggcgacctgcccggcgtcgaggcgaacgacggcgacgccctgatccacgccttgatcgagcggggcgggcaagaccccgactggctcaccgaggggcaactggccggcaacccgatccgggtgtccgccgccgactaccgcgcctggttcgcgaccctgcccgccgagttcaccggcgccgtccagcagcactggggcccgccacccgggcagcttttcgtggatcgcagcaacgatcccgacggcgagatcgtcatcgccgcaatacaatcgggcaacctggtgctgatggtgcagccgccccgcggcttcggggacaacccggtcgcgatctaccacgaccccgacctgccgcccagccaccactacctggccgcctaccactggctggacgccggattcggcgcgcacgcggtggtgcacctgggcaagcacggcaacctggagtggctgcccggcaagacgctgggcctgtcggcgggctgcgcgcccgacgccgcgctgggcgacctgccgctgatctacccgttcctggtcaacgaccccggcgagggcacccaggccaaacggcgcgcgcacgcggtgctcgtcgaccatctcatcccgccgatggcgcgcgccgaaacctacggcgacatcgcccgtttggagcagctgctcgacgagcacgccaacgtcgccgcgctggaccccggcaagctgcccgccatccgccagcagatctggacgctgatccgggccgccaagatggaccacgacctcgggctcaccgaacgccccgaggaggactccttcgacgacatgctgctgcacgtcgacggctggctgtgcgagatcaaggacgtccagatccgcgacggcctgcacgtcctgggccaaaagccaacgggggaagccgaactggacctggtgctggcgatcctgcgtgcccgtcaactgttcggcggcgagcaggtcctccccggcctgcgccaggcgctgggtctggccgaggacggcaccgacgaacgctcggcggtcgacggggccgaggccgcggcccgggaactggtggcggcgctgcaggccaccggctgggatcccgacgccgccgggcggctcaccgacaacgccgacgccgcggcggtgctgcggttcgcggccgccgaagtggtgccccggctggccggcagcagcgccgaaatcgaccaggtgctgcgcgccctggacggccgtttcatcccggccggcccgtcgggctcgccgctgcgcggtctggtgaacgttctgcccaccgggcgcaacttctactccgtcgaccccaaagcggtcccgtcccggctggcctgggaagccggtgtggcgctggcggattcgctgctgacccgctaccgcggcgaccacggccggtggccacaatcggtcggcctgtcggtgtggggcacctccgcgatgcgcaccgctggcgacgacatcgccgaagtccttgcgctgcttggtgttcggccggtgtgggacgacgcgtcacgccgggtcgtcgagctcgccccgatcccgctggccgagctgggccgcccgcgcatcgatgtgaccgtgcggatctcgggtttcttccgggacgccttcccgcatgtggtcaccatgctcgacgacgcggtgcgactggtcgccggcctggacgagcccgccgccgacaactacgtccgcgcccacgcccaagccgacctggcgcagcacggcgaccaacgacgcgccaccacaaggattttcggctccaagccgggtacctacggtgcggggttgctgcagctgatcgacagccgcaactggcgcgacgacgccgacctggccgcggtgtacaccgcctggggtggtttcgcttacggccgcgacctggacggccgcgaggcggtcgacgacatgaaccgccagtaccggcgcatcgcggtcgcggccaagaacaccgacacccgcgaacacgacatcgccgactcggacgactacttccagtaccacggcggcatggtcgccacggtgcgggcgctgaccggccaggcgccggccgcctacatcggcgacaacacccgacccgacgcgatccgcacccgcaccctgtcggaggagaccacgcgggtgttccgggcccgggtggtcaacccgcgctggatggcggcgatgcgccggcacggctacaagggtgccttcgagatggcggcgaccgtcgactacctgttcgggtacgacgccaccgcgggcgtgatggccgactggatgtacgaacagctcaccgagcgctacgtgctggatccggagaaccggaaattcatggccgagtcgaatccctgggcgctgcacggcatggccgaacggctgctggaggcggccgggcggggtatgtgggcgcagccgcaaccggaaaccctggacggcctgcgccaggcgctgctggaaacggagggcgacctggagggctgagcggctgctcgccgagcatgcggctggtctcacactcggcgcgcgccggtgatcggctccagcggtacgttgatcgagtgacccccaccttcgccgacctcgccaaggcgcaatacatcctgttgaccacattcaccaaggacggcaagcccaagccgaccccgatctgggcggccgcggacaaagaccgactgctggtcatcacccaggaaaaatcgtggaaggtcaagcggattcgccacaccccgcgagtcacgctggccacctgcaccatgaacggccgccccaccagtgaggccgtcgagggcaccgccgccatcctcgacaagtcgcagaccgccgcagtctacgacgcgatcggcaagcgctacggcgtggtcggcaaggtgttcaacttcttcagcaagctgcgcggcggcatggccaacaacgtcggcctcgaattgaaagtggcgtagcggccggccgaaccggggtgcgactacggcgtggcggccagatgctcgccgaagaaggagaaaacgcggcgccaggcgtcctcggtggcctcctcgttgtagccgaaaccggcgatccgcagcagcggctgggccggcagctcgttggcgaagctgtgcccggccaccggatagaccttgatatcggcggtgatgttcttgtccgcggtcacttttcgcagcttttccggcgcgcccttgccggtgagatcgcggccgccgaaactcgctaccaccgggcatgcgccctcgagcacctcgtccaggttgccgggcaggggagtgccgtagaacggcgcggacgcgctgaaacccttgggcgacatgacaagagcgaagcgcccgcccatgcagaaccctgcgatcccgacgcggcccgtgcattccggcatggcctgcaggtggtcgcgggcagccaggatgtcgtcgagcgcgcgaccccgctgggccgccagctccttcatgacccgcgtgatgcagcggaccaggccgccgcgcgcgtacatgttcggggtgagcgccaggtagccggcccgggcgatgcggtcgttgatcgactgcttgtcccggccgtagccgaacgcgtcgtggatcaccactacacccggccaagggccctgtccggccggagtgctcagcagcgcatcgatcggtccgtcgggggtatcgatctgaatcgtggtcatagcgtcatctaactgcaatcgcgtcggatcgcaccacgggaactccggccggtgcgcggccgttggcctgacatggtggcccggctgttgctcctctacgccgtcgtcgaactcgcggtgaccttcgcgttggtgtcgacgatcggctggggctggaccctgctggtgctgctggcgaccttcctgctcggctggggcgtggtggcgccgatggccggatcccagctgctgcgccggatcgggcaattgcgctcggggttgaccgagccccgggccgcggccggagacggcgcgctgatcagcctggccacggcgttggttctcatccccggactgctgagcaccgcgctgggcctgatgctgttcatcccgccggtacgcggcgccgccgcgccgcggttgaccgcgctgacgctgcgcaccctgcagcggcacgccccgccctacccgaccgcattccgcgccgccaccgatccgcgcggcccgtacgagcaccgcgactacatcgacggcgagggcatcgacgtccacgaagtgccggcaccggcgcgcaaccaaccgttcgacagccgccgagccaccggatgagccgttgccgcgcccggcgcggcggcacgtagttttggcgtgtggacgtggccgaccgaccgacaccggtgaccctgctggtcaacggccgggtgcacaccccggcggcgccggacgcgaccgcgatggccttccgcggcggtgtcatcacctggctgggcggcgacgacgtcggccgcagcctgttccccgatgccgacgtcgaggacctcgacggcggtttcgtcacgcccggcttcgtggacagtcacatccatctgaccgccaccggcctgaccctgtgcgggctggatctgcgcccggcccgctcccgcgcccactgcctgcaactgatcgccgaccacgccgccgcccacccgggccggccggtctggggacacggctgggacgaaacgtcgtggccggagcgcaccccgcccagcaccgccgacctggacgccgtgctcggcgaccggccggcctacctgacccgggtggacgtgcactccgcgctggcctccaccgggctgcggcggcgggtcgcccaactcccgtcggccaccggtttcagcccggaccggccgctggtcggcgacgcccaccatctggtccgggccgccgcgcggaacctgctgaccgccgagcaactcgccgaagcccgcgccgcggcgctgcgtgccgccgcggcggccggcatcgtggcggtgcacgaatgcgccggacccgagatcggcggcatggacgactggctgcaattgcgggccctcgaccacggtgcggaggtcatcggctactggggtgagccggtgagcaccgccgccgacgcgcgggcgttgatcgaggccaccggcgcccgggggctggccggcgacctgttcatcgacggggcgctcgggtcccgcaccgcctggctgcgcgagccgtacgccgacgcgcccgaccgcaccgggacctgctacctggaccccgacgccgtcgaggcgcatctgcttgcctgcaccgaggcggagatcaccgccgggttccacgtcatcggcgacgcggccgtcgccgcggcggtggacgccttcgagaaggtcgccgcccggctcggcccggtcgccgtcgcccgctgcgggcatcgcctcgaacacgtcgagatgatcgacgccgagcaggccgccaagctgggccgatggggcgtcatcgccagcgtgcaaccaaatttcgacgcgctctggggcggcgccgacggcatgtacgcgcagcggctcggggccgagcgaggcagtcagctcaatccgtttgcgctgttagcatcccaaggcgtgcccctcgcgctaggttccgacgccccggtcaccgggcttgacccctggacgagcgtgcgcgcggcggcccaccatcgcaccccgggcagcgcgatctcggtgcgcgccgcgtttgctgcggccacccgcggcggctggcgggcggccggcgtccgcgacggcatgaccggcaccctggtgcccggcgcgcccgcctcctacgccgtctgggacgccggcgacctggaggtgagcgtcccccgcgacacggtcgcgcgctggtcgaccgatccgcggtcccgggtgcccgcgctgccgcgattgggcccgaccgacgccctgccgcggtgccggcgaacggtgcatcggggcgctgtcatccatggctgacgagcgggccgcagcccggctgggcagcgccgcgcgccgggcggcgaccgggctgggcgccgcggtgatcgcggcgaccgggctgggcgccgcggtgatcgcccggctgccggccgcgcaggcggcgatgcggccccgactgctccggttgatctgcgccgtcgtgggcggcgggttgctgtgcgccagcttcccggcggtgaactggtggtgggccgccgtccccgccgccgcgctgctggcgtgggtgctcacccatccggcgacgacgccggcgggcgggctggggtacgcctttgtcttcgggctggccttctatctaccgctgctgccgtgggtcgggctgctggtcggggccgtcccgtggctggtgctggccgcggtgtcggcgctgtttccggccgtcttcgggctgttcgccgtgctggtgcgccggctgcccggctggccggtctggttcgcgttgctgtgggcggcccaggagtggctgaagtcgatcttcccgttcggcggcttcccgtggggctcggtggcattcggccagacgcacggcccgttcctgccgctggtccagctgggcggcgtcgcgttgctctcgttcgccatcacgctggtgggcttcagcgcgacggccctcgcgctggagatcgtcaagtggtggcgctccggttaccccgcggcccagtcatcggccgggccggccgcgccgccggcggtggtgcttcccggcgtctgcatctgcctggtgctgttcgcggcggtcatcgtctggccgcaggtgcggcactccggtaccggctcgggcggcgagccctcggtgaccgtcgcggcggtccagggcaacgtgccgcggctgggtttcgggttcaacgaacagcgccgggcggtgctggacaatcacgtccgggagacgctgcggctggccgaagacgtgcgggccggggccgccccgcaaccccagttcgtgatctggccggaagactcctcggacatcgacccgctcgtcaacggcgacgccgccctggagatctcgcaggccgcgtcggccatcggcgcgccgatcctgatcggcagcgtgctcgaagtccccggacgcccggcgcaggatccccgctacaccaacaccatgatcgtgtggaacccggcgaccggcccggccgaccgccacgacaaggagatcgtgcagccgttcggcgagtacctgccgatgccgtggctgttcaagcatctgtccggatacgccgaccgcgccggcgccatggtgccccgcgcgggcagcgacgtggtgcacatggccggggtgccggtcggggtcgccacctgctgggaagtgatcttcgaccgcgtcccgcggcgcgccgtcacccacggcgcccagctgctggtcgtgccggccaacaacgccaccttcaaccagcggatgagcgagcagcagctggcgttcgccaaggtcagggccgtcgagcacgaccgctacgtaatggttgccggcaccaccggcatcagcgcggtgatcgcccccgacggcgccgaactggcgcgcactgacttcttccagcccgcctacctggacatgcaggtgcgcctcaaaaccaggctgacgccggccacccgctgggcgccgctgctgcaatgggtgatggtcgcggtggccggggcggtgatcctggtcgggatacggcagaatggatggttcccgcgttcgatccggcagaggccgagacgctcgggtgcgccgaagcatcccgatgcctccccggccgaaaccgagggcgacacacacccggcgcacgacgccgcgcccgacgaggacggcgaccacgctccgccagaggacggcggcgacgacactggaccgcccgagggcggccgaccccatatcgggcgacacagaggagctacatgaccaccagccaaccggcgcccccggacccgggcacccgacccagccagcgcgtcctggtgatcatccccacctacaacgagctggagaacctgccggtcatccaccggcggctcaaggacgcctgcccgcacgtgcacctgctcgtcgtcgacgacagcagccccgacggcaccggccggctggccgaggagctggcggcggccgacgccggtcgcacccacgtgatgcaccgcaccgccaaggacggactgggcgcggcgtacctggccggcttcgcctgggggttgagccgtgactactccgtgctggtcgaaatggacgccgacggcagccacgcgcccgagcagctgcaccgcctgctggacgcggtcgacggcggcgccgatctggccatcggctcccgctacgtcgacggcggcacggtgcgcaactggccgtggcggcgctgggcgttgtcctggaccgccaacacctacgcgcggctggcgctgggcatcggggtgcacgacatcaccgccggctaccgggcctaccgccgcgaagtgctggaagcgatcgacctcgacggcgtggactccaagggctactgcttccagatcgacctgacctggcgcaccatctgcaacgggttcaccatcgccgaggtgcccatcacgtttaccgagcgcgagctcggcgtgtccaagatgagcgggtccaacatccgcgaggccctggtcaaggtcacccgctggggcattcagggccgccggtcgggtgcgcggcgggcgcgcccgacccgggccgaccaccgcagctgagcgggggtcagccgcggcggcggctcttgatgatctcgaggcgctccttgagcagctcttcgagctcctcgatcgagcggcgctccagcagcatgtcccagtgtgtccgcggcggcttcaccttcttcggctcgggcaggtcgccctcgatcagggtgccttccatgccgttgcggcacagccaggtgccggggatctcggcgtcgtcggcgaacgggacctcgaactcttcgccgttctcggtgcggtaccgcgcgatctgacgcggggccaggtcgtggttgcggtcggtctcgtagctcacggctccgagccggctgcccctcaggacgcgatcagccatgtgtgctactcctttaaatcttctggagctctgcggctcccgtagggcgattcttcctcgctaagcaacgctgtggcgatctgcgcagttcccggcggcagaccgggatacgcgacgcgaccatccatgataccgggatcgccgagaatccccgactaaagtcggcaggcgtgagccgccgtacccatccgcagccctgccgctggtgcggtcgcgacgtcaccgacgcgggcatgggccgtcgccgccagtactgccgccagtcctgccggcagcgggcctacgagcagcgcagctcgctgaaccggcacggcgccgcggcggtgcccgaggatgccgtggtgctgtccgccgacgacgcggccgacctgtccgatcgtgtctaccaggtgcgctgcgcggccgaggacgtggcgaccgcggtcgacgagggcgccgggcccgccgagctgcgccagttgtgcgacgcgctgatccaggccgcccgagccgccgacggctggcgccgcgccggtgtgtgacagcctcgtgcctgccgcgccgcccgcgccggctcggcggccgaaccggccgcgacccgcgcctgaccatgcacgacgggcggccgggtacagtcgcgccatggaccaggggcctcgttcacgatggaccgctgtccagagagcgcaccgggcgcccggcgtcgcatcccgcccgcgcggggcgcttcgcccgtcccagccggtcctcctgtagcagccgggagcagcggacgttttgaaatccagtcggagttggccatactcaccagcaacattcttgcgttccagagcggcacgatgctggtcgaacggaacacggcgtcgccccgtgcagcaaattccgtgactcggcgagaaccgcatccggcggcaccagacggccagacattaggtgagggttaggcgaggttttgtgatggtggaccaactccagcatgcgaccgaggcgctgcgcaaagcgctggtccaggtcgaacgcctgaagcgcaccaaccgcgcgctcctggagcggtcgagcgagccgatcgcgatcgtcgggatgtcgtgccgcttcccgggcggcgtggacagccccgaggcgctgtggcaaatggtggccgagggccgcgacgtgatctcggagtttcccaccgaccgcggctgggacctggcggcgctgtatgaccccgaccccgacgcccgccacaagtgctacgtcaacaccggcggtttcgtcgacaacgtcgccgacttcgacccggcgttcttcggcatcgcccccagcgaagccctggccatggatccccagcagcgcatgttcctcgagctgtcctgggaagcattggagcgggccggaattgaccccgtcaagctgcgcggcagcgccaccggcgtgttcgccggcttgatcgtccagggctacggcatgttggccgaggagatcgagggctaccgcctgaccggcatgacgtccagcgtggcgtcgggtcgggtgtcgtatgtgttggggctggagggccctgcggtgtcggtggacaccgcctgctcgtcgtcgttggtggcgttgcacatggcggtgcagtcgctgcgatcgggcgagtgcgatctggcgctggccggcggcgcgacggtgaacgccaccccgacggtcttcgtcgagttcagccggcaccggggcctggcgcccgacggccgctgcaaggcgtacgcgggcgccgccgacggcgtgggctggtccgagggcggggcgatgctggtggtcgagcggctctcggatgcgcggcggttggggcattcggtgttggcggtggtgcggggttcggcggtgaaccaggacggtgcttccaatgggctgacggcgccgaatgggccgtcgcagcagcgggtggtgcgtgcggcgttggccaacgcgggtctgtcggcggccgaggtggatgtggtggagggacacggcaccggcaccacgttgggtgatccgatcgaggcgcaggcgttgttggcgacttacggtcaggatcgtggccagccgttgtggttggggtcgatcaagtcgaacatgggtcacactcaggcggctgcgggggtggccggggtgatcaagatggtgctggcgatgcgccacgagttgttgccggccacgctgcatgtcgatgagcccagcccgcatgtggattggtcggcgggggcggtgtcgttgttgaccgaggcccaaccgtggccgggtgagcggccgcggcgggcgggggtgtcgtcgtttggcatcagtggcaccaatgcgcacgtcatcatcgaggcggtcccggccgccgagccggcgcacgccgatgcgcccgcgctgccggtgctgccctggatggtgtcggccaagtccgcggcggcgttgcgggcgcaggcggcgcggttggccgaatacgtgcgcgcgcacggggaattggacatcgccgacgtgggctggacgctggcgggacgcgcgacgttcgagcaccgggccgtcgtggtgggcggtgaccgggaccgcctgctggccgggctggacgagctgagcaccgacgacccggccgcatcgatcatccggggtgtcgccacaccggcgggcaagacggtgttcgtcttccccggccagggatcccaatggctgggcatggcaaccgaattgctggacactgcaccggttttcgcgcagcacatccaggcgtgcgaggaggccttcgccgaattcgtggactggtcgctgatcgatgcgctgcgcggcgcacccggcgcagcggggatggatcgcgtcgacgtcgtgcagccggcgctcttcgcggtgatggtgtcactggccgagctgtggaagtccgtcggggtgagccccgacgccgtgatcggccactcgcagggcgagatcgccgcggcctatgtcgccggcgcgctgtcgttgcgtgacgccgcccgagtggtcaccctgcgcagcaagctgttgcggtcactggccggtcccggcggcatgctgtcgatcgcctgcagcaccgagcgggcccgggagttgttggcgccgtatgggaaccgggtcagcatcgccgccgtcaacggccgctcgtcggtcgtggtgtcgggggagggggccgcgctcgacgagctcgccgcgttctgcgccgaccttgcgctgcggacccgccgcatcgacgtggattatgcctcacattcggtcgaggtcgaggcgatccgcgaggacctcgcgcaggcgctgaccggtatcgagccgcgttcctcgcgcatcgccttcttctccacggtgaccggaaaccgcttggacacagcgggattggacgccgactactggtaccgcaacatccggcaaaccgtgcagttcgaccaggcggtgcgcagcgcggccgagcacggataccggaccttcatcgaatccagtccgcatccggcgttggtcgcggggatcgaggacaccgtcaacgacagcctgccgggtgacaccgaggccatcgtcattcccaccctgggccgcgacgacggcgggctcgagcggttcctgacgtcggcggccaccgccttcgtcgcgggagtgaacgtggcgtggcgcggtgtgctggacggagccggcttcgtggagctgcccacgtatgcctttgaccgccgccggttttggctgtccggcgagggcgccgcggccgacgccagcggcctgggcctgggcaccagcgagcacccgctgctcagcgcggtcgtcgagttgcccgcctcgggcggggtggtgctgaccggccggttgtccccgagcctgcagggctggctgaccgatcacgccgtgtccggcacggtcgtcttccccggagccggtttcgtggagctggcgatccgcgccggcgacgaagtcggttgttcgacggtcgaggagctgacgctgcaggctccgttgatgttgccggccaaggactccgggatcggatcggtcgccgtgcaggtggtggtcggcgaggccgacgaatccggtcggcgcgacgtgtccatcttctcgcggcccgacagcgactcgccgtgggtgtgccacgcgcagggaacgctgagcaccggatcgatcgagccgggcgccgatctgtcggcgtggccgccggccggggccaccaaggtcgacattgcggacggctaccaacggctggccgcgcgcggctacggctacggcccggccttccagggcctgaccgcggcgtgggtgcgcggcgacgaggtgttcgccgaggtgcggctgcccgacgccgcgggcggcgtcaccgggttcggtgtgcacccggcgctgctcgacgcggccatgcacgccttgatcgtcggccaccaaatcgccggtgacagagacgaagtggtgctgccgttcgcgtggcagggcgtgtcgttgcacgccgccggggcgtcggcggtacgcgcccgcctggcccccgcgcaggcgccgggcacagcggcctcccgggcggtttccctcgagctggccgacgggctgggattgccggtgctgtcggtgcgcgcgatggtggcgcgttcggtgagcgagcgccaactgcgcgccgcggtgtcggccgcgggccccgaccggctgttcgaggtggcctgggcaccggtgaccgtgccggcggcccacggcgaaccacccgtccaccaggtctttgaatcccttgcggccgaaggcgatccggtcggcgaatcgtatcggcgcacccacgaggcgctggccgccgtgcagtcgtggctcaccgagcacgattccggggtactggtcgtggtgacccggggggcgatggcgctggccggcgaggacgtcaccgacctttccggcgcggcggtgtgggggctggtgcgctcggcgcagaccgagcaccccggacggatcgtgctaatcgattccgatgccgcacttgacgattccgcgctgaccgcggccctggcgaccggcgaaccccaggtgttgctccgcgacggcacggtctacacggcacgcgtacacggcagccgcgcggtcgacggcatcatgacaccgccggaagaccggccctggcggctcggcatcagcagcgcgggcaccttcgaaaacctgcagctcgaaccggttcccaacccggatgccgcgctgcagccgggccaggttcgggtggccctgcgcgccatcgccaccaacttccgcgacgtgatgatcacgctgggcatgttcacccacgacgccctgctcggcggcgaaggcgccggcgtggtcgtcgaggtcgggccgggcgtcaccgaattctcggtcggcgactcggtgtacggcttcttccccgacggcagcggcacgctggtgcccggcgacgtgcgcctgctgcagcacaagcccgcccactggtcctaccccgaagccgccggcatctcggcggttttcaccaccgcctacatggcgttcatccacctggccgacgtcaaaccggggcagcgggtgctggtgcacgccgcggccggaggtgtcggcatggccgcggtgcagctggcccggcatctgggcctggaagtgttcgccaccgccagccgcggcaagtgggacacgttgcgcgccatgggattcgacgacgaccacatcggcgactcgcgcacgctggatttcgaggacaagttccgctcggccaccggcggggccgggatggacgtggtactggattcgctggccggggagttcgtcaacgcctcactacggctggtcgcgcccggcggcgtgttcctggagatgggcaagaccgacatccgcgacccgggtgtggtggtcagggaataccccggcgtgcgctaccgcgccttcgacctgttcgagccgggccgtccccggatgcaccagtggatggtggaactcgccgggctgttcgacgccggcgtgctgaacccgttgccggtcaccacatttgacatccggcgtggccgcgccgcgctgcgctacctgagccaggcccgccacatcggcaaggtcgtcatgacggtgcccggggcgctctccgccggcaccgtgctgatcaccggtggcaccggcatggcgggctcgacattggcgcgccacctggtgaccggccacggcgttcgcgacctggcgctgctgagccgcaccggcccggacgcgcccggcgcggccgagctcgtcgccgaactggaagcggccggggcccgggtgcaggtgatcgcctgcgacgcggccgaccgggccgcgctggccggcgtcatcgccgggatttccgcgcagcggccgctgtccggcgtgatccacgccgccggcgtgctcgacgacgcgatgatcacctcgctgacaccggagcggatcgacgcggtgctgcgggccaaggtggacgcggcctggaacctgcacgagctgacccgcgacatgaatctgtcggcgttcgtgatgttttcctcgatggcggggctggtcggctcctccggacagggcaactacgccgcggcgaactccttcctggatgcgttggcggcgcatcggcgggcgcacgggcttccggcgatctcgctggcgtggggcctgtgggaccaggccagcgccatgaccgggggcctggacgccgccgacctggcccggctgggccgcgacggcatcctggcgttgtcctcggacgaggccatggaattgttcgacacggcgttgatcgtcgacgagccattcctggcgccggcccgtatcgatctgggcgcgctgcgcgcacacgcggtcgcggtgcccccgatgttcgccgagctggtcaacgcgccgacccggcgccgggtcgacgactcgctggccgccgcgaaatcgaaatccgcgctggcgcatcgcctcgacgggctgcccgaagccgagcagcacgccgtgctgctggagctggtgcgctcccacatcgccaccgtgctgggcagcccgaccgccgaggcgatcgacccggacaaggcgttccaggaactgggcttcgactcgctgaccgcggtcgaaatgcgcaaccggctcaaaaccgcgaccggactggcgctttcgccgaccttgatcttcgactaccccacacccaacgccctggccggctacatccgcaccgagcttgccggcgccccgcaggagatcacgcacgcgcccgtcgtccgcgccaccgacgacgatccgatcgcgatcgtcgggatgtcgtgccgcttcccgggcggagtggacagccccgaggcgctgtggcaaatggtggccgagggccgcgacgtgctctcggagtttcccaccgatcgcggctgggacctggccggcgtgtacaaccccgacccggacgtccccggcacctgctacacccgcaccggcggtttcgtcgacaacgtcgccgacttcgacccggcgttcttcggcatcgcccccagcgaagccctggccatggatccccagcagcgcatgttcctcgagctgtcctgggaagcattggagcgggccggaattgaccccgtcaagctgcgcggcagcgccaccggcatgttcgccggggtgtacacgcagggctacggcatgggcgccgcacccatcgcggagggcttccggctgaccggccagtcgtccagcgtggcgtcgggtcgggtgtcgtatgtgttggggctggagggccctgcggtgtcggtggacaccgcctgctcgtcgtcgttggtggcgttgcacatggcggtgcagtcgctgcgatcgggcgagtgcgatctggcgctggccggcggcgcgacggtgaacgccaccccgacggtcttcgtggagttcagccggcaccggggcctggcgcccgacggccgctgcaaggcgtacgcgggcgccgccgacggcaccggcttctccgagggcggggcgatgctggtggtggaacggctttcggatgcgcggcggttggggcattcggtgttggcggtggtgcggggttcggcggtgaaccaggacggtgcttccaatgggctgacggcgccgaatgggccgtcgcagcagcgggtggtgcgtgcggcgttggccaacgcgggtctgtcggcggccgaggtggatgtggtggaggggcacggcaccggcaccacgttgggtgatccgatcgaggcgcaggcgttgttggcgacttacggtcaggatcgtggccagccgttgtggttggggtcgatcaagtcgaacatgggtcacactcaggcggctgcgggggtggccggggtgatcaagatggtgctggcgatgcgccacgagttgttgccggccacgctgcatgtcgatgagcccagcccgcatgtggattggtcggcgggggcggtgtcgttgttgaccgaggcccaaccgtggccgggtgagcggccgcggcgggcgggggtgtcgtcgtttggcatcagtggcaccaatgcgcacgtcatcatcgaggcggtcccggccgccgagccggcgcacgccgatgcgcccgcgctgccggtgctgccctggatggtgtcggccaagtccgcggcggcgttgcgggcgcaggcggcgcggttggccgaatacgtgcgcgcgcacggggaattggacatcgccgacgtgggctggacgctggcgggacgcgcgacgttcgagcaccgggccgtcgtggtgggcggtgaccgggaccgcctgctggccgggctggacgagctgagcaccgacgacccggccgcatcgatcatccggggtgtcgccacaccggcgggcaagacggtgttcgtcttccccggccagggatcccaaacgctgggcatgggaaggcaattgcatgccggatatccggttttcgccgaggcgttcgacgcggtcgtcgccgaactcgaccgccatctgcttcgcccgctgcgcgacgtcatctggggtgacgacgaaaacgtcttgaacagcaccgaattcgcgcagccagcgctgttcgcggtggaagtcgccctgttccggctgctcgaatcgtggggagtgcgacccgatttcgtgatgggacactcgatcggggagctgtcggccgcgcacgtcgccggtgtgctgtcgttgcagaacgccgcggtgttggtggcggcgcggggccggttcatgcaggcgctgcccgagggcggggcgatgatcgccgtgcaggccaccgaggcgcaggtgcgcccgctgctgggcccggacgtcggcatcgccgcggtcaacggcccggccgcggtggtgatttccggtgaccacgatgcggccgtcgcgatcgccgagcggctgcgcgccgagggtcaccgcgtgcaccggctgtcggtgtcgcacgccttccactccccgctgatggaaccgatgatcgacgaattcggaactgtcgcagccggtctcgctagcgacaaacccgtcatcccgatcatctccaatctgaccgggcaaccggcggccgacgacttcgggtcgccggagtactggaagcgccatgtccgcgacgcggtgcgcttcgccgacagcgtgcggttcgcgcagtcggccggtgcgacccgtttcctggaggtcgggccgagcagtggcctgaccgcagcgatcgaagagacgctggccgacgcgcccgtcgtcaccgtgtccgccctgcgcaaggaccgcccggagccggtcgctctggtcaacgccgtcgcccagggctgggtctgcggcatggacgtggactggcgcggcgcactcggtacggggcacctggttgacttgcccacgtatgcctttgaccggcggcgcttttggctttccggcgacggtgcggcctccgatgcggccgggctgggcctggccgccggcgaccacgccctgctgggcgcggtggtggaactgcccgcctcgggtggcgtgctgctcaccggccggctgtcatcggccagccagggctggctggccgaccacgccgtcggtggcgtggtgctgttccccggcgcggggttcgtcgaactggcgatccgcgccggcgacgaggtgggctgcggcatcatcgacgagctgaatctggccgcgccgctggtgttgccggccggcggctcggtcgcgatccaggtcgtggtcgacggccccgatgattcgggtgcgcgtgcggtgtcggtgttctcccgcgccgacgcgggcgcgggctggttgttgcacgccgagggtgtgctgcgcgccgggtcggcgcagccggccacggacctgtcggcgtggccgccggtgggcgcggtgccggtcgatctcggcgacggatatgagcaactcgccgagcgcggctaccggtacgggccggcgttccgcggcctgacgtcgatgtggcgccgcggcgacgagatcttcgccgaagtgaacctgcccacggatgccggcgtcagcacaaccggtttcggcgtgcacccggtgatgctggacgcggcgttgcacgcggtgatgttggcgtccgacggcgacgaactcccggcgggctcgatgttggtgccgttctcctggcagcgggtgtcgttgcatgccgcgggcgcggcggcggtgcgggcacggatcgtaccggtcagtccgtccgcggtgtcgatcgaattggccgacgggttggggctgccggtgctctcggtggcgtcgatggtggcgcggccggtgaccgaccaacagctgttggccgcggtgtcgaactcgggcccggaccgcctcttcgaactgatctggtccgcccagccgtcgacggccgtgcagccggtgtcgctgttaaattggggcgcaacggaattggacgccaccgacaccgactccgacagcgggcgtttcgcggtgctgttcgaatcggcgccggtggccggggacgtcgtgaccgaggtgtacgccgcgacccgggcggtgctgccggtgctgcaaacgtggctcgcccgcgacggggccggcaccttggtggtgtcgacccgcggcgcgatgacgctgccgagagaagacgtcaccgatctggccggcgcggcggtgtggggcctggtgcgctccgcgcagaccgagcaccccggccggatcgtgctggtcgataccgatgcgccgctggacgccgatgcggtcgcggcggtgctggcggtcggcgagccgcagacgttgctgcgcaacggaaccgtgtacaccgcgcgggtgctcggcagccgggcggtgggtgccctgctggtgccgccggaggatggaccgtggcggctaggcatgagcagctacggcaccatcgagaacctgcggttggagccgatccccgacgccgacgcgccgttggggcccggccaggttcgggtggcgacctcggcccttgccgccaacttccgcgacgtgatgatcgcgttgggcctgtatcccgatccggacgcggtgatgggcatcgaagcgtccggcgtggtcatcgaaacggcctcgcaggacgggcgtgtcgcggtcggcgaccgcgtgatgggcctcttcccggacggaaccgggaccgtcgccatcaccgatcagcggctgctggtcaaggtgccggccggatggtcgcacaccgcggccgcgacggcgtccgtggtgttcgccacggcctactacgcgctggtggacctcgccgacgccaggcccggccagcgggtgctggtgcatgccgccgccggcggcgtcgggatggccgcggtgcagctggcccgccatttcggcctggaagtgttcgccaccgccagccgcggcaagtgggacacgttgcgcgacatgggcttcgacgacgatcacctcggtgactcgcgcggcctggacttcgaggacaagttccgggcggtgaccggcggggccgggatggacatcgtgctcgactcgctgtccggtgattccgtcgacgcgtcgctgcggctggtcgcccccggcgggatcttcctggaaatgggcaagaccgacatccgcgaccccgaggtcgtcgccgccgagcaccccggtgtgcgctaccgcgccttcgatctcttcgaggccgggccggaccgtattgcccggctgctcgacgaattggccgcgatgttcggtgaggacgtgctgcggccgttgccggtcaccaggttcgacgtgcgacgtgcgccggccgcattgcgctacctgagtcaggcccgccacgtcggcaaggtggtgatgaccatgcccgacgcgtggacggcgggcacggtgctgatcaccggcgccaccgggatggccggttcggcggtcgcgcgacatgtggtgacccgccacggcgcgcggaacctggtgttggtcagccggcgcggactggacgcgccgggcgccgcggagctggtggccgagctgaccgcggccggcgcgcgcgccgaggtggtggcctgtgatgccgccgaccgggaggcgctggccaaggtgatcgccgacatcccgatgcagcacccgctgaccggggtgattcacgccgccggggtgctcgaggacgcggtggtgacgtcgctgaccccgcaacggatcgacaccgtgctgcgggccaaggtggacgcggcgtggaacctgcacgagctgacccgcgacctggatgtcggtgcgttcgtgatgttctcgtcgatcgccgggctggccggcgcgtcgggtcagggcaactatgcggccggcaattcgttcctggacggcctggccgctcatcggcgggcccacgggttgccggccatctcgctgggctgggggctgtgggatcaggccagcgccatgaccggcgggctgggtgcggccgacctggcccggttcggccgcgacggtatcgtcgcgatgtcgtcgcaggaggcgctggagttgatggacacggcgctcatcgtcgacgagccgttcctgctgccggcccacatcgaccttgcggcgctgcgggccaagttcgacggtggcacgctgccgccgatgttcgtcgacctgatcaacgcgcccacccgccgccaggtcgacgactcgctggccgcggccaagtcgaaatcggctctgctgcaacgcctcgaggggctgcccgaggatgagcaacaagcggtcctgctggacctggtccgctccaacatcgccaccgtgctgggcagctccagcccggaggcgatccacccggaccgggccttccaggaactcgggttcgactcgctgaccgccgtggagatgcgcaaccggctcaaagccgcgaccgggcttgccctttcgccgacgctgatcttcgactacccgaactcggccgcgctggccggttacatgtatcgggaactggtcggcacgtccgaacagccgacagcggccgcggcgccgggcgaagccgagatccagcgcgtggtgggatcgattccggtcaagcgtcttcgccaggccggggtcctggagctgttgctggcgttggcgaacgagtccaccgggaccgcgcaatccgcaacgccggcggtgaccaccgaaaaggacatcgccgacatggatctcgacgacctggtcaacgccgcgctgctggatgacgacgacgagtaggcggtcgatgagaatcgcggttaccggggccagcggcgtgctcggtcgcggcctcgccgcccggctgctcagcaagggccacgacgtcgtcggcatcgcccggcatcggcccgacagctggtcgagcgcagcggatttcatcgaggccgacatccgggatgccgccgcggtcaaccgcgcggtcaccggtgcggacgtcgtcgcgcatttcgcgtgggcccacgacactcgggaggggaccggctcgcaggtcaacatcgccggcaccgccaacgtgctggcggcgatggccgaaacctcggcgcgccgcattgttttcccatcgtcgccgcacgtctacggcggcggcgacaccccgcgcagcgaggccgacgcgccggccccgtcggccgccgacgcggtgcagcaagcccgcgtcgaggagatgctcgtcgcctccggactcgaatccgtcaccatccgctgcgcgctcgtcgtcggccgcaacgtcgacaactgggtgcgccgggttctggcgctgccagccttccccggcgggaccgtcgatcgccccatccagttggtgcacctcgacgacgcgctgcgactactggagtcggcggtgctgagccacgaaatacccagcggcacagtcaatctcgctgcgccggggacgacgacgtttcgccggatcgcggccaccctgcgccgcccggtgctgcggctgggccgcccggcgccggccgagctggagccggtgctcagcgcgccgctgatggataccgcgctgctgcacgagcggtggggctttcggccggcatggcagtgcggtgaatgtgtcgaggatatggcgctggcggtgcgcgggcgcgtcacggtggggcgccgcgtcgtgtcgctgccctggcggctggccaacgtcgcggacctgcccgccgtcgatgcccccgcgcaggacggtgtggtgcccgtaccggccggccccgaaggggtcaacggcgagttcgacacgccgatcgatccgcgtttccccaccttcctggccaccaacttgtccgaggcgttgcccggtccgttctcgccgtcctcggcttcagcgacggtgcgcggagtacgcgccggcggcgtcaccatcgccgagcggctgcggccgggtggtctggtgcagcgcgaaatcgccctgcgcaccgtcggcgtgttcgcgcaccgcctctacggtgcgatcacctcggcgcacttcatggccgacaccgtgccgttcgccaagccgtcgatgatcgtcagcaacagcgggttcttcggccccagcatggcctcgctgcccgtcttcggtgagcagcggccggcagaaaccggctgggcccgaaggctgttgcgcaatacccgcaacatcggggtgttcggcgtcaatctggtgggcctgagctccggtgcggcgcgcgacaccgacgacttcatcgccgacgtggatcggctggagcggctggccggcgacgccgccgagctcgacgagcgccggttgctgagcctgatcgcgttggcgcgcgaccaggtcgtgcacggctgggtgctggcctccgcgtcgttcatgctgtgtgcggcgttcaacgtgttgctgcgcgcggtgtgcggacgggacacctcggcgccggccggcccggaactggtcagtgcgcgatcggtggaggccatgcagcgcctggtggttgccgcacagcgtgatccgaacgtggcccgggtgttgaccgaaccgggggagcggttggacaagctggccgtcgacgcgccggaattccatgccgcggtgctggccgagttggcgctgatcgggcaccgcggtccggcggagttggagatgctgtcgacgagctacgccgacgaccccgagctgctggtccgcatggtggccaaggcgatggcggcgaccgcggcgccgccgccgcagcatccccgtattccgttgcaggccaagccgattgcagcgctggctgcgcgtcaactccgcgaccgcgaagcccgccgcgacaaggtggtgcgcgccaactgggtgttgcgcgccctgttgcgggaatacggtcgccggttgacccacgcgggcgtcttcggcagcgccgacgatgtgttctacctgctggtcgacgaactcgatgccctgccggccgacgtcgcggcggtggtggcgcggcgtcgggccgagcaccgccggctggccggcatcgtaccgccgacggtgttcagcggaagctggcagccaacggcaacttccgtgccggcgctggcgggtggcggaacgctgcgcggcgtcggggtgtgcggcggacgggtccgcggtcgggtgcgcatcgtgcggcccgagaccatcgacgacctacagcccggcgagatcctggtggccgaggccaccgacgtcggctacaccgccgcattctgttatgccgcggccgtggtgaccgaactcggcgggccgatgtcgcacgccgccgtggtggcccgcgagttcggcttcccctgcgtggtggatgtgcagggagccaccaagtcgttgccgccgggtgcgctcgtcgaggtcgacggggcgaccggcgagatcagggtgctggaacttgcttcggagcaggccaccggcggcgggtaggcgcttacggcggcccctgtcatggcgccgaatgttgttgcgcggcttggcgggccagcctgtcgttgtggatcttgacgagttctcggaaccccagccggtgatacttcggtatcggctggataccccagacgtcctgcgcggtggccttgccctcggcgccctctggcgggccgaacggcgggtaggggtacttgcactcgagcgtgtcgttggagtaccggatcttgagcagctcgctgcagatctgtgtgaggctcagcgtcgggtagccgtagtagacagccatgaacggcagcgtgaaggcgccctcgatgaccagggccaccaggcacacgagcacggcccgcttgatccatttgtgcattcgcgcgtagtacggcgtggtgccgggttcgaggccggcggccgagtccttgtcgtcggtggtagacggtacggacggactagtcatggcacggccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctcctttagtcggagaaggtttcgcggttgacggtgtgcaggtaggggattgccaggaacggggtgatgtagaagatgtcgtagagccaccagccgatgaccgggaacaccacaccggcgtagcgcacgtcggcgaacatggtcatgttgaacacgtaggccgaccagatcaccacgcccatccagcaggtgacgaccatccattggtggccccaccgcttcatctgcaggaacccgatcgcggcggccacccgcatggagaagaccgtgagaatcagccctgcgacataagctttttcgcccggcccggccgcgccgccgatccacagttcgttgtagtgccagaagtagccggcgtcgaacatgttgccccagcccaccatcagtacccggttgatcagggtgtggttggcgaccaggtcgagcgcccagcccagggagttgagcattccgtcgatcagcaccaggtagccgatcagggtcacgatcatcggccgcaccgacaatccggcgcgcagcgcccgccgctgcaaccacaccccgcgcatgaagatcgggaacccgatcaggcccggcgcccacatgtccatcagggcggcgccgacgatcatccatttgtcggcgtggcgctgggcctggcgggattcgtcgtggtggtcctcgagggtggtcgcgctgtttgcttgtgcggcagcgagattcacagattccaccacccgcgggcgaacgacatgtagagctggacgccgaacatcgccagcagatagccgtagatgaagatctggaagacgatgagcgccctcttgcgcttttgttcctgtcggtccatgccggttactcccttccctagggcgaactgttcgaggtggccaggctggctgccgcgacttcacgcagtccatcggtgaccgcgccgtcgctgctcagcggcgcgagtatgcacgcgtcggcggcgtccaattcggttgcgccggcggcgatcagctgggcggcgttgaccagcaccctcgtcgacggcggttcgaagtggaaggcttcgtcggcggtgcggatcgcgaccgcgcacctgaccagccgctgggcggtggccaacgggattccggattcggcgacgatcacgtcggcctcgcggtcgggcggcagataatgcatcgccagcgtgacgaaccgttggcggaacgagggtttgagctccttgagtgagctgcggtaggccgggttgtacgaacataccagcatgaacccttcgggggccttcaccaccgcgccggcgcggtccaggtacaacgatcgtcggtgatcggtgagcgaatgcaggatcgccaaggagtcgtggcgggcctcgacgacctcgtcgaggtagcagatcgccccggctttgacggcccgggtgagcggaccgtcggtccagaccacgtcgccgccggtcaccatgaagcgcccgacgaggtcggagctggtgaggtcgtcgtggcaactgatggtgaccacggggcgctgtagcagcgagcccatgtgttcgacgaaccgggttttgccgcacccggtcgggccggtcagcattaccggcaggcgccgcgcaaaggcctgttcgaacagctgaacttcgttgccgttggcgaaatatgtgtcggtggtcatctcttcctcaatcggccggcattcacgcggcgaccagttcgcgatggacatgggccaatacgcggggcaattcctcgatacgccggatccgttgcgaccggcgcggcccgaatacctccggaagggggtccacccgggtcggcccgacgcccacgtaatacatcgacacgccggcgtcgttggcctcctcgacggcgtgcgcggcatcggcccaggcgtaacggccctcgtagccttcatcggagatcagcccgtcaccgatgacgatcagcaggcgccgctcggcgggttgggcgagcagccggctggtcaaatggcgaagtggcgcaccgagtctggtgtagccgcgggtggacaggccgagtgtgctcggcggcacgaaccggcggtcttcgaagtccttcaggcaccggacttcgacccggtgtcgggtgttgccggtgaacacgaaaacgccatggcgttcccgcgccagcgtcatggcacgcgaaagcgcgtcggcacaggccaattcgagctgaaacacgcgtcccccgtgcacccccagtgacgagctgccatcgagcagtagtgcggtggtgacgtcgcggccgctgggcaacaggtcgcgaaacaccctcggctccttggcctcgccagtcgtcaggtcgatgtagtggctgacgtactggtcgacgtcgaggtccgagccgtcttcgaggcggctggtcattgcacggtgggtgtgttcttcgaaccacttgcggacatcgacggccaccggcaccggacggcggaggcggcggccgtcggcgtgctcgacgacagcgacgtggtcgtgcatgaatcgctgtgtccacatgttccactcgggataggggatgcccggccggtgctggggtgtgacgtcgagatcattgtcctggggccggctcggcggcggcagattcgggttgcgcacacccccgtcgccgccgacgggcaccgagtacggccgcggacgacgcttctgtgtggtggtccacggcatcctcccgaagctgcgtcgtagtctgtcggtcaatccctggggcgccgtgtaggccagcggcaaagcgcccagcagcggaggcaccgttaattccaggccggtcgccgccaatccgattgccctgtcgagcatctgggcgccgtccatgtccgcggcctgggggtggacgtcggggagcagccgttggacctcgggaagcaggccgggccaccgcgacgcgatccagccgagcgccacggcgccttcgacgagcgtgagcgcgcgcagttcccgcgcggacagctcgttcagccggaattcggtgacgcgttccttggatggcgagcattgcagggccacaccgcaggtcagggttctgcgtgtccagtcggagggtgcggggtaggggaggtggacgaatgtgagtgccgcatccagtccgaagccccgccgctcgccggtgacgagccgcacgccttcgcggcgctgctcgctcagcgcgaccgccgtcacggcgcaactgcgttccagcgccatcgcgcggccgtcggagtactcggaacgctcggtcattcagaacgtaccgatgttggagaacagccagtaccagaaccagatgatcagcccggtgccgccccacgcggcgacgtagcggaggatctcccatagatagcccatgatgtgacttcctcggtggcgtagtggttttcagcgtgcgcgcggttcagtcggcgaagagttcgcggttgacggtgtgcagataggggatggccaaaaacggggtgatgtagaagatgtcgtagagccaccagccgacgaccggcaacacgacgccggcaaaacgcacgtcggcgaacatcgtcatgttgaacacgtaggtgatccaaatgaccacgcccatccagcaggtgatgaccatccactggtggccccaccgcttcatctgcaggaagccgatggcagcggcgatccgcatggtgaagacggtcaggatgagcccgacctccaaggccttctcgccgggaccggccgcgccgccgacccacagctcgttgtagtgccaaaagtagccggcgtcgaacatgttgccccacccgttgagcagcacccgggccagtatcgtgtggttggccaccaggtctagcgcccacccgacggtgttgatggcggcgtcgatgatcacgagatagcccagcagggtgaccagcatcggccggacggacaggccttcgcgttgcgcccggcgcagcaaccggactccccagagaaacagcggcaatccgaagacgccgagcgccgcggtgccgatcagcaggctgccagaaatcagccacttgtccgcccgccgctgcgcgagttgtgaccggtgcaggtgctcgtcgatgctcatgccggcctgcgcggcgtcactcgattcgagcctgggcagcatcgcgaaccctccccgccatcgacactgattggatcagcgcctgcactataacagactgactgtagtcagcgaaagacaccgcgtccgaacacctcggtgcagcacaatgcaaaggagtactgaatcgatgctgttccgcgcggccgacggccggcacccgtaaggcgttgcggcgtcagggtttcagactgcgcagagtcctcgcgacgtagtcctccaacagggcgtgtccggtgggccagtggttggtggtgatcaacaaggcgtacaggcccaacaggaagaacaccgcgctgttcatgggattgacatgggggtccgtctcgccgcgttgctgggcaccttcgatctcgttggccaccaagacgatcaacgggtggtcgcggccatcctcggtctgcgggcgggtctgggagaagtgcagcgcgagaaagtcattgaagagcatgtcgcccaatcggcgctccagccccaccaccaagcggaccgcctcgttcaacgccgacgccagatcgtgctcggacttgaggaattgcgcgaactgcttggctatccgctcctcttcccggcgctccaactccagcagtacatgctccttggtcgggaagtgaaagaagaaggtgccgtgggcaactcccgcggcggcgacgatcgcgcccacgtcggcctcggccattccggcgcgggcgaactcggcgatcgcggcgcccatcaaacgctcgcgcgtctgcaggcgcttggcttcacgcgccgacagccggtccgccacagccatcgctcttccttatagttgacccgactcatgccaaagacggcatgcccaacgacccattatgccgcgtcatcaccaaaagcgcttgtataccttgactattcttctcggcatcgagcgaaccgggatatcgcctgagcatagtcattgactatagtcagtatgctacctacattgaacggcgcagacatcaccccgcgaccgagggagtccggcatggcgttggagcaattccggctggacggacaggtcgcgatcgtcacgggcgccgggaagggagtcggggcgggcatcgcccgggtgctggccgaggcgggcgccactgtcgtcgggaccgcgcgcaccgaggccgatatcgtcgcacgatcgagggcatcgaggcggcgggcggcaagggcctggcgctggtggccgatgcgatgagccgtccggacggagagcgcgtggtcaacaccgccatggagcgtctcggccgcatcgacatcctggtcaacaacgtcggcggctccagctatgcacggtttctggacatcaccgacgaggacttccggcacaccttcgactggtgcgtgacctcggcgttcatcatgagccagctcgtggccgcgcacatgctcgccgccgggcacggctcgatcgtcaacatctcgtcgggctcggcccggttcgggatccgggcattgaccgcctactgcgtcgcgaagggcggcctcgaggcgctcacccgcgccatggggcaggaactcgcgcccaagatccgggtcaacgccattgcgctgggctctttcgccaccgacggtctgcggggcagcctggacctgatgcccggatcgctggagaagatgctggcggccacgcccctgcaccggctgggcgacgtcgaggacctcggccggctcacggtgtacctgtgcacccgggactgctatgccaccaatgcgatctttcacgtcgacggtggcctcgactcgaacaattcgccgctgccgataccggattactgaacccccgcaaaggacgaggcagtcgtgcgcagagtcattcaattctccaccggcaacgttggccggcattcgttgcgggcgatcatcggccggcccgatctggaactggtcggcgtgcacgccgccggtccggagaaaatcggccgggacgcggcgcagctgtgcgggctggacgaaccgaccggcatcatcgccaccgacgacatcgacgccctggtggcattgaacgccgactgcgtggtctacacgtcgcagggggagacccggccgatggacgccatcgagcagatgtccaggttcctggccgcgggcaccaacgtggtcggcacgtcgatggtctggctggtggcgccccgtcacgccgaggagtggttgcgcgaacccctgcagcgtgcctgcgaggcgggcaacacctcgctctacgtcaacggcatcgatcccggcttctccggcgatacgctggtgcacgccgccgtcagcctggccacccgggtctcgtcgatcaccgtgcaggagatcttcgactacggaaactacgacgacgccgagttcaccggtgccgcaatgggtttcggaaccgccccggacgacgactcgccgatgatgtttctgcccggggtgatcgtggcgatgtggggcggtcaggtccgcagcctcgcggaccatctgggcgtcgagctcaacgacgtgcgccagcgcatcgagcgctggttcaccccggagcgcatcgactgcaccatgatgacggtgcagcccggacggatggccgcggtccggttcgccaccgagggcgtccgcgacggcgagcccgtcatcaccctcgagcacgtcacccggctcacccgggccgcggcgcccgactgggaatatccgcccgacggtcacaccggggtgcaccgcgtggtcgtggcgggcgagccgcgggtcgagatcaacacccatgtctcccatccgctgttcgattccactgacgccgggtgcatttcgacggccgcccgggtggtcaacgcgatcgactgggtgtgccgggcgccccaggggctcatcggtgtcgaggacattccgctcgcggcgaccatgcgcggcgtgctgtggcaggaccgctagtccgccgttgggcgagatcgcttcacgaatcgcgtcgaacccataggctgtgccctcaggtgaacgattcgttcggcggccggacagccgacttcggaaggggattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccgaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaagcctaaggccgacggccccgaacacccttcaagaaaggtaaggggctcatgaccaaggtgcggacggccgcgctcggcctgacggccaccgcggtgctggtcggcgcggccgtggtgggctgcggcggggacaagaacccggcggcgtcatcgagcccggcggcctccacccccagcgccgcatcgccctcctcggcggcgccggcggactacagcaacctgttgatcaagcccggcgacgtgggccccaacgtcaccgccgacggcccgcccagccagaatcccagtggcatcaccggcgtgggacaggttttcaagaaccccgacggcaagcgcaccatcatggacacgatcgcggtgttcccggacccggcgaccgccgctcagacggcggcgaacatgcgcgacgtcgtcggcaaaaaggtcaacgggccacagcagcccatcgacatcggctccaacgggttcatggtgatcggccagggcagcgatccggccaacccgatggagatctccgaggcggtcttcgtcgagggaagagcgatggtcgacctcgaatccgattgtgtgataggcaatcccacgcccgctgacgttctgctcgacctcgcccgcaaacaagacgccgcggtcaaagcgggcttgccggccggctgatcggacctcacaggggccagctgttcggctgggacgcataacgcagggcggcggccggcggcaacggccggcgctcatcgaccgatatcgcgtcgacgaccagcgcgacatagcgtcgccagccctcgctgcccgcatccatggtggacaacacgctgtagagcatcgccaccaaccggggcagatcgtcggcgaccaggtcggcgcggatcctgccggcccgctgtccctcgcggacgagctcaccgagcgcctcgttgagcgaaaccgagatgtcggaggtgagtgaccccgcccgatgcgcggcggccagcaggttctgctcgcgggcgcccagcgagatcgcggcctccaccaggcgggtcagcccgtgcagcggatccttcgcgtggcgggcgctgtcgatcaccggcgtgagatcctcgtcaatgctctggtccagggcggcccgcaccaggtccgccttggccggaaatctgcggtaaagcgttcgctcgccgacgccggcgcggcgcgcgaccgcctccaccggcgcgtcggggcccaactccgcgtacacctcgcgggccgcgcgcaggatgcgctcgacgttgcgtgccgcgtccgaacgcaacggccggtcctcaaccgcggtcatgagacccagcgtaaccgacagttgactgccaactggcggggctttacagtcttaaactgtcaggcttctgccacttaattggaaacatgggtcatgtcaatatctttcgagacctccgaatcccgcgccgacgcggagcttccggtgttgccgatgccgcgggccgcgcactgcccgctcgccccgccacccgagttcgtggactggcggcaacaacccgggctgcgccgcgcgctgttccagggcaacccggtctgggtggtgagccgctaccacgacattcgcgccgcgctggtcgatccgcgcttgtccgccaagaccattccggattcgatcatgcccaccgatgccgacaacaaggtcccggtgatgttcgcccggaccgacgatcccgagcatcatcggttgcgccgcatgctgaccggcaacttcaccttccggcggtgtgaatcgatgcgaccgcagatccaggacaccgtcgaccactacctcgaccggatgctcgacggcggtgcgccggccgacctggtgcgggaattcgccctgccggtgccgtctttggtgatcgcgctgctgctcggcgtgccgccggaagacctggaacttttccagttcaacaccagcaaggggctcgaccagaaatcctccgacgaggaaaagggcaaggccttcggggccatgtacgcctacatcgaggagttggtgcagcgcaaggcacgcgaaccgggcgacgacttgatcagccggctgatcaccgaatacgtagcgacgggccaactcgatcacgccaccaccgctatgaacagcgtgatcatgatgcaggccggccacgaaaccaccgccaacatgatctcgttgggaaccgttgcgctgctggggaatccggagatctatgccaggctcggacaaacggacgactccgccgtcgtcgccaacatcgtcgaagagctgatgcgctacctgtccatcgtgcacagccaggtggaccgggtcgcgaccgaagacctgacgatcgccggtcagctgatccgggcgggggagttcgtggtgatgaacctgcccgccgggaactgggacaccgaattcgtggataaccccgaatccttcgacgccgaccgaaacacccgcgggcacttgggcttcgggtacggcgtgcaccaatgcatcggcgcgaacctggcccgggtcgagatgcaggtcgcgttcgccacgctggcgcgccgcctgcccgggctcagactggcggtgcccccggagcagctgaagttcaaggacgccaacatctatggcatgaaagaactcccggtgagctggtaaccaccgccgcgccgcacatcaccatcgccgagcgtcgagttgttggcgccgaaagccacgatttcacgcaacaagtcgacgttgggcagcgaacgcctcagcagctgaacgcggcgcccacgccgtccggcggcggcgtcgagcgcaggcagccgaacggttcgaccccggccgggctgagcttggccgccgactggtgcgcgtagttcacgcagtacaggccggcctggtcggcgcggcaccggtactccccgaacgccagagagtccccgttggccagctccgtcccgttgccgttgacgaacggacccggatcggcccgggcggacccgacctgcaggctcgtcccgtcgaaatcgacccagccgccttgccattggccgtaggccgtcgcgggcggcggggcgggatgggtcaggctcaccaggcagaccaccgcgccgccggtgtgcttggcatccgtcatgcacgagactttgccggccagggccgacaccgcgatgtcgtcgcccagcggcgtggccacgccgtcgcgggtcgccgtgtggtagcggctcggatcggccgggtggcctgcctcgatccaggtgatgacgtccgacatcgccgcaccggcggccggcgcggccgagggccccggcggtttgctgctcgacggaccggcggcggaccccgacggcgtcgccgcgccgctcggggtgggctccgaacggccgcccgtcgtgtgtgcgcacccggcgaccagtactgacgcggcgatcatcgcagctatccgcatgaagtcaggctaaccggcgcggcgggcaaacaaggcgctgcgcgcgcgtcggcgccgtcacgtcggttaccgtcgattcatgcatgaccgcaccgtccgcgcccgcacggccaccggcatcgtcgagggcttcacccgcgacggggtccaccggtggcggtccatcccgtacgcgcgcccgccggtgggcgacctgcgcttccgcgcgccgcagcccgcacagccgtggtcgggcgtccggcactgccacggcttcgccaattgcgcgccgcagcagcgccgttacaccctgctcggcctctccggcctcggcggccgctatcaacccatgagcgaggactgcctcaccctcaacgtcgtgacgccggaggcgccggccgaggggccgctgcccgtcatggtgttcatccacggcggcggctatttcctgggcagctcggcgacaccgctgtacgacggggcggcgctggcccggcgcgggtgcgtctacgtgtcggtgaactatcgcctgggtgcgctgggctgcgtggacttctcgtcgctgtcgacgccggaaatccccctggagagcaacctgtacctgcgcgacctggtgctggcgttgcagtgggtgcgcgacaacatcgccgagttcggcggcgacccggacaacgtcacgattttcggggagagcgccggcgcctgcatcaccgccacgctgctggccgtcccggccgccaaaggcctgttcgctcaagcgatttcggaaagcccggcctcgggactggtgcgttcccaggaggtcgccgccgaattcgcgaatcgcttcgccaacctgctcggtgtgcgccgccaggacgcggccaacgcgctgatgcaggcgtcggcggcccaactggtcaagacccagcaccggctgatcgacgagggcatgcaggacaggctgggcgccttcccgatcgggcccgtggtcggtgacgacatcctgccgacggacccggtggaggcgatgcggcgcggcgaggcgcaccgggtgccgctcatcgtgggcaccaacgccgaagagggccggttgttcacccggttcctggccatgctgccgaccaacgaatcgatggtcgaagagctgctggccgacgcggaaccggctgtgcgcgaacgcattaccgccgcctatccgaactatcccgaccggtccgcgtgcatccagctcggcggtgacttcgccttcggctcggcggcctggcagatcgccgaggcccactgcgcgcacgcacccacctacctctaccggtacgactacgccccgcgcacgctgcgctggtcgggtttcggcgccacccacgccaccgagttgctcgccgtgttcgacgtctaccgcaccaggttcggcgcgctgttgaccgccgcggccgaccggcgggccgcgctgcgggtgagcaatcaggtgcagcggcgctggcgggccttcagccgcaccggcgtgccgggggaggactggccgcgctacaccgccgccgagcgcgccgtgctggtcttcgaccggaaatcgcgcgtcgagttcgatccgcacccgcaccgccggatggcccgggacggcttctcactggcgcgctgacctggcacgctaaccctcatgcatgccgagaccgagcaagtcatcgaacgacccagcgacctgagtgcctcctggctggccgcggtgatcggcaccggccccatcgcggacttctcggtcgagcgcatcggcaccggccagatgagcgagtgctaccggatccggctgcgctacgcgcaggccgatgcgcggggacccgagtcggtggtgctcaaggtcgcggccaccgatccggtcagccggcagaccggcctggcgctgggcctctacgagcgggaggtccgcttctacggtgacctcgcgccgcggctgggcggaccgatcgcgccctgctaccacgcggccgtcgacacctcgaccggcgtgttcgacctgctgttgggcgacgccggaccggccgtcgtcggcgacgaaatcgccggtgccacaatcgaacaggcccggctgggggttgtcgagctggggcggctgcacggcccgctgctcggcgacatctcgctggcgcaggcgccgtggctcaaccgcgacgcgccgctgaaccaggccatgatcgcgccgctgtacgccggtttcgtggagcgctacggcgaccagatcgcgcccgagcaccgggcggtgtgcgaacgcctggtggccgcgttcgacggctatcttgctcaggagccgggcgtccggggcctggtgcacggcgactaccggctggacaatatgctgttcggcaccgccggggccgagcgcgcgctgacggtggtcgactggcagaccgtgtcgtggggacccgcgctgaccgatctcgcctacttcctggggtgcgcgctgcccgccaaggaccgccgcgaacactacgacgcgctgctgcgggcctaccacgaggcgctgggcccgcagccgcccatcaccctggccgacgtcgccgacggggtccgccggcagagcttcttcggggtgatgatggcgatcgtctcctcgatgctggtggaacgcaccgaccgcggcgaccagatgttcatgacgatgctgcggcggcactgcgaccacgtgctcgacaccgacgcgctggcgacgctgccggccgcgagcgcgcccgagccattgcggccgtcgcccgaggacgaactcgcccacgatcccaccaccgaaccgctgtggagcgagagctggtacgccgacttcgccgatcccgcacagggattgggcggctggtttcgcctcggcctggtcgccaaccagcagaccgcgtgggtgcacgcgttggtgtgcggccccgacatgccgaccgtcgccgtcgacgcgcaggtgccgctgccgccggatccgtggacggtgcgcaccgacaccttcgagatcacgcattccgccggcgcgccgctgcgcagttaccgcgtcgacgtgcgggccctggcccaggcctacgccgacccggcggcgctgctgcgcggggagcccggcacccccgtcgcgatgaccatgaacctggattggcacaccgacggcacgccctacaaatacgcgatgacgacccgctacgagattccgtgcaccgtcaccggcagcgtcaccatcggcgacaccgcctaccgcatcgaatccgttgccggacagcgcgatcactcctggggggtgcgcgactggtggagcatggactggatctggagcgcactgcacctcgacgacggcacccacctgcacggggtgaacatccgcatccccggcgcacccgccttcagcatcggctacacccagggcgccgacggcgaagtcaccgaactgcagaccgtcgactcgcgagaatccttcggcgacaacggattaccgctggacgcgacgctggaactcaacccgggcgagatcaccgcgcaggtggacgtgcgcggccaggcgccggtccggctggtcgccgccgacgggcgggtcagccagttcccccgtgtctgggccgccgtcagcaccggagacggccgccggggcgtcggttggctggaatggaaccgcaatctcggcgaacggatcgggtgagcggatcggcacccgtcgtggtgatgggcgtctccgggtcgggcaagtcgacggtcggggtgacgctcgcccggcgcttgcgggtcccgttcgtcgatgccgacaccctgcacccgcccgccaacatcgccaagatggcggccggcacaccgctcggcgacgacgaccgccgcccctggctggacgaggtcggcgaatggctggccgcccatcgcgacggcggcgtggccgcttgttcggcgttgaagcgggcgtaccgcgaccggctgcgcgcgcactgcccggacgtcgcgttcctgcatctgtccggttcggcggcgctcctcggcccccggctggcggcccggtccggccacttcatgccggccgcgctgctgcagtcgcagttggacgccctggagccgctgggccccgacgaggcggggttgaccgtggacgccggccgcgaggtggattcgatcgtcgacgtcgtcctgcgggcccgccggtagccgacccccgggccgtcgtgtagcattctgctacggactgtaacggggtgttgcggtcgcggggcgtcgaggaggatgtgatggccgaggccgtcgatcgggtcacccgggtcgcgtccgatctgatggacagcgcggcggccgagggcgcccgtcagagccgctcggccaagcagcagctcgaccactgggcgcgggtcgggcgtgcggtgtccagccagcacaccgcgtcccggcggcgggtcgaagccgcgctggccggccggctgtccaccgccgaaatcaccgccgaagagggcgtggtgttcaacgccgagatctcggcggccatcgacgaaagcctggcgcgcaccaactacggggcgacgctggccgggcagggtgtcaccacggtggccctcaacgacgatggcgagatcgtcgagcaccggcccgacggcaccgcggtggtgctggccggccggcgctgacccggcacccgcgggcggtccggcggccggatggagcgactcgacgtggtggtcgggcccaacggcgccggcaagtcgacgttcatcgcgttgaccctggcgccgctgctgccgggcagcgtggtggtcaacgccgacgagatcgcgcggcagcgctggccgcaggatccggcgtcgcacgcctacgacgccgcgaaggtcgccgccgacacccgggcgaagctgatcgacctgggccggtcgttcatcgccgagaccgtgttctcccacccgtccaagctggacctgctgcacgccgcccgccgcgccggcttcaccgtcgtgctgcacgtgctgctcatcccggaagaccttgccgtcgaacgggtccggcaccgcgtgcgggccggcggccatgacgtgccggaaaccaagatccgcgagcggcatcgccggttgtggactccggtcgccgaggcgatgaccctggccgacctggccaccggctacgacaacagccggctgcgcgggccgcgtgtggtggcccggctcagcggcgggctgacggtcggtgccgtcgactggccggcgtgggcacccgagaccttgcggtcgcgttggccggtctaaccgctcaccaggacagcttgcggcgtccggtcccgacctggccgccgacccgctcgcgggcggtgtcggccagcaggctgccgcgctgccgggcggtttcggccagctcctcgccgcgcacccgcgccgtgccggcgagcttctcgctgcgcttgcgtgccttcttggccagcttctcgctgcgcttgcgcgccttcttggccagcgacttgccgcgctcggcggcctcctcggcgagttcctcgctgcgcttgcgtgccttctgggccagataggccgcccgctcggcggcctcgtcggccaattcctcgccgcgcttgcgtgccttcttggccagcggcctcccgcgctcggcggccgtgctggccaattcgcggccccgttcgagtgccgcttcggcgtacggcgcgccgcgttcggcggccgtgctggccaattcgcggccgcgttcgagtgccgcctcggcgtacggcgcgccgcgttcggctgcggtgctggccaattcgcgaccccgctcggcgccgatctgcaggccgtgcgcaatccgctcgcccagctccgacaggtcggcctcgaaccccgagtcgtcggagccgggccacgccgaagacacccgttccgagagccgctcggcggcccgccgtccgcgccagcccagcgagggcttgcccgcggtgtccgcggaggcgatcaacaatccgcccagcaggctcaggtcggtgagaaactgttggcgcttctgggctttggccaccgggtcgctttcgttccagaacgagtgcgccccgaggttggccggcaacaccgtcagcgcgagcgcggccgaggcgacccggggcagcttgccggtggccagcagcagaccgccgccgatctggaccgccgccgtgatctgtgcgaccgtctcaggatcgctgggaatgttgccgctcaccggatccggtaacgcctgcagcccgtccacggccggcgccgccgcctcggccgccgatttcgggttgagcagtgagttgactccttgtccgatgaatgccactgataacaggggtcgcgcgattctcctgatcaccatggcccgtgtattacccggctcgttgtcgagcaaaccgtggtgccgatatgcccagctagtgccgcgccgcggcgctgcggcggcccggcgggtgcggctagggtgaagtggtgcgagcgttgatcatcgtcgacgtgcaaaacgatttctgcgagggcggctcggtgccggtggccggtggcgcggccgtggcgcccgccatcaacgcctacctggacgacgctccgggctacgactacgtggtggcgacgcaggatttccacatcgacccgggtgatcacttctccgaccggcccgactattcgtcgtcctggccggtgcactgcctcgccggcagcgccggcgccgatttccggcccgagctggacaccacccgcgtcgacgccgtcttccgcaagggcgcctacgccgcggggtacagcggcttcgagggcgtcgacgacaacgggacgccgctgctggaatggttgcgccggcgcggggtcgacgaggtcgacgtggtcggcatcgccaccgaccattgcgtgcggcggaccgccgaggacgcggcgcgcgcgggcctgaccacccgggtgctggtggacctgaccgcggccgcagcgcaggattcggcggcccgggcgctagacgaaatgcgaagcgccggaatcgaattggtcggagtgcgctgatggtggcgcccctggatcgacagcagctgctggccgcggtggagcgctcgccgcaggccgccgccgagcacgaccgcgccgcgtgggtggcgttgttcacccccgacggccggatcgaggacccggtcggctcgcgaccgcacctcgggcggacgcagatcggccgcttctatgacacgttcatcgccccccgggacatcaggttccaccgcgatctcgacatcgtcttcggcacgacggtgctgcgcgatctggagctcgaggtggcgatgggcccggcggtcaccatgtacattcccgcgttcctgcgctacgaccttcgagaaaccaacggcgagtggctaatcggcgcgctgcgtgcttattgggagcttccggccatgatggtccagttcctgcgcagcggcccgggcgcggcgcgccccgccgtggacctgtgccgcgggctgctgcgcaatcagggatggcggggcagcgcgggcttcatggccggattccgccgcgtgggcgcgccgcaccaacggctggtgcggcgcttcctcgacgccgtcgcagccggcgacaagttcgccgctgcgcaggcgttgtcatcaacggcggcaataactttgggcgaccgcgacccgatcgaactggccgaattggccgaacagttggcgggggcgggcctcaccaagatgaacagcgccggccccgccgtggcggtctcgctgcattcgggtcacggccgcgccatcatgttcgccgatgtggcctggcgggccaacgcgatcaaccggatccgctacttcccggcctgacctcgcgcccgattcagcgcagagccatccaggccagcgatgccgcggacagacacaggtaggccccgggaaacgcgatgttgtacagcacgccggcccgcaggtgcgtcagcaccgcaccgacgaagaacaccaccagcccggcggccgcggcgattcccagcgccggcaaccccagcagcccgacgacgaggccggcggccccggccaatttcgccgcacccagcgcgggcagccaggaccgcggcaccccgacctcggccgagttggccagcacgaatcgcgccgggacgaagtcggccaccgcgatcgcggcggtgatggccgcggtgaacagtatgatcccgacgaatacggtgttcatgtgcataaatcccttgccgcgcagccgtttccggggttctcgccgcggccggccgcgcgggtacacagcgccccgcgacccgtgatgggtatggtcatggtggtccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttcggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatccccttggcatgtcggagggatgcggtcaccaacttgacgactgccgtgcggaaaaggtgacccatgaacgccccacgaaatttggcggagctggcgcagcgtttcgacgacgaccggcgccacctgaggtcggtcgcgttccagctgctgggttcgctggccgacgccgacgatgcggtgcagtcggcctggctcaaggccagtcgcgcggacttcgcggcggtcgacaacctgtccggctggttcacgacgatcaccgcgcgcgaggccctcgatcagctgcgggcgcgcaaacggcgtgccgagctaccgctcgccgcgcccgaggagctggaccggctggccgtgccggcgtcgtcgccggccgacgaggacaccctgctggccgagtcggtgagcaccgcgctgctggtggtgctcgatcggctctcgccggcgcagcgcgtcgccttcgtcctgcacgacgtgttcgccatgccgttcgagacgatcgccgaattgttgaaccggtcgccggacgccgccaagaagctggccagccgggcccgcgcccggctggccagcttcgccccggccggcccaccccgccgggacgggcaccggatcgagcgccacgtcgaggtggtgcaggcgttcctggcggcgtcgcgcggtggtgacatcgccgcgctgctgcagctgctggcccccgacgtactgcgcacggtcgatcctgtcctggtgcccgcggacgtgccgaccgcgctgcgcggcgccacccgggtcgcgcaggagacccgtcgattcgccgggcgggcccgcgccggtgctgtcatgctcatcgacgggacaccgggcatcgtgatcgctgcccgcgggcgcgcccagatcctgttgatgatcggcatcggggccgacgatcgcatccacacgatcgacatcaccggcgaccctgagcgcatccgccgggcaacgctggcgctgccacccgccggccggttcaggaacatcacaacctgatcgggtaccaaggacgtcagaggacgccggccaccggaccggcaccgggccagaccgggaggaccatgctcgataggccgttcggacggcgcagcctgctgcgcggtgcgggcgcgctttccgcggcggcgctcgccccatggtcggccggctgcggctccgacgacgacggcgcgctgaccttcttcttcgcggccaatccggaggagcgggacgcgcggatgcgcatcatcgacgagttcgcgcgccgccaccccgacatcaaggtgcgggcggtgctgtccgggcccggcgtgatgcaacaactttcgacgttttgcgtcggcggcagatgccccgacgtactgatggcgtgggaactgtcctacgccgaactcgccgaccgcggtgtgctgctggatctgggcccgctgctggcgcgggacaaggcgttcgcccagcagctgcaggccgacagcatccccgcgctgtacgagaccttcaccttcaacggcaagcagtacgcccttcccgagcaatggtcgggcaactacttgttctacaacaagcggctcttcgatgaggccggagtgccgtcgccgcccgcggcgtgggaacacccttggggcttcagcgaattcctgaacgcggcgcgcgcgctgaccaagcgcgacgcctccggccgggccgcccagtacggattcgtcaacacctggggctcctactactcggccgggctgttcgccatgaacaacggcgtgccctggtcggatccgcggctgaacccgacccacttcaacttcgacaacgccgccttccaggaggcggtgcagttctacgccgacctggccaacaaataccgggtcgcccccaatggctcggagacacagtcgatgtcgacgcccaacctgttcgccgtgggcagggccgccatggcgctcggcgggcactggcgctatcagacctacctccgcgccgagggccttgatttcgacgtcgctccgttgccggtcggtccggcggtcggcaaggggcagcccgcctgttccgacatcggcgccaccgggctggctatctcatcgagcagcccgcgcaaggagcaggcctgggagttcgtcaagttcgccaccgggcccgtcgggcaggcgctgatcggtgaatcctgcctgttcgttccggtgctgcgctcggcgctcaaatcggacggattcgccagggcgcaccggcgggtcggcaacctcggcgtgctgaccgacggaccggctttctcccagggcctgccgatcaccccggcgtgggagaaggtcaatgcgttgatggaccgcaacttcgggccgatcctgcggggcagccggcccgcgacgtcattggccgggctgtcccgctccgtcgacgaagtgctgcgcagcccatgaccgcgctggacaccggggcgggccggcggaccccgaagaacccgagcccgtggcgccggcacgcatgggcgggccggttgttcgtcgcgcccaacatggtggcggtcgctgtgttcatgctctttccgctgggcttctcgctgtacatgagctttcagcggtgggacgtgttcaccccgccgaagttcgtggggctgaagaacttcacggatctgttcagctccgatccgttgtttctgatcgcgatccgcaacacggtgatcttcacgctgggatcggtcgtcccgacggtggccatcagcctggccgtcgccggtgtgctgaaccaaaaggtcaggggcatcggcattttccggacgatcgtctttctgccgctggccatctcttcggtggtgatggcggtggtgtggcaattcgtcttcaacaccgacaacgggttgctgaacatcatgctcggctgggtcgggctgggcccggtgccgtggctggtcgagccccgctgggccatggcgtcgctgtgcatcgtcagcgtgtggcgcagcgtcccgttcgccacggtggtcctgctggcggcgatgcagggcgttccggaaacggtgtacgaggcggccaggatcgacggcgccggcgagatccggcaattcttcgccatcaccgtgccgctgatccgggggtcgatctcgttcgtggtgatcatctcgatcatccacgcattccaggcattcgacatggtctacgtgctcaccggccccagcggcggacccgagtcggcgacctacgtgctgggcatcatgctgttccagcatgcgttctcgttcctggaattcggatacgcctccgcgctggcgtgggtgatgttcgcggtcctgctggtgctgaccgtggtgcagttgcgggtcagccatcgacgttccttggagacttcccgtgggctcaagtgaggccgtcatcaagcgcaccgtgctccgcgccgctaccgtctacgccgcgctgctgggcatcgcctggtgcgcgctgttcccgatcgcgtgggcggtgtcgggatcgctgaaaaccgagggcgaggtcagcgagcccacgctggtgccggcccgcccgcgctggtcgaactacaccgaggtgttcgcgttgatgccgatcgggcggatgttcgtcaacaccgtgctgtacgccggctgcgtcaccgccgggcatgtcttcttctgttccctggccggatacgccttcgcccgactggatttccgcggccgcaacacgctgttcgtggtctacctgggcacgctgatggtgccgctgacggtgacggtgatcccgcaattcctgatcatgcggacgctggggtgggtcgacaccccgtgggcgatgatcgtgcccgggttcttcggcagcgctttcggcacctacctgatgcggcaattcttccgcacccttcccaccgatctggaggaagcggcgatcctggacggttgcacaccgtggcaggtctactggcggatcctgctgccgcacgcccggccggcggtgatggtgctcgccgtgctcacctgggtcaacgtctggaacgacttcctgtggccgctgttgatgattcagcgcagcagcctggccaccctgaccctgggcctggtccggatgaagggcgaatacgttgcccgctggccggttctgatggcagcctcgatgctgatcatgctgcccctggtcatcatctacgcgatcgcgcaacgctcgttcgtccgcggcatcgccgtcaccgggatgggcgggtgagcatggcttcggtgactttccagcaagcgacccggcgttacccgggggcggaccggcccgccctggacaatctgaacctcattgtcggcgacggtgaattcgtggtgctggtcggaccctccggctgcggcaagaccacctcactgcggatggtggccgggctggaaaccgtggactccggacgcatcctgatcggtgaccgggacgtcaccaacgtcgaccccaagcaacgagacgtggcgatggtcttccagaactatgcgctgtacccgcacatgacggtggcccagaacatggggttcgccatgaagatcgccaagatccccaaggcgcagatccgcgagcgggtgctggacgccgcgaaactgcttgacctgcaaccgtatctggatcgcaaacccaaagatctgtccggcggtcagcggcagcgagtggcgatgggtcgcgcgatcgtgcgccggccgcaggtcttcctgatggatgaaccgctgtccaatctcgacgccaagctgcgggtgcagacccgcaaccagatcgccgcgctgcagcggcggctgggcaccaccaccgtctacgtcacccacgaccaagtggaggcgatgacgatgggtgaccgcgtcgccgtgctgcgcgacggtgtgctgcaacagttcgcgccgccccgcgagctctaccgcaacccgagcaacgtcttcgtggcgggcttcatcggatcgccggcgatgaacctgttcaccttgcaggtagtggattcggctgtgtcacttggtgattggccgatcgcactgccacgcgagatcgccgccgcggcaagcgaagtcgtcgtcggggtgcgtcccgagcatttcgagctgggcggcctcggtgtcgagatggaggtcgacgtggtcgaggagttgggtgccgacgcctacctgtacggccggatcaccggttcgggcaaggtgatcgacgcgccgatcgtcgcgcgtgtcgacgggcgcaaccccccggagaagggcagcagggtgcgcctgcatcccgcgcccgggcacctgcacttcttcgggcgcaacggccagcgaatcgggtaagggggtcatggtgaacacagtgcgtgccgacctggtgtgcgaaggcggcggcgtccgcggcatcgggctggtcggggcggtggatgcgctggccgcggccggctaccggtttccccgggtggccggcagcagcgccggcgcggtggtcgcctcgctggtggcggccctgcaaaccgccggcgagccgctgagccggctgaccgacatcatgcgcaccatcgactaccggaagttcttggaccgcaatctgatcggccacgtgccggtgatcggcgggggactgtcgctgttgacgtcggacggcgtgtaccgcggggcttacctggagcagttgctggccggtctgctcggcgatctgggcgtgcggacgttcggcgatctgcgcaccggcgaggcgcccgagcagttcgcctggtcgctggtggtgaccgccagcgacctgtcccggcgccggctggtacgcatcccctgggacctcggctcgtacggcatcgaccccgacgacttcccggtggcccgcgcggtgcacgcctcgtcggcgattccgtatgtgttcgagccggttcgggtcggcggtgccacctgggtggacggcggcttgctgtcggactttccggtcgagttgttcgaccggccggacgggcaaccgcagtggcccaccttcgggatccggttgtcggcccggccgggcattccgcccacccatcccgtgcacggcccggtgtcgttggggatcgcggcgatcgagacgctggtcagcaaccaggacaacgcctacatcgacgacccgtgcaccgtgcggcgcaccatcttcgtgcccgccgaggacgtcagcccgatcgacttcgacatcaccgcgcagcaacgcgaagctctctacgaacggggaaggcaagcgggccaacagtttctgcagacctggaactacgccgactacttgaaggcctgcggcggcccggtgcccgaaactccgtgacggcggtggaccgccgggcaattggctatccgcgcgagcagcggatcgcgtgaacgcggcgcaacaccaggttgacgtcctgcggtgagggcagctgattggtgaaccgggtgatctccaccccgatgtcaacggagctgatcggccacagtcggcgggcgatgagatcggttgcgatggcggtgatgtcgtcgtggcacagacgccggtgcgccgacgccaccaacggcacgtgaccggtggccggcatgccggcggggtagccggcccgcacgaaagccacaatgctggtcacccagtgcgccaggtccatacgtccacctcgctaaccgccgcggttgcgcttaagcggcagtgctttacctggctagcaacgtaccatcggtaacgcgatcagccaggtaacgccacacagttaaacgcgtttttctcgccggcggtgccggcagccccggcccggtttcagcggcgccggcctcggtcacgattcgcacacggtggcgcgccgtaacgatgcttggccgcaacgctttctagtatcgccgcgtgatggatcgctatggaacggatgtccttgcgccgggtcggcgcaagccccgctcgaccgagcatcccgccgagccggggctggtggtcgaggacgtggaaaccggctacgtcggcgcggtggtgcgggtggaatacggtcgggtggatctggaagaccggcgcggtcatgtgcgtgggtttcctttgggccctgggtttttgctcgaaggccgcccggtcatcttgacagcgccgcggcggccggcgccggccgccgcggccaggacggcgtccggatcggtcgccgtgccgggcgcgcgagcgcgggttgcccgcgccagccgcatctacgtcgagggccgtcacgacgccgaactgatagcgcaggtgtggggggaggacctgcggatcgaaggcgtcgtcgtcgagcaactcggcggcgtcgacgatctggtggacatcgtcgccgagttcgcacccggcccggggcggcggctcggcgtgctcgtcgaccacctggtgcccggttccaaggaggcgcgcatcgccgacgcggtgcgacgggggccgggtggcaccgacacgctggtcgtcggccacccctatgtcgacatctggcaggcggtcaaaccgcagcggctgggcctggcggcctggccggaggtgccccggcacgtggagtggaagcacggcgtgtgccgggcgttgcgtttgccgcacgccgatcaggccgacatcgcccgggcgtggcggcacatccgttcgcgggtgcgtgactggaacgacctcgagccggcgctgatcagccgggtcgaagaactcatcgacttcgtgacgcagccggccgcctgacccggcgcccgcaggacctggccgccggccggagtttagctaggctacgctaagccgaaagtcccgatcggcgggacagaaatcgggcgtatgcagggcgtattcggcgtattcatcggcacgtttctcatcggtctgcgtgaaggcctcgaggcgtcactgatcgtgagcatcgtcgccgccttcctcaagcgaaacggacagaccctgcgcccgatgttcgccggcgtcgcggtggcggtgctgctcagcgtcgcggtgggcgtcggcctggacctgctggcgaccagcctgccgcaggcccagcaagagatgatggaaaccgtcatcaacgccgtcgccgtggtgttcgtgacctcgatgatcatctggatgaaccgcaacgccgcgcagctcaagggtgaactcgagcgcgaagcccgccaggcggtccaccgcggcggggccctggccctgggcgccatggccttcctcgccgtcctcaaggagggcttcgagacgtcggtgttcctgctggcggcggccgagacctcgcacggcagccggtggttcgccgtgctgggcggggtgctgggcatcgcgacgtcgatcgggctcggcgtgggcctgtacttcggcggcctgcggctgaacctgggccggttcttccgggtgaccggggtgttcctggtgctgatcgccgccggcctggtgctgggtgcgctgcgcaccgcgcacgaggccggctggctgaacatcggccagcggcagcttttcgacctgtccggctggatcccgagcgattccgtgctgggcgcggtcaccaccggcgtgctcggcatccccgccgacccccgtctggtcgaggtgctgggctggctgctgtacgccgtgccggtgctcgtcgtgttcctgcggccggcccggctggcggccaccccgcgcgcccgaggccggctgctggcgaccgccgccacgctgctgctggccatcgccgccgtgctcgcggtcgcggcgcccgcccgggacacggtcgacgccgcgcgcacccgcaccgtcaccgaccgcgccgggcacgccgccgcggtgtcgatggcgaccgggccgcacgggcgcgaactgaccgtcacccccgcgggcacctcgaccgtgcaccacatccagcttgtcccggccgacgaccagagcgtggacgggctgccggtccaggcgtggcaggcctccgaaaccgccggggttgacggcgcgcccgagatcacgctggaccagctgcgcgacatgaccggcggccggctgccggtcggtctggcggcggcgcgcaccccggggccgtttcagggccaatggtcgacgaccaccgtgtacacggtgctcacccggggcgacgcggtgatcagtgcgaaagcggcgagcaaccgcacggcggtgctgaccggcggcgggttgaccggggccaagaccgtcagtctcggcgggctggcgaccgactggtccacgtccgccgccgaagaccacgcgaccgccgccgcgatcgctgccggcgaccgcaaccggggggagggacagctgtggaatgtctggcttcccttggtaatcgccggtttcgcggtggcgtgcgcgctgtcggcgctagcctcggtgcgcgtggaccgcaagcgagaagatgagaggaaagcaatcgatggtgaggcgcatcgccggggcaacgtgccggtctcgtgaatcagcttggcccgcagcggttctcgttgcgacgacgatgctgtcggtgaccgcatgcggccactccggcgacaacgcgaaccatgctgcgcagtccaagcccggcggcggcaacgcggtcaagatcaccctgaccaacagcgccggcaaggacggctgcgcgctggacaccaccaacgtgcccgccgggccggtcaccttcaccgtggccaacaccaatgcccccggcatcagcgaggtcgaactgctccgcgaccagcgcatcgtcggtgaaaaggagaacctggcaccgggattggacccggtgtcgttcaccctcaccctggacggcggctcctaccagctctactgccccggggccagcaccgagtaccagaccctgacggtgacgggcaaagctccggcgacgccgacgggcaccatcgcgaccgtcctcagccagggcaccaaggactatgcggcctatatcgtcaaccagatcggtcagctcaacgacggcgccaaggccctcgacgcggccgtgcaggcgggcaacctcgacgccgcgaaggcggcctacgccaaagcccggttgtactgggagcgttcggaatccaccgtggagggattcgtgctgcccggcttcgcggtcggcgacaacgccggcaacctcgactatctgatcgacatgcgggagtccaccccggtcgacggcaaggtcgggtggaaaggcttccacgcaatcgagcgcgacctgtggcaggccggcgcgatcaccccgggcaccaaggcgctgagcaccgagctggtgggcaacgtcggcaaactgcacggcatcgtcgccaccctgcagtacaagcccgaggacctggccaacggcgccagcgacctgatcgaagaaatccagaacaccaagatcaccggtgaggaagaggccttcagccacatcgacctggtcgacttttccggcaacgtggaaggcgcccagcaggcgtacgcgtcgctgcgccccggcctggagaagatcgacaacaacctggtccaccagatcgaccagcagttccagaacgtgctcgccaccctggacggatatcgcgaccccggcgcgctcggcggctaccgcacctacacgccggccctgaaggccagcgacgcgcccaagctgaccgcggtcatccagccgctgcatcaaagcctgtccaccgtcgcgcagaaagtcgtctcggccggctgaccatgaccgacgaccccatcgaacccaccgacggcgcgccgaaaagcgaaggcgtggaacctgattcgacggccgtgtcgcgccggcgcgcgctgggcggcgcggtgctggccggcctcagcggcgccgccatcggcgccgtaggcggcgggttcgccgggcacgccgtggcggcggggcagcgcggcgacgaccacgacaccgtcgacctgcgccgcagctaccccttctacggccagccgcaccagggcggaatcgacacgccgccacagcgttacgccatgttcatgtcgttctccctggcgtccggtgccggccgcaccgagttgcagaccctgctggcgcgctggtcggcggcggccgcgatcctgcagcagggaaagccggtcggcaccgtgcagccgcaggtcgacgtgcagcccccggccgacaccggggaggccgacgggttgagcccggccagcctcaccgtcacgatcgggttggggccgtcgctgttcggggatcgtttcggattggccgcgcgccggcccgcggtgttcaccgacctgccaccgctcaatggcgacaacctggatcctcgcctgcacggcggcgacctgtccgtgcaggcgtgcgccgacgatccccaggtttgctaccacgccgtgcgcaacctggcccggctgggccgcaacatcgtctcgccgttctgggcggtgctcggcttcggccgggcctcggccggccccggccagcacacgccgcgaaacctgttggggttcaaggacggtactcgcaacatctccagccaggcggaatacgaccggttcgtgtgggtcgacaacagcgaccagccgtggatgaacggcggaacctaccaagtggtccgcaagatccggatgctgctcgagacgtgggacgtcgaccggatcggcaatcagcagcggatcttcggccgcaccaaggaagaaggcgcgccgctgtccggcaggcacgaattcgacacccccgatttcaccgccaagggccccgacggcaatccgctcatcgatccgatgtcgcacgtcggcctggccgcccgggagaacaacgacggcatcatgatccgacggcggtcctacaactacaccgacggcctggacgccaacggccaactcaacgccggcctgctgttcgtctcgtatcaaaaagatccgcaagattttatccggctgcagaaccggttgggcgcccacgacctgctcaacgagtacatccgccacatcgggtcagcaatcttcgcggtcccgcccgcgcccgctgaaggccactacatcgcccaaagcctgttccgctgagcaaattccgccgcgcggcgcgcggcggtaaccgcgccgccggtggccggcgccgatgtgggccggctcaccgccgcagcaggccggcccgccgtcacgcgtcggcgcccgccgagcaccaactccgtgaagccgcacaatcagcgagaaacggagaagtcacatgaccgacgcgctcgtcatcgacgccgaaggcctggaccggctgtcctgtaacgccaaggcaaaccccgagaccggcaagaagacgctgaaggccaagacggtgtgcgagaagggattccgcaacatgacctacgtccggggcctggcgcccatgctggtgggggagccgcccgcgctgctgggcgacgactcggcgcccaacccctccgagaccgcgctggccgcgctgggctcctgcgtgtcggtggggttgctggccaacgccacgcatcgcggcgtgacgctgaccaagatcgaggtcgagatggaagccgacatcgacatctccgcggtgtggggtgtcggggacaccccgccgggtaagcggctcgggttcagcgcggtgcgctgcacggtgagcctggccggggacgcggacgaggccacgctgaaggagatccacgacaacgccatcgcctggtcgccggtggtgaacaccttccgcaacccggtcagcgtcgactccaccctggtcaccggatgagcaccgcgaactgcgctgggccccaacggcattcgatgccgggacaccggaggtgatggcatgacggcgaccgtggatgccgcaaccggcctgctcgacgccgcgctggtcgaggacatccgggctcatgccgcggtgctggaccgcggccaggacagcgcccggcgcagcttcaccgcgctgggcgaggccggcgtgctcgggatcggcgcccccggcaaccgcgacggccggctgccggtgatggccgaggtgatccggtccatctccgggatctgcatgagcaccggcttctcgctgtgggcgcaccgcatgacggtcgagtatttgctcacggccgcaaccccgttcagcgccgtcgcggtccggccgctgctgcgcggaagcgcactgggggtcaccggcatggccgccgcgttcaaagaggcggcgggctgcggcagcgtggagctgaccgccacgccggtggccgggggctaccgggtgtccgggccgatcaggtgggccagcaacctgtatcccgattcgacgatggtgaccgcggtgcgcaccgaggccggcgagcggttgatcgtcgcggtgccgctggacacgcccggggtgatcctgggcgagcacttcgacctgctcgccctgggcagcaccgcctcgtcgtatctgaacttcgacggcgcgcacatcgcggacgagcaggtgctgtcccgcgatttcgacggcttcctgcaggcggtccggccgactttccttgtgctgcaatccgcgatgtgcctggggctgagccggaccgcggtgcggcaggccggcctcgggctgggcggagtcaacgcggtgtttcgcgccgacgtcgaagccatcaccgagaagctgggcgcagccgaggaaacgctggcgaaactggccgcggccgtgggcgggccggcggcgccgagcaagaaggagctgttgtcacttcggctggccgcggccgaattggccgccgccagcgccgatgtggagatccgcaccgccggcggcaagggttatgcgagcaggacatcggcgagcaggcgctaccgggaggcggcgttcattccggtccagtccccgtccgaggcgcagctgcgctgggagctggccggatgcggctgagcacgggtcgatggtgaccccggtggcggtgccgccggaaggcaccgacgcggggcggctggtcggcggtgtgccgctggcccgcctggtgcgcgactttcaccggccgatgctgaatttcgcccgcaccatggtggattcgccggcggtggccgaagaggccgtgcaggaggcgtggctgcaggtgctgcgatcctcggactcgtttcagggccgatcgtcggtcggcacctggctgttcggcatcgtcaagcacaccgccgcgcggcaccgccgccgggaggcgcggatccggcgtcacgaggtgctggccgacgcggacatcgaggccgtcgacccgctctccggccgcatgcatcccgccgggcatcccgatgccggccactggagggtgccgccgtcgcgccggttcctgcccgaagaccggaccgtgcaccgtgagctgctgggctacctgcgcgaggcgctggacgcgttgcccgcgcgccagcgccaactcgtgatcctgcgggatctcgtcggcatctcggccgaggaggcggcggagctgctgcaactgtccgccgaggcgcagcgggcgctgctctaccgggcccggggaaatctccgaaacgaattggaaaagcggtaccagccatgaccgttcccgacaacaccgtccccgccatcgactgcgtcgacttcgttcgcctggtcgacgacctcgttgacgccgacccgcagcagtgggggccgatcgtggccaagcacctcgacgagtgcccgccgtgcctggtctacctgcaacagatgctcgacctcaagatcctgctccgccatgtcttcgacggcgagcagctcggcgagcacgacgtgacccgaatcctcaacgcgctcaacaccttgacgaaaggcgaacaccgatgacgatcaacgcttcagcgccgcagcgccagggcgcggtggcggtggtggacacggtcaccgcgttgcccgccgccgtcgccggcgacggccacaccgcggatcccttcgagccgctgacggtcggcgccatggtggaccgggtttcggccatagcggtggaaaaggcggcgcacccgtgggcgttcctgatgcgctcgttggtcggcggcgcgatggtggcctttggtgtgctgctggccctggtggtcagcaccggcgtcaagacaccgggcgtggcgagcctgttgatgggcctggcattcggcatgtctttcgtcctcatcctggtgtcgggcatgtcgctgatcaccgccgacatggccgccggctttctcgccgtgctgcaacgggcgctgagcatccgcagctacgtggtgctggtcgccgtcggactggtcggcaacatcgtcggcgcgctggtgttcgtcaccgtgtgcgccgccgccggcggcccctacctgggcgccttcgccgaccgcgccgcgaccgtcggcacccagaaggccggccagccgttctggacggcgctgctgctcgccgtgctgtgcacgtggttcctgcagacctcgatgtgcatgttcttcaaggcccgcagcgacgtggcccggatggcgctggcgttctacggcccgttcgcattcgtgatcggtggcacccagcacgtgatcgccaacgtcgggttcgtcggacttcccttgctgctcaacctgtttcacccgatcgccgcgcgcggcgatatcggctggggaatcggcgaccacggcctgctgaccaacatcggcgtcaccaccgtgggcaacctgatcggcggcaccgtcttcgtggcgctgccgttctggatcatcgcgcacttgcagcggcgccgcatcctttcgacgggagccctccggcccgacggctgaggaccaaagcctcacgaccgacaccccctccgcggaatagcatggtcaccgatggagggagaatgaaatgtccgcacccgtccagcaactcggcatcgccgtcgcggtcgacggctcgccggcctcgaacgcggccgcctactgggcggcccgggaagcggcgatgcgccactgcccgctgaccatcgtgcacgcggtgtcgaccccgaccaccatgtacccgccggtcccgtaccccgaggcgctggccaccaacctggaagacgaaggcaaacaagcgatcctgcacgccaccaagatcgccgaggaggcgatgccggccgaccgccaggttccaatcggccgcaaactgctctactcggccccggtgcccgccctgctcgagctgtccggcgccgtgcgaatgctggtgctgggcagcgccggacatggattgctggcccgcggtctgctcggctcggtcagctcggcggtggtgcgtcacgcgaactgcccggtcgcggtcgtgcgggacgaagagctgccggatccgcacagcgcgccggtgctgctgggcaccgacggctcaccggcctccgaattggccaccgaaatcgcgttcgacgaagcatcccggcgcggcgtcgatctggtggccatccacgcgtggagcgacaccgcggtcaccgaggtattcgaaatcgattggccgatagtcgaagccgaagcggagcgccacctcgccgagagcctggcgggctggcgggaacgctatcccgacgtgaccgtccatcgcctggtcgcccgcgaccgggcggcgcaacacatcatcagcagctcggaaaccgcgcagctggtggtggtcggcagccacggtcggggcgggctggcccggctgctgctgggttcggtgagcaacgccgtcctgcactcggtgcgggtaccggtcatcgtcgcgcgaccgccggcctgagcacgcggcctcgccgccggccgaacaacccggttcacgccggccgctccaccgggcgagcggtgggacgtaacgccgcgagcagcacaccggccgcgaaaaccagggcggtcggccacggaaaccgcccgtcgggggcaaagccctcggcggccaccacggacagggtgtaggccgccagcgccgcaccggccagcagcacgggttcggcggcgcgcgcgggcagcggcacgccaagcagtggcagcggcgcggcgaaaagccttcgggcccaccacaacagcaccatttcgaccgccgtcaccgcgctcaggacggccacccattccagccgggcctgccaccactgcacgctgccttcggggggctgcggcaacagcccggccggatatccgacgatcgccacgatcacgacgggaatcatgtgccacaggtagagggccatgatgttgttgttggcgatcgagagcccccgctcggcccggatggcgcgcagcgcgcggttgagcgcgggtgcagccgccatcacgattccggtttgggcgccgccgaaggccagcagcgccacggtgggcggcgtggtgttgtcgatggtctggccgggaaccccgatcatgctgaccggatacacgcgcagccaaatcaatgccgccagcagcaccgccgagacgccggccagcagccacggccggcggcccgccaatgacccttcgtgccaagcgatcccgagctgatacagcgttccccagcccaagacatagttcacccagcttaggtggggcagatgggcgccgatccgggccgcatcgaccacggccaccgtcacagcgagtgccgcgggcacccacagcccccaacggcgttgcgcgacaagcgcaatcggcgtcgacgacaccaccaccagatacaccgccaaaaaccacaggtgcatggccaccgcccaaccggcgtactcgagcaccgaacccgccaccccgcaggcggccagcgcgaccaccaccgccgacaccagcaccgcatacaccgcggtcggcccgaggacccgggccagccggcgctgcagccaggaccgacggggcactccctcttcgtcgtgccggtgcgtccaggacaccgcgccggcgtacccggccaccaggaagaaggtcggaaccgcctggaacggccaggtcagccattgcgtccagggcatgtccaccaacgggttctgccggccgaactgcccctcgtgataggtcaccgatccggccagccagtgcccgagcacgatcagcaccaccccggacacgcggtaataatcgaccgccagattgcgcgccggccgcgcgctgtttgcgtgctgcatcagatcgcgggaagctcgacgcgggacacagcgccacgctaccgtccggccccgcgcgcaaccacgtcaggaacaggagacgcgccatgaagcaggctcaactcggcggactgcaggtgggccggctgggcctgggggcgatgggaatgtcggtggcctacgccggggccggcaccgacgacgccgaatcgatccgcaccgtgcaccgcgccatcgagctgggcgtgacgctgatcgacaccgccgaggtgtacggcccctacgtcaacgaggaactgttggcccgggcgctgcgcgggcggcgcgatcgggtggtgctggccaccaagttcggcctgatctcgcacaccggccgcgacggcctggacagcagccccgccaatatccgtgtcgccgtggatggttcgctgcgccggctggccacggaccgcatcgacctgtactaccagcaccgcctcgaccgccaaaccccgatcgaagacaccgtcggagcgctggccgaactggtcgccgccggcaagatccggcacatcggtctctccgaggtcggggtgaacaccatccgccgtgcgcacgcggtgcacccgatcaccgccgtccaatcggagtactcgctgtggacccgcgaccaggaagacgagatactgccggtgctgcgcgaactcgggatcgggttcgtcgcctactcaccgctgggccgcggcttcctcaccggcgctatccgctccgcgcacgagctgcccgacaccgactaccgcaggaccaacccgcggttcgcggaacagaacttcgcccacaacctgcgctgcgccgacgaattgcgggacatcgccgcggacgtcggcgccacgccggcccaggtcgcgttggcctggttgctggcgaaaggccccgacgtcgtgccgatcccgggcaccaaacgcgtcgcccgcctagaagaaaacgtcggggccgacgcgctggagttgactaccgagcagctgtcccggctggatcgactcacgccgccggtgggcggacaccacgccgacgcgcagctggcgtggatcgaccgctgaccgaaccggttagtcggcggtcgccaatgccgctgtgccgtacttcttttcgatcaacgtccacgggtcggcgtaggggccgcgtccctcccagccggcgctgcacgatcaagatggtgcgcaggaggggccgcagcagcggccccagcagtcgcagggcgagccggctgcggccctgcgattcggccagccaggccaccgtctggctccagtcgtgctcctggaagtcgagcagctgctgggcttcggtggtgtcgtaccagccggtgaaactccagccccggtcgtcggccgggttgccgggcaaactggccgacgggccgagccggcccagcccgacggcctccatcatggcgtcctccagttcgcgctgggtgagcacgtaggactcgttgccgccgatgagcagcaccttgccggaaatggtggccgcacgatcgacgccgttggcgaaggccagcgccacgtcccgcgcatccaccgcgtgcatccggttgtcgctgggcatcgatcgcatcagcagcaggtagtcgccgttgatggaggcgtgggtgtccggcgagatgatcccgccgagccggaacagcgcatacggcagcccgctggcccggattgccgcctcggccagcaccttgtcctggccgtattggtcgatcgggttcaccggggtatccggggtgatccgctccggctggcggtaggggtttcgcgacccgtagaccgcggcgctggaggccattaggaacaggggcgggcggggcagcgccgtgcaggcggccaacaggttctccgtgccgccgacgttgactcgccgggccaggtcgggcttgcgatatgacagcggggagaccacggcggccaggtgcacgacggcgtcgggctggtgggcggtgaccaggtcccgcaccgcctcggcgtccagcaggtcggtgtaggcgggaatcagcgtgccgggatagccgccggcggcgagttcggttgcgacggcggcggtgttgtcattgcgcaggtccatcgcgacgacggtgcgtccgcgctgcagcagaagctgcgtgcagcgcttgccgacctgtccgaacgcgccggtgaccagaacggtgttggcggtcatggccgggtcaccgatccatcaggcggccggcgaaggtgccgatcgcggcgcggatccggggggagacgtagatcgagaagaggggagtcacgatgtcctcgcgcagtcgagttagcttggagctcttgatgaaccactggccgtcgatgttttcgtaggtttcgtggtagtggccgtagccgaccaaggttatcccgggcccgaagcggacgacgtcttgcagcgcccacgtcccgcgcgcggtcgtcgccgaggtgagctcgatctcggggttgtgcacctgatgcgccgtcggctgggtggcgcggccgagtgcccggcgggtgaaggccacgaagtcgtcggcgccggcgatcaccgcgccgccggcttcggaggtgtcgctgaggaagtcgtcggtgaagatcgtccgccaggccgcccagtccttggtgtccaggtagcggcagtagcgcgccttgagttgcttgatggattcgatcgccggcagggtgtcggcgaccgcgctgtgcgcgcgctcggtcattgcggctcgattcttctcgcacgggtctgcacgtgacgtttccctggcgaagtgtaaacccgtcagcctttgaagtagacgacctgatggctgctggcaagcagcccgccctgccgggtccacacccgggcgctctggtcgaaatagccgcggtcgaagcggttggcgtgggcgctggccaggacgaagtcgtcgcccacggcgtcgagctcgtgttgatcggcgtggaagtaggtggtcagcgagatggtcccggacggcacgaagccgccgcggcgcaagaacacccgcgggtagaagatgtcgcacaatgcggccagcgccggataatccaccgggcgtcccgccttgtcgcggacccacagcgtgctggtcgacgacgggctgggttcctcgtctcgcccgggcatcgccccttcgacgtaccgcatgtcgtagcggccggtccaccgaaccaggcccggatcgacgctcggcagccgctcgggcggcggggtgccgggcggccgcgcttcggtgtccgaccagctgtcgcgccgcagcgcgaagatcgcggtggcggtggtcttgaccacgtcgtcctggcgcagctcgacgatccagtgctggttggtgcggttggtgcgggcggcccgcagcgtgacgtcgaagtcgccgtcggcgatgggcgcggcgtagttgacggtcagggcaagcgggtcgccgatgcggtcggggtgggcgtggacggcgctgagcagcgtggcggccgtgatgccgccgaacggtccgaccatgttggcccactccgggtgggtgcggccacgccgggcatcggcgcccagcgtgtcgaggtgcagcgcttcatcgaaaacatgtgtgtcggtcatggcggttcgacgcagattacttgcgggcgacgccgcgaccggacaccgggtctcgcggacccggccggtccgttcgtagggcgccgcctgtacacccgccgcggcggtgctgtacagtcgcccagcacaaggtcgacgctgcaacgagaggccatccggtgacgtcggagtcggtcgaggaatttcggggccgggccagggcctggctggccgcgaacatgccgcgactcgatcccgcccgggcggcgctgctgcagcgcgacgagctcagctcctggcaccgggcccgggaactgcaaaagctgctctacgacggcggattcgccggaatctgtttcccgcgcgaatacggcgggctcgggctgagctacgaatacaagaaggcgttcgacgccgagtcggtgggttacgagacgccgctgctgctcaacgtcccgtccttcgccatctgctgcgccacgatcctggacatgggcagcgagcagcagaagcgcacccacatcgcggccgcgctgcgcggcgaggaagtgctggtgcagttgctgtccgagcccagcgggggatcggacctggccggtgtgctcacccgggccgagcgccgcggggatcgctggatcatcaacggcgccaagacctggagcacgtgggcgttcgcggcggactacggcctgtgcctggcccgcaccgactggcaggtgcccaaacacgaaggcctgaccatgttcctggtgccgcttgcccatcccggcgtcaccatcaatcgcatccggcaggtcaacggctcggtcgagttctgcgaagagttcttcgacgacgtcgacgtgggcgacgacgcggtgctgggtgaaccggggaaaggatgggacgtcgcgtcgcggcagctctatcacgagcgccgcacgatgggagacggctcggagtacaccagcggcccgggaatcgctgaggcccaagacgtttcggtcgatctgctgtcgttgatcgacgccgtcggcggtcccggcgacccgcggctgcaggaagcggtgggtcgggcgctggtgcaccgggccgtgcacggacagctcagcgagcacgtctttcacgccgtggtcgacggaaccctgccgccggccgcgggatcgatcatccgcctgtccatggccgaggtgcacaacgtggaaaccgacaccgcgctggcggtggccggcccggcggccgtggtcgacggcgccggtggcctgctcgacatcgggacgcgctatctgggtcgtcagatcgccagcatcggcggcggcaccaccgagatggcgcgcaacgtgatcggcgagcgggtgctcggcttcccgcgcgagcgcgccgacgaccgtggcgtcccgttcaaccaggtgcggcgcggcagaaacccaggaggccaacgcaattgagtgaccgacttcgtgacatccgggagttggccggacacaccgacacctaccgcgacgaactgtaccggcgctggaccggtctgctgagctaccgctacatcggccgcaaacactcgtcgatgaatctcggcgagaccgacgacactgtcacgatccgccgcgacatgcgcaacgaggccggcggaatcatggtggcgccgttggctatttcctccccggagggctgtcagaccgacatggtcgccgtccccaacccggtgatcgcgtcggtacagatcatcgaccccggctacgacgtgaaacgggtcgagatcgtcgggtccggcatcgtgcaccagggccgcaccatgggctacgggcgatgcaccatcgtcgacgccgacaaccccggacgggtgatcgcgttcaacgaggggcagggagcgatcatcggcgttccgccggaaggccttgaccggatggatgtttcgggcaccgaattggtgatcgaggattccgacgagctgccgccgctgtggcgggccttcggcgcgagccggcgcgccgacggccattggacgctgcccgagctgaacaccgagctggcatccccggacgccgcgctgcacatcggcccccagcacgtcgtcctcgagaccgcggccatcgatctggccgccgaggtcgcggggaccaggaagctgcaggtcgtcagctggcacgtgatgttcatgtcgcgcggcaaggtgggcccgttccgggtggagggcacagcccaccccggtgcgtccggccgcgtcggcgtgcgcatgctgctgcacgacgagggcaacgccgacaaggccgtcacctccgcggcggcaatcttcgaggtcgtcggctgagccggtcccggctgctgcgccgcccagaggccccctaacgcggtattacggcacaaagtccctcccgacagaggacgtcgtcccctcgtgcggccgccgtgacccgaccacgatcgaggtgagcaggcaaggagaagggtcgaccgacatgaccaaccgctttcccgacgagggcaccatccgcaccgtcctggccctggcgtcccgtgctccgtccgtgcacaacacgcaaccgtggcgatggctggtggggcaggagagcctgcatctgtatgccgacggtggccggcaactgccgaacaccgatcccgacggccgcgacttgattctgagttgtggtgcggcgcttcaccactgcgtcgtcggtttcgcggcggtgggatggcaggcccgggtgacccggttgcccaacccggccgaccccgatcaccttgccgcaatcgaattgtccggcggcacagccgatcccgtcgacatcgcgctggccgcggcgataccgcggcggcggaccgaccggcggcactacagttcctggccggtaccggtgggggacatcgcgctgatggccgcccgggccgcccgcaacagggtgacgctgtgccaggtcgaggacgccgacaagctgcacgagatcgtgaagcaatcggtctgggaccacatgaatcgcgactacctcgtcgagctcgccgcgtggagtggacgctacgccgcggtcgccggggttccggcgcgcaacacacccaagtccgatcccggcgccaagattccgggacggctgttcgccggacccatgttggcgatgccatcgggatcgtctgcggccgaagataattcggtactgctggcgctgggcacccgtggtgacgacaggttggcccggctccgcgccggcgaggccaccagcatggtgttgctgaccgcgacatcgatgggcttggcgagttgcccggtcaccgaaccgctggaggttgccgacacccgggaggcggtgcgggccgaaatcttcggtggcagcaactacccgcagatgctgcttcggattggctggccaccgatcaacgccgaccccttgccggcgacaccccgccgcgaactccgcgatttcgtcgaatggatgaccgaccgggaaccgggcatcgccgaatagccggggcgcttcggcgaaagtgatctccccactagccggttcgcccgggcaccggcagagttggggtagccgggaaggaggactcgatgatcgagatgttgccagacatgccgccgggagcgaccggtgtccgggtgtcgggccggctgagcgggcaggaactgcgcgaggtcaggcccactttggagaagtcgctgaaaagcggcgagatcaggatcgtggaagtcatcgactccgattaccagggcttcgggcccggcgggctggtcgaggatctcaagctcggcctgggcgcggtcctgccgcaccattcggcattccggcgcatcgcggtcgtctcggacaaggagtgggtcgcgcacaccttgcacgcgctggcctggatggtgcccggtgagctcgccgtgttcggactcggcgagctcgagcgtgccaagcagtgggccgcgggcgcggactcgtagcagggagccgccgacccgaggtctaacgaccctagcgtgcgcggtggcgtcgccctacgttgggcaacggtaccggcttgcccacccgggtccggcacttgcccaaggggcgcaagggtaatcgagcaagcgcgcaacgcggatgccgcgttgccttccggcggccggcgtctgtggtttatgcggcgcgcgggacgtccggcgtcgaggtcggggccggcgtggacggcgaggtcacgggcttccagccgacgtaagccagatacaggcctaccacgccgacgacgacgtcgccgcttacccacaacgcggtcatccggacggcggcgtcggcggctgccatgaacgcatgcggaaaggccatgagaagcaaggcgcgtaccgcgaaaacccatcccaccaccgagaccgtgacggccggcgcgcctcgccagcactgatgcagaccgatgatgaccagcgacgccaacagcaggaacccgccggtcaccaacggcaatgcggatttggagtcgaaatccgacagcagcttgcgcatatccgacgcacgggccacggtcgtcgcggtgaagacgaccaggaacgggccgagcacacgggcgaacatgcgggtgcgaagctccggtggtcttgtagtgctcatgtgccacacctccattggtgacgggtcgctcggcgtgtgcgatttgccccctcatccgtagcactgtgcgtaaccccgggccagggaccgaaagtcccgcaccgtggggacattggtcgacgtgcgtcggcatgaccgcgatcgcgtgccgaagcgcgggttcgacgggacctaggaccctagcgccggcggcgtggacggccgaaggtcgtaggtggtcgtagctagcggacaggcaggtgacagtgatgatgcaaatgaccgcggataccgaggtgatcacggcggcaatcgaattggcgtgccatgccccgtcgctgcacaacagccagccctggcggtgggtcgccggcagcaccggcgtcgatctgttcgtcgatccgcgccgaacagtgaaatcggccgacaaatccggtcgcgaggcgatcatcagctgtggcgccgcactggaccacttccgtgtcgcgatggccgcggccggctggagcagcaacgtcgcgcagtttcctaacccgaacaacctcgaccacctcgcctcgatcgacgtcgtgcccaccgagtacgtcgcccgggctcgccgcgaccttgctgacgcgatactgcgtcgccggacgaaccggctgccgttccgggcgcccaagcactggtcggcgctggaaccggtgctgcgcgacgcggggcgagatcactccgtcgccctcgacgtgttgggcccggacgcgcggccgggcctggttgaagcggccaggctgactgaagccctgcgccgctacgacgacgactaccaccacgaattggattggtggacatcgccgtccagaaaattcgacggtatccccgaaagcgctctggtgtccgaggccgacgatcgccgggtcgacgtgaaccgccgattccccgtcgacccgctcgacgagcgcagctccgcgggcagctacgacgacgcgaaaatccttgtgctgtccaccccggaggacacccgggccgacgccctccgagtcgggcaggtgctgtcgcggatcttgctcgagtgcacggcggccggactggcgacctgcccggtgactcatgtcaccgagctggaagcaggccgggacctgatccagcacctgatggccgatcccgccgcggtgccccaggtgttgatccgggtgggcgtcgaaccggagggggagttgccgccccgcctgacgccgcggcgaccgctcggcgacgtcttgcaattccggccgctgtccgatcgctgaaaccgcttccagggccgtgtcttcggggccaacgggccgcccagcctatttcgtgaggagtacgacatgtccgatcctaaacaccgcggcatcctggtctgcgtccacggatcggcggcgtccgacgccgctgtggcgtgggcggcgcgcgaggcggccatgcgcggcttgcccatcaccgtcatccacgccgtcgcgcccgtcgtcgtgggctggccggtcgggcagttgtacgccgacatgcccgcatggcagcaagacggcgcacagcaggtcatcgaccaggcccgcaagatcgtcatcgccaaccagggcggcgggacaccgcccgaaatgcgcaccgagataatctattcggccgtgacgccgacgctgatcgacgcgtcccgggacgcctggatgatcgtcgccggaagccaggggctcggggcgttgggccggctgctgttgggttcggtcaccgccgcactccttgcgcatgcgcactgcccggtggcggtcgtccacgccgatgaccatgctgctcgcgcggccgacgcgcccgtgctggtgggtaccgacgggtcacccgcctcggaggccgcgatcgccctggcgttcgacgaagcgtctcgccggggcgtcggcgtggtggcgctacacgcctggagcgacgtcggcgtgtttcccattctcggcatggactggcgcgacagcgaggcgaagggggaggaactgctggccgagcggctggccggctggcaggaacagtacccggacgtgcatgtgaagcgattggtcgtgtgcgacacgccctctcggtggctggtcgcggaagccgagcgcgctcaactagtcgtcgtcggcagccacggacggggcgggttccccggcatgctgctgggttcggtcagctcgcatgtcgcgcaatcggcgacggcgccggtgatcgtggtccgtgggcggtgaccgtgcgtcgcgcccatcgcatgtccggctggctgctcagcgcgccaccacttcgcgagcggccgaggaaggtctgtcgtccttgcggttggggacgaaagtctcctgaccggctggggttggcgacatatagcgtttccgatgacggagggagaacgaaatggccgcatccagcaagcgctgtggcgtcctggtcggagtcgacggatcgccggcgtcgaatttcgctgtctgctgggccgcgcgcgacgcggcgatgcgcaatgtgccgctgacgctggtccacatggtcaacgccgccacggtgtggccccaggtgccgatggcggccgaagccgtggcgtggcaggaggacgacggtcgccgggtcctgcaggaggcggtcaagatcgccgaagacgccacccgcaacggccggaaactcgcgatcaccaccgaactgtggcacgcaccgccggcgcccacgctggcccagctgtcggaggaggcggaactggtcgtggtcggctccaccgggcgcggagcgatcggccggctgttgctcggttcggtcagttccggcctggtgcgacgcgcccgctgcccggtcgccgtcatccacgacgaggatccgatgatgccctacccgcagcgggcgccggtgctggtcgggatcgacggctcgccggcatccgaactcgccacggcgatcgccttcgacgaagcgtcacggcgcggtgtggacctcaacgcggttcatgcgtggagtgacacgcaagttttcgggctgcccggcatcgactggccggcggtcaggtcggaagcagagcggagtctggccgaacggctggccggttggcaagaacgctatcccgatgtcacggtgcaccgaatggtggtgtgtgacaggccggctcgccagttgatcgaacaatccgaatccgcgcagctgaccgtcgtgggcagtcacggccgcggcggcctggccggcacactgctgggctcggtcagcaatgccgtcgtccactcggtgcgcatgccggtgatcgtggcccggccgtcgtaaagcgccacgcccgcgcggtgtgaatacgcctgcccgacagcgtgatccaccgacggcacccggcgagctgcgccggcgctcgcagccgcggctcgggtagccgtccgggcggtagtatctgtgccgtcggaggcaatcagagagggccgcgcctgatgacatcgcccggcgccgaccgctatctgagcgcggcgtttcgcaacaagagcctgcccgagcgtcttcgcgacctcgaggccatggtggaagcgatcaccgactgcgcgatcatccagctcgacgccaacggcgacgtggcgcgctggtgccccggcgccgaggcgatgacgggttactcggcggccgaggtccttggccggccggtggcgctgctctacacctcggaggaccgcgccgccggactggccgaaagcgaattggccgcggcgcgcgaatcgggccgctgcgaattcgaaggctggcgagcacgcaagaacggccaacggtttcgcgccggtgtcgcgttgtccgtattcacggatgacgcgggcagcgccatcgggttcaccaccgtgatgcgcgatgtgaccgccgaacaccaacgagcggaaaccatgttccacgcgctgctcgagtcggcaccggacgcgatggtcatcgtcggtccggacgggcgcatcgtgatggcgaacgctcaggccgaccagatgttcggctatccgcgcgaagagctgatcggccgggaagtggagattctgataccgccccggcatcgcggttcccacgagcgctaccgcaccggcttcttcgccgccccggcagcccggcgcatgggcgccggcctggagctgtgggggatgcgttgcgatggaactgtattcccggtcgacgtgagtctgagcccgctgcagacggaacagggggtgatggtgtcggcggccatccgcgacatcaccgagcagttggccgtccaggcggagctcaccgaaacccgcgctcaggccgaggtgctcgccgagcgggaccggatcgccggcgatctgcaggaccatgccatccaacgcgtcttcgccgtcggtctcgcgcttcagggcaccatcccgcgggcgcgttcggccgatgtgcagcaacgcctcaatgcggcggtcgacgatcttcacgcggtggtgcaggatttccgcaccgcgatcttcgacctgcgccacaccaaaaccgatgtccccgggctgcggcagcgtttcgatgaggtgatcggccggctggcagagggtttggccaccaccgtgcagtacaaggggccgctgtcggtggtggaaggcgagctcgccgaccaggccgaagccgtcgtcgccgaagccatcggcaacgcggtgcggcacgccgcggccaccaagctgaccatcgccgtcgaggtcgccgacgaggtgagcatcaaggtcatcgacaacggcaagggcctgcccgacgacgtcagcgaggccgggctgaagacgttgcgccggcgcgccgaacgggtcgggggcacgctgaccgtcggcgccgccgcgggcgggggcacccgattgcgctgggtggctccgctgccctgaccgctgctgcgtcagcgccgcagcgcaaccctggtcatacatcgcatgccatatgtatggtgctcatacgtgccgatccgggcaccgggatgacgggagaaacgcagtggcagaacggttggccggaaaggtggccctggtcagcggcggtgcccgcggcatgggcgcatcgcatgtgcggtcgctggtggccgagggagccaaggtggtcttcggtgacatcctcgacgacgagggcaaggccgtcgcggccgaggtgggggaggcgacccgctacctgcatctcgacgtcaccaagcccgaggattgggacgcggcggtggccaccgccctggccgaattcggccggatcgacgtgctggtcaacaacgccggcatcatcaacatcggcaccttggaggactacgcgctctcggaatggcagcggatcctcgacatcaacctgaccggagtgtttctgggcatccgcgccgtggtcaaaccgatgaaggaagcgggccgcggctcgatcatcaacatctcctcgatcgagggcatggccggcaccatcgcctgccacggttacaccgcaaccaaattcgcggtgcgcgggctgaccaagtcggccgcattggagctgggccccagcggaattcgggtgaactcgatccatcccgggctgatcaaaaccccgatgaccgaatgggttcccgaggacatcttccagagcgccctgggccgcgccgccgaacccaaggaggtgtccaacctggtggtgtacctggccagcgacgaatccagctactccaccggctcggagttcgtcgtcgacggcggcaccaccgccggcctgggccacaaggacttctccaacgtcgagaccgacgctcagccggattgggtcacctagccctttgccgcgaaagtgctactgccgacgcatttcccgagtgggaccgtcggcagttgcactttcgcgtggttcaggcgtccgcaagcacctcgcgctcttgggcggccggcttcggccaaggggaggggacgggacgttggcggactcgttggggccaccagaaccatttgcccagcagggcggcgatcgagggggtcatcagtgaccgcacgatcagggtgtcgaacagcaggcccaggccgatggtggtaccgacctgtccgatcaccgtgagttcgctgaccgccattgtcatcatggtgaaggcgaacaccagcccggccgaggtcaccaccgagccggtgccgcccatcgaccggatgatgccggtgttcaagccggcgtggatttcttctttgaacctggccaccagcagcaggttgtagtcggcgccgacggccagcaggatgatgaccgacatggccagcaccatccagtgcagttcgatgccgatgaggtgctgccagatcagcaccgacagcccgaatgatgcacccagtgagagcaatacggtgcccacgatgaccgccgaagccaccacgccgcgggtgatgatcagcatgatgatgaaaatcaggcacagcgaagagattccggcgatcaacaggtcgtagttgttgccgtcgctgaggtccttgtagatcgacgcggtgcccgccaggtagatcttggagccctccagtggtgttcccttgagcgcttcgtaggcggctttcttgatcgccccgatgtgtgaaatgccttcctgggtcatcggatcgccgtcatggctgatgatgaaccgcacggcgtgcccgtcgggggagatgaagttcttcatccccttcttgaactctttgttgttgaaggtctccgggggcaggtagaacgagtcgtcgtttttggaggcgtcgaatgccttgcccatggcgttggagttcttctgcgcctcgttctgctgatcctgtagacccttctgggtcgaatacatggtcagcatcgtggttttcatggccttcatgttctcgatcatcgagggcatcaacgccaccatctggggcatcagcgtgtccagatgatccatgatgggcagcaggctttggatgtcgtcggtcatggtgtcgataccgtcgagcgcgtcgaacaccgagcgcagcgaccagcacaccgggatgtcgtagcagtgcttttcccagtagaagtagctgcgcatgggccggaagaagtcctcgaaatcggccattttgttgcgtaagtcgttgatgtcgatggtcatgtcatgcatcttttgcaccatcacatgcatgtcgttcgacatctgcacggtgatgctttgcatcttttccatgctgtcgatggtggtctgcatcatgtcggcctgatgcagcatgtcggccatctggtcttgctggtacttctggttcatctgctgggtgacgccctgcatgctgatctggaaggggatcgaggtgtgctcgatcggggtgccctgcggccgggtgatggcctgcacccgcccgatcccgggtacccggaagaccgttttggcgatcttgtcgatcaccaaaaagtccgccgagttgcgcagatcgtggtcgctttcgatcatcagcacttcggggttcatccgcgcctgcgagaagtgccggtcggcggccgcgtacccctcgttggcgggcaggtcggtgggcaggtagttgcggtcgttgtagttggtgcggtatccgggcagggtcagcaacccgacgagtgccaccccgatcgtgaggaccaggatcgggccgggccagcgcacgacgacggtgccgaccttgcgccatccccgaatccgttgcgtgcgcctgggttccagcgtctgacggaaacgcgaggccaccgagatgaccgcggggcccagcgtcaacgccgccgcgaccaccaccaccatgccgatggccagcgggatgcccagcgtctggaagtagggcaggttggtgaaatgcaggcagaacgtggcgccggcgatggtcatccccgagccggccaccacatgcgcggtgcccttgtacatggtgtagtacgcgtcttcgcgggactcgccgaccgcccgggcttcctgatagcggccgatcaaaaagatcgcgtagtcggtggcggccgcgatcgccaacgtgaccaacaggttggtggcgaacgtcgacaggccaatgatcttgtaataacccaggaatgcgaccatcccgcgggcggcggacagctcgagcaccaccatcaccagcgtcagcaacaccgtgatgaccgaccggtagaccagcagcagcatcccgatgatgaccgtgaaggtggccgccgtgatcagctgcaggctccggtcaccggcggtgtgctgatccgccgacagcgcggccgggccggtgacatacgccttgaccccgttgggtgcctgcacgctcttgacgatgttctggaccgattccaccgactcgttggccagcgcctcaccctggttaccggccagatagacctggacgtaggacgccttcccgtcgttgctctgcgcccccgccccggtcagcggatcgctccacatatcctgaacgtgctcaacgtgtttggtgtccgcattgagccggcgcacgatctcgtcgtagtaggcgtgggcgtcggcgcccaggggttgttggccctcgagcacgatcatcaccgagctgttggacttgtactcgttgaacaccgcgcccatgcgcttggtcgcaacgaccgactgcgcgtcgtcgggagtcatctccaccgagcgcatcttgccgacctcgtcgagctgcgggacgacgacgttgagcaccgcgatgagcgcgatccagccgatgatgatcggcacggcgaacgtccggatgaaccgggggatcttctcccgcacgggctccttgacgacggggatggcgtcggttctggtgtcgtcgaacgttgtgctcatgcggatttcaccaagcagaaggtcagggcgtgtacgccatgggtgatgttctcgtccttgacttcgtcatcgatggtgatgcggcaccccagggtgttgccgtcgctttgcgccgaaagattggggaagaccgacggggcggtggtggacagcaccagcgtccacggcagcggcgcgccatcgacgcgcttggggtcggcggacagatccagatagttcacgttggcctggctggccgaaccgaacacctcgtacttgacgaccttgggtttgaacggcttggaatcgtcgagccgcgggctggtcaggatgccggtgtcgtgggcgccgaagaaggacttgacccgaaccacggcgaagccgccgaccagcaccaccgccacgatcagcagcggcaaccaggcgttgcgcacaagtctcgaaatctgcacctagttcccttccccatcacgcggtcgtgacgcgggtcagcggttgtgccgccggggccgtgggcaagcgagtgcccacacgccgcgctgctcaacaacgagttatgtcgattgccgtggttcgtgtgcgctcgagcgtcacgcgcggtgaatgctggcccttacaccggctgacgttcccggtagcgacacccggatcgccttgttgctgaagcctccccgcgtaccgccaccagcgcatagtacatgatctgtataccttgcagtttatgcaacatttgctggaggtgtttcaggtcacttggtgaagatgctgttcaccagcgccgcggcccgctcaacataaggcattggcgtgtcgtcggtttcactcgcctcgccgctcgcccacttctcgattccggaacgcaccgccgtcagggccagcgcggagatcagcggggccatctcgtcgtcgggctgcatgccttggcggcgcacgatgatgtcggtcaactggttctggaatcgttccagatcggcgaggaacgcggccaacaccgcgggggaggtcttggcgagttccagcatgttggcggcgtgttcccgtcgtgggggcacgtcacgcaggtggtgcgccgccagcgtgatcagctccgccagcaccaccgagtacggggccggtccggccgcgacgaagtcggcgaccaactccggcggtatgtccgatgggccgtaggcgatcgcggattccttgttggggaagtagttgaagaacgtgcgcgtcgagattcccgcttcggcgcagatctcgtccacggtgaccttgtcgaatccgcgttccagggtgaggcgcaccgcggcatcgcggatgtcggcgctcgtctggcggcgacggcgctcgcgtagcccaacgggattggccatactcatatagttgcacgtcgtgcacactttgcactcaaaagccgtcggctcggggccgggcggaccgccccgtccgccgcgccggcaaacatggcgcggcttgtccggcggggctgagcagagccgcgggcggtgcccgtggcgcgtgagagcgattgtcggacaacggaactcagcggtgtaccgggccgggctggcttgtcacccgttgggggcgagagcaccgcgcagaaaatcgcactgactttcgaagaatttggcggagatcggcgccttgtccacgatctggtcgaaggcgtgaaacgcgccggggacgatctcctcctgcgctggaacgccggcctcgcgcagacgccgcgcgtactccaggcactccggataaaagaggtccagggtgccgacgccgatccaggccggcgccaagcccgacaggtccttgcggcgggccggtgccgcctcgtcgggatcggccccgttgaggtaccactgccaggccagctggttgtcggattcggtccacatgaggcgtcgggggccgtcgcgttgggcgccggtgcgatcgtcgagcatcggatacaccagcatctggaaggcgattttgacgtcgttgcggtcgtgcgcccgctgcgccagggtggccgcgaaaagtccaccggcacttgccccaccgacggcgacccgctccggatccacccagggctggcgcgccagccacagcagggccgcgtaacagtcctcgaccggcgcggggtacgggtgttcgggagccaaccggtgttccaccgccgcgatcgcgacaccggtgcggtgcgaaagcttgcgcaggtacttgtcgtcctgggcggcgcgccccatgaccgtgccgccgccgtggatccagagcagcgcgggcgcatgctcggcgaggttgggtggacggtgcagccggacggtgacgtgctcgttgaccgcgaccaccggcaccgtgcggaggcggcccgcgttgcccatcaggttcatgatggcgcgctgcagcttgagaccgcggtgcagggcgtacccgcggggcaggaatcgagccaccttgcgcagaccgggatccaccacctggggcgccgtgaaggcatcgtcggggagccggtcagccatcgagtgccctcggtttccgtgcggtctgcgtgcgccggtggacacgctgaccatacaggaccgggatagtgtcgacggggtttgcgaatcgcgggtccgcctcaccccgtagcgggcgtccagctgccgggcatcatcggaacggtcggtgcgccaccgaatgcgtcgccggccagcctggccaatcccgacgctcgccgcccggtcaccgtggtgacagccagccggcccgcgccgcgctcggaggtcaaagacgaattcggttgtggggcaacatctgccgcggcccgctcgtccggctcggtgtccgcctccgggtcgaggaattcgtagcggtagccgcggtcgacgcggctgggggcatttcgcaggcgtcgccgggtttgtcgatcggccgcggtcgggcccggcgcggccgcagccgccgcggtggcatcggcggccggccggcagttcttgcccgaaacgctcgactccgtcgccgccccgagaacccccaccaagtagggtgaaacgaaagcctgtgcagtaaacgatgtttcgggtccaatgatcgtcggtggcggtgtgggtggtgcgcccggggggccgccgtcgccggtgatgcgggcatcggagccgcgccgggcgacgacgccgtgcccatggtcggtgcggcgccgacggtcggcggcgggggagcgtcggtcaccggaatcgcggacggtgacaccggtggggtcagcgtgggcgccgggaccgccgccaggccggtcaggcccgccaagcctccggccgctcccgcgggcacgatcagcaagggtgtggtcagcgcgagggtgtacaccggattgctcaggaaaaagctcagcagcccggccgggttgtaaagaatcagccagatcaggtacagggttcggtggatcacgaactgaagtgcgagcatgacgatggtctcgagcagttgcgcggggttgtgcgcgtacatcggaatcaaggtctccacccgggacaagaacatcgacaggctcggatgcatcgaccagccctgcggcgaaaacgggttgaacggaaacagggcttccagccattcctgaaggttttgcggcagtgcggttcccatgacgtacggattgccgccgctcatcccggagccaccgctcatgccggcgttcatgatcttcggggccgccgtggcctgcggcgcggaagcaacggcggttgtcgagacggcctgatacgtgctcatggtggtggctgcctgcacccacattcgcgaatagtccgcctcgttcagcgcgatcggaatggtgttgacgccaaagaaattcgtcgagaccagcgccgcgtgcatcgcgtggttggcggccagctcgcccagcgtcggcatcgccgccagggcggtcgtgtaggcggtcgcggcggtttcctgccgtgcggccattgcggcgctgtccgcgctggcctgcgtcagccaggccacgtagggcgcatgagcggccgcatactgggcggcgctgggtcctttcccaggctccggcttgaacctcatcgagcagcgcggtcaatgcgctggcggctgcggcgtattcggtgcacagtgagctccaggcgcccgccgatgccagcagcggcccgggtccgggcccgctggacagcagcgccgaatggatttccggcgggaacgccatccagatcggcgcggtcactgccggcctttccaattacaaggtgttgcagtggctttcgaaacgacccgtgcgtgaccgccatggggggcgcgacccatcaccggctgactcctttcggccgctgtagcgaggcctgaagccatgagtgtatgtcgcctgatatccgcaaatgcggaaataatgctggaaagttcctgtatatacggagcgaatgggctgtggcgccgcttggtcgacgtcgatcagctggtgctcgtcatgcgagcgacgatgcgcatggcgccacggctgagggagtggcgtattcgctgggcgggggactgcgggatggggtggggtggggtgccgagccgcgggaatagggccaacgcgttggtgcgctcgatagcaccacgggtgctggtgtcgagggctgggtaggtttccaatccggcggcgaacagtttgccgacggcgaccggggcgaacggccagtccgatccgaaggtgatgtgccccggtctggcgaaggccagcagcgagggtagcgccgccgcgctggaggatagcgcggtgtcgaagtagaagctggagaagtcgtcgaggacatcggcgaagctgcgaccggtgtcggccatgatagccatcgccatccggtgactcgcatagggcacgaacccgcccgcgtggctgagcaggaaccggatgttgggataccggttccgaatgccgttgcgcaccaacaggtaggcagatcgagtggtgtccagcaggaagtcggccgcgaacggggcaacgccgggcacggtgggtcctggcaattcggcgggatggatgaacaccaccgcggagcgatggttgagggcagcttgtcgcggcccggggcccatcagcaccagcttgcccacccgccggggattgtcgagggccagacgcagtcacgctcgagcacaagcactttcaggccaagccggccgagcaggttggcggcggtcgcgccggtcggcccgtacccgatcaccgctacgtcatagatgtctgaagtgggcacggtcgtctcgcatcgtcgagtgcttgtcctgtagtgatcgctacggtgatgtagtgatcactacggagtcaagcaccccgggtgaggagagcggagatggcggccacgaagcagccgaaacggcgcaaacgcgccgacggtgaaatgtcgcgtgaacggatcctcgacgccgccaccgagatcgccgccgagcgcggttatgaggccaccagtatcgggctggtcagcgcgaagtgcggcctgcccgccagctccatctactggcatttcaaaaacaaagatgacctgatcgccgcggtcatcgagcgcagtttcgccgactggcgcaaggcgtggcaggttcccgacgaaggcgccccacgcgaccggctggccgggctggcgatgcagatcgccaaggtgctgatggactcgcccgacttcatccggctcgggctgatgctggcgctggaacgccgaccggtcgagccgcgtgcccgcgcgatgttcatccaggcccgggcccaggcctatgacgagcttgccgacatcgtgcgcgaactcgccccggggctcaccgacaagcagatcgaccaattggtcacttatgcgatcgccggcgccgatggattgttcatcgccagggagatcggtggcgatgcggtgaacctggtggggctcttcgagctgcacgccggagcgttgtacgacgcggcgctgcggatgatttcggagaatgccggtcaatgatgctgaggcataacgcgatccgcgaggcggccgatctgctacacgacgcgcagcgcacccgcaggccgatcgggccgctcaccgaacgcttccccggcctggacgtcgccgctgcctacgccatccagcaggccaacctgaatcgccggaccggggagggccgcctggtggtcgggcacacaagctggtcttcgacgccacctccgccaccgcgcatcgtgccaactggtccaaactggtcagcagtgggcgtgcgcgacgacgcctgatcgctggggaccgcgacttagaggagcgatacggccacgccgacgctggccgggctatcaatggtgcggcggttaagatcggatgtccccggtgtcgacgtggagggtgaggctttggctgcgatcccggtcatcgcgctcaccggtcacctcggggccggcaagacgacactgctcaaccacctgttacgccatcccggcacgcgaatcggtgtgatagtcaacgacttcggcgacatcaacatcgacgcgggtctggttgccggccaagtcgacgagccggcttcgatcgctggcggatgcatctgctgcctgcccgacggcggtgggctcgacgaagcactcggcaagctcgcggacccggctctacgcctggatgccatcgtcgtcgaggccagcgggttggccgacccggtggcgatcgcgcggctcatcgggttcagcgaaatccgtggggtccgtccgggcgggttggtcgacgtcgtcgacgccgtgaaccacttcgacaccgtggatcgtggcccgctgccgccggtacgctacggtgcggcctcgctgatcgttgtcaacaagctcgaccaggtgcccgagcgagaacggtcggtcgtggtgcaacgcgttagagaacgtgcggcgcaacgcaatccgcgcatacatgtggtgggcacaatcggaggtcggatagccccggagctgctcttcgacgcgtccgccaggcctgagcagattgggcagctgtcctttgtggacctggtgcccgagcacgagcatgaccacgtccatgcggacgccgtcaccgcccacagcgatggctgcatcgaccccgatgccctcctcaaccttctcgaaaacccaccgccgcaggtgttccggatgaaaggcgtcgtggcggtgcggcagcgcgcgaccgtgcggaactatgtcgtcaacctggtgggtagcgcaatcgacatcgccaaggcgccgccgaaggccacggccaaccgtctggtggccatcgggatgcatctcgacgtcgccgctgtgggggcgcgactcgatcgcgcgctgcagccggtctacggtccggcgtcggggcaggcgtcgcggcggctgcagcgatacctgcggctcagcgcctgagaggcgatccggcaagatacgtcgtgatgtcatcttcgctcggcgacgtgctcgccaccttggagctcgagagggtcggccagtggcgcttcgtcgggcagcagcttccggcgcccgccaatcatattctcggcgggcacatctcggcgcaggctttgttggcggcaagtcgcaccgcggcgggccgcgaaccgcacagcgtccatacctactttctgcggccgggggattcgcgtcaaccggttgacttcgaagtcgttgacctccaagagggccggacgttctcggcgcgacgggtcacagcacgccaggacgacaagatcctgatggaagcgatgtcgtcgttcaaagtcgtcaattccgcagccgcgcaggtcgtttaccaaccaatcatgccggaggctcccagcccggaatccctgccatgggttgcgccgcacctggcggaggccgacgagggctcccgggggcgatgggcgagcctgcgctggttcgagcgccggaccatcgagaccgagaccgtaccacccgcacgggtgccgatgtggtggcgacccgacgggcgtgtgcctgatgatccggtgctgaccgccagcctggtggcctacatgtcggcggtgacgctgacggagccggcattcgcggcgcgtggcggtgtcggggcgtcagctcagcgtgaccactcggtgtggtttcacggtcgggcggtgttgtcggattggcttttctacgaccggtcgtcacccagcagtgccggctcgctggcgctggcgagtgggacaatgttcaaccgcaccggcgaactggtatgcacggtgaagcaagagatgtacttccctccgcagacagcatgaaatcctgtcatggcgcgggcagctcgtgcggagcctgcggcctttcaggatgttcggcgcaacctgatgacgtcgcgttgcacacagccgacacgttcggcggcctcggcgaccgagagtgcggggttgaggaggatctgcaactcttcggcagtgaaggtcggttccacatcccagggggcttggtcccatccggagtcactgaagccggaaaacagttcgtcgcgcatggcgtcctcacgaaataggaagaaggagaagggatctcgtcggtaaggtcaggcaggaagtgggctgcatcgcccgcttggtgaccgcttgtgtcgataataccttcgttgtgatcacgtcgcagtcttacccagccgtgcggcgcaggctcgggttctcgagcggaccgttgtgaccaggcaggtggggagtggcgaatgaaaaaaattgggcgggcacgtaagtcgccgccgcggcagtgggatggggtttggcggcgtggcgagtcagtgccgcggcggggtgtcgccgagtccgagatgttgacgcacggtgtcggtgtgcagggcctgcatcccgagccgggttagtccgatggcagatgatccgctgctgccaaacgtgcgtatgagcaggcatgcgcgttcaaggatctgtgttgcttcggtgatggcccgaacgtcgggatcatcgaattcatcttcgcggcccggcccacgaggtgggtggtattgacctgtcttgcaccagccgacaatgctgtgcatctgaccgttgccgttttcccaaggagaccgcgcaaacagcggcaggatgggtggcggccacttcggcgaccggccatgtgagccaccacggcggagggttgttcatcttcgcattcaagcacggtcgtggcatcggtgtggctagagttgtcggccattttctcggtcctggtggcggcccgagcgggagcacgcggtcgtgctcggagatcgcatccaatcatgttggagtctaggcgatgtcgcgcagctaggcgagggctcggctgcgctgttggagcagttgcgcggcgcgggtgtgttcgatggcggtgcggggtcgatgccggccgcggtcaatgagcgactcaggcgggcggcgagtgcggtggtcatgaacaatggccctcatgacccactcggcacggtttgcacccaaggcgttgctgttcgatgttcagggcacggttaccgatttccactcgaccgtgtctagcgaagctcagcgtatctgcggcagccggaatcaggacgtggactggagcgacttcgtaaacagttggcgtgctgcgtacttcagctgtctggaggcggcgaaaccggaccgcgacaattggatcacggtgcactcggtataccgcagcagcctcgaatcactgctggccgaatacagcatcaccgacttgaccgccgctgagcgtgaggaactcaccctggcgtggcagcgcctcgtgccgtggcccgacgtgctaccggggctgacactgctcaagaagaagttcattattgccgccctgtcgaacgcggacgtgtcggcgctgatcaacatcgcgaaacgtggcggactgccctgggatgcagtgttcgccgccgaaatggccggcgtgttcaagcccgatccggcgatctaccatatggcggcgcgatacctgggactcgcaccgccgcagatcatgatggtggccagccacaaatacgacatccgtgcggccgcgagcctgggcttccaaacagccttcgtcacccgtccattcgagttcggacccttgggattggccgacacagcatacgacgacgcgttcgatgtgaacgctgcagatttgctcgacctcgccacccagctatcctgctgagcacccgatttcatattggttcgctcgtctttattcggcttcgtaacaccctcggtcgggcgatccgcaggaaagcgtcacagtgacaaaacgatacgctgtggggcccactgcctgacccggccgtgcgcagcaatttcgttcgtccaaactccgggggattgcatgtgatgattccgcgtcttgcgccgaagttgtcgggttctcgtgatccggcactgaaggcgcgggcagggggacgaaccagtgcccggccataaagccgtcgtaggcgcggacattcggacggcccacgaatgttccctttggtcgaacacttcgatgggaaccgctcggctcgatccacagcgtcaatacgtcacggtgacgaaatgcaacgcacgggcggcgggggcgagaccgtcggtgcggggcgggtttcgaggatctgggcggcgggacggaatcacgcaccgtccttgggaagcatcaatacgttcctggtgggcgaatggcttcctcgcgggctggccgaaagtagtgaagagccgggcgagtcgggtcggtccatgcggtgaagcttcgagatgcgggcggtccatctccgagttccgaggtgaggtccgggtcgcgacactggcagccgttctaccgataagcgacattatgtcaagtcagcgatcagatgaatcaccgacgttccaagtgacccccttcatggcatgcacaacagcaccgactcgatcccccgcctcgccgacgtcgaatccagctctcaggggtaatcgaattgattagctgacgggcacgtggcggctaaggaagtcgagctggtcggtgacgttgcgttcgaagtccgcaccgacgtagatgtcgaaatggcctgcgtcgtagagcttgatctcgccgcgcggtgcctgggcggcgtacttctgggtcgccttggcgggggcgacagtgtcgttctcacagatggcgaacaagatcgggcatgacaccttgcgggcttgacgtcccgggaagtgccggatgatgtcgagggcgaagcgggcggccacctccttcggtacgtgctgcccttcggggatcagcgcggacacgccggcgacgctgtcgggagaggacatcagcgaagccgatccgggcgggccgtaggacggcaccatcaccggcggacgtccgagccgggcgccgatggcatcgcgcacggcgagggcggtgaccttgaccgaactcaccggtgggatggcgaatgaggaggcgaagccgtcggtgaatgggcactgcgagatcgcggcggcgatgcgcttgtcctgggcggcggtgattatggtgtggccgccaccaaaggaggtgccccacaccacgactcggtcggggtcgatgccatcgagggtccgcgcgtaggcgacggccgagcgccagtcctgcagttgcttgtcgatgtcgagcagttggcgcggttcgccggaactcgcgccgaagtggcggtagtcgaagaccaggcagacgtagccggcagcggtgaaccgctccgcgaaggcatccagccgcatctctttgacccccgcaaggccgtgcgccatcacgatcacgggccgtcgatcgtctgcggagtgcgaggagggtgtgtagagccaggcggcacaggtgccgtcggccgaggtaaaagtgatgtcgcttcgagtcatgacgcccacagtaatggaagggatacaaacattagaaggccatccaactattgtatgggttacagttctggtgtgaacgccgccgctcctgcacctgcgccgatgacccgcacccagcagcgcgctgccgaaaatcgccgtacggtcatcgacgctgcgcgggagatcatcgcgacccagggcgtcgaggccctcactcttgaggccgtcgccgaaaaggccgacgtggttgtgcagaccatctacaaccgcgtcggcgggcgctccgctctactgaccgcagtggccgaacaggcactcgaacagagtcgcgtctacatggatccggcctatgaggcggacggcaccgtggaagagcgaatgatgttggcggccaacgcctatgcgcgttttgcgcgcgaaaggccacacgagttccggattttggtcgagccgccgaacgaacccgaggctgtcgcacgcatcgccgagctcacccgtgcccagaacgcacgcctcactgcggtgctccgcgaaggcatggccgccggtctcattcgcgcagacctcgatcccgacgacgtcaccactgcactgtgggcaaccttcaacgggctactcgcactggcctggcgtcccggggggccttcaggaaagccacgaaaccgtcgaccgccttcttgccgcgtacatcgccacggtgagtgacggcctgcgaacccgctgatgccaaaaccattggaatcccgttcggtgccacctgccggaaccgtcgaatggcgctaccaaagcagccgctgagtcctgcggatctacggccgcaacgtaaagccggtacggtgcggcagccgatccaatagacaggacgatcgcatggaatacggtggaatcgaatactgagggttaccagtcaagcccgtcgtattgcatggtgaatcagagcccgcccccctgccgtcgccgaactgctcggctacagccacaaaggcacccaacgccacgccgagctcgccgcccaatccgcttgggcggttggggcgctgtcgcggccgaccgcgtggaatccgactgaaccagttcgcctcccgcctcgtggttcgggcgtgcgcgaggctcgccacaacagttgcgcacgccaccagcccatggatgaattgcttccgctgattcgttcccgggctgcgcggctagccccgaaaatgcggaagaggacggtgggcatggagcccgttgagcaggatggccaagaggacgaaacaccaggcgacaccgagcgtcgccgccgcttcacgctgactcggcggaacgcattgctcggcatgagcgcggttgccggattcgccgcggtggacgtcggcgggttcgcctacgcgggcgggtggctgcgccccgactccccgctcacgccgccgcggttcgccgatcgcttcgagcacgtctacggccgccacgacgggttccggcgaaatcacgccaagggcctcagcgctaccgggtcgttcacgagcaccggcgcgggcgcggcgatctgccgggcggcggtcttccgggagggcaccgtcccggtcgtcggccggttttcgctaggcgggggcctgccggaccaggcggacaagcccgagactgtccgcggcctcgggctgttgttcgacgcgggtggccagcaatggcgcaccgccatggtcaacgtgccggtcttcaccgatagcacgccggaggggttttacgagcgcctgctcgcgaccaaacccgtgccctcaaccgggaagcccgacccgcagaagatggccgcgtttctcgatcgtcaccccgagacggccgcggcgatgaaaatcatcaagcagtcgccgccgagtgccgggtttgcagacaccacgttctacgggctcaacgccttcttgttcaccaacagcgccggcgccaccgttccggtgcggtggtcggtagttccgcatgacggcggcgtggccggcgcaccggggccgacgcgtggcaaggactttcttttcgacgacctgatccgcacgctggcccagcggccgctgaagtggcggctgattctgacgctgggtgagcccggcgatcccacccacgatgccaccaagccgtggccgcaatcgcggcgcaccgtcgacgccggcaccgtcaccatcaccgcggtgcacaccgaggaagagggcaacgcgcgcgacatcaacttcgacccgctggtgctgcccgacggcatcacgccgtccgacgatccgttgcccgcggcgaggtcggccgtgtacgcgcggtccttcacccgtcgcgccgaggagcccaagtcgcacagcgaggtcaacgtgacgcgggtgctgccatgaccagcgagacaaacgaaacaaccacggccccaatgcgtttcgccctcccgacgcgcatcctgcactggctgatggcgccgatggtcatcgggcagctgctcatcggggtggtcatgatcacgtcgttgacctactatccgctgctgctggccatccaccggccgttgggcgccttgatcctggcgtttgcggtggtgcgcctggcgaaccggttcacccaccggctgccgcccttccttgccacgatgggccccgtcgaacgccgcgtcgcgacatggtcggagtacctgctctatgccctgctgctagcccagcccttgatcgggtgggcgatgctgtcggcggcgcggttcccggtcgtcttggtgggacccgtgcatctgcccggcatcgcaccgcacaacgtcgacgtctatgcggcgctgcgccaagcccacaacgtcggcgccttcctgcttttcctgaccttcacggcccacgtctgcgcggtcctctttcatacgctcggcctgcgcgaccggctcctcgatcgcatggcgctgtggcccaccaagcccgtcgcctcgcggcaggacgaaatcaaggcgtgacggccggcctcgatgcccctcaacacctcatcgccggccgagttagtgcgccaaaaggggcgacctctccccctccaggcaaaagcacgggaccccggatatggcgaccatcgcgagtagttgagcgcgatgatcaacgagccccatggtgtgtgaacgtaaacacgccaccgggcgcccaattagcggcagtcacgatcgagcggacaggcatgtaatccccaccccctatcgacctcttcgccaccatcttcgatctcaatcccgtccatgctggccatcctcaccgccatcactgacaaggcaggccggttttcgccgcaaagctggctggtcctcggaaatgcgatcagtcctgtttgagggcgtgtaaggcggagagggggccgccaccaacctgcatgagccgaccgccgtctcggaggggcccgacgtccaccggtgcgaaaccgaggccgtcggtcacgtgatggaaggttgccttggccggggcatcatcgcccgcatagaacaagacttgacgcccggccggatgacgcgggtcggggatgatgtaacgggcgtgcaaggtgttgaacgccttgatcacccgggctcccggcgcgagggcagcgacccactcgctgccggtcagctctccgagatctgccacctcgatggggtccgccttcgcgaattggttggtggcgtcgaccagcgtgcgtccgtcccacgacggcagaccggcaagagcggcctcgatgtcccaccacatcaccgcgaggaacaccatgtcggcccgcgcggcttgggtgacagtccccgccgacgccagtggccccaggttggagacaacctcgttcagactggacggaccacggctgttgctcaacaccacgcgatgaccggccgccaccaggtggcgggcaacggcctgggcgatcgtcccggcaccgatggttccatactccactccttcaatccctccattttgctgacggtcgtcatttaaagaatcaatgctgtcagacgtcatcaataatcgtcaaggagattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccggaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaagcctaaggccgacggccccgaacacccttcaagaaaggtaaggaccacatgtgttcgcaaggcgtcacggccgaagcgacgccgctcctatgccgtggcctgtattttgatgatggttgccatcgatgttcgggcattcctcaaaaggcgtcaggcccagctggagaagggagaaaccgttgcctcgcatctcacgggagcagaaggaacgcaaccgtggacgcatcctggctgccgccggcgaaggcttcaaggcacgtggaatcgacggcgtcggcatcgacgaactgatgaaggctgccggcatgtcccacggcggcttctataaccacttcccctccaaggaagacctcgcgttggaggttctgcaccagggcttcaccgactccctcgacaccgtcgccgcggtgatcgacactcacgcccactctggtcgcgctgccttgcacgccatcatcgacacctatctcagcaccgagcaccgcgatcatcccgaacacggatgcgcctcggctgccctggccgccgacgccggacgtcatggagtcaaggcccaagaggcgtaccgccgcgggttgcagggctatatcggcgctttcgccgacttgctgagggttagtgcgcgccagagggggacgaagcttgacgcacgccgggcgcgggagcaggccattgggctattcagccagatggtgggcgcccagctcatcgcccgtgcggtagcccatgctgaccccggactctcagatgagatcttgtcctccaacagcaaggcactcaaacgtctgcgaatgtaaccgagatcgtctgtggtccccgcctcatgtttgtcggcgtcttgtctcggctgtgcgcgcactggatcgatcggagcgggtctggaccacgcaaacatcgccgatgctgcagcgtgcagatgatcaacgccgcctggcttgagcgcaagatcggtgcgacgtggactaccgactgacgccgcgaggccgagaaacgctggccaccttagggatagacctggctgccctcggccgcaagaagccgatgatccgctactgcgtggactggtctgaacaacgccaccatctcgccggaccactcggggcggcagttacccagcgcatgttcgatctcgactggatccgccgcatcaaccaacgccgcgcggtggtgctcaccgaaaccgggcgcctcgggctcgccgataccttcaacttgccagtcaactggggttgagctgagggtaaagccccataccgaccgccgagcgtggagttgttggcgttgaaatggccgattcggcacaacaactcgacgttcggcgtcagggtccgaggtgccgctcggcgagcttggcgaacgtcgcaccagccggttgcggtcccccgtgcgtcggccagcgtaggacttcggtcccctgtgacgcacgagacatagttagttggattaaccatttcgtccgtgcgggtagacgagatggcatgaacgcgaaactttcgaagctcacaccaattctcttcgccggtgtcgctgccgcaggaatcgcagtcgcaccctccgctttcgccgatccggaacccccgccgccggcccctccggctcccggttgctataaccctgacggcaccccctgcacgccgtcggcgggcccgcagggagccggtgccgaaattccgggcggcccaggggcgttggcgcgctccgatggccacgtctcggccggaaccccggtggcccctgggctaaagcggggccgggtggaggaatcgcgtgcgtaccaggcggtccgtgccgaaccatcaccttgcccggataacgcttcattcacttcacgttcggcgcgaggggcgactgtcgagtcaccccttgcgccgaactcgtctgaaggtgcgctcggaccgttgacgctgggacgaggcaaaacctacaaaccgttcgcaacccctgaaaagcgcctcatccgtgcgcggtcgagcggatccggtccttaactcagtgtcaagatcgtgcccacggcgacgctgatcaccaccatgatggacaccaagatcaccgttatcgacgcgcccacgatctcttcttccgtgaggcgccagcggggtttgtcggcaagaacggtgcgcctttggggcgcaaacgcgttcattgccgcgaccgccaaaagaagatcgtccgcgtcgtccgcatccttctcgattgcctcgtgcgcggctaatgcggtcgtcatatgaacccccaggattgcggtcgccaataggcgttatctcgtatctccacgctaagagtgcgagatcaagattgcggcaacgctccttaacggtcgcagcacaacgtccatgctctaggagcaatggaccatgcgcagcgcttgacgtctcgccgccgagtccacgccgcgatcagccgcacgggcaggtgctcgtgtcggtgaatcgcccgtcgactggcccacgcgaatcgcgtcgccgccaattgtgttgcgatggcagctacttggtccgccgataaaccgaagtagatctcaccgtattgggtcgggatgggctcgccgggcatttgttggggagccgatagtgatcggcacgccggcggccgacagcaggaactggatgccgtcgattgccttgtcgaccgagccaacttggtaaaggtcaccgctgtttggcctttctctggccggccggtatccgatcaagactaaagccagccgcgggtgcggcggctgagaaatagcaaacgcgtgcttgggtcatccctgtccggcaccttccgcgacggtgaagtagtcgccgtgctcgaggtcttccagcagcgtgtggtggctcgggttccagccgagcagcgcgcgggtgcgcgcactggaagccggcacgtcagcggcgaaaacggagctcagcgccgcgctcccgaaatgggctggcgcgtcgtccaattcgaccgacacgaccggcagatcaagctttcgaccgatcttttcggcgatgtcccgcagcggcacaccgctttccgccgttccgtgcagcgcagttccggccggcgccttctccagcgcaagccgaaacagggttgccgcatcgagacggtggaccgcgggccaccggttggtcccgtccccgatatacgccgagacacccgttttgcgggcggtcgccaccaacatcgccacgaacccgtaatcacccgggccgtgcacagtcggggcgagccggatcacgctcgagcgcactccccgctcggcgtaccccagacaagcccgctcgccggggatccggtacgcggcgaacgcgtcggggtcgggcgcgtccgtctcctcgctcacccgtcccggagccatcaccatggtcccggacgttgacacgaacggtttgccggtcccggccaacgcggcccccatggcctcgatcgcatcgacgtcgcgtttggtgatgccggacaaatcgccggagtccccaccgatagccatatggatgacgccgtcggcggctgccgcgccctcgcgcagccggtcgagatcgtcgagcgaacccgtgaacggctctgctcccaggcgagccaggcgatctgccgaggcggccgagcgggccaacccggtgacccggtgccccgcagacagcagctccgatacgacggcgggcccggtcaggcccgagcctccagtgacgaacacgtgcacgagattccccctcgaagctaagtggagcgcgttccgattagctgacgagagtacataaccggaacgtgttccgctagagtggcctgcgtggctcaacccgttcgcagcgacgcggcgcgcaatcgcgaggcgctcatcgaggtcgcgaccaggttgttcgccgcggccgccggcggcgacgagccctcgctgcggttgatcgcccgcgaggccggtgtcggggtcggcacgttgttccgccacttccccactcgcgaggcattggtcgaagccgtgtaccaggaccaggtgcgtcgcctgaccgaaggcgccgatcagctgctggcgaatcatccacccgcgcaggccatgcgccgctggatggatctgttcaccgactggttggccaccaagcacggcatgctcggcaccctgcgggcgatgatcaataacgagcaactcggctctggtcacacccgcatcgagttgctggccgccatcgataagatcctcgcggccggtcgcgccgcgggtgacatcggcgaccacatcagctccgaagacgtcgcggccggcctcatcggcatcttcacggtggctccgaccggcggcaacagcgagcaagccacccggttactcgacatcttcatgaacggactctcggcaccccagtcgaccgtgcacactacgacgagcacgacggacaacccgtagcccacgcgggatcgagcccgatcgaaacgcgcgccagcaaatgccagggtttgaaattccacgctttggatagacctcgcttcaactgccgctccccggatagcggcacatcaggaagggagcccgacgtggcgttctcacacattgcatcgaaaacgacggcagcgacggccgcgctggcggcggccggactcctcgccgcggccccggcattcgccgatccgcaagtcctgcaattcggccagatggcagagatttccagcaacggtggcaccatcgactacaccgtgagcaacctgcaacccagcggccacaacgacggcgtgtggtactccgacgtcacggccaagggtgtcagtggtaacgcggttcccaacattgccgacttcaacgcgcgggccgtcaacagctccacgttcgcggtgatgaagggcaaccagaccgacggccttcccgagggtccactgcccctgggcacccccgtcacgggacgcctttacttcgacgtgcgcaacggcacgaaccccgacagcgtcgtctaccgggacgccggaggcacggacaaggtggtctggaagagctagccggtcgggtgaccgcctgattcgggctacagcccggacggcacaaccttgccgttgaccgtcaccgcgacctggtcggtcttcgggttgtattggatcgtgccgtgctcgaagttcgacacgagcacatcgccgacggagctctggtcgctgacgggcgatcccagcggacctgccgaaccgttggtgccggtgatctcgggcgtgccgtccgcgccgcgtggcacattccaggcctcccggatcttgcccagggtgatataggcgggcgttccgggcgcgtcgttcttggcggtgatgacgccgccctcgaactgctggaacaccacgccgctctcccgtttccccgcgttgcggtcacccgtcagtggcttgccgagagccttcttctgatcgtcggtggccgacgcgtacttggcagcgatcgggccggtcagcgtcacctcgacgttgctctccccgatgaggttcacctcggtgggctgcgccgggttcgccgacgtggaggtggcgctcgctgccgcgtggggcggtgccgacgcgtcgacgctcttgccattgctgcatcccacggtgatcagcgcgacggcggccaggccgacgactgccgaacggcggtgtgcggtcgttttcacggggttcctctcgcgtcgtccgatggagtgggtcaaggtgcggccgacctcctcgccggcggtcttatcgctccgaacgaacttacgccgctagcactggcagcaagccagagcacccgagtaaacctcagcgctgctcgccgggtacccgctgcacgagattcgcttcttcagcccctgtcatgattcctcggccagccgccggtggtaggcggcgcgggcgttggggtcggcgccgctgacgagctggtcgaaccggacggcgtgcgcgacggcaaaacgcggcgtgtcgggcagcagcgagacggacttgagcagggcgccgagggtggccggcacggtcttgcgtggcttgtctttgctgacggcggcgacgataccggcggcgacgtcctcgggctcggcggtggccagtggcctggcccagccgggaacctttgtgcccgcggataattcggtgttgatgatgcccggaagcaccaggctgaccccgacgcggtgcgggcgcagttcgcggtgcagcgattcggtgaagccgaccacgaaatgctttgtgccgcaataggtcgccattcccggctcaccggtgacgccggccagcgacgcgatgttgacgatgtgtcccgctcccctgggcacgaaccgcgctgccgccagccgagacccgttgagcaccccgtagacgttgacgtcgatcatgcggcggctcatggtcggcggctcgtcgacgaacgggccggtcggcatgatgccggcattgctgacgagcacgtcgagccgacccagccgggcctcgacgtcgtccaggaatgcgacgaatgacgcgggatcgctgacatcgagcgacaatccgaccaccgccggatcgccgccgagttcgacggcctgtttctccgcgagttcggtgtcgaggtcaccgagggcgacctttgcgccggctgccaggaacgctttcgccgtcgccagcccgatgccgcgtgcgccgccggtgatcgcgacgaccttgtctgtcagatccatcggaatcgccctccataccttgcggcgagttcatcggcgcgccggcggaacgcatcgatcccgcccggatagccggtgacgaactggcgcactccgccggtccacggcgggtagccgatgctgaagatcgagccgatgttggcgtccgggtcggagctgatgacgccgtcgtcgtaagccttttgcgtttcgatcgcctggatgaacaggtagcggtcctgcaggtcgtcgaacggaaccgacagtgcgcgtgtggtgttgaatgcctttcgcagatcgtcccacaacccggcgcgggtgccgtcgacgtagtcgtagaaacccgcgccgccccttttgccggtgcggtcgaacgtgtccatcagcgtggtgaccacctcggcggccacgcgcaccgactcgtcgagcgccacgccgtcggccttggccgcctgcaccgtctcatccatgatcttgcggatggtgccgaagctgagctcgtcggccacttgcagcggcccggccgggtagccggcctgaagcgccgcctgttcgatggtggccgggtcgatgccttcggcgagcatgttgaaggcctcgagcaggtaggtggagaacacccgggtggtgaagaacccgcggccgtcgttgaccacgatggggtacttgttgatggccagcgtgtagtcgatgacccgggccagggtctcgtcggatgtctttgcgccgcggatgatctcgatcgggtccatcttttccaccggtgagaagaagtggatgccgacgaagttctccgggcgactcaccccggcggccagctcggtgatcggcagcgacgaggtgttggagcccagcacggcgccgggttcgacgatgttctcgatctcggcgaacaccttgttcttcagctcggtgttttcgaacaccgcctcgatcacgaaatccacgccggtgaagtcggcggcgtcggcggtcggggtgatgcggtccagcagcgcccgcgacttcgcctcggtggtacggcctttcgccaatgccttctgctcgaggttttccgaatacgccttgcccttgcgggccgcctgcagcgtgacgtctttgaggacgacgtcgatgccggctttcgctgtgacatatgcgatcccggcgcccatcatgcccgcgcccaggatgccgaccttgtggattgtgcgctcgggcgcatcggcggggcgcgacgtcccgctctgcacggcctgcagatcgaagaagaacgcctgaatcatgttcttggcgatcgggccggtgaccaggttgacgaagtagcgcgtctcgatgagctgggcggtgtcgaagtcgacctgggccccttcgagtgcggccgccatgattgctcgcggcgccggcatcggcgagcccttgagctgcttgcgcaagttggccgggaacgccggcaggttggccgcaaacgccggtgtggacgggctgcccccgggaatctcgaaacccggaacgtcccacggctgcacatgcttgcccgggttggccaggatccacgccttggcggccggcaccaattcgtcgacggactcgaccagttcgtcgacgaggccgacctgttgggccttggcgggcttgaatcggttgccggtcaacaacacctgcatcagcgcgttttggatgccgagcagccgcacgctgcgcgccacgccgccggcgccgggtagcacacccagcatcacttcgggcagaccgatcacgctgcccgccacgttggccgcgatgcggtgatgggtggccagcgccagctccagcccgccgcccaacgcggcgccgttgatcgcggcgacgaccggtttgcccagcgtctccagccgacgcagatcacgtttgatcgccgtggagccgtcgaacagttgctgcgcgtgctcgggtccggcgctgcggatctgggtcagatcggcgccggcgaaaaacgtggacttacccgaggtgatcaccacaccggtggtctcgtcgacctcggcctcgagccggtcgatcatcgcgcccatctgctcgacgtaggcatcggtgagcatgttggcgctgttgtcggggtcgtcgatcgtcagcgtgacgatcccgtcggcgtccttgtcccagccaataatgctgtcactcaattgaactcaaaccctttcgatgatggtcgccacgcccatgccgccggcgacgcacagcgtgatcaggccgtagcgtccaccccgccgctccagctcgtcgaaaacggtgcccaacaacatggcgccggtggcgccgaggggatgacccatcgcgatagcaccgccgttgacgttgtacttctggtccgggatgccgaaatactgttggatcttgatggcgatggccgcgaaggcctcgttcatctcgaacaggtcgatgtcgtcgatggtcaggccggcaaggtcaagtgctttgcgcacggccgggattgggccgccgaacatcagcaccgggtcggcgccgctggtggccgcggacacgatgcgcgcccgcggggtcagaccggatgccgcgccggcctgctcgctaccgaccagcaccagcgaggcgccgtccacaatgcccgagctgttgccgccggtgtgcacgtggttgatcgcttcgacccagtggtagcgctgcatcgcgacggcgtcgaagccaccgaattcgccgatgcccgcgaacgcgggcgtcaacttggccaggtcctccaccgtgccgtccggccgcatgtgctcgtcgtgatccaggatggtcaacccgttgatatcccgcaccggcacaaccgatttcgcgaagtagccgcccgaccacgcctcggcggcgcgccgctgcgaacgcaccgcgtaggcgtcgacgtcctcgcgggtgtacccctcgatggtggccagcaggtcggcggccaccccctgcgggatgaagtagttgtcgtaggcggtcgccgcgtcgtaagccatcgccccacggtcgctgcccatctcgacccgcgacatcgactccaccccaccggcgatcaccaactcgtcgaaacccgagcgcaccgccttcgccgcgacgttgaccgcgtccaggcccgacccgcagaaccggttgagctgcaccccgtccacggtgtcgggcagcccggccacggtgaccgccgtgcgcgcgatgtccatgccctgatcgcccaccggggtgacgacgccgagcacgacgtcggagatgcggtcctcgtcgaggtccggaaagcggcggcgcagctcgtcgatcagcccgaccaccaacgagatcggcttcacggaatgcagcgcaccgctggctctgcccttgccccgcggggtgcggattccctcgtaaatgtatgcctcagtcaattcaacgtccttacagcgagcggctgatgatttccttcatgatttcgctggtaccgccatagatccggttgacccgcgacgcggtgtacatgttggcgatcggatactcggtcatgtagccgtagcccccgaagatctgcaggcacttgtcgacgatctggtcgctcttctcggcggcgaacagcttggccatcgacgcggtggccgggtcgttcttgccgtcgaggtactgcccgacggcgtagtccaccatcgtcttgatcgccagcgcctccgttttgcattcggccagtacgaatttggtgtgctggaacttgccgatcggccggccgaacgcctcccgctctcgcgagtacttgatcgcctcgagcaccgcgacctcggcgagcgcctcgcagattgtcgcgatgatgagccgttcgcgggcaagctgctccatcaattggtaaaagcccagaccctcctgcgcgccgagcaggttggccaccggcacccgcatgtcggagaagaacagctcgcgggtgtcctgcgcgtgctggcccatcttggccagcacccggccacgctcgaaacccgccaggttctcgtcggtttcggccacgatcaacgacaccccggcagcccccttcgacgggtcggtcttggccacgatcaccaacaggtcgcagtgagttccattggagatgaacgtcttcgacccgttgatgacgtagaagtcgccgtcgcgccgcgcggtggtcttcaccgattgcagatccgacccggtacctggttcggtcatcgcgatggccaacaccgcctcaccgctgatgatcttgggcagccaccgcctgcgctgctcgtcgctgccataggcccagatgtagtgcgcgacgatcggcgagtgcacggcgaatccaaagccctggtcgtaggcgtaggccagctcctcctgcacgacgacgttcatcgcgaagtcgccgcccgcgccgccgtattcctcgggcaggtccaggcccagcaaaccggcatccccggctttgttccagaactcgcgatcgaccgcgtgttgggcggcccagcgttcctggttcggggtggcctccttgcggaagaactccgcggcgtgcttgcgcagctcgcggtgctggtcggtctcccaacgcggacggtaatcgggaaacaattcggacatatctacctcacttcgttcaggggaatatccatatgccgcgcaaggtcttccagctcggcggtggtcttggccgcgaacgccgcacccaggctttcgtgactcccgtcggcgccgaacacctcgcacgtgcgcgcgaaaagtgcggttcgatcgccccaagggcgacgtagccgtcggcggacgcgtagatgccgtatccggggtaggcgccgccgagcaccgcgccctcccccatcagcccgtagcgcaccgcatcgccagcccgggcggcggcttcctccaacacgacgcggtagcgttgtcccgcacccgctttcgcggcttgcagcagcgccgcgagcgcgctcgacaccgcgcgctcggcgccgagcacatcggcgatcggcaccttcggcatatgcggcggggtcagcgtgccctggaccgcctggtagttcaggtcatggcccggggtctcggcgcgctcgccgtgatgcccgacgatctcgatcaacgacaaccgcggaaacttctgctgcgggcgcgccaggcctgaccgatgcagcgccgagggccgcatcgaggtgatcaacagatccgcgccggccagcaactcgtccagctttgcgcgatcagccgcgtctttgatgtccagggtcagcacgtcttggtgctcaaccaaatgcgcgtaccagtcgggcgcggcggcggcgagcggatcccccgccgtcggctcaaccttcgtcaccgcggcacccagttcggcgagccgggccgccgccagcggaccgggcaggttcacggccaacgacaccaccgtgacaccgatcaggggctgcatagaacgtcatcctccattccccagcgtacgatacagatgtattggaaatagatcaaacgtagagctaattgggtcaggcgctaacatagcggcgtggaccaggagcagtggtgatgaccaatccgcgggcgaccaacgaggacctgacggccaaggcgcgaattcgcaacgccgcgctggacctttacgcgcaatatggtgaagatcgaatttcgctgcgcgacatagcctctgcggccggcgtcaccctggggttggtgcaacaccacttcaaaaccaaggccggcgtgcgcgatgcagtcgaccagctggtggtggactacttcgcccacgcgctggcccaggttccggccgagggcagtgcgcggcacgtcgcggcggcccgcgacgaggcggtcgcccgcatgctgcgcgacaaccccccggtggtcaactacgtgcggcgcgcggtgctcgatccctccgaggatcggctgcacctgctcgatgcgctcatcgagctgactcgccgcgaaatcacagccctgcggggttcgggaatggcatccaccaaacgccccgagtccacccagatcctgggcgtcttgattcgccaaatgggcgagctgctgttgcagcccatggtcgacgcggtgtgggaccgcgtcgccaagccgactgacgcccgcaagccccggctgcgcatcaccgtcgaaaactaacgtggccccggcgccggttatcagcgggtcgcgtccgccaactgttcgatctcggcgttaaacgcgtatggcacttcgatattcgtgcagtgcccggcgcggggaaaccgcgcgaaccggtgcagactgcctcggccctgtagtgtctcggcgatccggtgtgcaactgccggcggcgtcagccgatcctcggtgccggtcaccacggtggtcggcaccgtgagtttctccaacccggcggtgacgtccaacccggacagccccgctccccacaccgcccgcacatcggtgcggcaatcggccaggatctcatagacgaagtccaccgcctgccgatcggcgtagcgggacaatgccatccgctgcagcggccaccgtgaccagcggatcgagggaagcgtcatcgtcgagcccgctaacgcggtgatcaacggtcggcggatgtggcgatagcggtcggcgaatggcagcagcatcgtggtggcgctgaagcgctcggcgatggtgttggccaacagcaccgccgacaccgcgtgggcggcgaagcgctgcgcccacgccatgatggtgatcccaccaaaactgtgtcccaccaacaccgcccgttcccccggtgccaacaccgcgtcgagcacggcggcaaggtcgcgccccagcacgtcggggcgcacgccgtcagagcccagcgtgctgcggcccagcccgcgctggtcgtaggcgatcacccgatacttggcggcaagagcgttgatctgcgggttccagtactcgatgcggcatccgaaaccatggatcagcacgatcggctggccgaacgccgaaccgtaactgcgcacatgcagctgcgcgccgtcgtgcgtcgccaccgtcgtcgcgtcgtaggctacccgcggctcccgaaacaagccctcagcgcggctttcggggtcgaaacgcggccctagcccccgccggccactccccatggttcccaccttgcgtctgcgcgatcgctacgtgacaatacaactgtactgtaaacaatgttaatgactagttcaaggcagctgatgacccatgcaccggccagccggcccaccaccctgtgcgaagccttccaggcgaccgcagccaagcacccggacgcggtggcgctgcgcaccctcggcgatgccacgaccatcacctggcgtcagtaccgcgaccgggtgcgggcgatcgcggcggggctggccgggctcggcgtagggaacggcgacaccgttgcgctgatgatgagtaaccgccccgagttccatttgtgcgacaccgcggtcctgcacaccggtgccacaccgttttcggtgtacaacaccaatccacccgagctgctggcgtatcagttcgacaacgcagacaaccacgtggtgatctgcgaaggcactttcatgccgcaggttctcgccgcggcgcagcagggcggcactgtcgaacacgtcgtgtgcgtcgacggcgcggcgaacggtgccatcgggctcgatcaactcgaggcctcccccgcagccggtttcgacttcgagcggtcatggcgggcggtcgggccggacgacgtgctgaccatcgtctacacctcgggcaccaccggccctccgaaaggcgttgagctcacccacaccaacttcatcgagaacgcccggatcaccgaagaggtgggtgggatcacgcatgccgaccgggcggtgtcctatctgcccgatgcacacgccgccaaccgctggatcactcactatcaaaacctgctctacggcctgcagatcaccaccgtcggcgatttcaaggctgtgctgcccgcgttgaccgaggtgcggccgacgctcttccttggcgtgccgcgggtgtggatcaaggccaaggcgggtctggaagccgcggtagatgcggaacctgccggcaagcgagcgcttgccaaatgggcgttcggggtcggccgcgcgagggcccgggccgtgtcagatggccgcccggtcggacttgccgagaagcttcggtacgcgttcgccgaccggctggtgttgtcgaaggtgcgccggcggctgggcatggaccggctccggatcggcgtcaccggcgcggccccgatcccgcgggaggttcacgagttcgtcttgggcttgggcatcccggtatgcgaggggtacgggatgaccgaatgtacggccggtgcgaccgtgaatcgtccggaacggatcaagatcggaatggttggtaccccggttccggggaccgaggtaaccgttgcctccgacggggaggtgctggtgcggggcaagaacgtgatgcgcggctaccgcaaggcgcccgagaagaccgcggaggcaatcgattccgatgggtggctgcacaccggcgatatcggcgagatcgacgaagacggctacctgcgcatcgtcgaccgcaaaaaggaactcatcatcaacgccgccggcaagaacatgtcgccaaccaacatcgaaaacaccatcgccgccagctgcccgctggccggccccgtcgtggtgatcggcgatgctcgggcgtacaacaccgccctgatcaccctagatcccgactccgtcaccgaatatgcgcacgcgcacggtctttcgggttcgctccgcgaacttgtccgcaatccggcggtgcgcgccgaaatcgagaagggaatggcggccgccaatcgccggctgtcgcgggtcgaacagatcaagcgctacacggtgttggccgacgtctgggaacccggcagccaatacctcacaccgacggccaagctcaaacgtaaaccgatcgccaccggatacgccgcccagatcgacgcgatgtacaccgagcaaggcaagcgatccgcaggacattcagccgcatcggactgaagcggcgaccttgcggcgcgatgctattcgggccagccgttgttgaggatcagatcgacgaggttgtcccgggcgaacgtcgggtcgaagtgctcgagcacatcggcgttcatcgtgccgaacgtgctgtgcgggcggtgcttcatcccgtcgttgaaggcctgcagaatgcgcgttttgaaatccgggcgcggatgggtggcgatcaccgcggcgagcgcttcgggagcaaggtcgtcgcggccaacgcccaccacatcggtctcgacaccggcggtcaccaaggcgatttcgggatccaggaattcgggcacccccggggtggtgtgcaaggcgatgcccagccataccttgtcggcgtctgccttgctgacgccgcggtgcagcaggaactcccgcgccgcattggcaccgtcgacctcgatgcgcagggcggaatcgcggtagcgctcggtcaggcccaggtcgtgaaacatggcgcccgcgtacagcagttccaggtccggttgcagtccccggcgccggccctgcagcgcgccgaagaggaatacccgtcgggaatggtggaaaagcaggtcgtcctcggcatcccggatgaactcggtgatctcgcgaaccaatgcggtgtcgggtatggcgatgtcggcgatggtttcgatggacgacgtggtggtcatgatatgtctcctcggttgagctgtactgtgttggccgccttggcattacgcggcgatacttccgcccccgtcgacgcgcaggatttgaccggtgatgtagccggcgtcctcgtcgaggagaaaacaaatcgcgtgggcgatctcgcgcggcctggcgacccgatgcagcggaatgctttgcaggaagcgggcttcgcgtgccgatccgaccgggctgcgttcgcggtacatgtcggtttcggtgggtcccggtgccacggcgttcaccgtgatgccggccgaggcgagctcgcccgcccagatgcgggtgcacgcctcgagcgccgccttggccgcagcgtacggggtccgctcgggcgtgccgagcgtggtcaagctggtcacattgacgatgcggccccattccgcgtcgagcatgccgggcagggccgcctgcacgacctgaacggcggcgcgcacattcaggttgtaggtgtcgaacaggtggtccagctcgatcgagccgagtcggccgaaccgggcgaaacccacgttgttgaccacggcgtgtacggcagcgtgcccgacgatcttgtccagcgtcgccgcggttgcgtacgggtcggccaagtcgacctcgtagaactcccccggaaaatccttgggggcgctccgggcaaggccgatcggttcgtggccaccctcggccagccgatcggccaccgcgcggccgatacccctcgatgccccggtgatcaaaacccgtcgcgacggcatggactgctccttggaatcgtgatggcggtgcgcctggagccagtctggggccggcgggccgtgctctcccatgactgctgagccgtatatcccacaaaaagcgacacaagggattcgtggctcaagccgatgagccgtcaaagcccatccgagccgtcgcaatctccgtcggcagccgggttcaggtgcaacggtattgaccgttgagcacgcaattcgtcggtggcgaataggtgccggtcaacactcctcggaaaccacccgtcgccgaaccacccggtgcgatgacccgattccagttcgccggcgtcagaacgtaatgcgtgccggattgggtgagggtgctgttccacgtgtgcaggacggattggccggccggcatgtcgaattcgagcttccaatcggacagtggcaccgtgctcgagttggtgatggcgaagcgggcgatgaaaccggtctgccacgtatgctcgaccgtcaacgtcgccatgggtgcggccgcatcggccaccggggcgatggcgaggccgaggaccgcaaccacggcaacgatcaccgccgacacggctccgtgaagcgctgtgcggcagcgcttcaggtgattgtccagtccagccatggcagccaaggtaaagccggacaggcgatctcggcccttgcagcgcgggtaggctaccggacctttgcccaaccgagaccggcatgaaatttcggccgcgatccaccgggagccaaggttcaacccgcaagcaaggtgccggcctgcgcgctagcgtggcatcgtgggtaaggcctgggattacacgacggcggcgccgggcagcgcgcccggagtcacgtccatggtgggctaccgcaccttggatgtgcccgagggcgtgcaccgcggcatgccgtcgtcgatgctgaccttcatcgtcagtctcgacgatgggggtggaagccgccgacaccgcgaccgcgctgccggctgcccgacccacgccgctgatcctcggcggcctgcacctgcgggcgagtcacgtgcggcaacgccgcggtcaggccggcgtgcagctggcggtgcatccgctggcctcgcgcgcgctgttcggtctgcccagcgccgagattcccgtcgccgactacgacgcgaccgccgtattgggacgagacatcgtcgacctgcaccaccgggtggccgaagcgcaccggtggcccgacgtgttcgcgctggtcgcccagtacctgatcgatgcgcgacggcgtcgagacggcgcgacggtgcgtcccgaggtcctgcatgcctggcacctgctgcagcgcagccgcggcctgatgccggtgacggccctggccgacgcggtcggcgtcaccacgcgacatctggccacgttgttccggcgggaggtcggtcactcgcccaaaacggtcgcgatgctgatgcggttccagcacgctacggggctgatcgccgagtcggcgcgccggcacggtcgcgtcgacctcgcccgggtcgcggccgacaccggttacagcgaccaggcgcacctgagccgggaattcgtccggttcgccggtgtgccgccgcagcggtggctggccgaagagttccgaaacattcaagacggcgggcactcgctcgggtcacagtgggagcatgactgcttcgaatccgaccgtctggttgacactgcaagcccataacgtacccaaactgatcgactactacgtcgagacattcggcttcgtcctgacggcccgctacggcgacggcgagaccgtcgaccatgcgcaactgaactggcccgagggaagcggcggcatcatgctcggcagccacaagcccggcgccgagtggtgtcgcgaacccggaaccgccggcggctacgtcgtcaccgcggatccggatgcgctctaccggcgcgtccggcagcacaacgccgacatcatccgcccccttgccgaaaccgactacggtgcacgcgaattcaccgtccgcgatccggaaggcaacctgtggtcgttcggggactacggcggagcaaacccgccgaactgaccagttcggcgatcacaaccgggcgtttggctatccttcacattcgggctgccgtgtacccgcatactggcggcgtccgcaccacgccacgatgaggaaggcaacgccatgtccccacttcggtgcttggccagagttgccacccccctgatgatcggcgccgtgctggtcgttggcgctgggatcgcggctgccacaccgcaagacgacgcctacctggcgcaactgcgcgcggccggcctcacctggcccccgaagaccgaagaggcactcattgccgaggcgcacgacgtctgctacgacctcacgtggggttggacgccgcaacagatcgccgacgaccttcatgcccgcttggacaacaagggcgtgacgttgttggacgtcggcagcctggtcaacgccgcccacaacatctattgccccggcaatgtgtgcgacgcccccagcctgtgcacgtgacaacggcgtcgggttggctactcgcgcaacccttttcggctgcctagcacgccggcattgataccggctagtcggcgggtggcaccacgggcggacggcattcgttggtgcccgggtcccaccaccagccgttgtcgcaggcgagcggttgcggcccgacccccagcggccggcacacgttggccgtcgggtcccaccattggcccgggtcgcaggccaacggttgcggcccgaccccgagcggtcggcacaccttgccggtgggatcccaccactcgccgtccgcgcagtcggccttgctcaccgccggcgtcgctatcgccacggccgccatcgacgcgaacgccaacatggcgacgaccacaagctggcgtacaaatgtcttcatggtgggtctcccctcgttgctacccgtcatcgaaccgagtccgggcctgcgggtcaaggccatcgggcaagttgcgggcgacggcccggcggcgaagccgtccgatgaattcgtggccgcccaccggtcggcctacaagcacaaggtcggcaaccggatggactggtactcgtcatcgcagagcacgttcggcgccgacatggacgcaccgcccggcggcggcttcgcggtcaacgtgttcctgcgcgacggcgacacggtataccgcacctggcacaccaacggacgcggcaccgagcagctcagtcactccttcgggttgatcgacatcctgccgtgggggcgccaggaggaatggcaggactccccgcacggctggccctcccggcccacccattcgggctggcccgactcccccgccatcgcccgcgcctacggacccaacgacggctgatgaccgcgcccgtcggcgcgggacggatgttcgtccggcgttgagcgaaagcgtgtttcgacaccgccatgggcggggcgcacactggggcaatggacgaatgtgagctcacgatcagcgcgccgggcggagcagccccgcccccgccgccatctcgtcgccggaggccgccctcgacgtcgccggggcgggcgtgatgacgcacgccggcgagccccagccgcgccgcgtgctcaacgggctgtccgacatccgcgcgttctttcacaccaactcggtgccgctgtacttcatctcccccaccccgttcaacctgctcggcatcgaccgctggatacgaaacttcttctacctcacctactttgactcgttcgagggcatacactcgcgcgtgttcgtgccccggcggcgcgaccgcatcgatttcgactccatgggcgatgtctgcaaccacctgctgcgcgatcccgagacgctcgagttcatcgcgggtcgcggacccgggggtaaggcatgcttcgtgatgatggacgaggagactcaggccctcgcgcggcaggcgggtctgcaggtcatgcatccgccggtggagctgcgcaaccggctgggttccaagaccgtcatgacgcgtctggccgatgaggcgggcatcccgagcgtgccgcacgtgatgggtcgcgccggctcctaccaggaactgctgacgcttgcgcaggacgccggactgggcgacgacctcgtcatctcgatcccctacggcgccgccggcagcgggacattcttcgtgcgcggccagcgcgattgggacgagcacgccggtgacctgaccgcgcagcaggaattcaaagtcatgaagcgcatccgcaacgtcgaggtgtgcctcgagggcgcggtgacgcgccacggcaccgtgatcgggcccgcgatgacaagcctggtcggttatccggagctgactccgcaccgaggcgcctggtgcggcaacgacatttggcgcgaagtgctgccacccggccagacgcacgccgcgcggcaaatggtgggaaagctgggcgacatcctgagccgtgaagggtaccgcggctacttcgaagtggacctgctgcacgacctggactccgacgagctctacctcggcgaggtgaacccgcgtctgtccggcgccagcccgatgacgaacctgaccaccgaggcctacgctgacatgccgctgttcctgtttcacttgctcgagtacatggacgtggactacgagctcgacatcgaggggatcaacgcccgctgggagcggggctacggcgaggacgaggtgtgggggcaggtgatcctcgcggaaacctcgccggacgtcgagcttttcacggccacgccccgcaccggggtgtggcgcatcgacgacgacggccgggtctccttctcgcgcaccgccaacgactgggccacgctgctcgacgggtccgaggcgttctacatgcgggtcgccgcgccgggcgacttgcgttccgagggcgcacaactcggtgtgctggtcacccgcggacacctgcagaccgacgattaccggctcaccgagcgctgccagcgctgggtcaagggcatgaaggcgaagttcgcctccactcccctggcgccggccacgccgatcgtctcgcggctcgtcgcgcgcgcgtgaacgccccggccggcatctccctggacaactggctctcgccgccctacgcgcggtggtccttccagcacgtcgaagacttcgtgccgaccgcggtgatcgcgcgcggaaccggacccgtcgccgcgatacctgccgccccgtccgagctggccgaaatccgggtggcggtgaccgacgggacggccagcacggtcggcgccgtgatggccggcaccgcgaccgacggatgggccgtcgcccaccgcggcgcgatgatcgccgagcattacctcgagggcatgcgtcgccagacccggcacctgctgttctcggtgagcaagtccctggtggcggcggtcgtcggcgcgctgcacggcgccggcactatcgagctcgacgcgccggtcaccaaatacattcctgcccttgctaattgcggctatgccggggcgacggtgcgccacctgctggacatgagatcgggtgtcgcgttctccgagaactacgacgacccggccgcgcagatacacctgctcgaccaggcggtcgggtgggcgcccaaccaccggcccgacgcgcccgcaacgctgcgcgacttccttcggaccttgcgacagaagtcggtgcacggcggaccgttcgaataccgctcgtgcgagaccgatgtgctcgggtggatctgcgaggtggccgccgaccagccgatgcccgcactgatgtcggaactgctgtggagccggatcggcgcgcagcgtgacgccaccatcgcggtcgacccggccggcaccgggtttttcgacggagggatcagtgcctgccttaccgacatgatccggttcgggtcgctgttcctgcgcgagggtgtctcgttgacaggccggcgcgtactgccggaggcgtggatcgccgacaccctcaggggcgggcccgactcccgtcaggcattcgccgccagccccgacgacaacgagatgcccggcgggatgtaccgcaaccagatgtggctgccctacccgggcgacaacgtgctgctgtgcctcggcatgtgcggtcaaatgatctacgtcaaccgcgccgcggagatggtggccgccaaggtgtccacccagccgcattcccacgagccacacatgctggacacgatgagcgcattcgacgcgatcgcataccggctggccgggcgcacggattagcccaccctggatgccgtcgcggcggactcgacaccggcggcctcagttccgaaatcgaatcgctgcatacggtccagcaggttgcccaccagcgtgtcgacgccggcccgggcctcgaccggcaggagttggtccacggcggcatgggtggccacccggcgcggcaggaacagctggcagcagtcctggtcgggcagcatggcgatctcggcggtgccgatccgccgggcctcggcgaggatttcctgcttgtcgaagcccagcagcggccgcagcaccggcagggtggcggcctgttcggtggcggccaggttgggcagcgtctggctggccacctgacccaggctgtcgccggtcacgacggcctgggcgccgatccgttcggcaaggccacaggccaggcggagatacagccgccgctgggcgacgatctgggcttccccggcgccgctggccgccaaggtccgctgggcccggcccaccgcggccacgtacagccggcatcggggctggaagcgggtgagttggcgaaccaacgcatacgccttgtacgtcgaggaggcatcggtgaacggggcgccggtgcagtgcaggaaatcgcaggccagtccgcgccgcatggcgcggtatgccgccaccggcgaatcgaacccgccggagagcaacaccaccgcccggccgctggaccccaccggcaagccgccctgtccgggatgcgttcgggtgccgagaaagatctcgcgccggtcgacctcgacggtcaattccagctccgggtgcgacaggtcgacccgccaccccaggtcggcgcggacgcgggcgccgatgcgggcggccaattgctccgagctcaacccgaaccgcttgtcgcgccggtggcagcgcaccgcgaacgtcggcgccccgtcctgggtgcggtggtctcggagcaactccaccgcagcggtttcggcagcccgagcggacctgggcacccgccagaccggctgcaccaggctgatgccgatcaggttgcgggccaacgcaaccaactcgtcctgcagtgccggggaggtgaacaacaccagcacgccgccacggcgccggaccgcggggcggtgcccgggcggccacgccgacagtgcgtcgtcgagattggtcagcagccactgctcgaaccagcgccggttgccgcccttgagcaccatctccccgtacttgagcagaacacagcattgcatgtgcacgtctcgttcacctccggctaccgactaccccgctaccacgccgcccagaccgatgcgtgggccacacccgggccgggcggatcgtctccgcgcaggaatatggtgtctacgtcataggttttctcttctgaaaagaatagatcatcgtccttggcccaaaggaggtggtgaacatgctgaggtttgacccgttcttccgcgacatcgaccgcctgacgcagcagctgtggggtgccgtgccctggggcaccgccgcgcaaccggccctggtaccgatggacgcctggcgcgacggcgagaagttcgtggtggagttcgatctgcccggcgtgctgcccgagtcgctggacgtcaacgtcgagcacgacgtgctcacggtgcgtgcggaacgacccgccatcgacgaggaccgcaatggtgtggtgtccgaacgcccgcgcggcgtgttcagccggcaggtctacctgggtcacggcctcgacaccgacaacatccacgccgattacgtcgacggggtgttgcggttgacgatcccggtggccgaggcggccaagccgcgcaagatcgaagtggccgcgggcaagcaccagcgcgccatcaacgcgtgagcgcaaatcgtcgggggctgttccggcagggacagcccccgacgcgggtccagccgttgatcagacggcttctcgccgcgcctcgccacgacattggcgcggcgccgcggcccgttccgggttttgccgggtcttgagtttggcgttgagcagctcgagcgccgagtagtcggccttcagctgatcgttcttgctttccagatccaggatgtgggcgaccccgaccaggttgacgccctgatcgaccagctgacttatccgcttgaggcgcgccagatcgtcgtcgctgtagcggcgggttcccccatcgctgcgcgcgggggtcagcagccctcgccgctcgtagtgccgcagcgtctgcggggggatcccggacagttcggaagccaccgagatgccgtagacgccgcgcgccgagcggggtgtcggatcacctctcaagtcagtcccctccagaaaatatctgactactacttgcagaagtataccagtagtagtatcaaaaccatatgtcaacagacatagatcttctgctttgagctggaggtgaatcatggtgttgatgcgtacagatccgttccgcgacctcgaccggtgtggacccaacaggtgctgggcaccgcggcgcggccggcggtcatgccgatggacgcctggcgggacggcgaccagttcgtcgtcgaattcgatttgcctggcgtcaatgctgattcgctcgacctcgacgtggagcgcaacgtgctcaccgtccgtgccgaacgacccgacctggaccagaaccgcgagatggtatcggccgagcgcccccgcggtgtgttcagccggcagttgttccttggggacaacctcgacaccgacaagatcgaggcgaactaccacgacggcgtgttgcggctgaccatcccggtggccgagaaggccaagccgcggcggatcgagatcaaccacaaccacaagacggcgatcaacgcctgagagcggggtcgcanccgcggtgcaggtccggccgcggttgcgaccccgatcattccaacttgtcggtgatgacaaggaggtgatgcgtcggcagccgaagttgacacggtgaatccccgtgccgcccaccacttactgctacgtacggacagcgaccgacgcatgagattgcgcgcgcaccgccactttcgtggccgccattggtggaccgcacgggagatcaccggcgggaccggggcgcgcgtgtgatcccggcgcgcgcccctcacccgcggtcaggctgtcgaccccggcgtaaggcacggtggctgtccatgacgaatccctatctggtgcttggtgtttcgccgacagcgacgcaagccgaaatcacccgcgcctaccggcgccaccttcgcgcccaccaccccgacacgtccccgccggattcggcgaccgagggcagcgaacggctgagcgaaatcctcgcggcctatgcgctactgcgcgatccggcccggcgggccgactacgaccgggagcatcgggtgcaccagcgcatccgccccgccgtcacgcgcgtcacgcgcatcgagtcggccgacgagcaaccgccgctgcgggcgggcccggtgcgctggcatcgccggtactgatccgccgtggcagagggtgcagccgtgtccggcccgggttgagcgcggcgaggtcaccgaaggaccgggttggcgccgaagcccgcgccttgcaggcgacggtcggtgcggtcggcggcgttggcggtcgatcgggcggccgacgcgttgaccgcggcaacgacgcgccggcggttcggcaccgcggcggcaccgtgctccaccacccgcagacacatcgccctgaccgcccggatgtagcgctcgaccgaatcgcgggcgaccggattctgtgggaacgccaccgtcaaggtggtctcggtgtcgaatcggttgacccacataagcacctgatcggacgaccggccgtcgccgtaaatcccggcgttcaggccgtcccattgcccgctgaacgggatcccccgcgcgtcggcgaacgagagcatgtggacgtcgcccgtcggtttgctgattcgcccgccgaaagacgacagctccaaaacgcggtcgaaggggacgtcggccagaccgatagcggaatcaaaggacgcctgcgcggcgatcaccgcgtcaccgaacgaggccccggcgaccgggacggtgaccgggatgaagctggcgaaccagcccggagtcacgaattcggccggcgtgctgcggtggtcatacggcgtgatcgcgcaatacgtctccgccccggtcagctcgtactcggcgaaggccgcgcaggcgaccacgccaccgctgaagcgagcccccgccttcgtgcaggtggcgtcgaaccgctcggtctgactctcgtccatgagcggtgcgaccaccacaccgcttccgcacggcaccgacggatcgccaagtggcagcgggaaactcgggagggttccgccgttgtcctgcgcgaatcgaatccatgcgcgcacctggggggactgcagggtcagcgcctcggtgtgctggtgctgccggcggcagtagtcgtggtagctggccggctcgggcagcggcagcgggcgcccgccgctcaccaaagcggcatacgtcagatggatttcgaggaagatcacgccgaccgacatcccgtcgatgaccagatggtccgcactcatatagaaggtgaagtgatccgggtgctggacgagaccgaaggtgaagcagtcccagcgcagcggattcggggtggccaggatgtgggcgcgcagctcggtcggcgtcatctcgccgcgctgcagcgcagcgaactcgatgtcggcgggatcggcgaaggtgtgccggacgatacggccgtcggtccgatgctcgaaccaactgtggtaggtgtcgtgccggcgcagatgggcattgatcgcttcggtcatggccgccacgtcgcacacgccggagatatcccagaccccgatgttcagccgcgccatgtccaggccccgggcggcgtgttcgctgaaccggcgaagatgatgcaactgctgataactggccggcacgtcgctaatcggcgcctgccgggctttttcccgcgccgccggagtcgcgtgccaggaaatgaccgaaccggttcccggatcccagttatgcaccgtcccgaatgtgaccacaaaacctcctcggagctgcggcggaattaccggaaggctgcagcgataggggcgccaaatccaggcggataagtcgccggttgacggctattttactgatgtctactaaaggccatgcgacggatgtcggcagccttattccacgaatgtctactaatggcggcgcatagtcggccagttatacgcgcacgtcagaggggctttcgcggctcgcgttagcgtacatttggctagctgggcaaggccagagccgggatgaaactgttagttacatcacaccgccaaccgacgtgcgagagccgcactctcctaccggataaatatccttaccgccgcgccggaaagggccaaattcgtcttattgtgcatttgtctaattgcgaaatagcaggtaccgggcaattcacggaagcatggccacgaaaaatgttgccgtcaaatctgcgagcgacctccccggccgacggtattcggggtcccgcggcgccacccccgcccgccggccgcggaacggcgccgtgccggtagcgtgacggctgtgaactccgtccggacgttttctgccgccgcgttcgcggcctgtttcacggccgctgctgcgatgctcgccggtgcgggcacggccggcgccgccgactcctgcccgaccgccgcgccgcccagcggtggcacgccggactggacgctgaccgggaccaccggcagcgtcgcggtcaccggatccaccgataccgccgctccggtggtgaacgtgacggcaccgttcagcgtgacccagactcaggtgcacacgctgcgcgccggcgacgggcccgccgttccgggcaccgcgcgggtgtccgtctgctacatgggcgtcaacgggcgtgacggcacggtgttcgacagcagctaccagcggggcgccccggtcgacttccccctcggcggcgtcgtgccaggcttccagaaggccatcgccgggcaaaaggtcgggtccaccgtcgcggtcgccatgacctccgccgacggctatccggacggccagcccagcgcggggatccgccccggcgacacgctggtcttcgcgatcaagatcctcggcgccacgacctagctgtgcgccgattcgcctgtgccgcaacgcaggtgaggtggtcggggtcagacttggttgaacccgccgtcggcggtgaccgtggacccggtgcaaaagctggacaggtcgctggccaaaaacactgcggcatgggcgatctcgacgggatcggcgaaacggcccagcgggatggtggcgatccggccggcgcggaactcctcgacggacacgtaggggtcggtctgcgcggccagccggtcgctccccggagtggcggtggacccggccacgaggacattgacccggatgttgcggtgggcgagttcgttggcccaggcccgggccagcgatcgcaccgcggccttggtggccgcgtagatgctcagcccggctcggccgcggtcggcggtggtggagccggtcaggatgatcgaggcgccgtcgttgagcagcggcagcgccttctgcacggtgtacacgacgcccttcacgttggtgccaagcagggtgtcgaggtcgtcgtcggtgatctcgcccagccgcgccaccctcgtcgtcccggcgttggccatcacgatgtccagacccgcgccggccgccgccacctcgccgtaaagccggtccaggtcgcgcggtgccccgacgtcgccgcgcacggcggtggcccgcgcccccaattgccgtgccgcgtcttcgagttcgcgttgccggcggcccgtgatgaacacccgctcgacgccctcggccaggaaccgctcggcggtggccaacccgataccggagttggcgccggtgatgacggcggtcttgcggtcgagcagtcccatccacactcctgacgttgccgcggcggcccacctgccggtgtcgccgactcccgatcatgccgcgcggccagggcggcgccgccacggctcccccgcggtcggccggtctcgtattgtctgcagcgtgattgccgcttggatcgtgtcgccgtggtcagtgcccagcgagcccgggtcagccggcggggccgcccgctaggccgggcaccggcgtggcagccctggtattcgcgctggccggactggcgtttctggattcgctcaacgtcctcaacgtgggagtggtctcggcggtcatcttcgacagccggctcagccggcgatcacccgtcccgggcgccctgagcttcgtggccggcgtgttcgcggtgaccaccacctttggcctgtgcacggtgctgggcatcagcttcatcaccacggcgctggatttccacgtcacaccggccatccggttccgcggcgagctggtgctgggcatcgcgctgatctgcctggcgtacttcccgctgaccgcgcagtcgtcggctcccggctgggcgatggcggcgatgcgcaaacggccctggctgctcggcttcctcgggctggcggtgggcagcgggcaggcgccgacggcggtgccctacctgaccggcctggcgatgctggccgcgctggatccgcggccgccgctgtggccgctggtcatcatcgcctactgcgccatcgccgtgtcgccgccgctggccatcctcgcgctgtcgctgcgacgcacaccgcgggccatgcgcattcagcgcgggctggtccgtgcgctgacccgctacggcccgatgtcggtgcggctgttgttcttggtcttcggggtcgggctcatcgccgatgcgctggtcaaccacagcgcgctgtggtaacgcctctcatgtcccgcacagcccgctggattaccttgtcggctgtgaccgatcgtcaagagcgcgcaatgtctttcggctcgatcgctgaggactacgacggcctgcgcccgcaagccccgccggaggcggtcgactggctcatgccgcccgactgcggggtggccgtcgacgtgggcgccggcaccggcctgttcacccgggcactcgccggccgggccgcgcacgtcatcgccgtcgaacccgacgcgcggatgcgggccgtgctggcccaccggtcgcccgctgtccgtgtgctcgaggggcgcggcgaggcgataccgctgcccgaccgttgcgccgacgcggtgttcgtctcgtcggcctggcactggatggatccgcagcgggccgtcccggagatcggccgggtgctgcgcgacggcgggcgcttcgggctgatctggaccagccgggaccgcgacgtcgactgggtgcgcgacctcgacctgctgcccggcgatgacaccagcgaggcggacgcgcccgatcgcttccggcggcgacacgagaacgtggtgctccccgatccgcagatctttcaccacgtcgcccgcgagacgttcacgttcgtgcggaccatgacgctcgacgacgcggtggcgatgctggccacctacagcaggatcatcaccgcgtccccggccgaccgcgcccgccggctggccaaggcccgggcggtgttgaccgagcgcttccccggggcccacgcgatcgacatcccgatgcagtcccggtgctggcgcgccgaccggatcgcccgcgccggctgaccgccccgggcgccccgcgtcaggactgcggcccctccgagggcggccagtgcgtccccggcgacgcgtcccccgggctttcgtagtcgccgcgcgacaacggcacccaccgctcgctgggtgcgggctgcttcgaggacgggaagtcgcgcaggctccccgtcggcttggcgtcccacttggcgaacgtcaacggcgtctgcagccacgcgtgcagcaggttgtaggcggcctccagcgaatcgatgtgggtgcgctcccagccgtggctgccgtcgagcccgaagccgaccagcgcggcgcgggtgttcgcgcccgcctcgatcgccgcggcggcgtcggaccggtaatagcgaaagatgtcgcgcgcgaacgggattccccggtcctgggccagccggcacaacttgcgggtcaggtggtagtcgaacgggccgtgcatatcggccatcgggatcgtcaccccatcctccagcgagtgctggccgggcgcgcacaccgcgttgtccacggagatcagttcggcgacgtccggcggcagaccatgactggcgccgtgaccgacctcctcggtgatggtgaccatgatcgtggtgcgatgcggcaacaccaccttgttctcggcgaagttcttggccagggcgagcgcgatcgccacgcccgccttgccgtccagatgccgggagaccacgaagccgtcggcggtcagctcggggctggtgatcagggcgacgaaatcaccgatctgcagaccgaggcggaccaggtcgtcccggcacgacaccttgcggtcgatgcgaacctcgacgtgctcccagcccgtgggttgggtgtcgatctcgtcgccgaacgcgtggccgctggacttgagcggcaggatcgtgccggtgatgaactcctcgggatcgtcgatgaagatgcgcacccgtgcacccgcggcgaatcgggccgagaaggtgccgaccggaacgagttccagccggccgttgtccttgagcccgcggaccatgcagccgatggtgtcggagtgcaccaccagcgcgcggtcggtggtcgccgactcccccggcagctcggcggtcagcgccccgcgccgggtcagcgtgaacggcacgccgaagtcgtcgaggatgtcgccgatcacctgcatcaccgcgtccgtgcgccccgacgggctcggggtctgcagcagcgccagcagcgtgtccaccatccacgtgcggtcggcctcggccatggccgcggtctggcccacctcgtctcctttccggtctgggaatcgcgttcaacctaccgtgtgcccgacgcgagcggccccggcccgggctgcagcgctgctaggacgccgcgtcccgttcggagatcagatcggcgagcgcgaggatccgttgcgcgtcgcgcacgtgcaaactctcgatcatccggccgtcgacggtgatgacgctggttcccgcggcctgcgcctgctggtaggccgacaccaccttgcgggcgtcggccagctcctgctgtgacgggccgaacagctcgttggccggggcgatctgggacgggtggatcagcgtcttgccgtcgaatcccatctcccggccctgggccgcctcggcccggaaacccgcgtcgtcggtgatgtcgttgaacacgccgtccaagacgacctttccggccgcccgcgcccccaacaacgccaggcccagcgccggcacgacggggccgcgccccgcgacgtgccggccgtgcaactcgttgaccaggtcattggtgccgaccaccagcccggccaggcggtcgctggccgacgcgacctcctcggcccgcaggaaggcccgcggtgtttccatcatcacccacagctgcagcgacgccgcggcgcccaacgtgtccagcgcccggtccagggcttgaacctgttgtgccgtctcgactttcggcaccagcacgccgtcggcggcggacccggccaccgccgccagatcgtcgtcgtgccactcggtgtccaggccgttgatgcgcaccacgatctcgcggggccgggtaatccggcgacgagatcgcctcgcacaccgcggctctggattcggctttcgcgtcgggcccgacggcgtcctcgaggtcgaatatcagcacgtcggccggcagcgatttgcctttctccagcgcccgcggcttgttgccgggcaggtacagggccgatcggcgcgggcgcagggtcggtgccatcgggcgattcacttcctgtcgtcgggctcagcgggggatcatcggcgtgcgcgatgcgcgcggcatagccagaaagtacccttcgataccggcggtgtagtcgcgggtggcgaccgggccgggggccaatcggtcccgcggcggccggatcgcggaaggggagaacagatgtcatcgaccggttcggcacgtaccgagggcgacagctgggatctggcctccagcgtgggggcgaccgcgaccatggtcgcggcctcccgggcgctggcctctcgcggtccggacccgctgctcgacgaccggttcgccgaaccgttggtgcgcgcggtcgggcatcccttcttcgtccggatgctggacggccagatcccgctcgacaccgacgacatgccgatgacgctgcagcagcggcgcgagcaaatcacggtgcggacgcggtttttcgacgatttcttccgctccgcgaccgctgccggcattcgccaggccgtcatcctggccgccgggctcgacgcgcgggcctaccggttgtcctggccggcgggcaccgtggtgttcgaggtcgaccagcccgaggtcatctccttcaagaccgacaccctggcccggctgggcgcgcaaccgaccgccgagcgccgcaccgtcgccgtcgatttgcgcgatgactggccaacagcgttgcgcgacaacggctttgacagcagcgcccgtaccgcctggatcgccgaggggctgctgccctacctgccgccgcacgcccaggaccggctgctggacaacatcaccgcgctcagcgcgccgggcagcaggctggccaccgagaacatcaccgacatgcgggtgttcaccgacgaacgcgcccgggcgatgcgcagcacctggcgccagcacggactggacatcgacgtggccgaactggtctggctcggcgagcgccgcccggccggcgaccacctggaggccaccggctggagcgtcacccgcctgcccaccgagcgggtgtacaccgactacggcttcgagttgcccgacaacgaaatcctcagggaattccgccaggccatcagttatctcagcgccgaattgggctgaaccgcagcacttctcagctgcccactccggggtagggtctggggatcgcgccactcgcgctcgaacggcagccgccacgcgttgggcgcgatcaactggtgaattgcgttggggccccacgtccccggctggtacagcttggccggtggcgggtcgttgagcagctcttcggaacgctcccacagtgattcgatgccttcggcggtggtgaacagggtgtggtcgccgcgcatcgcgtccaggatgagccgttcgtagacctccagcacgtccaccgcggtttcgatctcctgggtggagaattgcatggacagcttgtccagtttcatgccggggccgggccgcttgccgtagaacgacagcgacacccgcgaattgtccgcaagatcgaacgtcaggtggtcgggcccctgcgtgcccacccccgacccgggcgggaacatggtccgcggtgcctccttgaacgcgatcgagatgatgccggatgccctcggccatcctcttaccggtgcgaaggtagacgggcaccccggcccaccgccagttgtcgatgccgaccttgagggcgatgaatgtctcggtgtcggaatcctttgccactccgtcttcctcgcgatagccgatgtactgaccgcgaaccacgttcgagggcttgaccggaagcatcgaccggaacaccttgttcttttcttcgctgatggcgaacggttcgagcgccgtcggcggctccatcaccacgaaggccatcacctgaaacagatgggtgaccaccatgtccttgtaggcgccggtctcctcgtagaaactcgcccgctgatccaggccgagggcctcggggatgtcgatttggatgtggtcgatgaagttgcggttccagatcggctcgaacaacccgttggcgaagcggaacgccagaatgttctgggcggcctccttacccaggaagtggtcgatgcggaaaatctgggattcctcgaaggtttggtgcacgaagtcgttgagcgccaccgcgctggccagatcggtgccgaacggtttctccatcaccacccgcgaccgctcgaccagtttggcgtcgcgcagcatggtgatcaccgcgcgcgccgccttcggcggcaccgacaggtaatgcagccgccgcacgttcggccccagcttggcctcggcctcggccaccgcggcggccagcgcgtcggagccggcgctctgcgggatgtaggtgatgatgtcggcgaagttgcgccactggtcgggcgtcagcttgtgcgtgccgaacgagtcgatcgcgttcttggccagctcgcggaattcgtcgttgctcaggtcctccagcgacgtggcgacgatctggatgtcgggtgccagctcggactggtccagatacgccaaaccggggatcagcttgcgtttcgccaaatccccggtggcgccgaacaggacgatcacatgagggtcgagcgggtcggtgtggtgacgacgcggccgggcctcgggagccgggtaggagatggtctgcggtttctgggtagccacccctgcgatacttccatcgccgcgctgccgtgtcgcgcctgctcgggttagcggtcctacgatcgggtactggataccggcgggctgcccacgcctgggcccccacaccaagcccgcgccacccccaatggaatgcgccgatggaaagcgatatgagcgaacccgacaaagacccgctgagccgtgctcaggagctggagaacatcgtcgaccaactcgaggagaaagtcgccgacgaccgcgaagccgagggtgttcccggaaagcccagcgaccgggaggatgccgccgtccgcggctcggacgacgagccgcctgactagcgcggccgccggaccgcgtcgggcctcatcggtccggcaggtccacggcgtgcgcgcggaaggccgccagcacgtcggccgccggccactcgtcggcccggtaccggacgggactgatccccgcgacgggcagcaagcccaccgcatcgacgaccgtcgggaacggcacggtgaacgtgtcggcagcgttcgacgggtcaccggccgcgaacgtcacgtaatcggtgtgcggcagctcccaggccgacccctgcgcccacaccgtggtggtgcgccggccccacggcgtgtcgatcagccgcgcctcggccacctgctgcgggaaccgttcgcgctcatagtgttcccgcagatattcggtctggtgccggtattccgttgcggccaaaaggcttcgggcgctcagcgccagcccgcgccccgggtgggggccggcttggtcgaacggcacgatgatggcgcccgcgatcgtgtacccctgcggggagacgggctgttcggcggccaggtacagctgctcggcgacctcgaagagctcggccacgccgtcgggcgcatcggtgcccagcaccaacgacccgtcgccgggaaagaacaccagcggccgggggccgcccgggaccgccagcgagcccagccaacccgtcgccaacaccatcgagtcgatgtagctgtcgccgtcggtgtccctcagcaggtacttctcccccggggtcagaatctgctgacgcgcggtcaggttctcccgggccaccgtgaaggcctgatcgccggtgatgccccaggcaccggtttcggccggtgtcaccatcgcccgcaccgcgggcaggtcgacgaccaccatctcgttgatgagcgggaacaccggacgcacccagggctgcgcgccgtcgttgaccagccggttggcgtagctttgcgggcgtagcaccggcctgagcagcggttgggcttcggcccacgtcaccggcggcgtcgccggttggtcggttgccatgtccacgtgcttcctgctctcgatcagcgaacacgcacgttacaccctgggggcgccggcacaagtcaccatcggcgcgcgctcatccgccggccgcgggcggcccgcaccaggtggtgagggcgtcgtgcagccccgggtcgttcgggtcgccggcccacgcgacgtggccgtccggccggatcaacaccgccggcggtgcgctcacccgcccgagcaccggaagttcccaatccgcaccacatttcgcgtcgacgacgcgcacgcgatcggcccagccggcgacgctgcggcgcccggcgccggcgaaattgagcagcaccggccgggcgtttcgcagcagggcgaacacccgcgatgcgccgtcggcggtgaccaggtcgagatcgggcatgcgccggcccagcagcggatgccccgggcccaggtcgtagcgaacgtccagaccggacatcatcgcggcgaaccgttgccgcggctcgtccatgcccagcagctcggtgacgaggtcgcgcagcgcccgggtgcgctcgtcgggacgcagcagcgccatctgcgctatcgcgttgcgcagcacccgctcgccgaccggatgccgttcggcgtggtaggtgtccagcagggcgggtggcgacgcgccgccgaccaccagggccagcttccagcccagattcaccgcatcctgcacgccggtgttcagtccctgcccgcccaccgggtgatggatgtgtgcggcgtccccggccagcagcacccgccggtcacggtagcgcgccgcctggcgtgccgcatcggtgaaccgggaaatccaacggggactgtggattccgtaatccgtgcggtagaccgcgatcagcgcctgcctcaggtcgtccaggttcggctcggccgcgctctgcagctgccgctcggtgaccagcacccgcacacccccggccggctccgtctcggacagggcatgcacgccgagcgcatcgtggtgaatcccccactgcggtgattgccctgtccgccaatccatttcggcctcggcgagcagatagctcgtcgtcgcctcccagcccggaaagtcgataccggccgctttgcggaccacgctgcggcccccgtcgcagccgaccagatactgcccgcgcagggttcggccgtcggacgcgacgacgtccacgccggtgtcgtcctgggtgcaggtcgctatccggtggccgcggtaaatcggcacaccgagttcgccgacccagtcggccaggatgcgctcgatgtggttctgccacagcgccattccgtaggggtgccgggtgggaaagtcgctgatgtccagccggatttgggcgaagccggcgacctgcgccacctgcccctcggccaggaaacgatccacgatcccgcgctggtcgaggatttcgagcgtgcgggcatgcagaccgccggcgcgcgagccgatcagctgctggtcggcccgccgctcgaccagcgcgacgtcgactccggccaaccccaactcgccggccagcatcagccccgtcgggccggctccggcgacgagcaccgcatggccgcggaccgaccgctccgagaaacgcacaccccgcatttcgcccccattccgaattgtggttcgagacagcgattttgcgtcaccaccccggtcttgcggcaagccccggggtgcgctataggttgagagtgggaggcaaagccacgcggtaacgctgccgcgccgcgtcgatcgcccggtggatgcgttgctcactgaccgggcgcggcgtgccgagctgctgggcccacaggctcaccctcagttcctcgatctgccacgcgatgtcgcggacgtcggcggccgtcttcgcggcctcgggtagctcatccaccaactcgtcgtaggcgtgctgcgcggcgtgcacccgccgcatccggtcgcggtcggcctggccggcccgggccagcccgtccaggcggcgacggatcgccgacaggtagcgggtgagatcgcccagccgcgcgccgccggtggcggtgacgaagccggccggcaacagccggtccagctgggcgcggatgtcggcaaccgcgtcggcctgggcaggcggcggcgtcgcgggcaacgccagttgcacctgctgggcggcggccagcacctgctcgacacggcccaccagctcgatggtggtgggccccagcgtctttgccacccgctgtcgtagcgcggtgaactcgtcgcgggtccacaccggctgcggcaccagcgcgtcggtcgcggcgtcggcgcagtcttccagcagcgccggcaacgagccgtccgggttgccgcccagcgccaggcgggtgcgtggaccaagttgacgcgcaatagctttggccggtgacggaatactcaggcgtaccagccggcggagaccggcgcccatcatgcggacctgttcggccgatgtcgcgaacaccctcaggtcgaccgcagcgccggtgtccacgaacgccgggtagccccgcaccgtgcggccgtcgaggctgcgctgcacgacgcggggcagttcgtcgaggtcgtcgggccagccgcgcaacccggtgcgctgcagccgggccccgaccgtgtcggcgaccgcctgccgcgccggcgtggtgagccgttcctgcagtgcccgcagatccttgccgcgggcgagttcggtcccgtcggtggactccaccgcgaacgtcatccgcagatgcgccggcagcttgtccagatcgaacgcgtcgatgggcaccgaaaccccgctgcgccggcgcaattcgcgctgcagcgcaggcagcagcggctcggcggccggatcgatggcgcccagcaccgcgcgcgcggtgtcgggcgcgggaacgaagttgcggcggaggtctttcggcagcgaccggatgagcgcggtcaccagctcctcgcgcaacgccggcacctgccaggcgaactcgtcaccgcccagccgcgccagcacgtcgatcggcacgtgcacggtgaccccgtcgtcggcggcgcccggctggaaccggtaggtcagcggcaacgtcacgtcgccggcccgccagctgtcgggacggtcggcgtcgccggtctcctcggtgcgcagcaggtcggcgcgggtgaaggtgagcagatccggggtctggtgtcgctgctttttccaccacgcgtcgaagtgccgcgcggacaccacgtcggtggggatgcgggcgtcgtagagcgcgtagacgtcgtcgtcgccgaccaccaggtcgcggcggcgggcgcgctcctccagctcctcgagttcgccgcgcagccgggcgttgtccgcgaagaagcggtgccgggtgtgccagtccccctccacgagcgcgtgccggatgaacaattcgcgggccagcaccggatcgatgcgggcatacccgacccgccggcgcgacaccagcggcagcccgtacagcgtcacccgctcgtaggccatcacctcgccgcggtcggggtcccaatgcggttcgctgtggctgcgctgcaccaggtcgccggccacccgctcgacggcctcgggctggatgcgcgcggcggtgcggccgtagaggcgggtggtctcgatcagctccgccaccaccacccagcgcggtggccgtttgctgagcaccgacccgggcgccagcacgaaacgggagttgcgcgcgccggcaaactcgcgggagtcctcgcggcgcatacccacgtgcgacagcagcccggcgagcagcgccgcgtgcacccgggccgggtcggccggctcgccggactcttcggtgatacccagctccccggcgatgccgcgcaactgcccgaccagatcctgccactcccgaatccgcagatagtgcaggaattcggcgcgacacagccgccgaaactggttgccggacaattcctttcgctgctcacgcagatagcgccacaggttgagatacgacatgaagtcggagtgctcgtcggcgaaccgggcatgcttttggcgggcggcttcctcccggtcgctcggccgttcccgcggatccgggatgctcagcgccgcggccagcaccagcatctcgcgcacgcaaccctcggtctgggccgccaggatcatccggcccaacctggggtcgaccggcagccgggcgagccgacggccccgctcggtgatcgcgccctgccggtcgaacgcgccgagctcggtcaacagctgcacaccgtcgcggacgctgcgccggtccggcgggtcgaggaacggaaagttctcgatatcgcccagctgcagcgccgccatctgcaacagcaccgcggcgaggttggtgcgcaggatctcgggttcggtgtagcgcgggcgggccgcgaaatcggcctcggagtacagccggatgcacacgccgggcgcgacgcggccgcagcggccggcccgctgcgcggccgacgcctgcgagatcggctcgatcggcaaccgctgcaccttcaaccggcggctgtagcgcgagatgcgggcgtttcccgggtcgacgacgtagcggatgccgggcacggtcagcgacgtctcggcgacgttggtcgccagcaccacccgccggccggtgtggggcgcgaacaccttctgctgctcggcggtgggcagccgggcgtacagcggaagcacctcggtgtgcttcagccccgtcaaagcctctgcggtgtccctgatttcgcgttccccggacagaaacaccaacacgtccccgggcggctcggcctcgagctctgcgatcgcgtcgacgatcgcctcgacctcgtcgcgtgtttcggtgcgcacgatctcgtggtcggggtcgtcgggatcgtccgcggttgcggagggcagggcgatctcgagcggccggtagcggatctccaccgggtacgtgcgtcccgacacttcgatgacgggcgcgttggcgaagtgttccgagaaccgccgcggctcgatcgtcgccgaggtgatgatgagcttcagatccggccgacggggtagcaactcgcgcaggtagcccagcagaaaatcgatgttcaggctgcgctcgtgcgcctcgtcgaggatcaacgtgtcgtagcgcagcaggcggcggtcgcgctggatctcggcgagcaggatgccgtcggtcatcagcttgatcagggtgcggtcgctgacctggtcagcgaaccggacggtgtagccgaccgtcccgcccagcgggctgcccagctcgtcggcgatgcgctgcgcgacggtgcgcgcggcgagccggcgcggttgggtgtgtccgatggttccgcggatgccccggccggcctcgaggcagatcttgggcagctgggtcgtcttgcccgatccggtctccccggcgatcaccaccacctgatgcgcgcgtattgcgtcggcgatctcccggcgccgctcgctgaccggcagatcgggatagctgacggccgggacggcggcgtggcgggcggcgacgaccgcttccgcggcggcgatctgatcggccagctggcgcagcttgtcgggcgcggcgccgcgcagcttcttcagccgccggccgaggcgcgcggcgtcgcgaatggtcagaccgtcaagccggccgcgcagctgcgccccggacaccgggaaggacggttcggccaccgctgccacgataggcgtccttcagcgacggccgcgcacggccgtccggtcacgcgtcggggccgacgcggtgtcaaaatggcaatgccgcacgtcgccataccggggggtgacgaggagatttgacgggatgggccgaagcctcccccacccatccggcgataaagacgcccgcccctatcgattgcggctgcgcgccgatgcgggcagcgtcttctaccgcacccaacaggcccgcatgttgcgaatcttcttgggggccaccatattcctttacgcctacggtgtggtgttcaccttgttcccgatccgcccggggttgaccctgtccaatccggccggcggcatcgtcgcggtcggcctcggtctgggggcgctggcctggctggccgcccggcccgacaaacccgcgcccgcgacggtgacggcgatcgtggccacgccgatcgtgatggccttccaccgggtgatcatcgccgagttcgtctgcctgatcgcgccgatgttcctggcgatgtacctgcgcgcgttctactcgccgcgccgcggcgcggccctggtcgccgtgctcgccggcctgtccgtggcggccctggcggtcgcgcccacgccgaagctgtcgatcgactacgcgatcttcgtgatcgcgatcatcggagccgccgagtcgttcgggttgctgacgcgcgccctcgtcacggcggcgtgcaccgatccccttaccggcctgctcaaccgtgcggggtgggagatcgccaccgcggacctgctgtcccgaacccgttcggccacagccaccgtcaccgtcgtcgcgctggacatcgacaacttcaagacactcaacgacaccgagggccacgtcgccggcgaccagtatctggtgcggtgcgcagccttctggcgccaggtcgcgcccgccggcgccgtgctggccaggttcggcggtgacgagttcgcggtgtgcatcgccgaccaccaccccaccagtgccaaggcggaccagttcgtggccagcgtccgccggcacaccccggacatcagcgtcggcacggcgtccggcgcgggcgcgagcgccgacatcgcgtcgctgtacgcggccgcggacgcggaactgtacagcgccaagcgcaggaggcgagatcccgggctgcggcccgcccgcggttgacggcggccgaatgcgggtatcaggcggcaagcgcatccaatgggaagccggctcgggtgggggaagtgatcgtcgatggtcggttggctggacaggcttcagcgacggaatcgggccgtcggcgtgatcgtcggtgtcgtctacaaatacaacgacgaccagggcggttacctcgccgcgctgatcacctactacgcgctggtgtcgctgtttccgctgttgctgctgttgaccaccggcctgggggtgatcctggcgggccggcccgatctgcaggcccaggtgctgcacagcaccctgagcgagttcccggtcatcggaagccagctgcaccaccccgagggcctcagcggaggagcggccggggtgatcgtgggcctggccggtgccctgtacggcggcctgggcgtgggtcaggcggtgcagaacgccatggactcggcgtgggcggtgccgaaacacaagcgccccaacccgattcggtcgcggctgcgcagcctgctgctgcttttggtgctcggctcggcggccatcgcggcgaccctgctggccgcggcgggccaggccacggcggggctcggcttcctcggcaaggccggacttgcactcgcctcggtggccatcaacgcgctgatctgcctggtgctgttccgcctcaccaccgcgcgtgcgctgtcctaccggcaggtgtggccgggagccgttgcggcagcgctcgtttggcaactcctgcaatggttcggggccggctatgtcgcgcacgtggtgaagcgggccagcgccaccaacagcgtgttcgcgttggtgctgggcgcgttggcctttctgttcctggcgtcgaccgtgctggtggtgtgcgcggaggtcaatgtcgttctggtggagcggctgtacccgcgcgccctgctcggcgcattcagcgacgacgcggatctcacgtcggccgatcgccggacctacaccaagaaggtcaaggccgaacgcgtcaaggccttcgagcgggtcagcgtcagattcgacgacgccaaacgctcacccgccaaaaccgttgggcgccttaatattttcggcgatgcgcggcggccgcgcacaccgtgagccgggtgggcggcggccttgtgcgaacgcgatggcgacggggaaatagtctcccctcatgagtctggtcacctatgagctgcacgaccacgtcgccaccatcaccctgaaccgccccgaggcgcgcaacgccatcaacggagcgctgcgccaggacctcaacgcggcctgggaccgcttccgcgacgacctggacgcctgggtcgggatcctgaccgccaacggcgacgtgttctgcgccggcggtgacctcaaggacggcgaaggctcggtcggcaccttcggcggcaccttctgggagaagccgacgatcaactccttcgagtccggcatggaactgttcaagccgaccatcgccgccgtgcacggcccctgcatcggctacggcctgaccggggtgttgttctgcgacttcgtcatcgccagcaccgaggcgacgttctgctatcccgaggtggcgatcggcgtgcccaccatcgtcggggcgatccggttgccccgccgggtgggctggggcaatgcgatggagctgctgttgaccggcaagccgatgagcgcggagcgggccaaggagatcgggctggtctggaagctggtggagcccgaccggctgcaggccgaggcgcgggcctgggcccgcaccctgaccgaggccgcacccctggcccagcgggcgaccaaagaggtggcgtggcgcaccgcggacatgggctggatcgagtcggtgcgcttcggcgagaccatgcgcaaggtggccggggccaccgaggacgtcgccgaaggcatccgggcctggaccgagaaacgcaagccgcaatggcgcggccggtgaggcgtgccggccgggcaccggcactgccgcgccgggcggtgtgtcaggattccaggatgaatgcacgcagacttgcccgcttggttggtatctcggttgtcacgacgtgggcgctgctgagtgcacccgtgggcaacccggtcgccgccgccgacccctgctcggacgtctcggtggtgttcgcccggggcacccaccaggaacccggcctgggcaacatcggacaggccttcgtcgactcgctcacctcgcagctcggcgggcggtccgtcgacgtgtacgcggtcaactacccggccaacgacgactaccacaacagcgcgaacgccggcgccgacgacgcgagcgcgcacgtccaggacaccgtggccgcctgccccaactcgcggatcgtgctcggcggctactcgcagggctcgaccgtgatcgacctggccaccaacgcgatgccgccctcggtggccgaccacgtggccgcggtggccctgttcggtgagccctcgagcggcttctccaccatgctgtggggcggccagccgctgccgacgatcaacccgctctacggcggcaagacgatcagcctgtgcgcccccgacgacccgatctgcttcggcggcggcaacatcatggcgcacgtgtcctacatcgacgcgggcatgaccgcgcaggccgcgacgttcgcggccaaccacctcaaccagggctcgccgcgcacctagcgaccgctcaccgtggctgcggcgttgcccctggtcaagttgctccgcgacaccgtcgcggtgcggatgtcggtggccgtgctgctcggcgtcgccgtcgcggtggtggtgggcaacaccgtcggctggcggttcgcgctggtcggctgggtggtgacggccggggtgtatgtggtgtggacgcagctcatcctgttcggcatggacgccgagcagacccgcgtctgggcgacgcgggaggatcccacccgctgggttgccgacgcggtcattttgtcggccagcgtcgcgagcctggccggggtcggttacgtggtggccgccgggtcgcatgccggcgctcgggcggtggccgccgccgtgctgggcatcctggcggtcgccgcgtcctggttcgccgtgcacaccctgttcaccgtgcactacgcgcggctgtactactcgggtcagccgggcggcatcaacttccacgacccggagccgccccgcttccgggatttcgcctacgtggcgttcacggtcggcatgacctaccaggtgtccgacaccgagatcgggctgaccgccatccggtccacggtgctgcgccacgccctgctgtcctacctgctcggcgcggtgatcctggccgtcacgatcaacttgatcgcggggctgggcgccaagctctgagcggccccggccgatcggctaccgtcggggctatgtccaaagtctccggcaacgagttgatcgacgacgtcaccccgggcgacctcatcgccgtcgaccgcgggtccggcgaacggccctacaaggtcgtcttcaaggacgccaccgacgggggctatctcgtcaccctggaaagcgacggcggcgagacctttcaactcgacctgcccgccggcacccgggtgacccgggcactcgaggcgaaatgggaatccgcccaaagccccacgcccaacgccgatgactgacggctctgcgttaaaggtccggcgatccgggtaggcgtctcggtgaccggctcgccgcgagtcggtgccgcggcgaaggggtggttcgccatgaccgcacaactgcccgccgcgccggacgctacgattcgatggtgaccgggtcgccgacggtgatgaccccctcggccagcaccgccagataggccccggcgcacggctgtgggccgtgaccgcctgtgtccaaacggttttcggccgcggggatgcgaagcgcgtgcggggcccgcggcagccggccgtgctcgagagtgggaaccacgcagcgcgacgtcgccgtcagcacccgcaacctggcctccccgaccgtgatttcgcttcccgcccaatcgttttcggcatacggcgggtagcccggcggggtggcgatcaccaggttgggccggtagcgcagcgcctccaccccgatgtgctgcagggtggcggtggtgatcgcatgcagcggggcttcgtcggtgaacgaatgacccggggtggccgcggagatccgcagaatgcggccgtcgacctcggcgtcgaggccgcgctcgagcagctgctccggatcggggcgcaccagcgtggcgccgtcggggcggcgcgcgatcagccggacccggcgtcgcgtcaaccgggagatcaactcgtcgacgccggggtcatcggcggccacgtccatcccgtcgggcaggctgatgcgcaccccactcgcatcggcgcgcgcggtgcacgtcaacaggtcacgccagagccggggattcttggcgctggcgacgtgtccggtttcgtcgtcgacgagcgccagccgccggtcgccctgggcgccgtgctcgtcgaccgccagccggtccagcgtttcgcccagcatcgacttcaccgggtaacgcagcaaggcctcgacccgcatcggcaccgcggcgcgggcggccgtcgactcgtccatcacacaccttcactcggcgcaactgcacactattgttcgctgtgctcactgtgcccgaaaccccggggccgcaccaccgttcagatcggcgccgcggtcaccacgatcgactgatcactggtctcccaggccgtcatgaacgtggcgacaccgacctgttcgtcggcgtggtcgatacccgggtcgttgaggtgcacgatctgggtgtccgtgtcgatgcccgtcacgaccaggaagtggtcggctttggtgcgctggtcatcggcgttcaggatgaccgaggagttgacgaaggcgatgatcttgcggttcttggcgaggtattgctccaacgcgggcaggccggtgcggtccggctcggtcgccgagaccatctccgacttgatgccgaagtgatcgagcagcacgacgagatcggccaactcgatgccggcgttggggcccgaatggctgggatcgttgcgcggcgcgtagatcggaccgggattggtgcccgacggggtcgactcggccaggtcgagcatctgccgttcactcggtgcggtgccggtgatttcgcccaccacgtcggcgacggagaccagtccgcagttgtcctcaagcgactgcgccgcccagtagcgggcggcggccgcgggattcccgtaccggccgggagtagcggtcgtggacgacggattatcttgtgctgcaacggctttggtcgccgacgtggtcaccgacgcggtcgccgcggtggtggccggaggggcggcgccacaccccgcgacgagcggcgcgccggccaacccgatgcacgccgcgagcacggcaacccgggcggcgcggccgaggcggagggtgggcatgcgtgctaccggatttcgtcgaacggtcgaagggccagcaaacggtagcaccccgggcacggcgctagggccaaatcaccgtgaaccctcgaaatcagcttggcagcaggcgcttcttctgttcttcgaattcctgctgcgtcaggatccccgcgtcccgcagcgatgccagctcgcgcagctcggcggcgatgctggtgatcggtccgcccgcgctgacggccggcgccgccggctcctgtttcggcgccttgcccggttcttggcccggttcgcgcggcgccttggcggcctcggcccgggcccgctcgcgaccgaggccggtggtgccggccatcgcgcgcccggccaaacccgccgcggccatctcgccgaacaaactcccggtgccagcgggtgcggcggtggccgcggtttcggcggcggcggtcaccgtggtggccggcagcgccagggcggccggccggatcgccggagccgcggccgtccacgtcggcggcaccgacaaggtgccgacggtgttcgcctggcccaggcccgccgacgccagcgtcccgaaaccgcccgctgggttggtgatgaccgggaacggcgacggcggcaccgctccggtgcccggccagggttgcacgccggcccagccactgacgatgtcgtcggtgtggaaaccggtcagggcgccggcgatgtcgaagggcagcgcgatcgtggccgagggtgcgtcgacgcccatcccgaccacgctggccggcgcgtcgaggaagatcgcgatcaggtcgctctccagccccagcaggtcggtcaccgacgggtcgccgagcgcgttcggcgacagcgcaaggttgttcagcatgttgggcaccgccgagaacggctgctgcgtcacggtgttgcgggtgctgccggcggcggtggccgcggccttcgacaccgcttgcgactgatcggcgccggagttggtggtcggatccggttgggtgaacggggtcagccgggtcgccgcggcggcggcgccggcgtagccgtacatggcggccgcgtcgcgcgcccacatctcggcgtactccgcctcggtggtggcgatcgccggcgtgttctgccccaggatgttggtcgcgaccagctgggcaagcagcgtgcggttggccgtgaccaccgggggcggcaccgtctcggcgaacgccgtctcgtaggcgaaggccgccgcccgggcgttgttggcggtctcttaggcctgggctccggtggtgcgcatccacgtcaggtagggcgtgatcgccgcgatcatcgcggccgccgacggcccgacccacggcccggaggtcagggcggtgatctccgcctgataggagtccgccgtcgaatgcagggtggcggccagctcgtcccacgccatcgccgcggccagcatgggtcccgaccccggaccggcgtacatccgcgcggagttaacctccggcggtagtaccgcgaagtccatgtcgttctcctccgatcgctgcgctggccgtgccgggacggatggcgtcagcgcgggtcatgccgggcgtgcgtgatgtgggccatgatctggggatagccacctgagcagcaaacaaatcgcaatccttctggtactgccggtaccgcatcgaagtccagccggatgagagcccccaactgtccaggatcggtcgcacacatctgcaactgtcgcccacgttcacgaatacagcgaaattgttgcggtgggttaacgctaggttaccggggcgtgacggctgcgatcgacaagggtatgacgcgtcgtgagcaaattgttctcagtgcggtctcagccgcgcgcttccagcaaaaaccgtggtcacctcggcccgcgggcccgccgggaccttccggccggccggcccaggggtgttctgcttggattcgtagcagcatccgtgagtgaggttggttgatgaagattgtgctggccgcctacggcagccggggcgacgtcgaaccctgcgccgccgtcgcccgggagttgcagggccgcggccacgacgtccggatcgcgctgtcgcccgaccagctcggcctggcggagtcggccggactgcgcgcggtggcctacgggccggacagccgcgagcagatcgacaccgccaccgatttcgtccacacggtgcagaatccgatcagcgcgctaccgcagctgaccgagcgggtcaccgcggtgtgggccgccaagagcgaaacgctcgccgcgctggcggccggcgccgatctactggtggccgggatgaacgagcagcggctggccgccaacgtcgcccagcgcgtcggcgccccgctggcggcgctgcacttcttccccgccgacacgctggagctcggctggatgcagtcacacgtcaccgccgccgccgaagccgcccagcgtctggcgctcggtttgcccgtcgacgccgggcaatcggaccgggcggcgctggagatccaggcctacgacgagctgtgcgtgcccgggctggcagagcagtgggcgacggcggggcaccggcggccgttcgtggggtcgctgaccctgggcttggcgagcggcgtcgacgacgaggtactgtcctggatcgccgacgggaccgcgcccgtctacttcggcttcggcagcacccccgtcagctcccccgccgagacggtcgcggtgatcagcgctgcctgcgcgcgggtgggtgaacgggcgttgatctgcagtggcccaaacgatttcaccggaatcccgcccgaggaccacgtgaaaatcgtgccggcggtcaaccacgccgcggtctttccggcctgccgcgcggtggtgcaccacggcgggtccggcaccaccgccgcgggtttgcgggccggcgtgccgatgctgatcctgtggttgtggctcgatcagccggtctgggccgaggcggtcagcgcgttggaagtcggcctcgcgcgcgcgttctcggcgtccaccctggactcattgaccgccgatcttcgctgtgtgttggacgggcgctaccacgaccgggcccgggaggtcgccacccggatgaccaaacccggcgaaagcgtcgcggccgcggcggatctgctcgaggaggccgcccgcgggggctgatcggcgccggggtgcccgagcggtggtgcaaagccggcccgtcgtgtagaaggttctggtgcaggatccgccgaatcgctcgttcgatccgtcgctgctgcgcgacgcggtgatccggcggatctaccgccgcacgtcggccgagggcaccatcagggtgccggccgtcccggccatgatcgacgaatacctccagttgtgtggcaacgtctgcgccaccctgggcgtctggtatgcccctgagcagttcgcgcagctgcgctcggcgctggaagtcgaactggccaaggccttcaaggccttcccccggtcggacgtgctcatctcgtatcacgccccgttcggcaccggcgtgaacttccacgtccaggccgactggcgcaccatcgaggccgactacgaacagtgggtcgccgtgcgtccgccgccgctgttcggcaccgagcccgacgcgcgggtgctgaccctggccgccgaggccgacgaccccgccacctatcgggtgctcgacgtcggcgcggggaccgggcgcaacgcgctggcgctggcccggcgcggtcacccggtggacgcggtggagatgaccgcgaagttcgccgaggcgatgcgcgccgatgccgagcgggaatccttgggcgtcaacgttattcaaagcgacgtgttcacggcgatggagaatacccgcgaccgctaccagctgatggtgctctccgaggtggtgcccgacttccgcaccgcccacgagttgcgcggcatgttcgaactcgccgccgaatgcctggcgcccggcggacggctggtcttcaacaccttcctggcccacgacggctacgttcccgacgccgccgcggtgcaattcagtcagcagtgcaacagcatggtcttcacccgcgacgaggtgatgggcgcggcgggcgggctgccgctcgcgctcgtcgccgacgactccgcctacgagtacgagaagacccattcgcccgccgaatcctggccgcccaccgggtggttcgagggttgggccggtggcctcgacgtgttcgacgtcgaacgggacgactccccgatcgaactgcgctggatcgtcttcgccaagacccgcgccggatgagtcgctcagcgcgacgcggtcaggtcccgggtcgccggtccttccagcaaggtgccgtcgggtgcgaagcgcgacccgtgcagcgggcattcccacgccttgtcggcgtcgttccagttcacgatgccgcccagatggggacacaccggtgacacgcggtgctcggtgccgtcgacgcggcagcgggcctgtaggtgccacggcgggccgctgaccacaccgccgtcaccgtcgaccgggctgcggcgcccgatccgcaccgccggagtgacccagcccttggtcaggttgaagccgacctcgaggttggcctgcacggcggtggccagacccgacagctcgtgcgggctccagctggcgaacgcgcgcgcccagtccattcgcccgcccaggatccggctggacagcgccaacgccgccgcggccccgttggtcatcccccacttgttgaaacccgttgccacgaaaatggtttcgctgttgggcaggatggggcccacgtagggcaggtggtcgatgggcgtgtagtcctgggccgaccagaagtgagtctgcaccgcacccggaaaatgcttgcgggtccaggccgacagttcatccagcgcatcggacgggctcttctcgcggcccacggtatgacccgcgccgcccacgatcagccgctccccgtcgggcaccggcgcgtaccgcaccgaacgggtcggcgagtcggtggagatcatcatcggccgggtgatgttgccggggaccttgaaggccaggcagtaggaccggctgggcttgacccgggcgaaatagccgccgcgatccaggatcgggatgccggtggcgagcaccagctggtcggcgtgcagttcgacgtcgtggccggcggcatcgctgccctggttgacgtgcacgcgcacccccttgccgcgccaggacacgcggcgcacccgggtgtgctcgaccagccggccgccgcggccgagcagttcgacggccagcgagtcgaggaagggcatcgggtcgaactgcgcctggtcggccagccgcaccccgccgtgataggcgaacggcacgtcggcgtcgtcctgccacaccaccgggagcccgaccgcctgacaggcctcgaactcggcgcgcgctgacggcacgccccggacggactgggcgtaggtgtaggcgtcttcgcgttgcaccgccacgccgtgcgcctcgcagtggcccaacacccattcctggccctcgcggttgccgtccacgtacgcgcgcgtcacctcccggccgtgccgcggcagcaccttggacagctggctgccttgcagcaggctgattttcgcggtggtgttgccggtcgcgcaggcacccaccgtgcgcgcctccagcaccagcacgtccttgcccgcgcgggccagcagcgccgccgtcatcaggccggtgatgccggcgcccaccacgatcacgtcggcggacgccggcccctggtcaagctggcttgcggcccaaggacgttcggtgcgctcgctcatccacaaagaagtcacggctgtgctgataccccggcccggcccgaagaaacgccgcgggctcagccctgtcgtagccgggcgctggcctgctgcagcgtttccgcggcggcgtggctggccttttccgccgtgtcgcagtcgccctcggcgccgcgcagttcccgctcggcgtcccgcagctcccgggccgccgcgtcgcgccgctgccgggccgcatcgcgtcgggccctgcgctcggacaactccgcgtcggcccgggctttggcgtcttcggcggcggcgacggcggcgcgccgccgctgcgtatgccggttctgcgcggcggcgcgcgccggctttcggttcgcccgctcgggctcggggctcggggcgtcacccacgtcagccaagtcacccaagtcaccgaagcccgaccaccgctcgggccgggtgagccggcccaggcgcgcccgcacctgcgggtcggcgacggcggcttgcagcgtgccggtcaggtcttcgcggacggcggccgacggcgtgcgcacgtcggccgcccgcagcgcggcgccggtgagttcgtcgatgagccggtgctgctcggcggacaattcgcgaatgcgcgccccgtccaaagcggcgtgcgcggcccgcaaccgctcaccgaggtcggccagtcgctgtcgggcgtccttgtgccgcaaggccaaccggttgacgatccaggccgccgcggtgggtttgcgggccgccgaaatccgttgggccgcggcatcgtcgccacgcgccgaggccgccgcggccagccgggcgcgctcggcggtgaactgctgcggcggcacccagtagagagtgtcgaggtcctcgtcggccatgaagccatgctctcccgcggatgccggtcggtttaaaaacggtacgtcccgggatacctgacctacaacatcgagcacaccatcgtcggcgggtgatgaggaagcgggattcgaacagcgtcatggcgtccaagagcagcgatcggctcgtcggccgcatcctcggcgtccgtcggccgcgccgattcctggccgcggtgttcgtcgtcgtcgcggtggccggcgctatccaactggcggcggccgcaccgtgcccgcacggcggttgccccggcggcgccgccccgaaacccactgggccggcgcgcgtgaggatcaccccgggccccggcgcgcggaatgtcgaccccgtcgcgccggtgctggtcaaggccgagacgggcaccctggccggcgtcgaaatggtcaacgagggcggcacggcggtgcagggcgtgatgacccccgacaacctggtgtggaaacccaccgtcgcgttgggctacggccgcaactacacgctgacgatcaccagccgcggcaccgatggtgttgagaccaaacaggtttcgacgttctccacgctgcggccctcgaaccagaccaaggtgtcgttcaccaccacgtcggaatcgccgctgcgcgacggcgcgagctacggcgtcgggacggtgatcgtcgcgcacttcgacgagcagatcgccgaccgggccgccgccgagcggcacctgaccgtgaccaccaatccgaaggtcacgggctcgtggttctgggtggacggccaaaacgtgcactggcgccccgagcattactacgcgcccggcaccaccgtcactgccgaggcgaagatctacggaattgcgttgggcgacggcctgttcgggcaggacgacagccgggtgtcattccgcatcggcgacgcgcacgtctcgatcgccgacgacgccacccaccaggtcagcgtgttcgacaacggcgtcctggtgcgcaccatgcccacgtccatggggatgggcggtaccgagaacatcggcggtcggtcgatttcgctgtggaccccgccgggcgtctacaccgtgctcgacaagggcaacccggtcgtcatggactcctccacgttcgggttgcccaagaactcccggctcgggtatcgcgaaaccatcaactacgccaccaagatcagctcggatggtatctatctgcacgagctcgacgcgacggtgtgggcgcagggccaccaggacacctcgcacggctgcctgaacctcaacgccgacaacgcgaaatggttctacgacttctctgtgcccggcgacgtggttgaggtccgcaacagcggcgggccgccgctgacgctggcgcagaacggcgattggacgctgagctgggatcagtggcgtcggggctccgcgctcaaacccacctgaggcgggtgacgcagctcattggacatccgctgttgtgctccacttcacaataaactcttgactcgttccaaataagtgagtcattctggtgcggtgtcatcgacggccgattacgcggacaggttgcggatggccgatctgcgggtgacccggccccgggttgccgtgctggaagtcgtggacgccaacccgcacgccgacaccgagacgatcttctcggcggtgcgaatggccctgcccgacgtgtcccgccaagccgtgtacgacgtgctcaacgcgctgaccgccgtgggcctggtccggcgcatccaaccgctgggcatggtcgcccgctacgagtcgcgggtcggcgacaatcaccaccacgtcgtctgccggtcctgcgggaccatcgccgacgtcgactgcgcggtcggcgaggctccctgcctgacgccgtcggacgacgacaacgttctcgacggcttcgtcctcgacgaggccgaagtcatctactggggcctgtgcgccgagtgctcgacggcaggttcttgatcgcagcccgattcacccaccctcgaaaggaatgctgtgtcatctgatacatccgccagccgcccaccccaaccggacaccaggacggccagcaaaagcgaaagcgaaaacccagcaatcccttcgccgcacccgaagtcgaatgcccccctgaccaaccgggactggtggcccaaccagatcgacgtgtccaggctgcacccccatgtcgccgaagccaatccgctgggcgaagacttcgactacgccgaggaattcgccaagctcgacgtcgaggcgctcaaggccgacgtgatctcggtgatgaccacctcgcaggactggtggcccgccgactacggccactatggtggcctgttcatccggatgagctggcatgccgcgggcacctaccgcatccacgacggccgcggcggcggcgggcagggcatgcagcggttcgccccgctcaacagctggccggataacgtgagcctggacaaggcccggcggctgctgtggccggtcaagaagaagtacggcaacaagatctcctgggcggacctgatcatcttcgccggcaactgcgcgctggagtcgatgggattcaagaccttcggcttcgcgttcggccgcgaggacgtctgggagcccgaggagatcctctggggtgaagaggacgaatggttgggcaccgacaagcgctacccgggcaccggcgagcgcgagctggcgcagccctacggggccaccaccatgggtctgatctacgtgaatcccgaagggcccgaaggcaagccggatccgatcgccgcggccatcgacatccgtgagaccttcggccggatggcgatgaacgacgaggagaccgcagccctgatcgtcggcggccacagcttcggcaagacccacggcgccggcgacgccgacctggtcggcccggagcccgaggcggccccgatcgaacagcagggtctgggctggaagagctcgcacgggaccggcgtgggcaaggacgccatcaccagcggcctggaggtggtctggacgcccaccccgaccaagtgggacaacaccttcctggagaccctgtacggctacgagtgggagctgaccaagagccccgccggggcctggcagttcaccgccaaggacggcgccggcgcgggcaccattcccgacccgttcggcgggccgggccgcgcgcccacgatgctggtcaccgacatctcgttgcgcgagagcccgatctaccgcgacatcacccggcgctggctcgaccaccccgaggagctggccgacgccttcgccaaggcgtggtacaagctgctgcaccgcgacatgggactggtctcgcggttcctggggccgtgggtccccgaaccgcagctgtggcaggacccggttccgcccgtcgaccacccgctggtcgacgacaacgacgtggccgccctgaaggacaaagtgctcgcctccgggctctcggtcccgcagttggtcaagaccgcgtggtcggcggccggcagctaccgcaacaccgacaagcgcggtggcgcgaacggcggacggctgcgcctgcagccgcagcgcaactgggaggccaacgagccctcggagctggacaaggtgctgcccgtgctggaaaagatccagcaggacttcaacgcgtcggcgtccggcggtaagaagatctccctggccgacctgatcgtgctggccggctcggccgcggtcgagaaggcggccaaggacgccggctacgagatctcggtgcacttcgcgcccgggcgtaccgacgcctcgcaggagagcaccgacgtggactcgttcgcggtgctcgagccgcgggccgacggattccgcaacttcgcgcggccgggcgagaaggccccgctcgagcagctgctgctggagcgggcctacctgctcggtgtgacgggccccgagatgacggtgctggtcggcgggctgcgcgccctcggcgccaaccacggcggcagcaagcacggcgtgttcaccgaccggccgggcgcgttgaccaacgacttcttcgtcaacctgctcgacatgggcaccgagtggaaggcgtcggagaccgccgagaacgtctacgagggacacgaccgggccaccggcgcgctcaagtggaccgccaccgcgaacgaccttgtgttcggctcgaactcggtgctgcgggcgctggccgaggtctacgcccaggacgacaaccagggcaagttcgtcgaggacttcgtcgcggcctgggtcaaggtgatgaacaacgaccgcttcgacctgaagtgacaccgggcgacaccccgcgagtcaccggctcgcggggtgtcgtgcattcaggtcaccgcgcgaagtcccactgcccgtagtcggcggcgaggacgtcgtcgacgtccacgttgatgccgcccagcagcgggcccgggctgcccgggctgttgaccacggcctggtacagcaccgccgcgggctcccgctcgccatgcgaccacgaccgggtctgccacgcccaccggtggccgggagtgctggacggcccgacgacgccgtcacggatcgcccacccgcacgcccgggcatgcccgtagatgccggtacggccgacgcccagcaccgagttgatcccccgaaaccattgcaccgcaacgttgttccacgtgtcggcgtcgatgtcgtcgtcgacgctgaagaagatgggcgccgagtccgggccgccggccgcggcgtgcaactgcgtggccgtgtgcgcatcggcgacgccgccgtcgtagccgcgggtgaaatccgacgggtccggccatccgggcttgccgtactggaagttgctgacgatgtgcaggcccgcggcgcgcagcgcgtcggcgtagtcccgggtcagcggtttggcctcgaagtcggcgcccggccgcgacagcgatacgtagttcaccacgccgtcgtagccggccgccttgatctcctcgggcgcgatcctgcgctcggcaaagtcgatcagcttcaacccggcggcgcgggcggtcggaccgcccgcgcccgccaccgctcccaggctcagcagcaccggtgccagggcgcatccggcggcgtagccgaggacctcgcgccgtgacggcggtcgtcgatcgccgcgtgcacccggtccggccgaatcccgcaccgcgcgatggtagcaaaacccgcggtcgcggtttcgggtcgtcggcgccggtcagccgggcgcagccggtgcgccgccgggcgcgccgcgcgccggccaccgaccggtcggacggaggacgcccacgagccagtggcatgatctttgcgtgtcggacatcccgggagccgcctacgcgcgggacggcggattccggactcgttgcgctcgcttaggtgatcgaactatagtctggacacatgtccagtttgctgtcgcggagttcgggagtccgttgaccgcgatggattcggcgccattccgcggtcattttccagcaaagaagagttgagtatgcgaattgccctgctgtcctaccgtagtaagacccattgcggcggacagggcgtctacgtgcgccatctcagccacggcctggtggagctcggtcacgacgtcgaggtgttctccgggcagccgtatcccgacctgctcgacccgcgggtccggctcaccgaggtgcccagcctcgacctgtatcgcgaacccgacccgttccgggtgccgcggccgagcgaaatccgggactccatcgaccttttggaactgctgaccacctggacggcgggcttccccgaaccgcggacgttcacgctgcgcgccgcgcggttacttgccgggcgcacagcggatttcgacgtcgtgcacgacaaccagagcctgggcaccggcctgctcagcatcgccggcgcgggacttcccgtggtggccacggtgcaccatccgatcacccgggatcgggtgctggatctggccgccgcacgatggtggcgaaaaccgttggtgcgccgctggtatgggtttttggccatgcagcaggaagttgcccgccacatccccgacctgttgacggtctcgtcgtcgtcggcggccgacatcatctccgatttcggggtctcccccgagcaactgcacgtggtgccgctcggggtgaacaccgagctgttcaagccgggttcgggcccgcgccagcccggccggatcatcgccatcgccagcgccgacacgccgctcaagggcgtccgcaccctgctgcacgcggtcgcccggctgcgcaccgtgcgggacctcgagctgcggctggtggccaaggtcgaacccaacggccccacccacaaactcatcgccgagctcgggatctccgacatcgtgcacatcaccagcgggctgtccgacgccgagctggccgccttgttcgcctccgcggaggtcgcctgcatcccctcgctgtacgaagggttttcgctgccggccgtggaagccatggccagcggcaccccgatcgtcgccagccgggtcggcgcgctgccggaagtactcggcacggacggggcctgcgccgagctggtgccgcccgccgacgtcgacgcgctcacccgcgccctgggtgagctgctggattcgccggaaaagcgccgcagcctgggccgggcgggccgcacccgcgcggtcgacgtgttcagctgggaagccgtggcggcgcagaccgttcgggtctacgagcgggcgatcgcgcgcaacgcagcgggccgggcgccatgctgacggtcgatttcgaccggctgggcatcgggccgtcgagcaaggtcatcgacgtgggctgcggcgcgggccggcacgcgttcgaggcctaccggcgcggcgccgacgtcgtcgccttcgaccagaacgaggccgaattgcgttcggtcgacaccgtcctgcgcgcgatggccgacagcggcgaggcgccggccggcgcgtcggccacggtggtcgtcggtgacgcgctcaagctgccctacgccgaccagacattcgactgcgtcatcgcgtcggagatcctcgagcacatcccgcacgacgacgccgccatcgccgaattgatcagggtgctcaaggtcggcggcacgctggcggtcagtgtgccccgctggctgccggagcgggtttgctggctgctgtccgacgaataccacagcaacgaaggcggccacgtccgcatctaccgggccagcgacctgcgcgccaagatcctcagcgggggaatgacattgacccacgcgcatcacgcccatgccctgcactccccattctggtggctgaaatgcgctgtgggcgtacacaacaccgatcaccgcgcggtggccgcctaccacaagctgttggtctgggacctgatgcggcgacccaagatcacccagctggccgagtcgctgctcaacccgctggtgggcaagagcgtggcgatgtacttcgtcaaacagcaggacgcgaaaagccaagcgaccgcgggatattccattgcatcggtctagcctgcccgcggtccccggggtgctcacgcccgaccaatgccggcagaccgcgctgtcgatcgcggccgcgcaggaaccgtcgggcgccatcccctggttcgacggcggccacaccgatccgtgggaccacgtggagtgcgcgatggcgctcaccaccgccgggctgctcgagccggcccgggcggccttcgactggagccgtcgcacccagcggcccgacggctcctggcccatccaattccgcgcgggcgtcatcgaagacgccaacagcgacagcaacttttgcgcctacatcgccgccggggtgtggcatcacgtgctggtcaccggtgacgactcgtttgccgccgagatgtggccggtggtgcgcaaggccatcgacttcgtcatcgacatgcaggtcggctacggcgagatcgcttgggcgcgaagcgaagccggcctgttgccggaggctctgctgaccgggtgctccagcgtgttccacagcatccggtgcgcgctggcgctggccggcctggtcgacgacccgcagccggagtgggagctggcgctgggccggctgggccacgcgatcaccgcgcatccggaggcgttcaccgagaaggaccgctactcgatggactggtactaccccattctcggtagcgccgtgcgcggtccggcggcggtcgcccggatcaagcagcgctgggacgacttcgtggtcgacggcctgggcatccggtgcgtgggcgatcgcccgtgggtgaccggcgccgaaacctgcgagctggtgatggcgctggaggcactgggccggcgctccgaggctcatcgccagttcgccgcgatgcaacacctgcgcgagggcgacggatcatattggacgggactggttttcgcggacggaaaacgctggcccgaggagcgcaccacgtggacgggcgcggcgatgatcctggcggcggacgccctgtcggatgccaccgccggcgccgggatcttccgcggcgacgcgctgccggtgggcctgcagaccgacttcgattgcgaatgcgtggccagcggccgctgacgctttagtcctgttggaccggctcgcccgcccggccgccgatccgctccagcacgcgcagcgacccggtggccgacacctccctgaactgaccggaatcgattgcccggcaatagatgtgatacggcggccggccgccgtccctggggtcggggaagacgtcgtgaatggccagcgcaccgccgggcgtcacccacttggcccatccgtcgaagtcctggttcgcggcggtctcgctgtggccgccgtcgatgaacaacagctgcagcggtgatcgccagccccgggccacgatcggtgacttccccacgaccgccaccacgtggtcgtccagcccggcggcgtccagggtgcgacgaaacgtcggcagcgtgtcgaacaggccggtcacctcgtccaccaacgaggcgtcgtggtattcccagccggcctggtgctcctcggagccgtgatggtggtcgaccgtgtacagcacgctgccggtctgttgggccgcggcgccgaggaacagcgtggatttgccgcagtacgtgccgatttcgacgccggtgccgccgtcgaggtagcgcagcgcggtgtcgtagagcgcgcgtccctcctcggcgggcatgaaaccctggacctgttcggccagggcgaacaaacgctcgtcgacgtgattcatcagccgaacctatcgccttgcgcgacaccgccgtcaccgtggtcgatgttcgcgctgagcgatcaccgcgggccggcgcaccggctgtccggcgggcgaagcgaccgcgccttaacatcatcggtgtgcgcgcctcgttgacccgtgatcccggtgccgtccgcccggccgtcgtgaccgccgctgttgccatgacggccgttgccatggcggccgccctgctgctcccgcccggcacccctggggcggcggcgcccgcgtccgccgcgaactgcaccccggtgcaggtcgtgtttgcccgcggccgcaacgagtcctccggaccgggcgtgctgggcaatgcgttcatcagcgcattgcggtccagagtgaacaggaccgtcggcgtctacgccgtgcagtacccggccgacaccgaggtcgcccagggcgccaacgacatgagccgccacattcaggacatggtcaacagctgcccggacacccggccggtgctgggcggctactcgctcggcgcggcggtcaccgacgtggtgctcgcggcacccatcggcgcattcggattcgacagcccgctgccgcccggcgtagaccagcacatcgccgccgtcgcgttgttcggcaacggaagccagtgggtgggtccgatcaccaacttcaacccgacctacaacgaccggaccatcgagttgtgccacggcgccgacccgatctgcaacccggccgacccgaacacgtggaagcagaactggccgcagcatctcgccggcgcctacatcgacgcgggcatggccgaccaggccgccgacttcgtggccggcaagctctgatcgacggcaccggcgttgccgagccgatcgccgcggcgccccgcagccgcggcgcggttatccggggagacgcggaaattccgcgtcgggtcgcgcgcaaatcgcggtggcaagtctcaattccgaggcgcgcgagccttggcagatcggcgaagccgaattccggccccacagttcagggcttcgaattcacgccggagtgttaccgctggaatacagcatgaagttgcgggtcatcggaacgacgggattgccggtacccgaggccgcggcgcgctgccgggcgcggtaggacgggtggcgacgcatcgcttcactgcgttcccgctcgctccgctgcgcggcggcccatagcggatgggactgaaggaaaataaccgtgccttctgatgtattcgccacgatcgtcactcctctcagcaccactcgcaaaagccgggacagtggttatcggatcgtgattccagaatgcccgccgaatcctgagaccaaaccatccgccaggatgagaattggccgtgaattcgcatatgcacaatccggtgccactgcccgccgccgtccatgccggccggaccgaacgatagcgacgaccaccgacacatttgccgtttcgaatccgcgccggcgggctgctagggtcccttgcttatgccggagatcgatcgccgccgcatgattgtgaccaccggaatcggcgtgctcgcagcggcgctgccgaacccgagagccggggccagtccggccccaccgcccgcggcgcccagcggccaatccgggacctacctcttccaggatgagttcgacggtccggccggctcggcgcccgacgcgtccaaatgggcggtggccaaagcccgcgagacgatcaaggatccgacctactgggaacgcccggagaacatcgggcagtaccgcgacgaccgccgcaacgtcttcctcgacggcaagtccaacctggtgctgcgcgccgccaagaacggccccacctactacagcggcaaggtgcagagcctgtggcgcggcggcgtcggccacacctgggaggcccggatcaaactggactgcctgaccgccggcgcctggccggcttactggctgggcaatgacgaccagggcgaaatcgacgtcatggagtggtacggcaacggcaactggccctcggccaccaccgtgcatgccaaagccaacggcggcgagtggaagacccacaacatcgcggtggacagcgcctggcacacctggcgatgccagtgggacgaggccggcatccggttctggaaggactacgtcgacggcgcgcaaccgtacttcgacgtgcccgccagttcgctgccggattggccgttcaacggcccgggctacacggtttttccggtgttcaacctggcggtggccgggtccggcggcggcgaccccggcccgggcagctatcccgcggacatgctcatcgactggatccgcgtctggtagcaacgcccgccggcgccgtcagtgcgtcagcagcgcggccgcgctccacgcccggcgacccggacggcgcggatccggctgcggcagccagccgagcgggcgcatcaccagcggcaagcgccgcagccggcgggccgccgaatacagcgcctccacctggaccgttcgccaacccaggcgttcgaaataggccaacccgttgtccggggcgaacttgaacggcgcgttggccagcatgcccgccatcttcttgttcatcatcttcttcaggccgggtccggcgaagtcgagcatccaccagcggacctcgggccgctgcagcgccgccgacagcgcggacacgtcgctgtcgtccagatacatcaacaggccctcggtgagcaccagcgccttggtcgcaccgtccagcgcctcgttcaaaaacgcgtcccgggccgccgcgtcggccaggtcaacggcggttcgggtcaaccggcagcgcggcacctcgtcggcgaggacctgcgtcttctcggcgagcaacgccggcaggtccgcctccacccaggcgaggtcgggcggcaggttcaaccgatacggccgggtgtccagcccggcggccaggttcagcacccggtcgcagccctgggcgatggcctcggcgatggcgtcgtcgatgatcttggtccgcgcgacaagccaccacccgttgcgcgtcgtgcgcggcacgtggtcgacgatcgcgcggccgtggtcaccggcgagacgttcggccagcgggtcacggaaaaccgcgtcgggccgcgccgattcggtggcccggtgcaatgctgtccagcgcgccgtgtcggaaacatgggtgatggtgtgccctgggcctgacatacgtgcgttatagcagtacggcggcggcgctactgaccggccctgccgccggccagccaggcggcggtcaccgtgcgggtcgccggcggcggcagcacggcgtccggcgccccgagccggccgaccttgacggtccacgccggtgccgagcggtcgatgcaggagccgcggccctggctgggctgccacagcacggccagatccgaaccggcgccgccgcatccgtagacgccgacgtacccgtcggcccgcccgccccacgcgccgccgttgcgcagcaggcagcgggtgccgtcgtcgagggtcagcgcgaacgggtccgggtcggcgggcgcgcgcacgggtgccagctgcccgtcgaacgtcacccggtgcatctgcctgtcccacggattgtccacgcacagaagggatcccgacgtggacggccagcaggtgccggcgccggcggcgctcggcgaacagtagtagacgttgtcgtcgaccgccgacggtgacggttgcgaacactcggatgcgtgcccgacgctgtcgggcccggccgccacccgatagccgttgatggcttggccgtccggcccgaccgccacgacggtgatcacctgggtgggtggcggatcggccgccgcggatcccgccggcaggaacagcgcccaggccaggacggcgatggggaccagggcaactcgcgacacgttcaccggcgaaccctttcgacagccccctgccgtgcagggtagtgcgtgccggacgtggttgggatcggtagccgccggccgggcttgtactgggcgcaacgacggcgccactccggcgccgccccaccgaaaggaagccagcaatgaagatcgtgcccgccagcatcgaagaacagatcaaccgcgtggatcggcagcgcagcctctacatcgggctcggcgccggcgccgtggcggcgtggagcgtctttcggctgttctggcttgtctacctcgggatgacattcggctggctgttcggcgcgatggtcttccaggtggtgttgtggggggtgatcggcgtggtcgccgggattgcggcaatcgggttcctgagccgctacaccaaggggtcgtaaccgaccaaccggcgactggtctacagctgcgcccagaccgatttcgtcttcaggtagatctccaggccctctttaccgaactcgtgaccccacccggactgcttgtatccgccgaagggcacgtcgtggtcgaacaccaactggcagttcacctggacgctgcccgcctgcagccgcttgacgatccggtgggcgcggcccaggttctccgtccaggcggtggcggccaggccgtaggtggtgtcgttggccatcgccaccgcctcgtcctcgtcgtcgaagggcaggatggcgaccaccggaccgaagatctcctgctggtagagccgcatgccggggtcgacgttggtgagcaccgtggggtgcacgaagtaacccttgcggtccagccggtagccgccggtgaccacctcgacgccgtcgttcttaccttcgtcgatgaagcccatcacgcggttcagctgcttctggctgatcagcggcccgctcacgcagccctcctcgctgggcgcgcccagcttgaacgtgttggccatcatcgcgatgccctcgaccacgcggtcgtacacgccgcgctgcacgaagatccgcgacccgcacacgcagccctggccggagtgcacgaagatgcccagcgacgccatcaggatggccttgtccaggtcggcgtcgtcgaagatcagcaccggcgacttgccgccgagctcgagcgtgaccttcttcaggttgccggccgacgcccgcacgatctccttgccgacctcggtcgacccggtgaaggcgaccttttcgacgtcgggatgcgcggtgatcgccgcgcccgcggtgtggccgtagccggtcagcaggttgaccacaccctcgggaaccccggcctcgtgcaccagccggtccagcagcagcgccgacagcggcgtctcctcggcgggcttgaccagcaggctgcatccggcggccagcgccggcgcgagtttggcgttggcgttgaagatcgggccgttccacgggaagatcagccccaccacgctgtagggctccttgagcgtgtaggcgtgcatgttgacgaacgtgtcggtcgcgatgccgtctgtcttcacgtcgtaggcggtgccgttgatcttcgaacaccagccggcgtagtagcggaagaactccgaacacgtcgacatctgcagctgcgcctgcagcaacggcataccggtgttcagcgaatccagctgggcgaactcctcggcgtgttcgtcgatcaaatccccgatccgccacaggatcttggcccgctcccggcccggcagctgcgaccagacgcccgactcgaaggacgccttcgcccgggcggcggcttcgtcgaccgcttcggcgccgcagtcggtgaattcggtgatcttctcctccgtcgcgggatcgatgaccgcgatgacgtcacccgttccggggcgcttgcgaatgtcgtccaataccgcctgcaccgtcatctgatccctttcctctggcgagtcctctggcgagccgtcgtgcccagcgcccactgcgctcagtgctgagcacttgcttagcattgtgcgcgctgcgtggtcaagcatccgccgggggtggccgggctcagacgccgacgagctccgggtggaacttggccgccatccggcgcatgccgtcgcgccagtcgaccgtggtgccgccgatgagttcgtgcatccggtcgacggtggtcgggttgccgcgcagcgcgcgctcgctcggctcgaagaccggttccctgcccaccagcgagccgaggtagccgcaccactcctgcaggctgacggtctggtcaccgcaccagttgacggtggtagccggaaccgacgccacgtcgagcagcttggggatggtggcgatgatgtcgtcctcgtgaatggggttgtagcgggcgggttctccgggtggcaccgggatcgggatgccgctcagcatcatctccatgtggtagaacggccagccgccgttgtcgccgtaggggacgttgagccgggcgatcgtggtgggcagcccgacgatgcgcgccaccgaccgggcgaccacctccccggcgatcttggagatggaataggtgggaaacaacggcttgtggttgtcgcccagggcggagcgctcgctgcgcggctcgtcgccgggcgggtcgtagaccgcggccgacgagcaatgcaggaaggctttggcgttgcggcagtgggccatcagcacacccaccgactcggcgttggccgccaggtccttgtcccagcttccgctcttggccaccgcgaggttgaggacgaaatcgaaatcgcttggcagaccggtgaagtcgccggcggccagattcaccgtctggcaccggatcccggcctgctcgaggctttctcgggcggcggcgtcggtgaagcgggcgatgccccacacctcgttgtcggccgccagcgcccgggcgacgggggtggcgatttgaccggtcgggccggtgatcaggattttcgagccacgcatccgctgatggtagcgggacacgacgtcaccgcaggagcgaaaggcggggactcacaagccgggctggtcctcgatgatgcccagccagatctgcgcgacgtcgatggccaccttctcgctgatgaaggcgtgctgggttccggtgtagatgtcgcggaaggcccgctccagccggctgccctcgcggatcgagctggtgccggcgaccagatgcgcccactcggcacagccgcgggccgtgtcggtggcgtagacggcggccacccgcatgtcggcgcgcagcgccggagtcagctcctgcccggccgccaccgccgcctcggcggtcgtgaacgcatccagcaccaacagccgggccgcgcgccaggccgcgcggtgatgcgccagccccttctggaaggtggggcggctggccagcgacgccatgtcgctcatccggaacttggtcgccgccagctcctgcacgtcgtcgagcatgctcttggccacccccagcgcccacgacgcgtgcccggcggcggtgacgggcatcagccccatccgggtggccggcgaggcgccgcggaacggcgcccgggtgaacagctcgaaggtgcgggcggcgggcacgaacacgtcccgggcgctgtagtcgtaggagccggtgcccttgaggccctgcacgtaccagccgtcgtcgaagctgatctgctcgcggggaatgacggcaacccgcatctccgggaaaccctcacagatccaacgcatctcgccgtcgtccatcggcaggaacccggcggcgacgtactgggagtgcccgatccccgagccgaagttccacgccccgctcaccaggtaaccgccgtcgacggcggcgccctgcccgttggggaagaactggccgcccatggtgacgtggttgtcgtgcgcggtgaacacctcggcgaagccgtcgtcgggcagataggccgccgcggcgaacgacgacggcaggttggcgatgcccacccagccgaatgagccgtcctgccaagccatttcgatccacgtctcgatcatctcggtgaacgacggctccaccccgccggcctcgatcgggttgaacgccgacatcagcccgctcgcccacatcgcgtcgacgatcgccggggtcagcgtgcgcatccgctccgattcggcagcttggtcttgcaccaggtcccgcatgccgcgggccagggcgaccacccggtcatcggtgtcggcgatcgatgtcatgtggcccttcccatcgtggcctcatcgctgggtgcgacggcagcagcagccttacggtaagcgttgtgcggtggatagtcgacggaatgaatgtgattggcagccgcccggacggttggtggaaggaccgcgacggcgccatggtcgcattggtacagcgcctggaccgatgggcgtcgggccgcgacgacgacgtcaccgtggtcttcgagcggccaccggcggccgtcgtcacctcgtcggtgatcggcatcgcccacgcaccccgggcggcggcgaattcggccgacgacgagatcgtccggctggtcacggccgaccccgatccgcccggcatctgcgtggtgacctccgaccgcaccctggccgaacgggtgcggaatctgggcgcccgcgtgcaggggtcggacagcttccgtgacctgatcgagccgcggcaccgatgagtaccgacgccccagtccccgctgccaaccgggtctgccgcctggcacacatcgacatcccgatcctcggcgccccgatgacctacatcgccggcgcccagctggcggccgcggtctccaacgccggcgcgctgggcatcatcgagaccacgtccgatcagggccgggccgacctgcgccgggtgcgcgagctgaccgccggcgcggtgggcgccaacatcgcgctgctgttcaaccgtgacccggcgatgctggatttgcttgtcgccaacgacattcggttcgtcaccacctcggccggggatccggcgctgttcaccgatcggctgcacgacgcgggcatcaccgtgttccacgtggtgggcacgctggccgcggccaagaaggccgtcgacgccggggtggacggcctggtggtcgagggcgtcgagggcggcggattcaagaaccggttcggcgcctccaccatggtgctgctgccgttggtggccgcccacgtcgacgtccccatcgtggccgccggcgggatctgcgacgcccgatcgatggcggccgcgttcgtgctcggcgccgaagctgtgcagatgggcacccggctgctcgcctccgcggactcgccggtgcacgtcaacctcaagcaggcggtcgtcgcggccgacgagacggccaccgtcctgctccccctcgacggcaaacgcatgatgcgcgtcattcgcacgcccgccgcggagcggctggaggccgcgggcgccgccggcgagggcgccgcggcgctgcaacgcgtgcagcggctctacttcgagggcgacctggacgccagcgtggccaataccggccaggtggccgggcgtatccgcgacctccccccggccgccgacatcatcaagcagatgtggaaaggctgccgcgaggtgctggcggccacctcggcgcgactggactgggccgacgacgcctaggtagccgtgccgctagcccgccgcggccagcgccgcgtcgtagttgggctcctgggcgatctcgggtaccagctcggtgtaggcgacgttgccgtcggcgccgaccaccacgatggcccgggccagcagcccggccatcggcccgtcggcgatggtgaccccgtagtcgtcgccgaagctgtcccggaaggccgacgcggtcttgacgttctcgatgccctcggcgccgcagaatcgcgcctgcgcgaacggcaggtccttggacacgttcagcacggtggcgccggcgccggccgcccgctcgttgaaggtgcgcacgctggtcgcgcacaccggcgtgtcgatggacggaatgatgttgagcaccaacggcttaccgctgaattgatcactggtgaccgggctcaggtcgccgcccgtcaggctgaaggccggggccttggagccgacggagggcagctcgccgacggtgttgatcgggtttccacgcaacgttatctgtgccatggggcacagtctgccaagcccgccgcggccgccgtggggcaggtcccgtgttctgattcgtggggtgcatggcgtagacgacgcggcccgggtgcccaacactgagttcatgccggagttggtgccgcgccaggtggtgatcgtcgggtttcccggagtgcaggcgctcgatgtggtgggaccgcacgacgtcttctccggcgcatcgttgttgaccggcggcgggtatcaggtggtgctggcctcggtcgacgggcagccggtcacgacgcctgccgggctggggttcgtcgccaccgcgctgccggacccgggccgaccgatcgacaccgtcgtgctgcccggcggcgccggcgtcgacgccgcgcgcggcgatgccgagctgatcgcctggatcaaggctgtcgccgggcgtgcccggcggatggtgacggtgtgcaccggcgcgttccttgcggccgaggcgggactgctggacgggcaccgggtgaccacccactgggccttcgccgatcggttggcgagcgagttccccgccgtcgacgtcgacgctgacccgatctttgtccgaagctcggacaccttgtggaccgcggccggggtcaccgcgggcatcgacctggcgctggcgctggtcgaggacgaccacggcaccgaggtcgcgcagacggttgcccgctggctggtgctgtatctgcgccggccgggcgggcagacgcagttcgcggcgccggtgtggatgccgcgcgcccggcgggactcgatccgcgaggtgcaggagatcatcgaggccgagcccgggcgcccgcacaccgtcgacgagctggcccgccgggcggcgatgagcccgcgccatttcacccgggtgttcaccgccgaaatcggtgaggcgcccggccagtacgtggaacgcattcgcaccgaggcggcgcggcgtcaattgcaggagaccgacgacaccgtcgtcaccatcgccgcccggtgcggtttcggcaccgcggaaacgatgcggcgcaatttcattcgccgcgttggcatttcacccgaccaataccgcaacgcatgcgcgtgatgccccgggcttgatggagaaaggactaccccgatgactcagatcgcgttcctggcctatccgggattcaccgcgctggacatgatcggcccgtacgaggtgctgcgcaacctgcccggcgccgaggtccggttcgtctggcacgaaaccggaccgatcaccgccgattccggtgtgctggtcatcggtgctacgcattcgctggccgaaacaccttctcccgacgtgattctggtgccgggcggcccgggcaccgcggtccatgcccgtgacgacgcgctgctcgactggctgcgcgcggcgcaccgcaccgccacctggacgacgtcggtgtgcaccggttcgctgatcctggcggccgcgggcctgctggacgggcggcgcgcgacgtcgcactggctgaccatccccgcgctcaaggcgttcggcgtcaccgcggtgcccgacgaacgcatcgtgcacgaggacggcatcgtcaccagtgccggtgtgtccgccgggcttgacctggcgctgtggttggccgcgcagatcggcggcgacggccgcgccaaggccatccagctcgccctggagtacgacccgcagccgccgttcgactcgggtcatttgtccaaggcgtcggcgagcacgaaagccgctgcgacggcgctgctttcgcgggacagcctgtcccccacctacctcaaggccaccgccctgctggcctgggatcaggcgctggacagggtcaggtcccggcggcgcaggcgccaaccggatctgtcgccggcctgatcacgggttgggctgcaggatctcgctggaggcgagccggccgccggcctgcaaccaggccgcgatcaccccgggcgcatcacggttggggttgtagatgtcctcctcgctgctgaacagcccgtcgccggcgtagaccagccgggtccagttggggaaccagaacggctcgccctgcgggtcggtcgggtgatccagcaggttcttgatcatcaccacgaccgcgtcgttgtcctcgtcgtaggcggtccagccggacggaaatcgcatgtgcggaaacggcgccatcaccgcgacgatccagtcccgcaccgcctcacggccgcggaagaccccgtagtgatgctcggtgtagacgacgtcctcggtgaacaggtccgcgaaggggcgccagtcgccggacgcgctgcatccttcgaccacccgcgtgtaattgtcgacggcgttctcgatttctgccctggtgaatcggcccatagcggacacactagaacgtgttctcccgtttttcgggtcagttcatcgggtcggtcgtggcgaatggggatggcgaatgagcgtgttggatctgttcgacctgcgcggcaggcgggcgctggtcaccggggcgtccagcgggatcggcaagcaggtggcgcaggcgtatctgcaagccggcgctcgggtggccatcgcggcgcgcgacttcgaggcgctgcaacgcaccgcggacgagctcaccgccggcggtaccggcggtgtggtcgcgatccgctgcgacgtgacccaacccgatgaggtgagcggcatggtggaccggatgatcgccgaactcggcggcatcgacatcgcggtctgcaatgccggcatcatctcggtctccccgatgctcgagatgccggccgcggaattccagcgcatccaggacaccaacgtgaccggggtgtttctcaccgcccaggcggcggcccgggcgatgatgcggcagggccgcggcggcgccatcatcaccaccgcctcgatgtccgggcacatcatcaacgtcccgcagcaggtcggccactactgcgccagcaaggcggccgtgatccagctgaccaaggccatggccgtcgaattcgcgccgcacgacatccgggtcaacagcgtcagccccggctacatccgcaccgagctcgtcgaaccgctgcacgaataccatcggcagtgggagcccaagatcccgctcggccggatgggccggccggacgaactcgccggcatctacctgtatctggccagcgcggcgtccagctacatgaccggttcggacatcgtcatcgacggcggatacagctgcccgtagctcggaacgaaaagcgttggcgcactcggattttcaactctcgatctccccggagatcgcgcgctcgatgttcgcccgggtcgccggcggcaacaccagcagaccctcgagttcgcgacgggccacatcgtaggcgcgctggcgttcgtgcgccgccgccgcggggtccgccgccacccggaacaggctctgcgcccgggcaattcgttgctggtcggtgcgggagaagtcggtgcggcgccggcgggtcgcctcggcctcggcggcgttgaacgccgttacgtagtcctcgaccgcggccaggtagtgcgcggccgcgtccggatcgtccaggagatcttcggccttggcgggtcgcaggaagtcggcgcgcagcttggccttgtggaatgcgatggtcagcggatcgcgcatgtcggtcatcagcgggaagtccagcagcttggcgacgtcgagttcgtagtccagccaccgctcgtcggtgcggctgtgctcgtcgaggacccgccggatcgagcgccaccgggccgcctgattgtcggcgccggcgcgggcctcgggcggccgggccccgtcgacttcccgcgccggttcgtcggtgcgccgccgctgcgcgccgagcgcccgcaccacggcgacggtcgcgccgaccagcggcagcaccaggatcaacagctcggccactctgatcagcaaccccacctggccaggatgccaccggcgccgggccggtgcggtgccgtcgacccgcccgatcagcgggcgcctaggctgccgtcgaggtattgggcgcggcaggcccgccgggccagcttgccgctggtagtccgcgggatggcgccggcgggcagcagccgcacgtcggcgacggccaactcgtgccgctgcgcgacggcggcgcggatgacctcgatcgccggccgcgggtcctgacggctggtgcccgcagcgcgctcggcgaccacgaccagccggcccgcttcggaatcgtccacggccggcaccgagaacgccgtcacataaccacgccgaaccatcggcgacgcctcggcgacggtggcctcgatgtcctgcggatagtggttgcggccatcgatgcgcaccaggtccgcgatccggcccgtcacgtacagctcgccgtcgagatacacacccaaatcgccggtgcgcagccagctgccgtcgggagcggcccccgcggcgtggctgccgtccggcagccgcgaccgcagcgtggcgccgaacacccgccgagtctcctccggcattccccagtagccgcggccaatgttgttgccctgcaaccagatttcgcccacctggccgtccggcaactcggccccgtcggcgacgatcaccgcccattcactccgcgccacctggccacaggacaccgcggcgacggcatcgggggcgttggccggcacccgcaccgcatgtccggcgcccaactgccggcggtcgaaatacaccgccgtcgcctcggcctgcggcgcgatggtcgcaacgaacagcgtcgcctcggcgatgccgtaggacggcttgaacgccgtccgcggcaacccgtatggagcgaacgccttgttgaaagtccggatcgcatccatgctgaccggttcggagccgatgatcatcaccacattgcgcaggttgatgtcctcgccgccgccgggcagcccgcgctgcgcggcccactcgtaggcgaagttgggcgccgcggtgacgacgttgccgtgccgcgacccgtcggacagggccttgatccagcgctgcggccggcggacgaacgccgcgggtgacatcagcgtggagtggccgccgtacaccgcggggaagccgatcatcgacaaccccatgtcgtggtagagcggtaaccagctgacgccgtgggtgtttcggtccagcaggtcgatggacaggatcatctgcaccaggttggtgccgaccgcgcggtgggtgatctccacgccgaccggtggccgggtggagcccgacgtgtactgcagatgcgagacgtcgtccatgccgagttcggtcggcgcgaacgactcggcggccgagtcgggtatctcgtcgatggcgatcacccgcggccggtgcaggtgcgggtggccggccaggaactgctcgaccgcatcccgcgcgacggtggtggtgagcaggacgctgggctgcgaatcgcgcagcgccgtgtccagccgctcggtatgcccgggcagttccggggcgaacaacgggaccgcgatggtgcccgccttgaccgccgcgtagaacccggcgacgtagtcgatgccctgcggcgccagcaccgcaacgcgctcaccgcgactggccacctgctggatgcgcgcgccgatggcttccagccggacaccgaactggctccaggtcacctcgtgcgcggtgccgtcgtccgaaccgctgtagtcgaggtagcgatacgcgacggtgtcccccacgttggcgatgttgcggtcgatgagcgaaatcaggttgacgccgggcggcagtgcgaccccgccgtcggcgtccaggcagtcctcgatccggagcaggccgggcacaccgtcgtcgcgccgaagggcgtcatccataccgtgcagtctaggcacgcgatgcggccggccggggtcggtgacgttcgggcaaaccacaagagcgacggccgtattcgctcattccggcggtagcgcgggatcttcgtggacaggtcttcgtgggcgagcgatccacccgatccgccggccgcgcgggttgggcggtagcctaccggcatgccgggccggatgttctccttcgaagtcacccgcaccagtagcgcgcccgccgcgaccctgttccggctcgtggcggacggcgcgaattggtcacggtgggcaaagccgatcgtgctgcattcgagctgggcccgccagggcgatcccgcgccgggcggggtgggggcgatccgcaaggtcggcctgtggccggtgctggttcaggaggagaccacggagtacgagcccgatcgccgtcacgcctacaagctggtggggccgcccagcccggccaaggactacaccggcgaggtggtcttcacgccgaatccggccggcggcaccgacatccgctggaccggctcgttcaccgagggcgtgcgcgggacgggcccgctgatgcgggcggccatgggcggcgcggtgaagtttttcgcgggccggctggtgaaggccgccgagcgggaagccggccaggcgcgctgacccggtctcgttcagccccaagctaattcgtgtaccggcggctacttggactcgacctcgtcctgatacttcttcgtcatgtgcgcgacggcgtccaactgcgactgcgcgaggctgtcgcgggcctggccggcgcgcgcggccgcatccagcgtcggctgcgcctggccctggaaatgcggcatcacttcggcggcgaacagttcggcggagcgcttggtcgcggccgggttggcccactcgtgacccatctgcagcatgcagccgaacccgccggattgatcccagcaccgctgcacctgttcgcgcgcccgctcgggcgtgccgatcacgcccgccccgttctcgttgatgacgtcgatcatctcgtcgagctgatcgcccggcatcgtcatctgcgggaaggcggccaccttctggaagtaccggaaccacggctcgatgccgaacttgacctcttcgcgggcctgcttctcggtctcggccagatggaacaaaccgaccaggctccaattcgtgcgatcgacctgggtgccgaaggccgccgcccgctcctcgacgatgccccagtggtaggacagcgcattgaatccctcgacggtcagcgtcgccccgatggacagcagcccgatgccgtgtttgcccgccagccgggcgccggtcggcgacgcgacggcggccaccgccagcgggatgccgccgtcggagtacggggccagctgcaacttggcgtcgaacaattggtgggtggccgtcttggcgctgaccgtctcccccgccaacagccggaccacgatgtcgagattggtctccagcagctcgcgggtgtcggtgggagtcagcccgatcatggacgagtcgctgggcagcgagcccggacccaccccgccgatgatgcggccgtgcgtgaggtggtccagcagcatcagccggtccgctacccacagcgggttgtgatacgacagcgagatgacgccggtgccgaaccggatgcgcttcgcgcgctcggccgcggcggcgatgaagatctccggggagctgatgatttcgctgcccgccgagtggtgttcgcccagccagacctcgtcgaaaccgagggcatcgagatgctcgatgaattccaggtcgcgttgcagggccagcgtcggattggtgcccgcacggtggaacggggcgatgaagtaaccaaacctgagcttgcccatggggttccccttgcactcgagtcccccgaaccatagccgtgcccgacgccgagccggaagcaaaacccgaaaaggtatcagccggtggggccagatgaacatggccccaccggctagcgaaacaagcgagggagctacagaaagcgcggggtcaaccgcgccgactcaacggcggtgggcgatcacgggtagccgccgcagacgttgcccacgcaaccgccgccgccgcccggtccgccgccgcccccgccgacacccgggatgctgccgccaccgccgccggggccgccgccaccggtcgggccaccggggatgctgccaccgccgccgccggggccgccgccaccggtcgggccaccggggatgctgccaccgccgccgccggggccgccgccaccggtcgggccaccggggatgctgccaccgccgccgccggggccgccgccaccggtcgggccgccgggcacggtgccaccgccgccgggtgtggtggacggcacgacgctcgtcgacggcgtcgtcgtcggggtggtggtgctggtggtgctcgggccgcccttatggccgccgccgcagccgaccgccagcacgagcatcgccgcgccgccgaacacggcgatcgtcgtcctcggtccagatctcatcgcaaccccaatctcgaaggggcgccgcgccgcgacgccccctgtttcttacccgggggcgcgggcgtgcaaactccggtccgggccggcggctaaccctctttggtgatcagcttgcgcagcgccacccggtcgggctgcagcagttcggcgatgcggggccggttcacctcggcgacgatgatctcgccgacctcctggtacacctcgctgaagatgccgtgcgacttcatcttcgaggtctggtacaggttgtcctcggtcggcgtcacgtagatcaccgcgtcggccttgaagcggtgcaccagccacaggtggatcaacgtcatcagccgcttctgccggagcttttcggcgaaggtgttctggtcgcgcacctgaaggatgctgcggccgtgccggtccttgatcgggtcgacgacgacattggccagttgctcgtcgccgtcgccgtagatgccgagttccagcacgtccgaacccgcccggcggggccgcaactgcacgcggagcttctcgccgaggtggtagttctcgctccacatcgccagccactcctcgagcagcttcttgggcacctcggtctgcaccagatgctgatgctgggtcgagccctcgcccatcgccttggtggtcgcggtgcggcccgacgaggcggccagtgcggcatcgctgcggggcccaccgacgagcgtttgcggtgtgcggtaaggggattcgaccagacgcatcttgcgctgcaagcgggccagcgccagcatgccgtcctgttgcagcgaggtggcgaactcctcggcggccacgccgtcgatctggtgtccgccgtaggtgatgaagttgaagacgaagcccatcttgccgagttcctcggggaactgcttcatctgctcgtcggtcatgccggtggtgtcccagttgaacgacggcgacaggttgtaggccagcatctggtcggggaactcggcgtggatagcgtcggcgaactgcttggcgtcggccaggtcggcggtcttggtctccatccacaggatgtcggcgaacggcgcggcggccagcgacttggcgatggcgtacgggatgccgccccggatctggtagtagccctcgggggtcttggccagctcgcagtcccagcccgggtcgaagcccagctccttcgccttggccttggcggagtagagcgaggcgcgcgccgcgaaggcccgccactcgtcggcgctcatgtcagccggctcgccctcgctcgcggcgaactccagcacctcggcgacggcctcgccgtaggtcatcagcccggcgtcgtcctcccaggccgccacgaaccgcgactccacctggtcgaacaggtcgtcgatggactgttgcccgttctcgcgccaggcgttgacggcgtcggagatgacgccctggatgccctgacgctcgagccaggcggtggcctcggcgtactccgcctccggcagcgcgtagagcaggtggccgttgaggtccttgacacccagctcgtagaagcggcgcaccatcgccaggaagcacgccttgtacgacgggatgtcgaggttggtggcacccagcaggaacggctggtcgcgctcgtcggcgcggctgtccagcaggttggcggcctcggcgtcggtgcgggcgacgatgatcccgggcacccgcatgatgtcgagctggaagcgcgcggcgttgagccgcttgatctgctcgtcggagggcaccaagaccttgccgccctggtggccacacttcttggtgccgggccgctggtcctcgatgtggtagccgggcaccccgacctcgacgaaacggcggatcaggttccgcacgtgcgggtctcccccgtggccggtgtcggcgtcggcgatgatgaacggccggtagtcgtactccttggtggcggcgcgctgctgttcgctcatctgcagccgcaggtactgctggttgcggtcggcggtgagcagcgcgcgcaccaacaccgcggcgtcgtcgggcacctggctcagcgggtagctggcgaggtcgggccccgggtcctcggtggtggagcccttggccgaggtggcccacccgccgaggtagatgccctcgatgcccatccgcttcatggtgaccgcctggccgggcgagtacgggccgaaggtggtgatgctcttcttctgggcgaacagctcgcgcagccgttcgtagaacgcggccgccgcgtcgcgtgccacggtgtagtcggtgcggatggtgccgcgctgctcggccacctgccgagcggtgtagaggcgcgtgatgcgggcgaagcgggggtcgtcgaagtagcgctgcgtggcggctacctcgtcgtcgaacgatggccggacttgcgtctctttgtcgatgatcgccatggtcttacgctcctctcggcacgattcccctgaccgcgagtctatccccggaaagggccgttcaatcaggagtcgcaggagttgaaccaaagctgttgccgcatccggtacttgcgcccgtcggcgcggtcgggttcggcggcgggtcggtcgttggcgtcaacccttgggacacaacacttttcgccacgcctttcggcattgaacgcgggcgccgttcaccgggtggccgcgcgggcgcgcaaccactcgcgctgacgacggacgaacgcggcgtcgacgaccctgccgtgcccgggcacgtaacgggccccgggcccgccgagcgccagcagccggtccagggtggccggccaggccgtcacatctgagtcggcgtcgatcgcggggtcggcggattcctcgaccagatcaccggtgaacaccaccgtgggttcgccgtcgcgcgccgcgggcacgaccaccaccaggtccgacgcggtatggccggcacccaggtgggtgatcgtcaccgtgcggtcccccaggtcgatccgggcgtcgcggatcccgtgctgcacgggccgcagggccgcgatggcggcatccacctcggcggcgtcggcgccatggcgcagcgcgtcgtcgcggatttgatccgtcgccgccccgagatactcgaccacctccggcgcgcagtagacctcggcgccggtgaacaacgacgaacccagcacgtggtcgaagtgcttgtgcgtcaaggcaatatggctcaccggccgtcgggcgagccggtggacgtcggcgtcgatcgcggccgcttcggtcagcgtggttccggtgtcgacgaggagggttccgctgcggccgcagatcagcccgacggtgacgtcgcagaacggcagccggcagcgatgcacactgccggtcagccgctcccacgcgaaatgcacaccagcaaggtagccgcagcagggccgcccgcgccgggtccgcaccccgcccgccgatgcgccctgcgatgtgtcggaaaaagttgacatgtcggaaatgtccgacgtatcttggtggtcgtgaccggcgtcgatcgcgtctttctcgccctggccaacccggtgcgccgcgaactgctgcagctcctcgcccgccatccgctctcggccggggaactcagcgaacggttcgagctcagccggcccgcggtcgccgagcacctcaaggtgttgcgcgaggccgccctggtggccgacgagcggcgcggccggcagcgcatctaccacctgaccgcggagccgctggccgagctcggcgagtggctgcatccattcgagaagttctggcgcacacgactgcgccggctcgccgaggtagcagaggagctggaatgacggacacgtccaggttcgcgacgatccgggtggaccaattcgtggcggcgccaccggcgaaggtgtggcggatgctgaccgaacccgagctgatgaaactgtggtgggccgaggggcaggtcgccgcggtggtgggacatcgattcacgctcgacatgccgggctacggcaagcagccgtgccaggtgctcgaggttgacccgccgcgccgcttcgtctacaccttcaccgcggcctggacattgacctggcggctggaagccgaaggcgagggaacccgagtcttcttggaacacagcggatttgaccttgatgacgcccgcatggcccgggccttcgaacagatggggccgggctggcgcgacaccgtgctcccccgtctcgcccgggtcgccgtcgactagctgccgatgccacgggtttcgggcggcaccgcaccggctatctcccgggcatggctatcaccgattcccgcgaagtcgtcatcgaagcgacaccggaggagatcctggacgtgctgttcgacctcgagtcgctgaccgagtggtcgccggcccaccagaaggtcgaggtgctcgagcgcgacgaggagaaccaccccatcaggtccaggcaggtggtcaagctcgtcggcatcagcgacgaacaggaactcgcgtacaccatttacgacgacggtgtgggctggacgctggtcagctccaaacagcaacgcgctcaacagggtcgctacaccctgacgcccgaaggcgacgccacgcgcgtgcacttcgagctcaccgtcgacctggtgatgccggtgccgggattcctcatcaagaaggggtccaagagcctgatggacaccgccaccgaaggcctgcgcaagcgggtggcggaggtcaagaagcgcgcggcctcataaccgttgctcttcgctgtggcccggcgccatcgcccggccgggaacggatgcttccgcggcgcccaccggcgcgtcagactgtgcggtatggaagcgacgctggtggacacctctcgccggatcggcacgatcatctgcgcgctggcgctgccggcgggcgcggtcggttgcggcggccacggtcatggcccgacgacgactccgtcgacacccaaggtgaccaccctgggccgcacggcgccgaacgccccggccggcgggccgttgacgatcaccagcccggcattcaccgacggcgccccgatcccgccgcggtacacctgcaagggcgagggcatcgcaccgccgctggcgtggtccgcgccaacgggtgcggccctggtggtcgacgaccccgacgccccggggggggggggggggggggccgtacgtgcactgggtggtgaccggcatcgccccgggctccggcagcacgtccgcgggccaaacgccgcccggcacaacgactttgccgaacaccgccggacaggccggctaccaggggccgtgtccgcccgccggaacgggcacccaccactaccggttcaccctctatcagctgcccaacgactatcagctgcccgccggcctggcgggggtgcaggcggcgcagacgatcggcgccgccgcgaccgcgcaggctcagctcaccgggacgttcggcggctgatcggctggcggcccttcaggtcctcagcggcgttgtactcggggtgaaggtgatgccgcgcctgccgcgacatccggcgccggcgagatagcgaccgtcgatcggaatgacaagtcctggaaccccttcgggccgggccggtcacgctgcacgggaccgggcctgtctagctccagcgatctgaatttcagatggctgatagctgaactagctattagacatatggattttgggcggccatggttagtaccgagcttgaattccgattcgccgagagaggacaggggtgagggattgtggctgtatttcgcgatttgcgcgattacatccaaacgctgaccgacaagttgggcggcgaggaggtcaaaaccatccgcggcgcgcattgggacctcgaaattggttgtctgaccgagcttttagccgaaaaagaggggccggcgccgctcttcgacaacatcgagggatacccgagcggctaccgggtcttcaccaacttcatggggactgtgccacgctgcgcggtggcgttagggttgcccccttggaccccggccatggatatcgtcaaagcttggaaggacctgagcaagagcatcgatcccgttgcgccagtgctgctttcgacgggatcggtacttgaaaacgtactggaaggcgatgacgtcgacctgaacatgtttccgacgccacgctggcacgatggtgacggcgggcgctatatcggaacggcgtgcatggtcatcaccaaagatcccgataccggttgggtcaacgtaggcacctatcgcggatgtgtgcagggcaaagacaggctgtcgttgtggatgctgggcaatcggcatgcacttgcgatcgcgcagaagtactggcaccgcggtcaagcctgccccatcgctgtggtggtgggctgcgatcccatcctgacgaccgccgccgcgatcgccgcaccctccggggtctgcgagtacgacgtggccggaggcctacgaggtagcggtgtcgaagtactggccgcgccgggtactggccttcccgttccagcgcacgccgagattgttctcgagggcgagatgcccccggtggaggaggagtcggttcccgaggggccgttcggtgaatggacggggtatttcacccatgccggcaatgaaaccgtggtccgggtgcaacgcatcttgcatcgcgattcaccgatcattttgggcgcgccgccgatgattccaaccgtccctgcgggggaccaagcggttccgctgtattccgcctcggtgacctgggatcaccttgaagcctctggggtgcaaaacatcaagggcgtgtgggcatatgcgcgccagttgatgatggtgatatcgatcgagcagaccggcaccggcgacgccatgcatgcgttgttggcggcggcgggacgaaagagaacgggcggcatggaccgctactttgtcgtcgtcgacgaagacatcgatatcaccgacatcaatcatgtgctctgggcgctgttcactcgcgtcgacccgaccgaatccatccacgtcctgcgcacaccgacaacggcgatcgatccgcgactgtcgcctgcgaaacgcgatgcgggtgacctgtcgatggggatcgtgctcatcgacgcgtgtaagcccttcgcctggaaggattcttacccgcgagctaaccggttcgacgacaactatcgggccgcgattcgcgatcgctggcaggccgcgttgccgttgtagacacgatgacgacacagacggccttgatcagaccagtcaggaggtgacgatgatggcggggatgccggaggaggtcgctgcgcttctgcgcggtttcccacgcatcggcgcgcgcgagcaggcgtttgcgttcttgaccgttgacactggcgggtttccacatgcggcgttgctgtcgcgctgcgagctcgagcctgggcgggacccccaaacactgatggccgccatagctagccgacagacccgcgccaacttgcggcgtagcggcaccgcggggctgctcgcaatcaatggcactagttgccaccacctcaagctgcgagtggtcgcctcgctcgtcggtcgcggaatactcggatgtgtgtttgccgtgaccgaacataagcgcgatgacatgggaatacccttgcagcctacgctatttcggacctcggccgagatctcggtgcttgaggactggccgcgtagtcgggccatgttcgaccgtctcgcagcgctgcgcagcgcagcgcgggaggtcctatgagcacgcaaccgatacgaatcatcgtaggggtcaccggcgccagcggcgcgccgtttgccgtgcggttaatgcagacgctgcacgggatggacgacgtggagacccacttggtgatgagcgggtgggctcggtcgagtattggaatcgaaacaccctatagcgttcaacaggtttcagcgatggcggatgtcacctacaaactcgaagaacagggcgccgcgatctcatcgggttcgtttcagaccgccggaatgattgtagtgccgtgcagtatgcggacgttggcagcgattcgctacgggctggcggacaacctggtgtgccgtgccgctgacgttgttcttaaggagggacgacggttagtcctagtgccccgtgagacaccattgaatacaatccatttggagaacatgctggcactcagccggatgggcgcgcggattgtgccgccgatgcccgccttttacaaccggccggaatcggtcgacgacattgttgaccacgtggtggtccgtgttctcgatcagttcggtatcaatgccccgcaggcaaagcgctggcagggaatgaagtcggcgaggaccaccggcttcggcaagaactcagcgatcctggcgtagctcggccggtcgccgaagtttagttgtcgccgtggtggcgtgttcaacgaaggcacgagccgctgggctggcggcttgcccttctggccagatgatgcctaggcgcccgggcggatgatcgctgactggcaatcctattacgtgatcgctttgcgcgagggctgattgaggaacgagacccacgcccagccccttcgcaacgagcgcaacgagtacgtcgggatcgccggcttcgaaggcgatgtgggcttgaacgccggcccgccgcagcgcgcggttgagttgccagcgcaagcctgatccctccgggagcgtgatgagcggtctatccgccacgtcggccaatgtgagcttccggcaaggagataacggatcggacggtagaaagatcgcgatcaccggctcccgatgcaactcgcgcatccgcacgccggctactgcctcatccgtcaggctggtgaaagctacgtctaaagcgccattggatatgtggcgattgagcatcgctgcagtgtcctcaaccagcgacaggtctacccccgggtgctcatggtgaaacgctgctagaagctcggggaggtcgatgctgcgcggtgagatcgaggtgatggtgccgatggcaaggcgaccatgtagtagaccggtgagtccgtcgatcgaggcgcgacctgcggccagcgcatcgagtgctgcgcgggcgtatggcagaagcgcgtttccagccgcggtaagccgtaccgtgcgtggccgccgttcgaatagctgctgcccgatttcgcgttcgagcgccttaatgtgtgcactaacaccagattgcgccagatgtatccgctgtgccgcggcggtgaaggtgccttcctcggcgaccgcgataaagcactccagctgatgaagatccatgctgaccgaaaatctattacagagcatcgtctcgtcgcgcagggcatctagtaagccgactagccgcaatcgcgggcgcgctccactgcggtcgctccgcgtcgaaatcggtgatcggtaccaccaagggtcacctttgcgaggcgcaaaacgtcgggatggatgagacggcctacgtaccgtctcgacagaaaacgcatcagagaaagtaaattgccatgagcgtacagatagtccgattccgcatctcaccggaacacatcgcaccggtaacgaagaagatcgaagcgatctttagcgcattgcgcgaggcggatccccctccttccatgcggtatgtcgcgctgcgcgatgacgtcgacccggtattcacgctgatcctcgaactgcccgagggtgctgccaacccgttgttgtcgattcccgacgcgttggccttccgcgagtcgctagcgggatgggcgcatgacgatgttgctcctcggcccaccaccgttgtcgggagatactgcgcatgaccaaggtgctgttcgcagccacggtgttatgcatcgtggctaacacattgatcgcgattgccgactacgttcccgcaggcttcgtgctgaagaactctgctgaagttcatgttcctgccgccgcattgccctaccttgcgacattgaagttagcgggcgcggtgggtctcaccctggggctagtcgccctgccgcggctaggcgtggcagcgggaatcggcctggtgttgttcttctttggcgcggttggtgcgcatgtcagggcccgcgtgttccacaacatcgcgtttccaggcgcatttctgcttctcgcactcgccgcgaacggctacctcgtccatcttgcgagcggcgcatgaaacgcgttggacactgagggtgggggaacctgctggttcccccactgacctcggaaacggcgggcagtcgctcgctcttactctgaggtccacgggcgcgtagaaactcttcagtgagaatccggttgtaccgttccccttttccgttatgacgcggaatgtagggcttgactttctggtggcgctcgaacgcgatgcgcactactaaccattttcgcgtgcgccacaatagttcgatacgggcgaagcgccaatggcgacgcgcgcgggcgcagtctcaggagggcttcggcgtttctccccgcgcttggagattcggttcgagtgagctagatagcttggtgcatagtcgatttcgtgccgtctggacctaaccttccgccaacgtgacgtcctacaacccccacttcggagggccgattgtctaacctacatactagtatgtatgctgatctcgacaccgcgataggggtagggatgactgttgacgacgaaatgacccaggccaaccgcagcgctggtcctccgggcgaagccggcgcgggttctgcctcgatgccacagcgactcggactggccggcctgtgcctgggcaccgctctgatcatcatggaagccaacgtgctcaacgtggccattccctcgatccgacaggccttgcacgccagcccagcgcagagcttgtggatcatcgacgcctacaccctcgtgctggccgcattactactgtcggccggtcgtttaggcgaccgcatcggcgcacggcgttgctatctattgggtctggcagtgttcagcatcgcctcagtgctgtgcgccctcgccgcatcgtcggccgagctgattgccgcacgcaccattcagggagtcggtgccgccgtgctgatcccggcccctctcgggctgatctcggcaatgtttagcgatctcaccgcgcgcgcgaaggcggtcgctgtgtgggtcacaatcggtggggtcggttttgcggcgggacccttgatcggcggtctgctggtcagcacgttcggttggcgctcgatcttccttatcaacattcccgccgcggcgatcattgcggtcatggtgcgcctcacagtcgctgaagcctctcggtcccccttgccgtttgactatgtcgggcaggccctggcaattgtcggtctgtcggcagtcgtcttcgcctgcgtggaatcgagtgccctggcgtggatgtcgccattcgtgttattgcctgctgtggcggccgcgctgatcctcgggctgtttgtgatcgatcaacgccatcgaggccgtgccggcgcctgggtgctactgccggtcgagctgttgaataaccggccggtgaacgccggactgatgtcaggatttgtttacaacttcaccctgtacggtctggtcctcgtctatagctatgtcttccaatccgcccgcggctacagccccgtgcagaccggtctggccttcgcgccgttgactgtggcagcgctggttacctcgctgcccgcgggacgctttgtcgccgcgcacggtgcgcgaagaggcatcatgatcggaatggcgctgtctgccatcggattatgcgcactggcattcgatgcccagcggatgccgttcgtggtcctatcgatcgcctttggcatcttcgcgaccggtctctcgctttcggcgaccggacaaaccatggcggtgatggccaacgccagcgaccagtacaaaaacacggcgtccagcatgctcaacaccgcgcgccagaccggcggtgtcatcggcgtggcggcgctgggtgcgatcacgtcgcgcgacctgctggccagcgcgccggtggcgttgaccatcgctgccgcagcatgtctggtcgccgctctgggagttgcaacgttgattgcgcgtcacgcccgcacacatgattcggaccaacactgataccggcatacataccgctaggtatgcttgccttatggcggacgaacaggccgattcacgcgagcgattgattagtggaacccgagaactgctgtgggatcgcggctacgttggcaccagtcccaccgcgatcctgcagcagtccggtgttggccaaggcagcctctatcaccattttcgtggcaagcacgacctggtgctggccgcggagcagcaggccgcagccgatatgcagcgcagcatcaaagaggcgtttgcgggcaacagatccgcccacgacaaaatcgccgactaccttactcgtcaacgagaagtgctgcgcggctgcagcgtcggtcgcctgacagcagatccggtgattgtcggcgacgatcaactgcgtgcccctgtcgcacagacctttgaggtactgcatacctgtctgacacgaacgatccgagaagggcagcggtcgggtgagatctcggtcgagcttgagccgcacaaagtcgcggcagcgatttctgcaaccatccagggcggttacgccctggctagggcagccaactcggtcgaacccttcaatcgcgcgattaccggcatcctgcaactgatagaagcctccaccgcccaccgtcgacgcacaaacccagcggctcacgatgccgtgccagcccaacgacgccgaacgtcccggtcaaaaaacccaagcaatcacaaaccagcccgataagcgaaccggcggcacggccacgaggacgagctgtcggcgcggctgcccgaatcggttgcggcctaccagaatgccgttgccgcaggggatttcgacaccgcagcgatcctcatcggcgaagcggtgggggtcatccgagaggttcgtcccgccgcggggatcgtcgccgagatggtcggtgcagtacagcgcatcctgcaccgcgacggcgcgccctagacagcaccttccacgagacctaccacgcctacaacccggcgctgcggttcctgctcgagcgccccgtgcacgcgatgatctcccgcgacaacctcgaaacctatcagcgtgcgctcggccatgcggggcgcgtgcggcgcctcgattaggcgcctcgattagccggccccattaggcgcgtcgactcggcggccgccggccggcgggcgatttcacagggacatgaattagctcgtcggccccggtaccctcgacttctatgcgtgcagtagccatcgcggcgaggacggccgccgcgggtctgatggcggccggctgggccgcgtcgacggtcgttgccggcgccgacccggacgagacgcacggaccggcacccggccccgccgcgacaccgtcaccagcgccttcgacctccccgtcccccgccgcctccccgtcaccgagtgcctcccccgcacccgcgccggcggcaccgaagaccaccatcgacaaggacggcatctacgcggtgggaaccgacatcgcgccgggcgtctacagttccggcggacccgtcggcaacggcacctgctactggaagcggatgggcaacccggacggcgccgtgatcgacaacgcgatgaccaaaaagccgcaggtcgtccagatcgatccgggcgacaaatcgttcaagacgtcgggttgtcagccctggcagctgaccccggacgcggttccgccgcccagcgccccgcccgccggggtgcagggcacgctcggcattctcaacggcctgctggggggagccggacagcaggccccgtcggccccatcggcgcccgccgctcccccgtccggcgcgcagccgcccgcggccgcaccggccccgcaagccgctcatccctgaccggcccgtcgcgacccggtgagccccgcaatggcccgtaaccagcagatcgtcgtgatcggggccggcgtgagcggactgacgtcggccatctgtctggccgaggcgggatggccggcccgcgtgtgggcggacacgatgccggcggacacgacctcggcggtggccggcgccgtctgggcaccgccgcggcccgccgaacgcgcggccgagacgctgcgctggaccgagcactcgttgcgggtgttcaccgaactcgcccgcgaccccgattcgggtgtgcagctggcgccggcgctggccgtcggcgagctgaccgcctccgaggcgatgtcgacggcggcctcgctgatccccgagctgcgcccggccgacccggccgacctcccgccgggctatcgaaccggatttcacgccaccgtgccgatgatcgacatgccgcactatctcggctatctgacccggcggctgacggcggccggatgcgagatcgaggagcaccgggttggctcgctggacgaggtcgccgaccacgccgacatcgtcgtcaactgcgcgggcctgcgcgcgggcgcgctcaccggagacgacaccgtccggccgctgttcggtcagcacgtcgtgctcaccaatcccggtgtgcgccaactgtttatggaactcaacgacggccccgagtggacctgctactttccgcacccgcagcgggtggtgtgcggcggcatcagcattgccggccgctgggacaccaccgcagaccccgccgtgaccgaacggattctgcagcgctgccgccgaatcgagccacgactgggcgaagccgaggtgatcgaggtgatcaccgggctgcggccggaccgtccgtcggtgcgcctgcaggccgaaccgctccgacgggcacgctgcatccacaattacgggcacagcagcaacggcgtcaccctgtcctggggttgcgcgcgtgacgtgctggccctggtggacgacgctcgctgacctcagccggcggtgcgtcgaatcacaagggacagtagccaactcactatcgacaacacgatggcggcccagatcgcggtccaccagaagtggtcgatctgcaggccccagtgggtggtgtgctcggtgatccacgcggtgatccagagcatcagggcgttgatcacgatatggatcagacccagcgtcaggatgtagagcgggatggacaggatctggacgatcggcttgatgaacgcgttgaccagaccgaagatcaccgcgacgacgaaaatgatgccgacccgctgcagcttcgtgtcaccgcccacgaacgtcaggccgtgcacgaacagggtgacgatccacagcgcgaatccggtcaacgccgcgcgcagcacaaaagggcccatgccgccatcctgtcatccgtcgcccgcgtgggcaccccgatcaggtcagttcaggttgtagaagcgttgcgcgttcaagccgccgatcttctcccgggcttcctcgctgatatcggcgcgggtgcgcagatgcttggtgctctccggccattcgccgtcccagtgcgggtagtcgctggcgaacatgatgaaatcggcgcccagcacgtcgatcaccccgggcaggatcggttcctccggctcgcacgtcacaaagatgttgcccgccttgaggtattcgtgcggatcgcggcgccagccgcgctcgacccagtcgccgcgcttctcgtagtgctcgtgcaggcgatcgatgaagaacggcacccagcccgcgcccgcctccaagaaggcgacccgcaacttcgggtgccgctcgaagacaccgccggacaccatcgcggtcatcgcggtcatctggtcgaacgggaagctgatgcagtgcacctgaatgtaattagtgaagcggtccacgccgatcttgggcagatggatgccgggcgcgccgtgcacgcccagcggcatctcgagttcgacggcggcggcgtagaacgggtcgagatcggggtggtcgaggttgcggctctgcagcgccggcggcaccaacgttgccaccagcccaaggtctttggcttccctcatgacgtcgatcgccagttggccgtgttcgatcggcgtgaccgcgacgccgcgcagccgtccgcccgactgggcgcagtagtcggcgacccaccggttgtacagccgggcgaacccggcggcgaactcggggtcgcgcaggctcggtgcgcacaagcccaggctgggatagagcaccatggtgtcgatgtgatcgcggtcggcgtcgcccagcacgccttcggcggaccggcagttgatgtcgggggcgtcgctgatgccgtgctcgggcggacacccggcgcccgggccgcggtcctcggggtagttgcggccctcgatcatcaggccgagccgcccgtgccggccgggcttgacgtgctccggccaccgctggatcgcctcgatcgccagcgaggaattctcggcgacgtgaccgtcggcgtcgatgatccgcatgtctggcgaacttactcccgcgccgcgcccggcggaacgggtcgcgccgacgggccgggtaggccacgatgctgacgtgaccaaaccaagtcccggccggaagttgaccgccgaccagcgtaattccttcatcgccgcgttgttgggctggacgatggacgccttcgactacttcatcgtcgtgctcgtctacgccgacatcgcaaagacgttccaccacagcaaggccgaggtcgccttcgtcaccacggccacgctgatcatgcggccggtcggtgccctgttgttcgggctgtgggcggaccgggtaggacggcggctgccgttgatggtcgacgtgatgttctactccgtcgtcgggttcctgtgcgcgttcgcgcccaacttcaccgtgctggtgattctgcggctgctgtacggcatcggcatgggcggcgagtgggggctgggcgccgcgctggccatggagaaagtgccggtcgagcggcgcgggttcttctccggactgctgcaggagggctacgcgttcggttacctgttggccagcgtcgcctcgctggtggtgatggactggctggagttgtcgtggcgctggctgttcggtctgagcatcgtgcccgcgctgatcagcctgatcatccgctaccgggtggaagagtccgaggtgtgggaggccgcgcaggatcagctgcggctcaccagcacccggatccgcgacgtgctgcgcaacggcgcgatcatccgccgattcgtctacctggtcctgctgatgacggccttcaactggatgagccacgggacgcaggacgtctacccgacgttcctgggggcgcacgccaatcacggcgccggtctgtccagcacgacggtcaagtggatcgtggtggtgtacaacgtcggcgccatcatcggcggactcgtcttcggcacgctgtcccagcgcttcagccgccgctacaccgtggtgttctgcgccatgttggcgctgccgatcgtgccgctcttcgcctactcgcgcaccgcggcgatgctgggtctgggatcgtttttgatgcagttgttcgtgcagggcgcctggggcgtgattcccgcccacctcaccgagatgtcgcccgatgcgatccgcggcctctaccccggcgtgacctatcaactcggaaacctgttggcggcgttcaatttaccgattcaggagcgcctcgccgagacccatggctacccgttcgcgttggcggcgacgatcgtgccggtgttgctcaccgtcgcggtgctgacgctgatcggcaaggacgccaccggcatacgcttcgcgaccagcgaaagcgctttcctgccgaccgaaatgacgtgacggcgcaccaaccggccccgagcgtcacgccagcgtgacgccgggccgccgcggccacactggcgtgacgctcggcctcaggcgtcggtcagcaggcgccgcagcaggtgcatcgccaccgtcgtcgagcgctcgcggatgtccgaccggttgcccggaagccgcatggtgcgggtgtccgagcgggccgtggcaccgggtgggccgacctgcacgctgaagcacaccgttcccaccggcttctcctcggtacccccgccggggccggcgatgcccgtgatcgccacggcggtgtcggcggcaaagcgttgccgcgcgcccgcggccatcgcctgagcaaccggttcggacacggcgccgtgcgcctcgatcaacgccgggtcgacgccgagtaactcggccttcgcctcgttcgagtaggcgaccacaccgccggccacgtagtccgacgatccgggccggtcggtcagtcgcgccgccagcaaccccgcggtgcacgactccgccgtcgcgatccggcggccggccagcagccgcgccaccagatcgtcgacccgggaaccgtcctcggagtacagctggtcaccgtgcttgtcacgcagcagcttggtcagctgcgcgtaggccgtcgcggcggtcggctcgtagcgggtgaccatttcgatctcgccacgccgcaggcaggtggtgatctcgagttgcccgaaccccgggacggccgcctcggcctcgcgcagcgtttcggccagcccggactccggcagcccgaacatgcgcagcatctcctgccgatacaccgtccggccggcgatcgcctgctgcgccgccggggtctggatggccgtgtgccacatcggttgcagctcccggggcggccccgggagcacgatcaccgccggcttgccgggcaccacgacgccgggtgcggtgccgaccgggtcgagcacctgcgctccggccggaaccatcgcctgcttgcggttggcggcccgcaacgactcgaatgtgccggggtccagggcggattggatcgcggggttgcgcgccatgagcttcttgaggatgttcgcgatcttctcttcgacctcggcgtccagcaccagctcgcggccgcagaaacgcgccaccacttcgaccgtcatatcgtcggccgtgggccccagtccgccgctggtgacgatcagatccacgccttggtcggccaggaagcgcagctgggcttcgatgtcgtgcgggcggtcgccgcagatggtgatgtgcgccagctcgacgccgagctccaaaagccgatcggcgatccaggggccgttggcgtcctggacacggccggtgaggacctcggttccggtgacaacgatgcctgcgcgtgcgctcaccggcacgagcctactgatgggtctgccgacgcggccgagcaggcgtttcgcgcggcggtgtcaggctagccgtcggacaggtagcgctcgaccgaggcgaccttgtgcgtcatcgcgtcgctgaccccggcgcgccagtcggccttgatcaccgtgctgacccgcggcgcccgggcggccaccgcctccaccgcgcgctgcacgaccgccatcacctcttcccacgtctcgccttcgatcacggtgaacatggagtcggtcttgttgggcagaccggaatcgcgaaccacccgaaccgcttcggcgacgatctcgccgacaccctcacccacgcccagcggggtgacggagaacgcgacgagcacggacacccgaccgagcgtacccaacgacgggaggtctgggtcgccaaaggtctgagggtggtggcccggtctggcaccatcgaaatccatgcgggtgttggtgcaacgggtctcgtcggcggcagtgacggtcgagggcgcggtggtcggcgccctccggcccgattcccagggtttgttggcgctcgtcggcgtcacgcattccgacgaccgcgacaaggcgcgaaggctcgccgaaaagctctggaagctgcggattctcgccgatgagcgatccgcgtccgacgtcggggcgccgattctggtggtcagtcagttcaccctgtacgccgacaccgccaagggccgccgcccgtcctggaatgcggccgcgcccgcggcgatcgcggagccgctggtgaccgagttcgcggcggccctgcagggactgggcgccgacgtgcagaccggggtgttcggggcgaacatgcaggtcgagctggtgaacgacggtccggtcaccgtgcttctcgagctgtgagcgccccggccgcggggtaggtttgactgctatgaccacaccgcagttcggctcccaacgttccgacgatgacaactgggacatcgtcagcagcgtcggatacaccgcgctgctcgtggcgggatggcgcgccctgcacgcggtgagcccgcggccgttggtgcgcgacgactacgcgaagaccttcatcgccgcgtcaggggatccgtatttgactggggtgcttgccaatccggggacgtcggaggacgagcttgccttcccgcgcctgtacggcgcgcagacccggttcttcgacgacttcttcgacgccgcgggcgcggcgggcatacgacaggcggtcatcatcgccgccggactggattcacgggcctaccgtctcgaatggccaccagcaacaacggttttcgaagtcgacttagccaaggtcctcgagttcaaggcgcgggtgctcggcgagcagggtgccgtgccgaaggcgcgcagggtcgaggtcgccgccgacctgcgcgccgactggtcgcggccgctggaagcggccgggttcgacgtggagagcccgagcgcctggtcggtggaggggctgctgccctacctgaccgacgaagcccaacacgcgctgttcacccgaatcagcgggctcagcgcgccgggcagccgaatcgccatcggcgcgctggggtcgcgcctggaccacgaccagttgcacgccctggaggaaagtcaccccggggtcgacgtgtccgggaatgtcgatttctcggcgttgacgtacgaaccgcagtccgaccccgcggaatggctggccgcgcacggctgggtggtcgaccccgtccgcaacacgcttgatctgcaagccggttacggcatgacgccgccggaggtggacgtcaagatcgacggcttcatgcggtcgcagtacatcaccgcggcccggtgaacaccgctacggtttcagcaggatcttgacgtcgtcgcccgaccgcgaccccgcggtcgcatacccgatggccgcctcgtccaaaggcattgtcgtggtgaagattccgtcgacgtccagccggcctgactgcaacagcggaatcagttccggccaggtgcgctgcaccggcgccgtggtcatccgcagggtgatgctgcgaatcaggcagcccagcgcgttgagcgggaacgggttcatgtcgtgcacgccgaccaccgagaccgtgccgcccggccgcaccgcgttgagcgcctcggtcagggaggcgtccgtggcgacggcgtcgatcaccgcgtcggcgccgcggccgccggtggccgcgaggatcgcctcgagcgccggcgccttgacgggcgtcgccccccaccgggcggcacgcgccagccggccgtcaacctgatcgaccgcgaaaaccgttgccgcgccctggaacagcgcgctgcgcagcgcgcacaagccaaccgcgcccagcccgatgaccgccaccgtgccaccgaagggaatgtcggcccgctgcgcggcggcccagccggtggccagattgtcggtgagcagcagcgcctgctcggtgctgatgccctcggggatcttcagcagctggaagtcggccgcgggcaccgccagcagatcggcctgcgcgccgcccagcacaccacccccgaagatctggaaaccggagtggcacagcaccggatcccgggtggcgcagccagcgcagctgccgcagccggcgaccgaggacaccatgacctgatcgccgaccttgacgttgcgcacctgcggcccggcctccaccacggtgccgatcgcctcgtggcccagcgcaatcgggtccggcatcgggaagtcggcctcgtagaagtgcaggtcggatccgcagataccggccgcgctcacctcgacgatcgccccgtcgggcccgggaagcacgggatcggggcgggtgtccacccggatgctgcggggcccgtcgacgactacggtgcgcatagtgtcgcgctcactttccttatcgctttccctatctatttccttgtggcacagcatcgttcgtccgcaccatgaactgcgaccaatcgggctcgcgcaccgcggaccagtactcgttgagacgccatgggctcaccgtgtgaatctcgccgtcggcgttcttgaaataggagtgcttgaccgccgggtgcgaccacaccatcttcttgatctgggcctggggtgcgccggtgccaatcgatggcggcgtcgggtttcggttcgatggaatgcacaccgggctcgcacagccgcgccaggcattggtcgatgtagcgcatctgcagctcggactggaagatcaggctgccgccgtgggcgaggtgagttcccgggccgtagatgatgaagaagttcgggaattccggcacggtgatgcccaggtaggcatacggccggctcccccacatttggtgcaggtcgaccccgttgcggccggtcaccttcaggggccacagcacatcggtgtgccggaatccggtggcgtacacgatgacatcggcgtcgtacgccgcgccgtcgacggtgacgatgccgtgcggcgtgatcttgtcgatgggcgtgcgcaccagttcgacgttgtcgcgctgcagggtgcgcagccaactgccgttgtcctgcagggtccttttaccgcaggcgggatagtcgggcatcaccttggccagcaactccgaatcctcgccgacctggctggtgatccattgcgagaacatcaggtgggcggcggcgttgacgtcgctgacggcgtgctcctggtcggcgtagttcgggtcggcctcggcagcgtccaggcccttgtcggagccgggccacaacaccaggaagcgataccaccggccgtagaacggcagatggcgcatcgcccagcgcactccgtcgccgacctcgtcgtgatacatcgggttggggaacatccactgcgcggtccgctggaacacggtgagccgcttgacgtccgcggcgatcgccggtgcgatctgaaatccgctggcgccggcgccgacgagagcaacccgcttgcccttcagctccaccgagtgatcccaggccgccgaatggaacgacgggccccggaaggtctgcgcgccgtcgaaggccgggatgttgggccggttcagctgtcccaccgcggtgatgagcgcccgcgcccgcattgtttcggtgtggccgtcggccgagcgcagcgacaccgtccaggtgccgtcgccgtcgtcccattcggccgcgagcacctcgctctgccagcgcacctggccggccaggtcgtgttggtcgatgaccttggtgaagtagtcctgcagctcgtattgctcggcgaagaaatgggtccagtcgttgttgggttcgaagctgtagcaatagaaatggttggccacgtccacccgggcgccgggatagctgttctcccaccatgttccgcccgggccggcgttcttctcgacgatggtgaacggaatgttggcctgcttgaggcggacgccggccaggatgccggattcgccgcagccgacgacgagcaccgggagcccggccgcgcgttcggccggcaaggcggcggggcggcgcgggtcgacgccgtcgaggtccagctcttcgcagatcagcggtaggtagtcgtcgggcacgtgttcgcaggcggcccagtccatcatttcccggatgagctcggggctgagcggctcgggttcggggcaaccgcggtcgcggtagtcggtgatgaccgagagcgcctcggcgcgggcccgggccttgtcctcctcggacatgaacccctggacctcgttgaggaagatgcccatctgcttgaagtcgcggatgaagcgtgggtcgccggtgatgtggacgagcgagagcaacagcgtcgggatgctgacatcctcgagggcggcggcgatctcggccgtggaggtggtgaacggttcgccggcgtagcggctgcgcatcaagccgatgtcctctcgatggtcggataggtaatggtcggataggtgatggtcccgtagccccaattacgctacgcatagtttcgtaattgcagcactacgctacccggtcgctcggcgccggatcaagggatcggcggttgcgggtcgtcgggggcgtcggacgtgttgtcgccggtgtcgttatcgctgtccgcgaccagcttctcggggtgatggaaggcattggtccgcggccggccgtggtcgagatgcggtggtgggatccattcggtctcgcctcggccgttcttgcgggtgatccagccttgctcggccagcgggtgatggccgccgcaggcgaaggtcagttggtcgatgtcggtgcggccgcatttggcgtaaccggtgacatgatggacttcgcaggaatagcccgaaacgtcgcagcccgggtgtgaacagccacggtccttggcgtacaagacaattcgctgccccggcgaggccaggcgttttgtgtggtacagcgccagcggtttgccgttgtcgaagacggcgaggtaatggtgggcgtggcgggccaggcggatcacatcggacatcggcagcagggtgccgccgcccgtcagccccttaccggccgcggactcgaggtcccgcagggtggtggtgacgatgatcgatgctggtaacccgttgtgctgccccagctttccgccggccagcagcgcacgaagggcggcgttgaggccgtcgtggttgcgctgggccgcgctgcggctgtcgcgctggattgcctcctggccgggctgcccgtcgacgacgggtgctggatcgtcggggttgcacatgcccgccgcggccagtttggccagcacggcctcgatggtcgcccgggcctcgggcgtcaaccagccgcgcagttgcgacatgccgtcgggttgttgggcgcccagggtcagtccgcggtgacgcaaccgatcctcgtcgtggaacacgccgtcgggattgaggtagcaggcgatccggtcggccaccttgcgcaggctttcggggcggtgctcgccggcccagcgggccaggtcggcctcggcggcgtcccgggtgggagcgtccacccagcatggcaactggtcgaagaagcggcggatgaccgcgacgtgcgaggcgccgatgcgcccgtcccgctgggcggcggcggtggccgcataccgtggcggcaacggctcgccggtcagggtgcgccggacgccgagatctcgggcgtcgtcgatgcggcgggcggcctcggcgcgggtgatgagcaatcggtcggccagcaggtgggcgagtttgccgccgatctcggccggcgtggcgtcctgctcgatctggttgatcagttggtgaccgggaacttgaagtcggcgcgtctggtgttcgaggacctcgagcagccggatgcgttccgagttggtcagcgcatcgtaggaatgccgctggatgcgtgcgaccacggcgcgcaggacgtcatagtcgtcctggatgtcctcgcggccgatgatcgaacgcatgtgcgaatggtagctcgaccggccgacaagccagccgatggcgacgggccgtagtgccaaaacgcaggtcaggacccgctggccacgtcagtgcgctccgtactaaactagaacacgtttcaattccgccaccgcccagggagtaggcatgcacaccgctatctgcgatgagcttggtatcgagtttccgatcttcgcgttcacccactgccgcgacgtcgtggtggcggtgagcaaggccggcgggttcggcgtgctcggcgccgtcggtttcacccccgagcagctggagatcgagctgaagtggatcgacgagaacatcggcgaccacccgtacggggtcgacatcgtgatcccgaacaaatacgagggcatggactcccacctgtccgccgaagagttggccgagacgctgcgcaagatggtgccccaggagcacctggacttcgggaagaagatcctggccgaccacggcgtgccgatcgaggacagcgacagcgacagcctgcagctgctcggctggacggaggcgacggccacgccccaggtggaggtggcgctcaagcaccccaaggtcaagatgatcgccaacgcgctcggtaccccgccggccgacatgatcaagcacatccacgatgccgggctcaaggtggcggcgctgtgcggctccccctcgcaggcgcgcaagcacgccgacgccggcgtggacatcatcatcgcgcagggcggcgaggccggcgggcactgcggcgaggtgggctcgatcgtgctgtggccgcaggtggtcaaggaggtcgccccgctgccggtgctggctgccggcggcatcggcagcggccagcagatcgccgcggccctggcattgggcgcgcagggcgcgtggaccggctcgcagtggctgatggtcgaggagtcctcgaacaccccggtccagcaggcggcctacgccaaggcgggcagccgcgacaccgtgcgcagccgttcgtttacgggcaagccggcccgcatgctgcgcaacgactggaccgaggcctgggaggcgccgggcaaccccaagccgctcgggatgccgttgcagtacatggtttccggcatggcggtgcgggccaccaacaagtacccgaacgaatcggtcgacgtggcgttcaacccggtcggtcaggtggtcgggcagttcaccaaggtggagaagacggcgaccgtcatcgagcgctgggtgcaagagtacctggaagcgaccaaccggctggacgagctgaacgaggccgcgtccgtctgaccgacgggctagacctcgtcgacgtcgtcgacgtcgtgccggccggtgaagacttccttcgtccggtccaccgcgtaggtgccgatgtcgatggagttctgcacgatgccgctggcgccgccggcgatgtcgccgcggatgatgtcgctggcgtgctcgacgatgtcggaggctttctccaccgcgttggtcgcgatgtcccgcgccgcgtcgaccgcatccttggggttgaaggccatctcgagtctccttttgtcacaggacttatcgcagggccgttgccctgaccctagacggaactctagacgggtcggggggtcatttctcgccggcgccggagggcccgtcggtaaaggcaacgggccgacagtgggcctagtagtgcaccagggagcgccagtagtcctcggggatttcggccccggagcgcattatccgggccagcccgacggccatcgcgatgcccagcagtcccagccacagcccggccagggcgatgacaccccacagcacggcggtgacgacgggccagggcgagagcaccgccagcaccggcgcgaagaagaacccggtgccgatgtaccaggccgacccggcgcgatccgaggccagcacgaaccgcagccagcgaggcaccagcggtttgccggactcggcggtccgactgcgctcacggggggccgggctcatggcggcgccgatcatccgctgggcgggaagaaccctgccccggtgaaccatccttcttgccacccgcgatcgcccaggcacagcatgggcagcccggcctccgattgcgcggcggcctgcggaccggggcacttggcgccggcctgctggacgccgtacagcgggtaggacatgacccagtatccggtggtggccgccgggaactggttgggcggcgggaagtggcacgcctcggcctgcccgctgggccctcgaccgaagatgaaccgctcgtagttgtcgcacggcgcgcccaaagacgcctgataattcatgcccggcacgtcgccgtcgtatccggctgccgcaaccggcgccacgccgaccgcgatgcccgctaccgaagccgcagtgagcagttcccgaatcatcttccaccccgcctgtgctcgccggtgacctgcaccaaagcatatccgccgaaccccgcgccacaagggccgatcggccggatccgcccgggacagagaacacgttccaattcgcgcccggcgatcttgcgccaatgcttcccaacggtggcgtggcagtggtttccttgcacaaagacgactagaccacttcgtcctcgaggagcgggcccatggcaaccgtcgagccaaccaccaagccggtccccaatctgccgcctggattcgacttcaccgaccccgacatctacgccgagcggctgccggtggaagaactggccgaaatgcgtcgcgtcgcgccgatctggtggaacgagcagccgatcggcgcgggcgggttcgacgacggcggcttctgggtggtgaccaagcacaaggatgtcaaggaggtctcgctgcgcagcgacgtcttctccagcctgcagaagaccgccctgccccgctacaaggacggcaccgtcgccgagcaggtcgaacggggcaagttcgtgctgctgaacatggatgcgccgcaacacacccggctgcgcaagatcatctcccgggccttcacgccgcgggcggtcgagcgcctgcgcgacgacctgcgcgagcgcgcccgccgcatcgtcgaggccgcggccgccgagggttccggcgacttcgtcgaacaggtgtcctgcgagctgccgctgcaggccatcgcgggtctgatgggtgtgccgcaggaggaccgcaagaaactgttccactggtccaacgagatggtcggtgaccaggaccccgagttcgcgagcaacgacgccatcaccgcttccgtcgagctgatcatgtacggcatgcagatggccgccgaccgggccaagaacccgggcgaggacctggtcaccaagctggttcaggccgacatcgacggccacaagctctccgacgacgagttcgggttcttcgtcatcctgctggccgtggccggcaacgagaccacccgcaattccatcacccaaggcatgatggccttcaccgacttccccgaccagtgggagcttttcaaaagggagcggcccgccaccgcggccgacgagatcgtgcggtgggccacgccggtgacgtcgttccagcggacggcgctgcaagactacgaactgtccggggtgaagatcagaaaaggtcagcgcgtcgtaatgttctaccgctcagccaatttcgacgaggacgtgttcgacgacccgttcaccttcaacatcctgcgtgaccccaacccgcacgtcgggttcggcggcaccggcgcacactactgcatcggggccaacctggcgcgaatgacgatcgatctgatgttcaacgcgatcgccgacgccatgcccgatctcgaatcgatcggcaaacccgaacgcctccggtcgggctggctcaatggaatcaagcactggcaggtcgactatcacaccaacgggtcgtcgaaatgccctgtcgcgcattaggctaaggccatctaggctggaccgatgccaacacatcaagccgtccagattcaatccgccggcgcagcgttggaactggtcgacaccgaaacccggccgccgggccgggacgaggtacggctgacggtcggcgcctgcggcatctgcggcaccgacgctcacttcgtcaacggtgcattccccggcctgtcgtggccgttgacgccggggcatgaaatcgccggccggatcgccgagctgggcgagggtgtcgaagggttcgcggtcggccagcgggtcgcggtcggctggttcggcgggtgctgctaccggtgcgacccttgccgcgcaggccttttcatccactgcgtaaacgggaaggtacccagctggcactatcccggcggatacgcggaatcggtgacggtcccgaccagcgcgctggcccgcatccccgaggaactcaccgacgccgaagccgccccgatgggctgcgccggggtcaccacctacaacgctctgcggcacaccaaggcgctgcccggcgatcgggtggcgatcctgggggtcggcggcctgggtcatctcggcgtgcaattcgccgccgcaatgggtttcgagaccatcgcgatcaaccgcggtaccggtaaagccgatgacgcccggaaactgggcgcccatcactacatcgactccacggccgaagaccccgccgaagcgctgcgggcgttgggcggcgcggcggtggtgctggccaccgccggcaattcgcaggccatggccgccacggtcggcggtcttgcgccgcagggcgagctggtcaccatcggcgtcacgcccgagccgctgccgatcagtcccctgcagctgataacgccgggcctcagcatcgtcggtcatccctccggcaccgccaaggacgtcgaggacaccatgcagttcgcggtcctgtccggggtgcgcgcctggatcgaggagctgccgttgtcccgggcggccgacggctacgccgccctggaaggcgggcgagcgcattaccgcaccgttttgaccatgtgactttgacgtgtgactttgacgtgtgactttgacacagtcgatccgtggcatccgacaacgcgtcgaccatcggccctgccgacggtgaactgctgctgcacaccggtgtcaccggtcgggcggcgcgcatgggccatcgcctcaccatcgcgatgacccggtggcgcgccggcgtcagctgggccggctcccggcccgtgcgggccgagctggccgtcgaggtggactcgttcgaggtgctgcgcggtgagggcggcgtgaaggggctgtccacggccgagaaggcgctggtgcggtcgaatgccttgaagtccttgaacgccagtcgttttcccgagattcgttacacgtccgacgtcatcgagcacaccggcgacgggtaccggctgaccggcacgctacagatccggggcgctgcccgaaaccatgtaatcgacctaggcgcagaggatctcggcgaggcctggcggttgtcggtggaaacgaccgtccggcaatccgattacggcatcaagcccttctcgctgctgatggggtcggtccaggtcgccgacgacgtgtcactgtcgttcaccgcggtgcacgccaaggatcgggcggaggaccggtgagccgctgggggtggaatcagggctgcgggtccagcgtgggacgcggcgccgaatcggccgccggctcaccggtgtcaccggggatgtgctcgagcacccgggtcagatacggctgccggttgccggactccatttgccggtcgtcgccgatgccgggctgttcatcgggagcggccggttcgccggcgggcgcgggggccggcccgctcggcggcttgatctgcggcttggtctgcggtaccgccggcagcggtgtgacggccttgaccgcctcggcgacctgcggcgcgggcggatgggtggcgtgcttggcggccgcggtcgcactcgccggaccgacgtgaatgcccaccgcgagcgacaccgagccgacgaaggagatcgccccggcggtcagcgcggtcatggctccggcgtaggacaaccgccggtgccggacgggtgccggggtcaccggctcgctgcggcgcgccacgagttgttcgtcggtgaactcggtgctgcgcgccgccgagagggccgcgccccgcgcgatcgtcacctgggccatcgattgcacgaaaaccggtactggcaaagccttttcgagttgccaggacaagccgtcgatgtcgctgtgggcgccgacgacgacgatgccgcccggctgccagccgtcgcgctcgaacatgccggtcagccagcgggtcaggccgtcgaaaccgccgcgcacctgcttggtggcggtttgggtctgcccgtcgtgggagtcgaccatgacgaccgtcgtccagtcgtgctcgagaacgcagacggcggtctgctcgtacccgatgaccggggcgatggcctgggccagggtctcgacggcttgcaggaaccggaccggcaccacgttgtgcaagcccgcgtcggtcagcgcctcgagcaccagcgcggccggtacggacgcctcgtcgttccaggtcacgccgatgacacgcagccgccgatcgctgccggccgccgccgcctcgacccgcaacacctcgtcgaccacctgctccgcggcactggcggcacgcacagcgccgcccgagtgcaacgccaattcctggtgatccaggatggtgccgtccgcgccatgtccttcagcgagaacccacccaacggtggtcggtgtcaccgacaggccaagtaccgtgtccaaatctgtgccccaatcggtcccgcgctccgctcccagacacgctgacgcgcaccatgaaaccgctggtacacgggttcgtgagagccggaacagacgcgggatagcgcggtcttcatcggcttgctccgagagagcctacgcggtccgcgaaaggccggcagcgcccggtcagccgtcgggaacaaaccggtggccgaatcacctgataacccaccggaaaacgggtcgcatggcagggcggagtgcatcgattcctcgaccgcgaattgcatgcgaaaggaaaccggcgaccggttggcgcgctgaccaacgcgcagaaatccgcgccgacccggatgttttgccgcacgccggttggacactggttggaccggcgccgaccgggtatccccgcacccgtcgccgcccggcgctgcgggcggcgaaattgcgaggtgaaaacctgcgagacgaaaagagatgcgaaaccgagactcgttcgcgtccctatcgacatttgacggactcacacggtaaattcctgtgagaccacgatcacatgcgaccacatccgacaaggggcaggtatgacagatctgagcgagaaggtccgggcctgggggcgccggcttttggtcggcgcagcggcggctgtaaccctgccgggcctgatcggtcttgccggcggcgcggcgaccgcgaatgcgttttcgcgtccgggcctgcccgtcgagtacctgcaggtgccctccgcgggaatgggccgcgacatcaaggtccagttccagagcggcggcaacggctcccccgcggtgtatctgctggacggcctgcgggctcaggacgactacaacggctgggacatcaacaccccggccttcgagtggtactaccagtccggcctgtcggtgatcatgcccgtcggcggacagtccagcttctacgcggactggtaccagcccgcgtgcggcaaggccggttgctccacttataagtgggagaccttcctgaccagcgagctgccgtcgtacctggcctccaacaagggtgtgaagcgcaccggcagcgccgcagtcggcatttcgatgtccggatcctcggcgatgatcctggccgtcaaccatcccgaccaattcatctatgccggatcgctctcggcgctgctcgacccgtcccagggcatggggccgtcgctgatcggtctggcgatgggtgacgccggcggctacaaggccgacgccatgtggggcccgtccagcgacccggcctggcagcgcaacgacccgagcctgcacatccccgagctggtcggccacaacacccggctgtgggtgtactgcggtaacgggacaccgtcggagctgggtggcgccaacatgcccgccgagttcctggagaacttcgtgcgcagcagcaacctgaagttccaggacgcctacaacgccgccggcggccacaacgccgtgttcaacttcaacgccaacggaacgcacagctgggagtactggggagcccagctcaacgccatgaagcccgacctgcagggcaccctgggcgcgtccccgggcggcggcggataacccctcgaccgctcgcggccactactgcgctcgacgatgacaccgtcgggcgcagtagtgctgttgcggccccgaccgggcgccgcggcgccaggggtcgggccgcccgtgtggtcgtggcgggctgtctggtgaccggggccctcgccggggccttcgcggtgccggtggcgaaggcccgagccgacaccgccgatccgctgaccgagctggtcgacaccgccgtccagcggctgcagctcgccgagccggtggccgcctacaaatggaacagccacggtgccgtcgaagacccggcacgcgtcgcccaacagctggccctactcggcgaccaggccgccgccgagaacatcgaccgcgactacgtcacccgggttttcggcgaccagatccgcgccaccgaggccatcgaatacagccggttcgcgagctggaagctgaatccgggcgaggccccggccgacgcgcccgacctgacggcctcgcgggcggcgatcgacgacctcagccggaccatgctgactgcgctggcggccgattggccgctgctgcattcgccggcatgcgcggcgctgctggccgacgcgcggcgcgccgtcgtcggcgaccgtcggctcgacaccctttaccaacgggccctgacctcggccacgcagtcgtattgccagcaataatttaatttttcctcaccaatttctaacgccttgttttcgcctgccgaaatggcggttttcgcagatagaaggcatatctcgcggcattttcgaataggtaacgctttggccacacgggccgaaatcctggacatgacaaatctctgcaagcttctcgtcaagtccgtagtggtcggcgggttcgttgcagcgtcgatggcttcgtccacgggtgtggtgagcgccgagcccacgcccaactgggacgcgatcgctcaatgcgaatccggtggcaactggcacgccaacaccggaaacggcgaatacggtggactgcaattcaaaccggccacctgggcccgctacggcggcgtcggcaaccccgcggccgcctcccgcgaacagcagatcgccgtggccaaccgggttttcgccgaagagggcgtggagccgtggccgaagtgcggcgcccagtccggcctgccgatcggctggtactcgcaccccgcgcagggcatcaagcagatcatcaacggcctgatccaggcggcggtcccgcgctgatcaaacgccgccgcggtctatgagccggccgcaagctgtgtttggatcagcccatggaaggttcagcgacggtgcacatggcggcgcccgcggccaagatctgggacctcatcgcggacgtgcgcaacatggggcggttctcccccgaggtgttcgaggccgagtggctgggcggcgcgaccggcccggccctcggcgcgaaattccgcggtcacgtccggcgcaacgagatcggaccggtgtattggacgacgtgcaaggtgaccgcctgcgaaccgggtcgcgagttcggcttcaccgtgctgctgggtgaccgcgaggtcaacaactggcactaccgcttggcgcccagcggtggcggcaccgacgtgaccgagtcgtttcggctcaatccggcgccctgggtcccggtgtactgggtgttcggcggctttctgcgcaagcgccgcaatatccgcgacatgaccaagacgctgaacaggatcaaagacgtggtcgaggccgacgcgccgtgaaatcgatcttcatcaccggcgcgggcagcggcatgggtcgcgagggcgcaaagctgttccacgccaagggttggcgggtcggcgccgtggaccgcaacgacgacggcctggccacgctgcagcaggaactgggtgacgatcggctgtggacccgcgccgtcgatgtgacggacaaggcggcgctggacggcgccctggccgatttctgcgccggcaacaccggcggcgggctcgacatgatgtggaacaacgccggcatcggggaatccggctggttcgaggacgtgccgtacgacgccgcgatgcgcgtggttgacgtcaactacaaggcggtactgaccggggcgtacggcgcgctgccctacctcaagaagtcggccggcagcctgatgttctccacgtcgtcgtcctcggccacctacgggatgccgcggctggccgtctattcgtcgaccaagcacgccgtcaaggggttgacggaggcgctgagcgtggagtggcagcggcacggggtgcgggtggccgacgtgctgcccggtctgatcgacaccgccatcctcaccaccacgaccaaccattccaacgacggcgccgcgccgatgaccgccgaggagcttcgcgccaccgcgcccaagaagggcatgctgcggttgatgccggccagcagcgtggccgaggtggcgtggcgggcctaccaccatccgcggcggctgcattggtacgtgcccaggagcattcgcctgatcgacgtgttcaagggtctgagtccggaattcgtgcggcgtagcatcgtcaagtcgttgcccgcgctgatgccggagcggcagtaaggagttcggctggtgcaaaaacgcttgcccacagtcgttttggtgctgacggccgttgtcgccggtatcgccgggtgcagcgcggcgcagaccgtgccgcgcaaggccgcccggctgaccatcgacggcgccacccacacgacccgcccgccgtcctgccggcaggaccagatgtatcggaccatcaacatccccgaccacgacggtggagtcgaagcggtggtgctgctcagcggttaccgggtgatgccgcagtgggtgaagatccgcaacgtcgacggcttcaccggcagctactggcagggcggagtgggcgacgcgcacgtcgatctcaccaacgacgcatacacgatcaccggcagcgcgtacggcatcaacagcgccaaccccaacaaagtggtgaccaccgacttcaaaatcgttgccgagtgctgattctcgtgtcggccggggcatacgctggtgacgacggctgaacgagggaggggccggtgaaggaacgcttgcactggttcgcgatgcacggcttcatccgcggcgccgccgcgctgggcgcccgccgcggtgacgtgcacgcccggctgatcgccgatccggcggtggccgccgatccggcgcgcttctacgacgaagctcgggcccgcggcacgctggtgaagggtcgcgtcgcctatctgacggccgaccacgcgctcgcccacgagctgctgcgctccgaggacttccgggtgctggtcttcggatcgaacctgccagcgccgttgcggtggctggagcgtcgcacccgcgacgacctgctgcacccgctgcgcgccccgtcgttgctggccgtcgagccgcccgagcacacccgctaccgcaagaccgtgtcggcggtgttcacgccccgcgcggtcgccgcgctgcgcgaccgggtggagcgcaccgcggccgagctgttggaccagctgaccggcgggccgggcgtcgtcgacatcgtgggacggtactgttcgcaactcccggtcgcgatcatcagcgagatcctcggcgtccccgagcaggaccgcagccgggtgctcgaattcggcgaactggccgccccgagcctggacatcggattgccgtggcgccaataccgcagcgtgcagcgtggcatcgccggcttcagctcctggctggccgggcatctgcagcagctgcgcagcaaccccagcgacaatttgatgagccagctgatccagaccgccgaaagcggttcggccgaaacctatctcgacgagaccgagcttgcggcgatcgccgggctggtgctggccgccggcttcgagaccacggtgaacctgctcggcaagggcatccgcatgctgctggacgcgccggagcacctcgacacgttgcggcgccggcccgagttgtggcccaacgccgtcgaggagattctgcggctggaatcgccggtgcagctgaccgcgcggatggcgctcaacgacgtcgaagtggcgggccggcagctgcaccgcggcgatctggtactggtgtatctggcggccgccaatcgcgatccggcggtattcggcgatccgcaccgcttcgacatcgaaaggccaaacgccggaaggcatctcgcgttctccggcggacggcatttctgcctgggcgcggccctggcccgcgccgagggcgaggtagggctgcgcaccttcttcgagcgcttccccgaggcgcgtgccgcgggggcggggagccggcgcgagacccgggtgctgcggggatggtcgtcgctgccggtgcggctgggcccggcccgctcgctggccgccgcggaagccggcggccgcccggatgagccgaccgccgggtgaaccgggcggttgacaccgccgcgccgacggagtttcatttgccgctatgacagaggtttctatgatcgcggtggaggatgtcgtgcgcgggctgtggcaggccctgtcgcggcgtgattgggatgcggtcaagaccttcctgtccgacgactgcctgtatgtcgacatgcccgttccggcgttgtcggcccgtggccccgacgacatcgtcaagcggctcaagatggggcttgagcagttggccggctaccagaaccaccccggcgtgctggtgtccaacggctccgacgtgctctacgagcactccgagacatggacattcgccaccggcgagcagggcgtgttgcgattcgtcaccgtccacaaggtgatcgatggcaaagtgaccgtctggaaagactattgggacttcaacagcctggtggccttcgctcccccgaaccacttcgagggcttggcaaatggggacactagctgggtctttgacgcttcagcattggtctgaccgcggcgtcagagcgccgaaaggatctgcgatctcgacggcgtcatcagctggtcgagcacctggccccgctgctcgggtttgaggtcgggcgccagcccctgggtcaccttgagcaggtcgacctggcggtccttgcgcaggttcaaccaggcgtagttgaatgcgccggcttcggccccgccccgcagccactgctgttgcatgaacaacgtggtgaagaactccttgctgcgcctgggttcgttgtcgaagaagcccgcgaaggcgtcctcgtaatgggtttcggtcgagttgtgccggatgaaccgcgtcgtccccagcggtgtcgcggccgtgacgaccagctgcgggcgaccgtgcaacggaaacaggcggccccgcaacggctttcgtttcagccacttcgccacgttggcgcgttcgttcgacggccaatccttacacagcgtgctgggttcgaaaatcgccgcccacgccaggttccggaagtccagcaccggctgggcgaggatttggaagtcggccagcgggcgcttcggcctgaacggcgacctcagccgatgaaattggtagtgccaggtggcaattcgcagaatccgctccaggccggtggccaccagcgagatctgggctcgcggtgtgttccagtaaccgagcagcgtgaagatctccatctgactcaggatcgctttcagcgcacgctcgtacagcgtccagtgattctcgttggcgcaccgattcgcccggaatccgaactcgcgcggcaccagccaggcgagcgcggtcgcggtgaccgcggccagggcatcggcctggtagtccacgtccagcagcacccgcggggcatggcggctgagctcggagtggttgccgccggacatcccctgggagttgtgcagcagctcgtggatgaagtaattgtcgatcatccaatcggtgtcctggttgtcgagccccagattcgattgcacccgggccatggcttcccgggtccgccggctgatgcgatacaccggctgccgcagcgacgtgtcgatttccatcgactgctcgcgcgggccggaggccgtcgggtcggtgttccggtcgaacttgaggttacgcaggtccccgtcggaaaccagcgcggacaggaatttgatcggcgcgagccgaagcttcttgaccgaatccttcgtcagcaccttgcgcagggtttccaggcgcccttcgatgcggtcgtcgaaagccgattgcgtggccgccgccggttgcgtggtcgctgccgtttgtatggtcgccaacatggtctgacccccagctcgggcgtgggacgggccgtccgtgcggtagaacgttacgcgcgcgcggccagcggcgaccggttttgagcgattacgagtgtgcccgcgcgaattgccggtgatcgcgaccagtccggccccgccggccgggcggggccggactggtcgagcgatctcttgccgggactcgggaaaatggccacccctcattggccattccggcgatgccccggcgcagactggggcagggcgtgactagctggcccgggcgggtgacgagtcggccggcggcgcgacggcggccgggccggcgagaactgcggtgacggccgccgtgaagaaggcagcacgggacaacatctgcccaaacctccttgcttcctcgtgagttgggtgacgttgcccgattcgtcgatggcagcctagctgacggcgttgtcaataacaggcggaatcgggaaaattcgcgcccggcgtcgcaccggcgcggcccggcccatcgggcccggcggccggttacggcgccaggccgtagaggcgcgcggcgttctcgcgggcgatcagatcgaccacccggatggcgtcggcgcggccccagtcgccggcttcgacgaactcgcgcagcacgcggtgaatacccctgcgccacagcaccgctcccaaaaaatgcagttcggcgggaccgaatccgtcggaggaatacaggatcttggaaaacggcgccagctccagcaggcgcgccaagaacgccggcgaccgcgcccccaagtggttcacgctcaacccgccgtcgacgtagacgttgttgaaggcctgcgccaggtagccggcctcccgctcgtagggatagcagtgcagcaacacgatcggcgcatctccgctgtggcgcaggaagtcaagcagcagcagcggattggccttgtgcagatcgcaatcacgatcgccgaacccgacgtgcaattgcagcggcttgcccaaccgcagcgcccggtgcagcccgaaccgcagcagcacccgatcgcgcaaccgggtgccgccgagctcgcgccaccgggccgccgcccgggcgacctcggtcgccgacggctcgctcaggtctccgtcgaacccgccccggtaggccaggatcgatttggtgccgaccgcgccggccgcccgcgcggccaggacctcgtcgaaggccgccgcgtagtcgcccggcgcttgcgccgcctgctcggcgacctcctcgagacgcaccagctcggccgcggggccggccgccagctcggccatctcggcgacaccggcgaccacgccgtgcccgattccggtgtccaccaaccagttactgaccccggcggccggcaggaacagccgcgccagttcgtgttcgctgagttggcaacggcgctcccaataggactgcgggtcggcgtgtctgggcagccccaggatgggagcgcagtgggcgcgcacggcgaacccgagctgcgagtcgaaacccgaaccggtgatcggctcggtgttggcctcgttcagcgcgttctcgaatcgtcgccgcccgccggccgtcagccagcagccgtggacgtgctggtcgatcagcgacacggcgccgatgtgttcggccagggcatcggtgtcggagaccatggcggcgtcgtcacaggctccaggccatgcggaaccggtccgccagttgcgcggggtccaggtcgccgtagcgttcctgctccaagcggcgcaccgccaccaccatgtcgaccaccgggtcgcccaggatgtgccgcatcagctccgaatcatcaagggccgcaatcgcttctgcggccgaatcggtcagcagcaccacaccgtcgcggtcacggtcggcgtcggacagcgccgccgggtcgaccgtgacctcgggaggcagcgccgcctgcgacttgataccgtccagggagagcccgaggatggccgccgacgccaggtagggattcgccgacggatcgacgatcttcacctcgacgttcccgccgcgcgggctgccggggccgtcgacgatgaatcgcactgcggcttcccggttctcggtcccccagcaggcgtaggcgccggcccaattgcccgggcgtatccgcaggccggagacgatcgacccgcacagcacaccctgcgcctcgggcagcccgcggatcacgcccgccaccgcgttctcccccgccggggtcatgcccgccgtgccggcgccgccggagaacagcggcccttccgccatggacagcgaaaagtgttggtgagcaccggatcccacatcaccggcgaacggtgcgggtgacaggctgatgcggaacccgtgccggcgggccgcgcggccgatgatcagccgcatcaagatcagctggtcggcggcggccaccgggggttgcggcgccagcgagagctcgaactggttggcgccgtactcggggtgcagctgttcgatcgcgatgccggcccgggtcgccgaaccgatcacatcgcggacgaacgcctcgtgctccagcaccccggcaaggccgtactgcgcccacaacgtcgacggcaaccgctgcccgtccggggcgaccagaacgaattcgacctcatgcccgatggccgcgtcgatgccggcgtcggcgagcgcggcctcgacccgcttcagcgttccgcgggcgcagctgggtatgggcgtgccgtcctgggcgaaaaacgcggccggcgcccaggccaggccgtcgccgacgatgcgcaacgcggacaggtcgatccgaagacgttggtcccccaccacgcccacctcggcggtgaacgcgatgccggtttggtcgacggcgaaggcatgccaggacgggctggcgcccagacccggatcggcgaaggtgttcgtccgccggatcggaaccgtcttggccagggtgagcccggcgggattgacgaccgtcccgatcacggtgtcgacgccctcggcctccagctgggcgatcgccgcggcggcaagcggtgtgccggtcatggcagtcattgtgcagggtcgcgggcccggcgcccgcgatttcagttctggcggccgaccaactcggtgacgaaccgatcgagaaagccgtccaacggcgccgtgcccgccggccggatcacgaatttcgtcagccccgcatcaaggtaggcgtcgagtttgcggtgcagctgatcccatccgctcgcgatcagttcgtcggggtccaggtcggggcggcggcgccgcaccgccgcgatcgccggcggcggcagttcgccgtcggcgacggccagcgagatcccgaagtggtcgggttcgatgtgccgtccggcggccgccgcggcccgctcgatcgcctcgcgcccggcccgggcctccgccggggtgaggaagctgcccagccaaccgtcggccagcgcaccgatccgccgaaacgccgcgggcgccgaaccgcccagccaaatatccagtggcggtgcgggtttgggcgtgaccgccgcaccggtcacgctgaaataccgcccggtgaacgtcgccgaatcctccaccagcgccgcgcgcagcagccgcagcgactcgtcgaacaccgccgcccgctcgccgtcgggaaccacgaacacctcgcgttcggccggaatcgccgagcgcagcccgaacaccggaaggacccgcttgggcgcgagcgccgccagcgacgccaactgcttggccaccagcaccgggtgccgccccggcagcacggcgaccgacgtgcccaccttcaaccggtgcgtccgcgccagcgcaaacgccatcccgaccaccggatcgaccgccggggagtacaccagctcggagaaccacagcgaatccaccccggtcgactcgagatggtcgacgatggcgcccagcccgtcgggggcggtatcggcgcccagcccgacgccgaagcggatcttcatcggcgcctcccccgtcggcgtcgcacgccgggctatccgcggctggggatggtcagcttgcaggcctgcccgatgtcgagggtccgcagcacccggcccatgccgacccacagcgcgcaggacagggccagatcggcgagcaactcgtcggagaagtgctcggcgcagcggctccagaagtcttcgtcgtcgcgcagaccggtgtgatcggtcgcgaagcggtccgcgaattcggctgccagccgctcctgttcgctgtagccgggccaggtgcgccactcatggacgtggtcgtacagctcctcatcgacgcccgccgccgggccgtcctcgtcgcgggtgttgacgcacacgacgcactcgttgcggtgggcgatcacggcgcgggccagctcccgggtgcgcaacggcaaccggttcttggtgtagaccgcctggctgaacgcgcccagcgcggcgccgatgtccggagatttcacgaaccagccggccaggtcgtcgtcagcaaatgttccgattcggctcatggcgtgatggtacgcccgggttcgccggccgccggcgacgagtgctcggcccggctagcgagccgccgccgtgatcgccgcggtcggctgctcgtcatgccaatcacgttgggcgagaacgcgatacgcgacgcgttccagggcggcctgcaccgcttggcggtccgggcgcccctcgaagccgggcgaccgcccgagtttgtcgaccagccaggccaacagcagcgaatgcacgtagccgacctgctgggccccggccggggtgagccacagccggtcgccgtcgctgcccgcgtaaccggcggtgaccaggcgcgagaaggtcggctcgagcacctcgaacggaatccgcagatactccgccatgtcggtgagtcgcgcggccccgtacatctgggtgtagcggttgatgcgcaacactccccacaacccggcgacgtcgagccggcaatcgggtcgcatcgcgatgctgcgcaaccgcatcccggtctcgccgcgcaacatccgggcgatcgcgttctccagcatctggtcgggtgtctcggtggtcggcatgccgaatgcgtcaccgagatcgactgtgctgtcgtggatgtcgcgcagcgggatttcgcgcaggaacagcgccagcacgaaacccaccagtgcgaccggggccgcccagaagaacacctcggtgagcgattccgcataggccgccacgatgggcgcggccacctcatgaggctggcggtgtagggcgcccggcgagctgaccgcgccgggcggcgcgccgctggccgccagcgccggaccgatccggcggttcaggaagttcacgaacaacgagccgaatatcgctgcgccgaaggaacttccgatggtccgaaagaacctcaccccggacgtggcgacgccgagatcttcgaagtccgacgtgttctgcacgatcaggatcagcacctgcatggacagcccgatgccggcgcccaggatgaacagatacagcgactggatcaccgccggggtcgacggctgcatccgcgacatcagcaggaacgccaacgccatcagcgcggtgccggccacggggaagatcttgtaccggccggtgcgcccgacgatggtgccgctgccggtcgaggtgaacagcatgcccaccaccatgggcagggtgcgcaaccccgacgtggtggccgagaccccgtcgacgtattgcatgtaggtgggcaggaacgtcatcgcgcccaacatggcgaaacccaccacgaaggacagcacgcagcacacggtgaacaccgggctggcgaacaagcggaccggcagaatgggctcggcggcgcggcgttccaccaccacgaaaacaccgagcgccaccgcggcggcggcgaacaggccggtgatcgtcggcgagccccacggatagcgactgccgccccagctggtggccaacgtcaggccggccgcgcccaggccgacgaaaacgattccggcgtagtcgatcaccggtttggccgacgcggccagcgcgggaatcgccgcggcggcaacgaaaatgacgatcaccgagaccggcacgttcacccagaacgcccagcgccagctcaggtaatcggtgaaatagccgcccaacagcgggccgatgaccgtggtgacgccgaacaccgccccgaggatgccctggtaccggccccgctcccgcagcggaacgacctcaccgatcagcgcgctggcggtgacggtgatcccgccgccgccgatgccctgcagcgcacgcgctcccaccaacatggccatcgactgggccagtccgcacaggaccgagccggccacgaagaacaggacggcggcctggaagacgcgcttgcggccgtacagatcgccgagcttgcccaccagcgcggtgacaatggtcgaggcgagcaaatagctggtcacgacccaggactgatggccggcatcgcccaggttggccacgatggtcggcagcgcggtcgccacgatggtctggtccaacgccgcgagcagcatgccgagcacgatcgcgacgaagatcaggttgcgccgctgcgggctgatccgctcaccgccggatccggtatcggcgcgggccggtgcattcactgctgctctcggggtcgtcatggctgccttccgtcgcgtcggcgtcggctatgagtacccagctgtcggcgtggacctgtcagcccgctgaccccgagggcgcgccgtgccgccccggcatcagctcggtggccgcgacacgcactgcgccgagtagagctccacgcccagcttgtccatcaactccagctgcgtctccaggtagtcgatgtgcttttcctcgtcggcgacgatctgctcgaaaagcgtggcggtggtggagtcctgcttctcccggcacaggatgatggccggcttgagccggtccatcacctcgtattcgatggccaggtcggcctcgaactgctcgcgcagcgtctggccgatgcgcagcgagaacaggcgctgatagttcggcaacccgtcgagcagcaggatgcggtcggtgatcgcctcggcgtggcgcatctcgtcgaaggactcggcccgggtgtgctcagctaactcggtgaacccccagttgtcctgcatcttggagtgcaggaagtattggttgatcgcggtgagttcgctggtcagctgctcgttgagcagacgcaaaacttccggatccccttgcattttcactcctacggtgtgagcggctggctgttcggccgcggtcggtgcgccgggctggagcgcacgaactgggctgtagcagcactttgccacggccacagcgaatcttccagcaaggtttggctgcgctcagtgcgtgttacgggtgagctagatcgcttcttgttaggttagactccactaactgacttaggttagactccactaatatgcggcgggatatgcggcagctttgtccggaggtttcgccggggcgatcgacgccccgggaggccaccggccgaggcggcgcggcgtcgcccgtccgagcgttcgacgaaggggatgcctacgtgcgaggggtgcgctgatgtacgtgtgcctttgtgtcggggccaccaaccagaccgtgtccgaggtcgtggcgcgcggcgccaccacctccaaggagatcgccgccgcgtgcggggccggcggcgactgcggccggtgccggcgcacgctgcgggcgattctggccgcttcggcgaagctggagaccgccccgtcggtctgaggccgctcccccgcctcagctgggccgcttagtgctgtttgcttggtgcctgccgctcagcgcttgttgaagtcggccagcgcggccgcgttggcctgggcgcccatcagctccgcgaagtgcgcgttctcccgcgcggtggccgccgcgatctgcggccggaccggttccatcatcgtgtgcttgaccgccatcaaactcgaaatcgggcgggaggcaaggatttccgcgtgatgacgggcctgcggcagcagctcgtcgggcgcgcagacccgccagaccaggcccatccgcagcgcctcgtcggcgtcgacccattccgaggacatcaacagccaggcggcgttctgccggccgaccagttgcggcagcaggtaggacgaggccgcctcgggggccacccccaggctggtgaacgggcacttcagccgggccgtcgacgacatgaacgccagatcggcgtagcccaggatggtggcaccgatccccacgccgacgccgttcaccgcgcagatcagcggcttgggaaatgcgctgagcgcgttgatgagtccgatgaagccatgcttgcccggggtgaagtccgggtcggtgatgcgggcctgcatctcggccaggtcggtgccggcgctgaacccgcgccccgccccggtcagcagcacgaccgccacctcgggatcctcggccgcggccagcaacgcctcggcggtggcgtcgtagagggcttcgttgaacgcgttcagcgcctccgggcggttcagcgtgagggtgcgtacccgcttgtcgtcgtcgatctgcagcgtcacgccagcagcttaggtcagccgttgctgtagacgcgggtcggggcgatcagcacgacagcccgccgctcccgggccatcacccggtcgtactcgtcccagtcgtcgtgactgccgccggcggcggtgaacacttcacgcagcagcattcgcagccggtcggcgtcggtcagccacggctgggcgtcgtccgggccgaccaattccgcgcggccctcgacggtcgcccactgccagccgttgcggaaggtgacggccagctgcggccgggcccgcaggttggccagtttgaccttgccgtaggtggtaaagcccagcaccggttgaccgttcgccgggtgcgccaaccggccgacgttgaccagcgaggcctgcacggtctggtcggcgcggacggtggatatcaccgccagaccgttttccgcggcggccagggcgacggcgtcgtcgagtgtggtcatctccggtacctcattgcgcgaacggtgtcttgacgacgtagcggctggtcggcaccgtgtcgatgttctcgttggcgccaaaagccgtggtgctggccaccattcggcccagccggtgctgcaggtcctgttcgtcggccgccccgaagaacgcctgcagatcggtgatcgcctcggcggggaacaactcctcgacgatgccggcgatctccggtgcgcccggggtgagggtgcgcaccacccagttctgggtgtagccgaacgtcgattgggtctcgatggccaccggggtgtggtcgcgctgccagcgggtcagccaggtctcctggtccatgccggccggccggcgcagtaacgcgatgttggccaaacccggtgtgcgagaggctggttcggtttgcggcgccggcagcggcaccgactcggtcaccagataggcggccagctgctcgcactcggcggcgagcaggcgcagcgcggccgccacttgctcgccgtagctctgctgggtccacatgctgaccaccgcggccaccggcgggtccagcgtggtcaacgtcatcaacgaccggcgcaccgcatcgtcgcggacattgaccgccagcccgggcaggcccaactcgagcagcgcatcggcgaccacgccgcgctggcgggcgcaccagtcctcctccgaatcggcacgcataagcacggcgatcactttttccatgagccgaaacctacccgcgccgggccgccggcagggttacttcaccagccgtacctggtgctggctgctgatcagcccggccagctcgcggtaggagtcgtcgcgcccgctcgacgagcggaacaccagaccgatgcgccggcccgggcgcggcgcggcgaactgggccaggcccagccggctgcgcgacgcctcgaccgggaccgcgctctgcgggatgagcgtcacccccaggccgccggtcacgcactgcaccgcggtggccagcgacgcggcccgggtattggccagctccgcccgcacacccgccttgtggcagacgtccagcgcctggtcgcgcaggcagtgcccctcgtccagcagcagcggcaggtcggccagcgccgtcgccggcacccggcgcttgcccgccagcgggtggcccggcggaagcgcgagcacgaaatcctcgtcgtagatcgggatcgcggtgacgcccgccgtctcggcgggcagcgcgatcagcgccgcgtcgagcgcgccctcgcgcagcaccgccagcagccgttcggtctggtcctcggtgacccgcagggtcaggccgggccgccgttcggcgattccggccagcacggtcggcagcacgtagggcgccaccgtggggatcagccccagccgcatgccggcccgcaacgggtccgccgaacccgccgccgcagcggtgaaggcgtcggccgcctcgaccacggcctgggcgtgcggcagcagctcggcgccctggggtgtcaagaagacacgccgggtggagcgctccaccaactgcgtgcccagccctgcctccagcgccgccaacgcctgcgacagcgtcgactggctgactcccaaagccgttgcagcaccgctgaattggcgcttctcggcgaccgcgacgaaggcgcgcagaccggcgatggtgggctgataagtcttatcggacatgcctataagtgtagtgggaaatatcacctttacttcattgagggtacgcggcaacatggtggacgaaagctaattttgagttgatccagattaagtagatccagataggagcgacatgcctctgctgaccatcggcgatcagttccccgcctacgagctgaccgcgttgatcgcgggcgacctgtccaaggtcgacgccaagcagcccggtgactacttcaccaccgtcaccagcgaggaccacgccggcaagtggcgcgtggtgttcttctggcccaaggacttcaccttcgtctgccccaccgagatcgccaccttcggcaagctcaacgacgagttcgaggaccgcgacgcccaggtgctcggcgtctcgatcgacagcgagttcgtccacttcaactggcgcgcccagcacgaggacctgaagaacctgccgttcccgatgctctcggacatcaagcgcgaactgagcctggccaccggtgttctcaacgccgacggcgtggccgaccgggccaccttcatcgtcgacccgaacaacgagatccagttcgtctcggtcaccgcgggttcggtgggccgcaacgtcgaggaagtgctgcgggtgctggatgcgctgcagtccgacgagctgtgcgcgtgcaactggcgcaagggtgacccgacgctgaacgccaccgaactgctcaaggcctctgcttaattcgggcccggctgggtacaagcctgatcaggaggcgagatgagcgtcgagaatctcaaggaagcactgccggagtacgccaaggatctcaagctgaacctgggctcgatcacgcgcaccaccgagctcaacgaggagcagctctggggcacgctgttggccagcgccgcggcgacccgaaacacgcaggtactcaccgagattggtgccgaggcggccgacaccctgtccgccgaggcgtaccacgcggcgctgggcgccgcatcggtgatggcgatgaacaacgtgttctaccggggccgcggcttcttggacggcaagtacgacgacctgcgtgcgggattgcggatgaacatcatcggcaatcccggcgtggagaaggcgaacttcgagctgtggtgcttcgccgtttcggccatcaacggatgcccggactgcgtggcctcgcacgagcacacgctgcgcgaggcgggcgtcagccgggagaccatccaggaggcgctcaaggccgccgcgatcatttccggtgtggcccaagcgatcgtcgcctcccagacgctggcgaccgccggctgaccgtgccgtcgtggccagtgtcgtgaccggacccgactgggtccagcacgtcatctggtggcaggtctacccgctggggttcgtcggcgcgtacccgctaccgcagtccagcgagccgccgcaaccggaacaacaccggttgcggcggctcgtcgactggttcgaccacgcgatcgaactcggcgcctccggcatcgccctgggcccgatcttcgcctcccggacccatggctacgacaccaccgaccactaccgcatcgatccccggctcggcgacgacaccgacttcgaccacctcatcgcgcaagcgcaccggcgcggcctgcgggtgctgctcgacggcgtgttcaaccacgtcggtgtggacttcccgcggtatcgcgccgccatcgactctgacgatcacgccgccgcccgctggtttcgcggtagtcgcgggcgttttcacaccttcgagggccacgacggcctgatcaccctcaaccacgacaatcccgaggtcgtcgactacaccgtcgacgtcatggcgcactggctgggacgcggcgccgacggctggcgtctggacgcggcttacgctgtgccggaaacgttttgggcggccaccctgccccgggtgcgcgaccgctacccgcaggcctggttcgtcggcgaattgatccacggcgactacgccgcggtggtgcgggccgccggcttcgactctgccacccagtacgagctgtggaaggcgatctggagcagcctcaacgacggcaacttctatgaactggactgggcgctgcagcggcacaacgcatttctgggccggttctcgccgctgaccttcatcggcaaccacgacgtcacccggatcgccagccagctgaacaaccccgcgcacctggcgcacgccctggtgctgctgctgacggtcggcggggtgcccagcgtgtacgccggcgacgagctcggctttcgcggggtcaaggaggaacggttcggcggcgacgacgcggtacggcccgagttcggctctcccccaataccattggatgacttcggcacagaggtgtggaggctgcaccaatacctgatcgggctgcgccgccgccatccctggctgcacggggccaccaccaccgcgctgctgctgcaaaaccggcactacgtgtacgagacccgcagcggcgatgaggccctgctgatcgtgctcaacatcggcgatgagccgctgcgggtttcgctccgcgagctgggcggccggcgcgggcgggtgatcggcggctcggcggccccaccgccggaggtgctcgacacggtggtcgtcgagccgcagggctggcggatcctgagcccgatttaggagtccgccaggcgggccagcgtcaccgggtcctgccggccgtcgtagtacttctgcaggaccgccaggaagtcagcgttgtcgtcggtcgcgtgcgcgaacagcgtcatcgacgagcacagcttcaggtcgtcgggcgagccgaagatctgcccgacggatcggccctgcacccgctcgaccagtcgggcgcattcgtgcagacgcggcccgagcaactcgtggcgcaggtaggcgcgggcctccggcagcgacgagatgccgtaccggtccgccatcgcgctgccacccaggccgcgcagctgcggaaagacgaaccacatccaatggctgcgttttcgcccggcacgcaactcgtcgacgacggcggcgtacaccggctcctgggcgtccacgaagcgtttgagatcgaacgggtcggcggccgagtccatatgactacggtggcacatgtgggagtccaacggcgagtgcccagggtgcgcgacctcgcgccactgatgcagttcaagcggcccgagttcaacgcgaccaaacgccgcctgcgatccgcccacaccatcgaggacctgcgccgcatcgccaaacgccgcaccccgaaggcggccttcgactacaccgacggcgccgccgaggacgagctgtccatccagcgcgcccgacaagccttccgcgacatcgagtttcacccgacgatcctgcgtgacgtcagcaccgtgaccgcgggatgggatgtgctgggcgggccggtggcgttgccgttcgggatcgccccgaccggcttcacccggctgatgcacaccgagggcgagatcgccggtgcgcgggcggcggcgcgggcgggcatcccgttctcgctgtccaccctgggcacctgcgcgatcgaggacctggcggccgcagttccccagtcgcgcaagtggtttcagctgtacatgtggaaaaaccgggaacgctcgatggcgctggtgcgccgggccgccgacgcaggtttcgacaccctgctggccaccgtcgacgtcccggtgtccggggcgcggctgcgggacaaccgcaacggcatgacgatcccgccgacgctgacgctgcgcaccgtgctggacgcggtgccgcacccgaaatggtggttcgacctgttgaccaccgagccgctggcgttcgcgtcgctggatcgctggcccggcaccgtcgcggagtatctgagcaccatgttcgaccccagcctcaccttcgacgacctggagtggatcaaggcgcggtggccgggaaagctggtggtgaaggggattcagacgctggacgacgcccgcgccgtcgtcgaccgcggcgccgacggcatcgtgttgtcgaatcatggtgggcgccaactggatcgggccccggtgccgttccacctgctgtccaccgtggcgcgcgagctgggcaagcacaccgagatcctgctggacaccgggatcatgtcgggcgccgacatcgtcgcggcgatcgcgctgggggcccgctgcaccctggtcgggagggcgtatctgtacgggctgatggccgggggtgaggccggcgtgacccgggcgatcgagatcctggccgaaggcgtgatccggacgatgcggctgctgggcgtcacctgtctcgaggagctgtcgccgcggcatgtgacgccgctgcggcggctggcgccgctgccgcccgtcgagccgccagtgacgcccgcgtgacgctcgccggccgccggtgcgcgggcgtgacgctcgtagcgaaaccgtccgggaacaaaccggcgccgggctgggttaagcgcatcagactcaacttttggaggatttgatggctgaggcctactcggtgccggtgctgttcgtcaccgacaccatcgtgttgcccgggatggtggtgccgatcgcgctggacgacgcggcccgcgcggcgatcgacgccgctcaggcgagcgaatccggtcagctgctgatcgccccccggctcgaggaccgctacccgtcgcacggcgtgatcgccaagatcgtgcaggtcgggcgcatcgccggaggcggcaccgccgcggtggtgcgcggcgagcgccgggcccagatcggggccggcacgtccgggcccggcgcggcgctgtgggtacaggcgaccccggtccccgacgccgcgatcaccgacgagatcaagacgctggccgcggagtacaagaagctgctgctggccatgctgcaacgccgcgaggcctgggagatcatcgactacgtcaaccggctgaccgacccgtcggcgctggccgacacctccggctacgcgtcctacctgaccagcgcacagaagcgccagctgctggaaacggtcgatgtggccgagcggctgcgggtgctgatcgactggaccagctcgcatctggccgaggtcgaggtcagcgacaagatcgccgaggacgtgcgcgagggcatggagaagacgcagaaggaattcctgctgcgccagcagctggccgcgatccgcaaggagctgggcgagggcgaaccggacgggtccgatgagtaccgggcccgcgtcgaggccgccgacctgcccgagaaggtccgcgaggccgcgctgcgcgaggtcggcaagctggaacgcgccagcgaccagagcccggaatccggctggatccgcacctggctggacaccgtgctggagctgccgtggaacgtgcgcaccgacgactccaccgacctgaaggcggcccgggagatcctggacgccgaccaccacgggttggaggacgtcaaggaccgcatcgtcgagtacctggcggtgcgcacccgccgcgcccagcgcgggctgcaggtggtcggcggccgcggctcgggtgcggtgatggtgctggccggcccgcccggcgtcggcaagacgtcactgggcgagagcgtggcgcgggcgctgggccgcaagttcgtgcgcgtcgccctgggcggggtgcgcgacgaggccgagatccgcggccaccggcgcacctacgtgggcgcgctgccgggccggatcgtgcgtgcgatcggcgaggcgggatcgatgaatcccgttgtgctgctggacgaaatcgacaaggtcggctccgactaccggggcgacccgagcgcggcgctgctcgaggtgctcgacccggcgcagaaccacaccttccgcgaccactacctggatctggacctcgacctgtccgacgtggtgttcctggccaccgccaacgtcgtcgagaacatcccgtcggccctgctggaccgcatggaactggtgaccatcgacggctacaccgaggacgacaaggtggccatcgcccgggactacctgctgccccggcagcgggagcgggcggcgctgaccgaggacgaggtgacggtgaccgacgcggcgctgcgcaagatcgccgccgactacacacgcgagccgggcgtgcgacagttcgaacggctgctggccaaggcgctgcgcaaggtgacgaccaagctggcagagcagcctgggccggtcaccatcgacgagcccgacctcgtcgcctacctgggccggccccggttcacgcccgagtcggccgaacgcaccgcggtgcccggggtagcgaccggcctggccgtcaccggcctgggcggcgacgtgctctacatcgaggccggggcgaccgacggggagccggggttgcagctgaccggtcagctgggtgacgtgatgaaggagtcggcgcagatcgcgctgtcctacgtgcgctcccacgccgccgagctgggtgtcgacccgaaggtgctggaccggcgcattcatgtgcacgtgcccgccggcgcggtgcccaaggacggcccgtcggccggtgtcacgatggtgaccgcgctggtgtcgatggccaccggacgccaggtgcgctccgacgtcggcatgaccggcgaggtcacgctgaacggtcgggtgttaccgatcggcggcgtgaagcaaaagctgctggcggctcaacgtgccgggctatcaacggttttcatcccggcgcgcaacgagccggatctcgatgacgtgcccgccgaggtgctcgaggcgctgacggtcacgcccatgaccgacgtggccgacatcgtcgcgcaggcgctggaacccgtcaccgcgccggccgccgccgcggcctgaccgcgcctccagcgtcacgccggcgtggctctcggcgccgaacgccacgctggcgtgacgccgggtgtcgcggttgaatgaccacgtgagtctcaaacggcgagtggtacaccgagttcaacgcctgctggtcaacccggtgggccggcaattgccgatgaccatgctcgaaaccaccggacgcaagagcggcaagccccggcggaccgcggtgggcggacgcgtgatggacaaccagttctggatggtttccgaacacggcgagcactccgactatgtgcgcaacatcaaggccaacccggctgtccgcgtgcgggtcggcggccgctggcgcaccggcaccgcgcacctgttgccggacgacgaccccgtgcagcggctgggcaacctgccccgcctcaacagcgcgatggtgcgcctgatgggcagtgacctgctgaccatccgggtggacctggactgacctcgacgcgcgtgtcggcggccggcattaaggtcggcgcatgccctacgacgaggacctggccaaccggatccgcgagctgctcggcggtcaaccgggcatcgaggagaagcgcatgttcggcgggctggcgtttctgctcaacggcaacatgtcggtggcggccagcggccagggcgggctgctggtgcgggtgccgcccgaggacaccgacaaactcgccgcgcgcgcccatgtcggcccgatggtgatggccgggcgggagacccgcggctggttacgagtcgacgccgccggggtgcggaccaaacgccagcttgcgggttgggtcgcccgcggcgtcggatacgccggaagcctgccgcccaagtagcggcgccgtttgcccgcgcacgccgggggtacgcgaaccggtatgagcaaccgcgaccagcgagtgcgacgactgctcgacgtcgccggccagacgtacgccgcgcaggcgcgcatcaagctgagcgacaagcccatgccgctgtttcagcttctggtgctgtgcatgctggccagcaagccgatcgacgcggccatcgccgtgggcgcggcggccgaactgttcaaggcgggtctgcgaacccccaaggccgtgctggatgcggatcggcagaccatgatcgatgcgttcgggcgcgcccactacgtgcgttacgacgagagctcggccacccggctcaccgacatggccgagcgcgtgcgcgacgactactcgggtgatctgcgcgaactggccgctcgcagcgagcacgacacggcgtcggcgaaacggatgctgaagaaattcaagggcatcggcgacaccggcgccgacatctttctgcgcgaagtccaagacgtgtggacctgggtgcggccctacttcgatgaccgggccaccggcgccgccaagaaactggggctgcccgccgagccggacaagctgggaagccttgcgccgcaagccaatgcgcggctggccgccgccctggtgcgggcgtcgctggacgacgacgtgcgccggcgggtcagcggctgaccgccccgtgaccgtgcgcatcggtacctccgggtggtcgtatgaccactgggcggatgtgctgtacccgccgggaacgccgtcggcgcgccggctggcccgctacatcgaggtgttcgacaccgtcgagttgaacgccagtttctaccgctggcccaaggattcgacgttcgcggggtggcgcgagcagttgccggacggcttcaccatgtcggtcaaggcgcaccgcggactcacccactaccgccggctggcctcccccgagccgtggatcgaacggttcgagcggtgctgggagttgctgggcgatcggcgcggcgtgctgctggtgcagttgcatcccgagcagcagcgcgacgatgcccgcctggattccttcttggagcgcatgcccgcgtccatccgggtcgccgtcgaactgcgccacccgtcgtggaacgaccccgcggtgtatgcgctgctggagcgccgccgtgcggcgtacgcggtgacgagcggccttgggctggcgtgcatcccgcgtgcgacgaccgacctggtctacgtccggatgcacggaccggacccggccgccaactatgccggctcgtactccgacgacgacttgcggtgctgggccgagcggatcaccgcctgggacggtgacggaaaggacgtgtggatgtatttcaacaacgacctgggcggccacgcggtacgcaacgcgctcgcgctgcgcgagctggtgggttgagcgcccgcgagtaggctgaaacttcgacagaacggagcaccccatcatggccagcgcgaccggcttcgtcatcatcggcggcggacttgcggcggcaaaagccgtggacgcattgcgggacaacaacttcgacgggcgcatcatcgtgttcgccgacgaggagcacctgccctacgaacggccgccgctgtccaaggagtttctggccggcaagaagtcactgaccgacttcaccgtgcagaactcggactggtaccgggacaacgacgtcgacctgcggctcaacacccgggtgtgcgcgctggacgccgccggccacaccgtcgggctcgccgacggcaccaccgtggcctacgacaagctgctgctggccaccggatcggcggcgcggcgcccgccgataccgggatcggattgcgccggcgtgcattacctgcgcacgtatgaagacgcggtggcgttgaattcctttctgggcgaagggaagtcgctggcagtggtgggtgcggggtggatcgggctggaagtggccgcggccgcgcgccagcgcggcgtcgaggtcacggtggtggaggcggcccgacaacccctgaccgcggcgctgggggaaaccgtcggcgaggtgttcgccacgctgcatcgcgagcaccgcgtggatctgcggctcgagacgcaggtgcgagagatcacccgggccgacggctcggcgaccggcctgcgcaccacggacgggtcggcgatccccgcggacgcggtgctggtggccgtcggcgcccaacccaacatcgaactcgccgaggcggccgggctgtccctggccgatggtggggtgctggtcgacgcgtcgttgcgcaccagcgatcccgacatctacgccgtcggcgacatcgccgccgccgaacatccgctgctgcgcacccggatccgcaccgagcactgggccaacgcgctcaaacagcccgcgatcgccgtggccgggatgctgagcaggccgggcgaatacgacgaactgccctacttcttcaccgatcagtacgacctgggcatggagtacgtcgggcatgcgccccggttcgagcgggtggtgttccgcggcgacgtcgcagcccgcgaattcgtcgcgttctggctcgacgccgacgaccgggtgctggccgggatgaacgtcaacatctgggatgtgctcgacgacgtcaaggcactgatccggtcccgggcgcccatcgacgccgaccggctcggtgatcccggcgcaccgctgggcgagctgctcggttgacgggtcagcccgcggggcgccgggccggcgatccctcggcgcagtgctgcggcggcgtccaccggccgtcgatgacctcgggtgggcattgcacctgcaaccgctcccgctcggtgcggcggcgcttgatccgcagccgggcatcgccgggcatggtcaccagctcgttgcaggtcaggtagtacacgtcgtcgacggcgtcgatcagatccgcctccacccgcagagatcccaaggcgcgcaacgtcattcggagctcgtgggtgaaccgcatggtggcgtcgtgggccagctccttagagccgcgggcgttggccgccagccgctcggccagcgtcgccggcgcggcgggctcggcgggcgccgcggcggcggcggcgctcagcagcatcgccgggtcgtcgccgaacgtctggctggccagctcggcgtccccgggcccgcggtgtccaatccgcgccaccgcggcgtccacggcggcggcggtcttcggcgccagcgcgcggatgctggcgaggttgccgtcggcggccagcgcacacaacggcgggtcggccgccaacatcgccgccagctcggcggtttcggctgccaccaggccgctttcggtgatcatgccgaggccgggcacactctgcccggcctggctgcgcaccagcgtcgccgccgtgatcccggtgtcgagcagccacagcgcgttgaggatccagccctggtggatgcggtcgcgcaacagccgcagccgcacctccagcgcggcctgcggcagcaaggccagttgggcggcgtccacctgctcggcgacggcggcggcgcagtagtcgcgggtgttcgcccgcaagtgccgcagcagcgccaccgaccgtcccgcggccaccgccttggcgatcgagccgagcgccccgcccgccaacgccggctcaccgaacggcagcggatcgccgacctggggccggcccaccagggcgtcgcgggcgacggcgtcctggtcccagccgggcagctgggtggcggcgaccatgttgaccgacaccccgacatagggccggtggccgaacaccgcgatggccctgctgtcccattcctcgccgaccgcgccgcccagcgcgagcacccggcccaacacccggctcgcggtgcgcagcccgctcagttggacgtcgagcgtgatcggggtgagcggcccgggcaacgcctcggtgagcgcagtggccgaaaacaccgggaaccgcggatcgatccggtcgtcgaattcgccttccacgccttcgggcgccgcgctgtgcgcgccgttgcccgcccgctgcggcagcacctcgacgggcagcgcgagctgggcgccgtgattgatcgcgcccgcggtgtccagccggcgcccgaccagcccacgcgcggtgtcggcgaccgcgtccagcgcgtgccagccgaactcgaacagccaatcctcttgcgcagcagcaacattgagatccggaatcagctgcgaccagctgcgcacccggtgcagccgggaacgggggtcggtggcgcgcagcatccgccaggcggtgaccaggttgacggtgtccgggctggccaggtccaccacgccggtgcggtcggtgtcgagggccgtcaccaaaaagcgcatcaggtcgtcgaggtgcagcacccgcatcggctgcgccgacaccttggtgcgcagcacggtggccaccgtgcggcacaccatccagtcgagttgacgaccgaccggcggcgcgatccggaccaccacgctgggcccccagctcgaggccaccaggtcctcggccggtcgatacagctcgggccggccggcggcctgcgacacgaacaacagccgggacccggcccgggcggcggcgtcggtgacgcgcgccagcccgtccatggcggcgttgccgggcgcggtggggtcgatcggggccaggtggatgaccgcgtcggcctcgtcggtcagctcgcgcaacacccggtcgcgcagcggcgcgcaaacgaattcgacgttgcggtccaggcaggggtgcggcagctcagcaattccggtgacggtgtgcccggccgcgatcagctgcccagcgaccagccgcccgagtgcgccggtggcgtcggtaaccaggatgtgcacctgggctcacctcccccaaccctcagcactcaacaataggcaaataggcactggctacgcgaccgtcggtccggtaacggttcgatgaccggcggtgacgccggcgccggggccggggccactgccccgggctactgcagcgtcgcgctgccgtcggcggcgacggcgaccttggcgccaccgatgtcctcgcgcacggttgcctgcgcggcggcgcgatcggtgacgacggccagggcgcgcgacccgtccggggtgcgcaccgccaggaacgccttctccggctcaccctcgcggtcgtggggcgtcgtccaggcctcaacggtgccgacgccctcccactcgaccgccgcatcggtcgtcggctcccggtcgacggccgattgggtgtcctcccaacggaattcggccggcggttcggtgccgtagacgccgaagctgtgcttggtcaggtagccgccgttggcggtgatcaaaccgcgccgcccgggattggccaccagcaactcggccatggtggcgatggagtgcatgacgtagttgctccacggcccgcccgcaaacgtcagcccgccggtcaccgtgagcggtcgggcggggtcgtcgaggcccagcccgagttcggccgccgccacctgcaccgcggagggaaagcacgagtacaggtccacgtggtcgacgtcgtcgatgcccagcccggccagttgcagcgcccgggcgccggcgatccggatggccgccgagcggtgcagctcgtggcgttcggcgatggacgcggtgtcatgcgcatccgtgcccgccagcgggtagacccaccgctcgggcgggaccttcagccgtcgcgcctgctccaccgaggtcagtacgagcgccgcaccctggtcgaccatgttgttggagttcatcaacttggtgtacggccagctgatcatccggttgtgcggccccgcccggcagatgtcgtcggcgctgtgcggggtgcggatccaggcgtgcgggttgtccaccgccaccgcgttgaaccgcgcccacagccgcccgatgcgggtgaggtggtcctcgaccgactcgccggtggccacccgcagcgcctgctcgaacagggggtagacgtaggccggccggtccagggagatcctgatctcggcctcgccggccatcgccacgtcttcgccgctgacctcggccatcggcaccgagcggtcctgctcggtccagaccagtttgccgcccttggcccgcaatccccgtcgggtgcgccaggtttcggcgccggccagcagcaccacgttggcgcggccccgctggatatccaggcatgcctggttgaccagcgattgcggcacgttgccgccgaccggggtgtacagcgtgccgaagtcgcgggcgccgatgcgctggccgagcagcagcccgggatcgcgatactgcgccgagaggatgttgaccacccggatggaatccaccgcctcgatcaccgcggcgtcggcggcccgctcgacggcggcggccatcaggtcgacgggctcgacggagcgcaccgccgggtcgatgtcgtcgcgatggttgacctggccgtagccgatcagcgccggggtgcgggggtcgacggtcatgcaacgaatttagcgtggctatgaatccggccgggccgtcggccccggcgccggaccggccgggtcggcgggcccgaacagcacccgctcgtcgatcagccgccgaatgtcggcggtgttcatgcccagcaggtcgcagcagatcgccacggtgtcctggccgggcagcggcgccggggcctggcgggccggcgggatgtggcgaaacggcgccgggccggtctcggccggcagcgggttgtcgatcagcggatgccgcatcgggcggtagaggttgcgggcgatcagctgcgggtcctccaggatgtccggcgggcggttcatcgggccggccggcaccgcagccgcctgcagcagctcggcggcccgcaccggcgtgcgggtgcgggtccacgccgagaccagctccaccagctcgcggcgatgggccagccgcgcctccgcggtgccgaagcgggggtcgtccgcccattcggcgtggtcgaaaaccgaagcggcgcgccgccattcgtcatccgaccggatcgagatgacgcaccactcgtcgtccccggcgcaagggtagaccgcgtgcaggccggtgtccgggcggatctgggccacaccggcggccagcgcagcctgcgtgacatacagcgtgtcgagctggttgaccaccacctcggcctgcgagatgtgcacgtgggctccggcgccggcccggtcgcggtggatcagggcggccagcgccgcgatcgcggtgacccgccctaccacgtgatcggggaagatcgtcgtcgcgtcgtagaacgcgtgccggccgtcgtcgtcgtgttcccgcgcatcgtcggacgtccacaaccgggtcaccccggtggtggcgcgcaccagggggccgtagcccatccgggtgctccacggcccgatgtcgccgaaggcgctgctttcggccagcacgatccgcgggttgatcgcgcgcagctgttcgtaagaaaaacccagtgcggcaagggttcccggtttgaagttggcgaacaccgcgtcggcctcggccaccagccgggcgaagatcgtcttgccctgcgcgctgcgcaggtccagtcccagcgcccggttgttgcggtgcgtccaggcgaacgactcgctcatggcctcgccggcgcgggcctggcgcagcccgtcggggtagtccgcgctctcgaccttgatgacgtcggcgcccaggtcgccgaacagccggctcagctcgccgccggcgacgatgatgcccaggtccaggatgcgcaggccggcgaagggatggtcgccgagccggcccgccggcgacggcaccaccgacggggcgccgcgccagtacggttcgtcctggccggcggcgggcaccggcgcgcgaaagcccgcgcgccggccgtcgacgacgaaatatccgctcggcacggcggtgtgcacgccggggacgagttcggcgtcggtgatggcgcccaccgcctgaaagtggtcggatcccaggatctgcgacggcgtcagcaccgcggcgatcggaaccccgtgcgcctggccggcggccaccagatccttcatggtctgcccggcgaacagcttctgcagcagctcgctgatctgcggccacaccgcgaaccgcgcgccgatcacgtcgtacttgggatcctggaagtcctccggctcccccagccagcggcgcagcccgtgccattgccgcggcgccatcacgcacagccggacgtagccgtcctggcacggatagatcgggtaggcatcctggttcttcggccggccccgccaccgcccgctgcgccggatgccggcggcggcctgcccgtgcgcgccgaacgccgggtcgagcgccatcacgacggcatcgaaccacgagaagtcgatgtaatcgcccgtgccacaacgtaatcggttgtagtatgcggcgagtgcggcccatgcagcctgaacggccgcggttgccgacgcgatgccgtccggcggcaacaccggagtgccggtggtggggccggatcgcgacagcgccccgcacatcgcatacagcaccggatcggtggcgcgccacgacgagcgcgggccggtggcgccgaaatcggtgatcgacagcaccaccaggtgcgggtagcgggcggccagctcctcggcggaggtgccgaacatggcgccgcgctcgtcgacgccggtgtccaccacgatgtcggcgtcggcggccaggtccaggaagcgggcgcagtcctcgtcgtcgaacgggtccagcacggtgctgcgcttgttggcgttgtgcacggcgaacggaatgctggcgccgcgcagcgtgggcagcgcgtcacgccccaggcagccgcccggcggctcgaccttgaggacgtcggcgccgaggtcggcgaacagccgggtgaccgcgtcggcgacgccgttcgacaagtccaggacgcgcacggcgtcgagcaaccggtcggccatctgcacaccgtacccgcctggtcaggccgccgcgcggcgggcgttgagcgcgccatcgggataccgcgccggcccaaaatgccgggcgggcaagctgtttcggcgcgcatccaccctgcgccgctcgccgcggcgggcggtcggctatcgtcacaggccgatccgcgacctgtcgtccgatggaggcatccccttatgaccgcgcacctgagctacgtcgaggccgtggtggtcggcgccttccagggcgtcaccgagctgttccccgtctccagcctcggccacgcggtgctggtgccggcgctggtcggcgggcgctgggcgcaggacctgagcgtgtcggcccaccgatcgccctacctggcgttcatcgtgggcctgcacgtggccaccgcggccgcgctgctggtcttcttctggcgcgactgggtgcgcatcctggccggcttcttctcctcgctgcggcatcgccgcatccgcacccccgacgagcggctggcctggctgatcgtggtgggcaccatcccggtggggctggccgggctagcgctggagcagctgttccgcaccaccctcggcaagcccgtcccggcggcggccttcctgctgctcaacggcgttgcgctgtatgccggtgaggtgctgcgccggcgcgtcgcgccggtggcggatgagcccgcggtgcccgacgcggagcagcaacacggcgacgaggcctccgacaaccgcctcgcccaacttccgctgcgccgcggcgtgctgatcggcgccgcgcagatcctcgccctgctgcccggcatcagccgctccggcatcaccatcgtggccgggttgtggcgcggcctgtcgcatgaggacgccgcccgcttctcgttcctgctggcgacgccgatcatcctggccgccggggtgtacaagatcccggagctgttcgggccgctcggcgccgggatcggtgggcaggtgctggccggcagcatcgcctcgttcgtgtgcgcctacctggcggtgcgctatctcacccggtacttccagacccgaacgctgacgccgttcgcgatctattgcgccgtggccggcggcgccagcctggtgtggctcgcgctgcgctgaccgggggccaccgaccggccgcttgttgcgcgggctgacgccgagtgctgtgcttagcccgtcgatgttgacacccgtcaagaatctggagggcagatggcagacaccgcttcgatcgggctgaaggtgcgggacaaggtcgtcgtcatcaccggcggggcccgcgggatcgggctggccaccgcgaccgcgctgcacaagctgggcgccaaggtcgccatcggcgacatcgacgaggtgcgggtgaaggagtccggcgccgcgctggacctggacgtctacgggaagctcgacgtcaccgacccgcactcgttctccgatttcctcgacgaggtcgagcgtcagctcggcccgatcgacgtgctggtcaacaacgccggcatcatgccgcttggccgggtcgtcgacgagtccgacgccgtcacccgacggatcctggacatcaacgtttacggcgtgatcctgggcagcaagctggcgctggcgcggatgattccgcgcgggcggggacacgtcatcaacgtcgcctcgctggccggcgagacttacctggccggggcggccacctactgcgccagcaagcacgccgtcgtcggcttcaccgatgccgcccgcatcgaataccgccggtccggggtgacgttctcggtggtcaagccgacgttcgtgaacaccgaactgatcgcgggcacgtcgggcgccaagggcgtcagaaacgccgaaccgtccgacatcgccgacgcgatcgtcaagctggtggcccacccgcggccccgcgtgcgggtgaccagaaccgcgggcgcgatcatcgcctcgcagaagttcatgccgcgcgcgctgtcggagggcctgaaccggctgctcggcggcgaacacgtcttcaccgacgccgtcgacgtggaaaaacggcaggcgtacgaggcgcgggcccgcggcgaacagtagccggggacgagcattcttcaccgaaggcgcgcagaatcggctcggtgagcctagaaacctcaaccaccacgcccgccggatctccgctctccgaccgcgaactggacctcatcgacaagtattggcgcgccgccaactacctgtcggtggggcagatctacctgctggacaacccgctgctcaaagagccgctgagcgccgagcacgtcaagccgcggctgctggggcactggggcaccacgcccgggctgaacctcgtctatgcgcacctgaaccggatcatccgcaaccgcgacgccgacgtcatctacgtgaccggaccggggcacggcgggccgggcctggtcgccaacgcctatctggaaggcacctacagcgaggtgtacaccggcatcgaagaggacgccgagggattgcgaaaactgttccggcagttctcttttcccggcggcattcccagccacgtcgcggcccagacgccgggatcgatccacgagggcggcgagctgggctacgcgctggtgcacgcctacggcgccgccttcgacaacccgtacctggtggtggcctgcgtcatcggcgacggcgaggcggagaccgggccgctggccgccggctggcactccaacaaattcctcaacccggtgaccgacggcgccgtgctgcccatcctggcgctcaacggctacaagatcgccaacccgaccgtgctggcccgcatcccgcacaccgagctggaagcgctgttgcgcggctacggctaccggccgatcaccgtcgccggtgacgatccgaccgacgtgcaccgtcagctggccgccgccctcgacgaggcgttcgacggcatcgccgccatccagggcgcggcgcgcggcggcggtgaggtgcagcggccggtgtggccgatgatcgtgctgcgcacccccaagggctggaccgggccgaaggtggtggacggcaagagggttgagggcacctggcggtcgcaccaagtgccgctcgccgagacgcacgacaaccccgaacaccgcgcccagctcgaggagtggctgcgcagctacggtccggagcagctgttcgacgacgacgggcggctgcgggccgagctgcgggcgctggcgcccaccggtgatcgccggatgagcgccaacccgcacgccaacggcgggctgctgctgcacgacctcgacctgcccgacttccgcgactatgcggtgccggtgtcccggccggggtcggtcacccacgaggccacccgggtgctgggcaccttcctgcgcgacgtgatcgcccgcaacaaagaccggttccggatgatggggcccgacgagacggcctccaaccggctcgacgccgtctacggcgccaccgagaaggtgtggttgtcggcgaccgagcccgacgacgagcacctggcgcccgacggccgggtgatggaggtgctgtccgagcacctgtgccagggctggctggagggctacctgctgaccgggcggcacggcctgttcaactgctacgaggcgttcgtgcacatcgtcgactcgatgctgaaccagcacgcgaaatggcttgcgaccagccgggaattgccgtggcggcggcccatcgcgtcgctgaactacctgctgacgtcgcacgtgtggcgccaggaccacaacggcgcctcgcatcaggaccccgggttcatcgacctggtcgccaacaagcgcgccgagctgacccgggtgtacctgccgccggacggcaacacgctgctgtcggtggccgatcactgcctgcgcagccgcgactacatcaacgtgatcgtcgcaggcaagcagcccgcgctggcctacctggacatggacgccgcgatcgcgcactgcacccgcgggctgggcatctgggactgggccagcaccgcccgatcgattggcgccgaacccgatgtggtgctggcctgcgcgggcgacatcccgacgctggagacgctggccgccgccgacatcctgcgccgggagctgcccgacctggcggtgcgggtggtcaacgtcgtcgacctgatgcggttgcagcccgactccgagcatccgcacgggctaccggaccgcgaattcgacgcgctgttcaccagggaccggccggtcatcttcgcctaccacggctacccctggctgatccaccggctcacctatcgccgcgccaatcacgcgcagctgcacgtgcgcggcttcaaggaacgcggcaccaccacaacgcctttcgacatggtgatgctcaacgacctggaccgcttccacctcgtcatcgacgtgctcgaccgggtggaggggctggccagtcgcgccgcgatgctgcgccagcgcatggtcgacgcccggctcgccgcgcggatgtacacccgcgagcacggcgaggacgacccggcaatcgccaattggacctgggaaccgagcgagcggaactcacgtagtgagtgacgggagcgagacgacccattgaacttgggagcctagcggctgagattcgcgtgacggcaatcgcatgccccctcgcgccgttggccgccggtaaactggccggatgcgtgacgccaccgcgacagccgacctgcaggcgtcccagccccccgggttgcaccggttccggatccatctcgacatcgccgtcgtcgtggtggtgctggtcctgaccaacctggtcgcgcacttcaccacgccgtgggcgagcatcggcaccgtccccgccgccgccgtcgggctggtcatcctgatgcgctatcgcgggctgggctgggccgacctcgggctgggccgtgaccattggaaatccggagtgggctatgcgctggccgccgtggcggtggtggccgcggtgatcgcgatcggggtgctgctgcctgcgacccggccgatgttcatgaacaaccgctacgccaccatctccggggcgatgatcgcctcgatggttgtcatcccggtgcagaccgtcatccccgaggagctggccttccgcggcgtgctgcacggcgcactcaaccgggcctggggcttccgcggcgtcgccctggcgggttcgctgctgttcggcctgtggcacgttgccacgtcattcggcctgaccagcggcaacgtcgggttcacccggctgttcggcggcgggatggtgggcatgatggccggggtgaccggggcggtgctggctaccggggccgccgggttcgtgttcagctggccgcgccggcgcagcggcagcctgatcgcgcccatcgctctgcactggtcactgaacgggctcggtgcgctggcggccgcgttcgtctggcatctgtccacctgagggccgaggccgctcagaccagcagcaccgccgcaccggcgatgcgcccggcgctcagatccgccagcgcccgatccgcttgtccgaggggatattccggcgtggtgacgctgatgtgatgcgtgcccgcgaagtcgaggaaggcccgcgcgtcggcccgggtgttggaggtgaccgaacgcacctggcgctcctggaacaggtggcgctggtagttcagcgacgggatgtcggacaggtgaatgccggcgatcgccagggtgccgccgcggtccagcgccgccagcgcgggcagtaccagatcgccgaccggggcgaacaggatggcggcgtccagcgggacgggcggcgggtcggcggcgccctgcgcggaggcggcgccgagttcgatcgccagctcgcgggcccggtccccgcgggtcatcacgtgcacctcggcgccctgcgccagggcgacctgcgcggtgatgtgcgcgctgccgccgaaaccgtacaggcccaaccgtccgcccggcggtagctgggcgcgcagcagcgcccggtagccgatgatgcccgcacacagcagcggcgcgagctcgctgtcgctataaccgccgggcagtgggtgcgcgaaagccgctggcacggtcgcgaattcggcgtatccgccgtcggcgtcccagccggtgtagcgggactcggggcacaggttctcgtcgccgcgccggcagtatttgcacaccccgcaggtgtggcgcagccaggcgatgcccacccggtccccgacgccgaactcgtcgccggcctcggcgccgacttcgatgacctcgccggccacctcatgaccgggcgtgacccggtcgcggtgcacgggtaggtcgccctcggtgacatgcagatcggtgcggcacacgccgcacgcacgcaccgcgaccagcaggtcggacggcccggggcgcggcacctcggtggtcacttcctcgagcggatgagtgtccatcggaccgggccgacgcaccctccaggcgcgcatcgccgtggtggtcaccggagaagacatcaccccatcatgccgctaaccaccacggccgcaacgggttaaggcgattacgtcctgcgcaccatgccgacgatccagagcaggatcaccgaaccgagcagcgcggtgaagaaggtgaagatgagcccgccgcccgcggtgttgacgaagaagctcaggatgaagccgccgatcagcgcgccgacgatgccgatcacgatgtccatcaggatgccggcgccgctgccccggacgatcttgctggccagggcaccggccaggccgccgatgatgatgtagccgatgatgccgacgctggtcagcgtggtggagcgggccaggtattcggtggcagcagtgacgtccatgaggatctcctcgcaatcgctggcaaagcccagctgtttgctgggccgtcacttcggtatacccagtttgggtcacgaatcgagtgacgaatcggcgacggttgatcaaccggttgccgacgcgacggcccggactcgtcggtcgctcaggccgagagggtctgctgcggtgtcggtgtgggggtggggctgacctcgacggccggcgcctggcccggtgccggcgcgccgggtgctgccggggcccccggggctgctggagccggagccgccggtgcgccaggagccgccggcgtgcctggagcccctggagccggtgcccctggtccgcccggagccgccggcggggcggccggcggcgtccacgcctggatcgactcggcgagcgccttggccgcgaccttgtccaccgggtcgttcgaggtgcccagccagacgacgaaccagcgttgcgcgttgccgccgttggccgaaccgatgacgccggtccagatctgaccgttcggcttggacgcgtcgctgaatttcacctcgtagtacgacgcgctgccggtgcttccgttggcgccgttgagcggggtgctgtcctggttgatgcgggtgccgggatagggcatgaagaactcccccatgtccgagcccagccgcaccgcggccttggcgttgttggcttccgcactggcgtaaagcttttggtcgagacggcccatcacgatgcgggtgtcgttggcaaccgggggcggctggtcgggcatcggcggcgggccggtgaccttgctcagcagcgccgagccgtagtcgaggtgagacgcgtcggactccacccagccggcgggcagcacgtagctgaacccgccgacggcgttggggatccgcccggcgttcgggtcggccggcgggggcggcggcgcgttcgggtcgacgggcggcggtggtgccccgttcggcggtgcccccaccggtggtggggccgcgttgggatcattcggcgccggcgcggcgggcgccggttgcccgttgggcgccggggcgccgggtgccggttgcgcgttgggtgccggttgcccgttgggcgccggcgcggcgggcggggcggtcgccgtgctcggcgggaccggggtcgggacctcgggatcggcatgcgaggtcgccggcaacgcgatggcgacggcgctggcgccgctcaccgtggtgatcgccagcgtcgtccacagtcctttgcggcgtgtcgaggtcgcttccacctgatccatggcgacgaacctaccgtgttaccgctgtgacgcaaggagcattgcggactaatgcagtgcggtttcactgatgttgccaatgtgcaatctgcggagcgcgcccgcgccgggcgggcgccgttcagcgttccgccgcggccgttgccggatacagcaccacttcatgggctttgaccgagaaccacacccggtcccccggcgtcaaccgcaattccgaagcggcgtccacggtgatctcggccgccagccccggcgcgccgtcgggttgctgagcgccgcgcaccaacaccgccgccccgcgcacgtccatctcggcgaccgtcacctcgacggtgttgcggggactgccgtgcggctgctcgcgatagacggccaccgccgtcggcgggaaaaccgcgacggcgcgctggccggacgcgagcgggccggcgggcgccgccggggcggcataccagcgggcaccggagcgcgcgagcagggcaccgtcgccctcggcggtcccgttgaccaggttcacccccgcgacccgggccgcgaaatgactgcgcggcgcggtcaaaacgtcggccaccgggccgatttcggcgatcctgccggattcgagcaccagcacccgatcggccaacgtgaacacgtccagtaggtcgtgggtgaccagcatcgccgcgcagccgatgcgggtgacgaccctgcgcagcaccgaccggatcgccgcggccgccgcgacgtcgagaccggccaacggctcgtcgagcagcagcacgtcgggttcggcggccagcgcccgcgcgatcgcgacccgctgcgcctgcccgccggagagttgtcgcggttttcggtccgcgagcgtctcggcgtccacctcccgcagccagcacaaggcggtggccttctccgcccggcggccccggcgccacatcggccggcgactgtgcggcccgaacgcgacgttggcggcgacgctcatatgcgggaacagcaaggcgtcctgcagcagcagtccgacccggcggtcgtgcgtcggcacgtcgatcccggccgcggtgtcggtcaacacccggtcccccagccgcaccagcccacggtcggggcgcaacagcccggcgatgacgtgcagggccgtcgacttgcccgcgccgttgggacccagcaccgccagcacctccccggcggccaccgagaactccacctcgaagcgccgttgcgagacgaccgcgcgcagctgcaattcgctcatggccggcggctacctggcgtcggtcccggtcagccggcgagcgcccagccccagcaccaccacggccgccaccaccaccaacaggatggacagcgccacggccgcgtcggcgtcggtcacccgctgcaggtagatctccagcggcagggtgcgggtgacgccctgccgtgatccggcgaaggtcagcgtcgcgccgaactcacccagcgagcgggcgaacgccagcaccgccccggacacgacaccgggcaacagcagcggcagggtgacgcgccaccagaccgtggtgggtcgcgcgcccagtgtcgcggccaccacctcgaaatcggcgcccgcggtgcgcgccgcgccctcgagcgagatcaccagaaacggcagcgacacgaaggtctgcgccagcaccacggcggtggtgctgaacgcaacgctgatacccgcggcttccaggtagtgccccagcagcccgagccgaccgaacgcatacaacaacgcgatcccgcccaccacgggcggcagcaccaacggcaccaggatcaggggccgcagcaaccggaccagccgcgtcccgccgcgcgccagcaccagcgccatcggcacccccagcgccacgcacagcgcggtgctggcggcggcggtcctcaggctcagcagcagcgccgtgcgcgacgacgggctcgtgatcagccaccagaagtgcggccagtccaccttgaccgcgatcgccaacaacggcagcaccacgaacatggtcccggccgccgcgggaaggtacacccagcggggcagcgccgtgccgcgtctgctaatgcctacccctttgcctcgtctgcctcgttcggcccgccgacgaataggtggggccgccggttattcgctgcacagcatgtcaggtacggccgagacggacgaaagaggacctccgggggtccgacgcggaccggcgccttattagccggacgcgagcaccccattggtctcgtctgctgacgcattttcccgcgcggcgcggcgagcgcgattttcccggagtgcttgctgtgcggactccagggtgatcttgcgcggatcgaccccttcccgcttgaagccttcgacggcaatcggcaagtacaggaacttcagcgggacaacacgctcgagaatcgcgtacagccgtcgatacatccgcatgaagcggcgcgcgatctcctcgtcctcgggggtccactccaaattgaacagctcctgcacgtggggcgggaaactgttgacgacgacttgccgccgacccgccacccagggccacacgaacttcttcatgaccggaggccaccaccgcggcggcacgcggcgctccatgaattgctccagcatgacctgggtcacctgagaattcaccaaatgattgcgctcgatgttgtccagataccgctcgaaatcgtcgtaggtggccggctggggactgtcgtccaccccccacatgctgtaccactccttggattcctcgaatatctgctccttcatcgcacgcggcatggccccgtcgaaatacagctgctcaaccaccttgagcaacagatgatagaaaaaggtgacatgcccaaaatagaaggtgtcggcgttcaacgcatgaaaggtgccgtcctgcagggtgcccttgatggacttgtgcatgttccgagtcttcaggccgtatttcttcgcatcctccggcgcgtcgtacaccgtgccatagatgtactcacgagatctctgacgccgtaccttatatatcttggagcgtgcaccgaacgaactgtcaccggtaaaaagaacggaactcgacgtcgctttcgccatctgcggccacgccccggcaatggtgcccacgactccactgccgaaaaagatcacatcaagccgtccccaatacttccatgtcagggaaccagggggaattggatgctgagaaaggtctttccgcgacaagctgttgtcgccggtgaattccgtaaccctggcttcgtccggaacgaccagctccggatcgaatgttgtctgcatgattttcttgagtgccctgatgccacggaccgccatgccgaactcccttgcgttgccggtacccgctacttggttaacccagcggcgcaggaagtttgaccgcgcgacaatgcggtgatcgaaggtcctcccctgccacggtcaggatgctagcgattcggctaagcccgcgcggtcgattcgcgaggtcgtccgcaaatatgcaacgcgaagagggatcgcgtgggaaatatgaggtgccgccggcggcgcgcaatcgcaggaatttcggctttgcccttggcgccgtgcgcggtcagggtttggcgaagccggcctgggccaggatctgctgcccgggcggggaggtcaccaggtcgacgaaattccgcgcctgggtggcaagcggcgcctgcttcaacacaccgatcgggtacacgttcaccgcgccggcggcctccgggaagttcaccgtcgccaccttgctccccgcggtcctggcgtcggtgacgtagaccagcgcggcgtcggcctggccgctggtgaccttggtgagggcgtcggtgacgctgggctcctcgctgacggggttgaggtgcacgccggtgctgtcctcgacgcggtgggccgccgccccgcagggcaccggccgctggcaggtcaccacggtcagcccgggcctcgtcaggtcggcgaacgacccgatccgcttcgggttgcccggcgcggtgacgatgaccagggtgttggaggcgaagttcgtcgggtcggcggcgagcaggcccgccttggcgacgacgtccatctgcgcggtgtcggccgaggcgaacacgtcggccgtcgctccctgggtcagctgggtggccagctcggaggagccggcgaactcgaattcgattccggtaccggggttttgggccttgaaccgctcggcgatctgggtgaacgccggtcgcagtgacgcggccgcgaacaccatcagtttgcccgcggtcggcggcggctgggatttggagccacacccggtcataccggcaatcagcaccaccgacagcaacccggtcaggatcccgatccgccgcatggaagcaccctagcccgccgctgatgcgggccgcgtggcggtgctgcctccgcaaccaaggcacaagacagcggtgcccgagccgtcccgaaatagttatccaaatgttccgcgcgtcgcggcggtcggaatttccccgactagctaccgtccagtaacatatctggaactgatgccatcacgcgctgggatctcaggccgttgacgggggccgcggtgttgctaccgcgccgaaccgccagcgcccgggttcccggttgaggacgaggaggtcatggcggtggaggtgctggttaccggcggagacaccgagctgggacgcgcggtggccgagggcttccgcgacgacggccacaaagtgaccctggtgggtgcgcgcaagagcgatctggagatcgccgccaaggagctcgaggccgaggcgatcgtctgcgacacaaccgacccggccgccctggaacaggcccgcccgcttttcccgcatcacctggacaccatcgtccacgtgccggcacccagctgggaggccggcgatccgcgcacctactcgatcgccgacacggccagcgcatggcgcaatgcccttgacgcgacggtgctttcggccgtgctgacggttcagaccgtgggcgatcacctgcgctcgggcggctcgatcatcagcgtggtgccggaaaacccgcccgcgggcagcgcccaggccgcggtcaaagcggcgctgtcgaattggacgacgggacaggcaagcgtgttcggcacccgcggcatcaccgtcaacgcggtggccagcgggcgcggcgcccagccgggctacgacgggctctcccgcagccccgcgccggtggccgcggaggtcgcgcgcctggcgctgtttttgaccagtccggcggcacggcacatcaccgggcagaccttgcatgtcagccacggcgcgctggcgcatttcgcctgaggcgtaacgccgcacccttctcgccgaccggcccgatcgttacggtgatgaccgtggctatccgacttggtctgcagattcccaacttctcctacggcaccggcaccgaacagctcttccccaccgtcatcgcccaggctcgcgaggccgaatccgccggatttgattcggttttcgtgatggaccacttctaccaactgccgatgctggggtcgcccgatcagccgatgctggaggcctacaccgccctgggggcgctggccacggccaccgagcgggtccagctgggcaccctggtcaccggcaacacctaccgtaaccccaccctgctggccaaggtcatcaccacgctggacgtggtgagccagggccgcgcgatactgggcatcggcaccggctggttccagctcgagcacgaccagttgggcttcgaattcggcaccttcaccgaccggttcaatcggctggacgaggcactggagatcatcctgccgatgatcagaggcgagcgggcaaccttcgagggcaagtggtaccgcgccagcgatgcgttcgcgaacccccgctaccgggaccgcattccgctgatgatcggcggcagcggcgagaagaagacgatcccgcttgccgcaaggcatttcgaccacctcaacgtgatcgccgggttcgacgagctgccccgcaagctggacgccgtgcggcgggcctgcgaggaggtgggccgcgatcccgcgaccctggaaaccagcactctgaccacggtgatgatcgacgacaacgcgagcctcgatcagatccccgccgagatgacccagcgcatggtggtcggcaacccggattcggtcgccgaccagatcaagaccaaggtgatcgacgccggaatcgacagcgtgatcatcaacctgcccttccacacccccggcatcgtccaggccgccggcgaagcgctgcgcccgctcgtcggcgcataggcgttgaggccggagcacccccgagtcgcggatccctcgcggcgcggcgatacttccgttagcagcgttcacctgcgccacaaccgcgcagcgcggaagtaaagccgggaaggccatgaccaaacgagcatcggcggcggcgatcgccgtcggggtggcgttcgccccgacggccgtcgcgcatgccgacaacaacgggatcgcgatggccatctccgattccaccgggcacatcagcattgccgacggcgccgcgagccagggcgcggcggagaaggcggcgatggacacctgccgcaagagcatcagcgactgccgcctgctggccagcggccagggtggctgcatggcgctggtgctgaacgcgtcgaaatccaaatacttcggggcctgggggccgacccgggaggaggccgaggcggcggcgctggcgcgggtgcccggcggaacggttcaagagggccacgaccattgcgcgggagaaggttcgccgcaataacggcggggtgattcgtcgactgataacttcgccacaccgtgcgctgtcgacctggagtgatactgctggtgtggttgattacacatgttgtgagttaggtttcggggtattcgcctgactagcgtggtggctgagtgcagtcgcgcgtccagaagcccccgtcaggagcagcggaaacatgagcccccattcaggaagcacagctggacccgagcgtcggcatcaagtcgtcatcatcgggtcagggttcggcggcctgaacgcggcgaaaaagctcaagcacgccaatgtcgacatcaaactgatcgcccgcaccacccaccacctcttccagccgctgctgtaccaggtggccaccggcatcgtgtccgagggcgacatcgccccacccacccgggtggtgctgcgccggcaacgcaacgtgcaggtgctgctcggtgacgtcacccacatcgacctggccggcaagttcgtcgtctccgacctgctcggccacacctacgaaactccttacgacactttgattgtcgccgccggcgcgggccagtcgtatttcggcaacgaccatttcgccgagttcgcgccgggcatgaagtccatcgacgacgcgctcgaggtgcgcgggcggatcctgagcgcgttcgaacaggccgagcggtcccgcgatccggaacgacgggccaagctgctgaccttcaccgtgatcggggcgggccccaccggcgtcgaaatggccggccagatcgcggaattggcgacctacacgctcaagggctctttccggcacatcgatccgaccaaggcgcgggtcatcctgctcgacgccgcgcccgccgtgctgccgccgttcggcgacaagctgggcaagcgcgccgccgatcggctggagaagatgggggtggagatccagctgggcgcgatggtcaccgacgtcgaccgcaacggcatcaccgtcaaggactccgacggcaccgtccgacgcatcgaatcggcctgcaaggtgtggtccgccggcgtatcggccagcccgctgggccgcgacctggccgagcagtcgacggtcgagctcgatcgggccgggcgggtcaaggtgctgcccgacctgtccatccccggccaccccaacgtcttcgtgatcggcgacctggccgccgtcgagggcgtgcccggcgtggcgcagggcgccatccagggcgccaagtacgtcgccaacacgatcaaggccgaactgggcggcgccgatccggccgagcgggagccgttccagtacttcgacaagggctcgatggccacggtgtcgcgcttctcggcggtcgccaagatcggccccctggaattcagcggcctgttcgcctggttcgcgtggctggtgctgcacctggtgtatctggtcggcttcaagaccaaggtcagcaccctgctgtcctggacggtgaccttcctgagcacccggcgcggccagctcaccatcaccgagcagcaggcgttcgcccgcacccgcctcgaacagctggcggtgttggccgccgagaccaagcggcccgcggcccggcgggccagctagccgcccggccgtatcggccaaacccgttgcagcacaacggccttcagtgaaccccgggctaagtcgttgcccgccagcatggttcgtggggttttcggcgcgcgccgatcaggtattgcgaacctcgagattctgcagccgcacttggcctcgggcgacgacgcggtcgtcgtcgtcggtgatggtgaccaaccacagctgctggctgcggccccggtggatgggctcgaccacgccgtacaccgtgcccgagccgatggaacgcaagaagtcggtgttgttgttgacccccaccacattcccgccgccgcgggtggccagccaggtgtaggcggccacactggccatgctttcgatcatcgagcagtagacgccgccgtggacgagtcccatgggctgcaacaacttcggggtgacttcgagccgggcgcgggcgccgtcggggctgagttcggtgaactgcagcccgatctcgcggtcgaagggtgcggaaaagtcgggcgggatgatcgcttcctgcggctctgacacgctcccgtgtctacaccatcgcccgggcgggccggcgcggcgggacggcgatgtcgccgataccggccccagaaacggctgagccccgtgcacagggcacggggctcgccgatcgagtagaccgggggtcactgcagccctcaggactctcacgcggtccgttatcgctcgacgggattagaataggcaaggctgccctaacttcgcaaggggtattgttcaacttgtccgggaaagtcccggaaagtcccgggacgcaccggaaagccccggaaaacccccgggatccggtgcggatccggtgccggccggtccgggcctgtgccgcccacggtggccggcacaggcatttgtctgcgttccgtacgaccgccggtagtaagccggagtacgctggtttcgacgctcaggagatggaacgaactatggccaaactgacacggctgggggatctggaacgggccgtcatggaccacctgtggtccacccccgaacctcagaccgttcgccaggtccatgaggcgttgtcggcccagcgtgacctcgcttacaccacgatcatgaccgtgctgcaacggttggccaagaagaacctggtgtcccagatccgcgacgaccgggcacaccggtacgccccggtgcacggccgcgacgagctggtggccggcctgatggtggacgcgctggcccaggccgaggactcgggcagccggcaggccgccctggtgcacttcgtcgagcgcgtcggcgccgacgaggccgaggcgctgcgccgcgcactcgccgaactggaagccaatcaacgcaataacccggcatctgctggcgccggcccggagggctgagggacactaacagggtgtccgccctggccttcaccattctcgcggtgctgctaaccggcccggtgccggcgatgctggcccgcgcgcgctggccgctgcgcgctccccgcgccgcgatggtgttgtggcaggccgtcgcgctggccgcggtcctctcggcgttcagcgccgggatcgccatcgccacccgggtgctggtgcccggtcccgacggccggcccaccaccagcatcctcggcgccgagggccgcctcgggtggccgctgtggacggcatacatcggcgtcttcgcgctgaccgtgctggtcggcgcccgattgatggtcgcggtggtgcgggtggccatcgccaatcgccgccggcgggcccatcaccggatggtcgtcgatctggtcgggatgggccacggcgccgcgctgtcccagccctgcagccgcacccgcgatctgcgggtgctggacgtcccgcaacccctggcctactgcctgccgggagtgcgcagccgggtggtggtcagcgagggcaccctgagcaccctggccgacgccgaggtgtccgccatcctcacccacgagcgggcgcacctgcgggcccgccacgacctggtgctcgaggcattcaccgcggtgcacgccgcgttcccccggctggtgcgcagcgccaacgcgctgggcgcggtgcagctgctggtcgagctgctcgccgacgacgccgccgtgcgcgccgccggccgcgctcccctggcccgggcgctggtcgcctgcgcatccgggcgggcgccatcgggcgcgctggccgccggcggccccagcaccgtggtccgggtgcgccggctcggcgggcgcggcaacagccccctgctctcggcggccgcctacctggccgccgcggcggtgttcgtggtgcccaccgtcgccctagcggtgccgtggctgaccgagctggaacgcctgctcaacctctgacgccgccgggaccggtcacccggtgatcgggcgctgtgccacagtgtcaccgaaagctttttgccgagaccccaattgagaggcgaagacatgagttcgtcggttaccccgtcgcgtcccaccaccggcaccgcccagatcggcgtcaccgggctggccgtgatgggttcgaacatcgcccgcaatttcgcccggcacggttacaccgtggcgctgcacaaccggtctatcgccaaaaccgacgcgctgctgaaagagcacggcgacgagggcaagttcgtgcgctgcgaaaccatcgccgaattcctcgacgcgctggaaaaaccgcgtcgcgtgctgataatggtcaaggccggcgaccccaccgacgcggtgatcaacgagctcgccgatgccatggagcccggcgacatcatcatcgacggcggcaacgccctctacaccgacaccatccgccgggagcaggcgatgcgcgaacgcggcctgcacttcgtgggcgccggcatctccggcggcgaggagggcgcgctcaacggcccgtcgatcatgcccggcggcccggccgagtcctaccggtcgctgggcccgctgctcgaggagatctccgcgcacgtcgacggggtgccgtgctgcacgcacatcggccccgacggggccgggcacttcgtcaagatggtgcacaacggcatcgagtactccgacatgcagctgatcggcgaggcctaccagctgctgcgcgacgcgctgggcaagaccgccgagcagatcgccgacgtgttcgacgaatggaactccggcgacctggacagcttcctggtcgagatcaccgcgcaggtgctgcgccagaccgacgccaagaccggaaagccgctcgtcgacctcatcctcgacgaggccgaacagaagggcaccggccgctggacggtcaaatcggcgctggacctcggcgtgccggtgaccggcatcgccgaggcggtgttcgcccgcgcgttgtcgggctcggtggcccagcgcagggccaccaccgggctggcgtcgggccggttcggcgaaaagccaagcgacgcagcacagttcaccgaggacatccgccaggccctgtacgcgtccaagatcatcgcctacgcgcagggcttcaaccagatccaggccggcagcgccgaatacggctgggacatcacccccggcgacctggccaccatctggcgcggcggctgcatcatccgggccaagttcctcaaccggatcaaggacgccttcgacgagaaccccgacctgccgaccctgatcgtcgcgccgtatttccgcagcgcgatcgaggccgccatcgacggctggcgccgggtcgtggtcacggccacccggttgggcatcccgatccccggcttctcctcggcgctgtcctactacgacgcgctgcgcaccgagcggctgcccgccgcgctcacccagggtctgcgggacttcttcggcgcgcacacctacgggcgcatcgacgaggaccccgacaagcgcttccacacgctgtggagcgccgaccgccgcgaagtgccggcgtaacggggccacactggaggccgtaagggggctggacctgcgatgaggtttctcgacgggcatcgacccggatacgacctgacctacaacgacgtcttcatcatgccgaaccgctcggaggtgccgtcgcgcttcgacgtcgacctgtccaccggcgacggctcgggtaccacgatccccgtcgtcgtcgccaacatgaccgcggtggccgggcggcggatggccgagacggtggcccggcgcggcggcctggtgatcctgccgcaggacctgccgatcaccgcggtgcagcagacggtgcagttcgtcaagagccgcgacctggtgctcgacactccggtgctgctcgagcccgacgactcggtgtccgacgcgatggcgctgatccacaagcgtgcgcacggcgtggcggtggtggccttcgagggccgcccgctgggactgctgagcgaatcgtcgtgcctgggcgtggaccgcttcacccgggtgcgcgacgtcgcgatgaccgacttcgtggtggccccggtgggcaccgagccgcgcaagatcttcgacctgctcgagcaggcgcccatcggcgtcgcggtcgtcaccaacaccgacggcacgctggccggcgtgctgacccgcaccggagccgtgcgcgccggcctgtacaccccggccgtcgatgcgcagggccggttgcgggtgggcgcggcgatcggcatcaacggcgacgtgggggccaaggcgcggtcactggtcgaggccggaatcgacctgctggtgatcgacacggcgcacgggcatcaggtcaagacgctggaggcgatccggaccgtcgcctcgctcgagctgggggtgccgctggtggcgggcaacgtggtttcggccgacggcacccgcgacctgctgggcgccggggcgaacatcgtcaaggtgggcgtgggcccgggggcgatgtgcaccacccggatgatgaccggcgtgggccgcccgcagttctccgctgttgtcgaatgtgcttcggcggcaagggaactgggtggacatgtatgggccgacggcggcatccggcacccgcgtgacgtggcgctggcgctggccgccggggcgtcgaacgtgatgatcggatcgtggttcgccggcacctacgagtcgcccggcgacctgatgcgcgaccgcgaggaccagccctacaaggagagctacggcatggcgtccaagcgggcggtggtcgcccgcagcggcgccgagacggccttcgaccgggcccgcaaatcgctgttcgaggaaggcatttcgacgtcgcggatgggtctcgacccggcccgcggcggcgtcgaggatctgatcgaccacatcacctcgggcgtgcgcagcacctgcacctacgtcggggccgccaccctggcgcagctgtacgaacgggtcgtggtcggggtgcagtcgaccgcgggcttcgccgaggggcatccgcttccgctgggctggtgacacgccggcgcgacgcgccgaggtcggctagtaaggctagcgttgcctaatacggcctgctaacctacttcgccatgacctcctccgcctcccccgccccgaccggggccatgcccgcgggctcacccgaaaaccacgtcagcgccgagcttctcggcatcctgcgcgacgacctcaacgtcgacgtgtcccgggtgactccggacgcccggctggtcgacgacgtcgggctggactcggtggcgttcgcggtgggcatggtggccatcgaggaacggctcggggtcacgctgaccgaagaggaactgctgagctgcgagaccgtcggcgacctgcaggccgcgatcgccgcggaaccccgcgaaacccgcgatgagtgagctggccgcagcgctgacggccgcgatgcgcaccggcggcagcgatctggtggtcttcgaccgcgagtcggcggcctggcgccgccatcggtggccggaggtgcacggactggccgagggcatcgccgcgtggctgctcgaccgggaccgacccgccgccctgggactggtcggcgagccgaccctcgagttcgtcgccgccatcgtgggcgcctggctggccggcgccggcgtctcgatcctgcccgggccggtccgcggggccgagggtcggcgttgggccgacaccacgctgacccgcttcgccgggatcggcgtgcgcaccgtcctgagccacggctcccacctggacgcattgcaagccctggacccgtcccgcccggacgagatggtcgtcgaagaccttgccgtcgcggccaataccggccgccgctgccccgagccgccggccccgcacgcgaatccggcgatcctgcagggcaccgccgggtccaccggcacgcccaaaaccgcggcgctgtcccccgacgcggtactggccaacctgcgcggcctcaacgcccggctcggggtgactcccgccgacgtcggctgctcgtggctgccgctctaccacgacatggggctgtccttcctgctcgcgtccgcgctgggcggaatgtcgttgtggctcgcgcccacctcggctttcaccgcctcgccgtttcgctggctcgcgtggttgtcggagagccgggccaccatcaccgcggcgccgaacttcgcctacaacctggtcggcaaatatgcccgccgggtctccggcgtcgacctgggcgccctgcgggtagcgatcaacggcggggagccggtcgactgcgccggcttcgagcgcttcacgaccgccatggccccgttcggtttcgacgccggtgccgccaccccgtcctacggcctggcggaggcgacgtgtgcggtcagcgtgccggcgcccggcaccgggctgcggttcgccgacgtcagcgacgagaccgggacgcgccggcacgcggtgctgggcgcgccgatccctggcaccgagatccggatctcgccgcgccacgatgcaccggacggcatcggcgagatcgagatccggggcgcgtcgatgatggacggctacctgggtcacgcgccgatcgaccaccaaaactggtttcccaccggcgatctcggcttcttctccgacgacgggctggtggtgtgcggccgggccaaggagctgatcaccctggccggccgcaacatcttcccgaccgagatcgagacggtcgccgcccaggtgcccggcgtgcgggaaggcgccgtggtggcgctgggcaccggcgagaattccgcgcgccccggcctgatcatcgccgccgaattcgctggccgcgatcgggcgggcgcgcgcgccgaggtgatccagcgggtcgcgtcggtgtgcggcgtcgttccctccgatgtgatcttcatggcaccggggtcgctgccccgaacctcgtcgggcaaactacgccgcctggacgtgcggcgctcattggaggcggtggactaagtgacgaccctgtccgcggcaacaacggccgacatcgaccactaccggaccgttctcgccggcgccttcgacgatcaggtgctggagtggacgcgcgaagccgaagcgcggcaacggtttccgcgcgagctgatcgaacacctgggcgcccgcggtgtgttcagcgaaaagtggtgcggcggaatgcttcccgacgtcggcaagctcgtcgaacttgcccgagcgctcggccggctgtcgtcggcgggcatcggggtgggggtcagcctgcacgactcggcgatcgccgtcctgcgccggttcggcaagtcggactacctgcgcgacatctgcgagcgggcaatcgcggggcaggccgtgctgtgcatcggggcctccgaggagtccggcggctccgatctgcagatcgtgcgcaccgagatgtcttcccgcgacggcggtttcgacatccgcggcgtcaagaaattcgtctccctgtcccccatcgccgatcacatcatggtggtggcgcgcagcatcgaccacgactcggccagcaaacacggcaacgtcgcgctgatcgcggtcccgacctcccaggccagcgttcagcgaccctatgccaaggtcggcgccggaccgctggacaccgccgcggtgcacatcgacacctgggtacccgctgacgcgctggtcgcccgggcgggcaccgggctggcggccatcagctgggggctggcgcacgagcggatgtcgatcgcggggcagatcgccgcgtcgtgccagcgggccatcggtatcacgttggcccgcatgatgactcgccggcaattcggccgcacgctgttcgagcaccaggcgctgcggctgcggatggccgacctgcaggcccgcgtcgacctgctgcagcacgggctgaacggcatcgccgcacagggacggctggacctgcgcgccgcagccggcgtcaaggtgaccgcggcccggctcggcgaggaggtgatgtcggagtgcatgcacatcttcggcggggcaggctatctggtcgaggagacaccgctcgggcggtggtggcgcgacatgaagctggcccgggtcggcggcggcaccgacgaggtgttgtgggagttggtcgccgccggcatggcggccgaccatggcggctatcggtccgtggtgggggcgtccagcgcgtagagcgccatccgccggttcgtcgtgtcgtgttcgccgaggaaccggcagccggcgtactcgcacagccggcgcgcggtggtgttgcggtggtcggggtcgaacatcacccggcggcaccgcggctcggtcgcgaagacgctggccacgatccggggcagcagcatcggtcccagtccccggttcaccagtttcacgtcggcgatggcggcgtgcagtcccagatcgtagggctcggcgtcgtagtaacgcgagatgagatcctttgcggccccaatatagttcgaggtaggcgagatcaacaccgcgcatgcttccgatcaacggcagcgagtagctgccctgaagctgggcgcccagatgccgccgccagcgcggggtcggccagtcgtactcccaggccgcggccaagtgcggtcggttcatccactcggccaccatgtcggcgtcgccgagccgcgccacgcgcagggcgaacggcggatccaggtggggcacgggcggacggggaatgcgcgccacggcgtcggggatatcggaccgctcgcgcggcaagatctggacgggctgctcggccgggtcggtctgggctgggtcaatctgggctggcgcgctctcggctggggcgtcggacatagtgcgccgagcctacccgagtaagggtaggcataccgaagtcgcctccggagtgtcggtcgggccgccaggcgtcggcgtggccccggtggtcggcgccccggcgccggagcgcgggctagcataaggcagcaaagacgggcgcgtccgcgccctccgccaccgggcagcgaaaggatcgacgtgccgcaggcacccgcgcaagccaccggcgtgcgggcgcatggcccgtccgaccagccgcccgatgcggagcctcccccggccaccgggcccttcccgtccggcgggtggcgtaggtcatgaacgtcaccgtcaccgtggtcagcattgtggcgatcgcggtgctcatcttcggcaacgccgtcttcgtcgccgccgaattctcgctcaccacgctggaccgcagcaccgtggaggccaacgcccgcaccgggggacgccgcgaccgctggatccgccgcgcccatcaccggctgtcgtttcagctgtccggcgcccagttgggcatctcggccaccacgctggcggccggctacctgaccgatccgatggtcgaggacctgccgcatccctggctggacgcggtcggcatcccggatcgggtcggcgacgcgatcatggcgtttctggcgttgctgatcgtgacctcggtgtcgatggtgttcggcgagctggtccccaaatacctggcggtggcgcggccgatgtcgacggcccgcgccgtggtggccgcgcagctgctgttctcggcgttgctgaccccggcgatcaggctgaccaacggcgcggccaactggatcgtgcgccggctgggcgtggagcccgccgaggagctgcggtcggcccgctcgccccaggagctgctgtcgctggtgcgctcgtcggcgcgcagcggcgcgctggacgccgcgaccgcggccctggtgcggcgctcgctgcagttcgggacgctcagcgccgaggagttgatgacgccgcggtccaagatcgtggccctgcagaccgacgacaccgtggccgacctggtgaccgcggccgccgaatccgggttctcccggttccccatcgtcgacggcgacctggacgaaaccgtcggcatcgtgcacgtcaagcaggtgttcgcgatcccgcgggccgcccgcgcgcacacactgctgaccacggtggcccagccggtgccggtggtgccctccacgctggacggcgacgcggtgatggccgagatccgggccaacagcctgcagaccgcgctggtcgtcgacgaatacggcggcaccgcgggcatggtgacggtcgaggacctgatcgaggagatcgtcggcgacgtccgcgacgagcacgacgacgccacccccgacgtggtgccggccggcaccggctggcgggtgtcgggcctgctgcgcatcgacgaggtggccgcggccaccggcttccgggcgcccgagggcccctacgagacgatcggcgggctggtgctgcgcgagatcggtcacatcccggcggccggtgagacggtgaagctgccggccctggatcccgacgggttgctggatccggtgctgcgctggcaggcgcgggtgatccggatggacggtcgccgcatcgacgtgctggagctgaccgagatcgacgcgcacgccgaagccccgggcgggcgccgatgagcgacaccatgggcgtgctgctggcgtgcctgctgatcggggtgaacgcgttcttcgtcggcgcggagttctcgctcatctcggcgcgccgcgaccggctggaagcgctggccgagcagggccgtgcggccgccgtcacggtgatccgggcctccgagcagctgccgtccatgctggccggcgcccagctcggcgtcaccgccgcctcgctgctgctgggccgcatcggcgagtcggcggtgtccaatctgctgcgaacggtgttggggctgaccaggattcaccccgcgctgctgcacaccctgtcgttggcgatcgcgctggccatcgtggtgacgctgcacgtgctgctcggggagatggtgcccaagaacatcgcgctggccggcccggagcgcaccgcgatgctgttggtgccgccgtatctggcctacgtgcgcgcggcccggccgttcatcgcgttctacaaccggtgcgccagcgtggtggtccgcgcgctgggcgtggagcccaaggaggagctggagatcaccgtctccccggtcgagctgagcgagatgatcgccgagtcggagtcggagggtttgctggaccgcgaggagcacacccggctgacccgggcgctgcagctgcggcaccgggtggtgggcgacgtggcggtgccgctggcccgggtgcatgcggtgccggtggccgcgcccggctcgggcccgacggtgggagcggtcgagcaggccctggcccagaccgggtactcccggttcccggtgaccaaccccaccggcgatttcatcggctacctgcacatcaaggacgtgctgacgctcgacgacgacccggcgacggtgatcaacctggcgaaggtgcggccgctgccccggctgccgcggtcgctgccgctggccgacggcctgtcccggatgcggcgcagcaacagccacctggcgctggtgaccgaccagggcggcgccgtggtggccatggtggcgatggaagacctggtcgaggacctggtcgggacgatgcgcgaggcctagcgggaccggcccgaccggccgcgccgcgcggagcccgtatgatctttcacgactaccagttaagaaagtgctgggggcagtggatcgcttgcgcgtacagcgtcgttgctggagtgcgatcccggtgcccgccgccgcgtcgatcttggggctgtcagggtggcctgacctgcgcatgtcgggtcaggcagctcacgctcgccaggatgtgctcggtaggctgatgacattgccaatctgggcccggtctggtggtccagggcggcccgtgacggaggagaatcatgactgatcgcgtgtcggcggggaacctgcgcgtcgcccgagtgctttacgacttcgtgaacgacgaggccttgcccggcaccgacatcgacccggacagcttctgggcgggcgtcgacaaggtggtcaccgacctcacccccaggaaccaggagctgctgcgccgccgcgacgagctgcaggcccagatcgacaagtggcaccgccagcgcgtcatcgagccgctcgacatcgatgcctaccgcgacttcctcatcgaaatcggttacctgctgcccgaacccgaggacttcaccatcaccacctccggggtggacgacgagatcaccaccaccgcgggcccgcagctggtggtgcccgtgctcaacgcccggttcgcgctgaacgccgccaacgcccggtggggctcgctgtacgacgcgctgtacggcaccgacgtgatccccgaaaccgacggcgccgaaaagggatcgagctacaacaaggttcgcggcgacaaggtgatcgcctacgcccgcaacttcctcgaccaggcggtgccgttggaatcgggttcctgggccgacgcgaccgggttgtccgtcgaggacggccgcctgcaggtggcgaccgccgacggttccgtcggcctggccgagccggcgaagttcgccggctacaccgggcagctcgggtcgccggactggtcggtgctgctggtcaatcacggcctgcacatcgagatcctcatcgacccgcagtcaccggtcggcaagaccgaccgcgccggcatcaaggacgtggtgctggaatcggccgtcaccacgatcatggacttcgaggactcggtggccgccgtcgacgccgacgacaaggtgctcggctaccgcaactggctcggcctgaacaagggcgacctgtccgaagaggtcagcaaggacggcaagaccttcacccgggtgctcaacgccgaccgcacctacaccacccccgacggccagggcgagctgaccctgccgggccgcagcctgctgttcgtccgcaacgtcgggcacctgatgaccaacgacgccatcgtgtggagcgacggcgacgaggaaaaagaggtgttcgagggcatcatggatgcgctgttcaccggcctgacggcgatccacgggctcaagaccggcgaggcgaacgggccgctgcagaacagccgcaccggctccatctacatcgtcaagcccaagatgcacgggcccgacgaggtcgcgttcacctgcgagctgttcagccgggtggaggacgtcctgggcctgccgcagggcaccctcaagatcggcatcatggacgaggaacggcgcaccaccgtcaacctcaaggcctgcatcaaggccgcggccgaccgggtggtgttcatcaacaccggctttttggaccgcaccggcgacgagatccacacctcgatggaggccgggccgatgatccgcaagggtgcgatgaagaacaccacctggatcaaggcctacgaggacgccaacgtcgacatcgggctggccgccggcttcaagggcaaggcccagatcggcaagggcatgtgggcgatgaccgaactgatggccgacatggtcgagcagaagatcggccagcccaaggcgggcgccaccaccgcgtgggtgccctcgccgacggcggccaccctgcacgccatgcactaccactacgtcgacgtgggcgcggtgcaggaggagctcgccggcaagaagcgcaccaccatcgaacagctgctcaccatcccgctggccaaggagctggcctgggctcccgaggagatccgcgaggaggtggacaacaactgccagtccatcctcggctacgtggtgcgctgggtcgcccagggggtcggctgctcgaaggtgcccgacatccacgacgtggcgctcatggaagaccgtgccacactgcggatttcgagccagctgctggccaactggctgcgccacggggtgatcaccgaggaggacgtgcgggccagcctggagcggatggcgccgctggtggacgcccagaacgccaaggacgccgcctatcagccgatggcgcccaacttcgacgacagcctggcgttcctggccgctcaggatctgatcctgaccggcacgcagcagcccaacggctacaccgagccgatcctgcaccgccgccggcgcgaggttaaggcccgcgccgcgcagtcgaattgagcctgcgcccgaatcgcgctcggtcgtgtcatagttccgctgatgactaaaatcggcgccggattatcgctggatcgacggaaaggccgcgggcaccacgatgggtaggcacagtgcgcccgaccccgacgacttcctcgacgagccatcgcccgaccacccggtcgacgagcgcgacgacgcctacgccttcgacgcgcaaggcgcgccggacgagggctactacccggacgaacggcgctaccccgatgcggacttcgtcgccgacgacgactacgcgcccgaggagttcgcgcccggcgaggatctcgtcgacgaggaccccgacgactaccccgagttcccgtcgcgccggccggccacgtccggcccgcaggaatcgccggcgtcggcgccgtcactgcgcgcacgccggctcgattggcgcggcgggcatcgcagcgagggtggtcgccgcggggtcagcatcggcgtgattgtggcgctggtcgccgtcgtcgtggtggtcgggtcggtgatcctgtggcgcttcttcggtgacgcgctgtccaagcgttcgcacaccgcggccgggcgctgcgtcggcggccaggagcaggtcccggtcgtcgccgacccgtcgatcgccgacgccatcgggcaattcgccgagagcttcaacaagtcggccggcccgatcggcgatcactgcatggtggtcagcgtcaagccggccggctccgacgccgtgctcaacggcttcatcggcaagtggcccgcggaactcggtgggcaaccggcactgtggattccgggcagctcggtctccgcggcgcggctggccggcgccaccgcccagaagaccatcaccgagagccattcgctggccagctcgccggtggtgctggccgtccgcccggaactgctgccggccctgtcgggtcagaactgggcggcactgcccgggttgcagaccaacccgaatgcgttggcgggattgaacttacccgcgtgggggtcgctgcggttggcgctgccgatgaccggcaacggggatgcggcgttcctggccggcgaggcggtggcggccgcgtcggtgcccccgggcgcgccggtgacgcagggcaccggcgcggtgcgcacgctgctgagcgcgcaacccaagctggccgacaactcgctgaccgaggcgatgaacacgttgctcaagcccggggactcggcgagcgcgccggtgcacgcggtggtcaccaccgaacagcagctgttccagcgcgggcaatcgctgccggatgccaagggcgccttggcttcctggctgccgccgggtgccgcggcggtggccgactaccccaccgtgctgctcagcgggtcgtggctgacccgcgaacaggcctcggccgccagcgagttctcccggttcatgcacaagtccgaccagctggccaagctggcgaaggcgggcttccgcgtcaacggtggtaaaccgccgagcagcccggtgaccaccttcccggcgctgccgtcgaccctgtcggtcggcgacgacgcgatgcgcgcgacgctggccgaggcgatggccagcccgtcgaccgggcaggccaccacgatcatgctcgaccagtcgatgcccggccaggaaggcgggaaatctaggctggccaatgtcattggggctcttcaggacaagatcaaggcgctgccggccagcgccgtggtcggcctgtggacgttcgacggtcacgagggacgctcggaggtcaccagcggcccgctggccgacccggtcaacgggcagccgcgttcggcggcgctgtcggccgcgctggacaagcagtactcgtcgagcggcggcgcggtgtcgttcaccacgctgcgcatgatctaccaggacatgcagtccaattaccatgcggggcagacgaattcgattctggtcatcaccgccggcccgcacaccgaccagaccctggacgggcccgggctgcaggacttcatccgcaagagcgccgatccggccaagccgatcgcggtgaacgtcatcgatttcggcgccgacccggaccgcaccacctgggaggcggtcgcccagctcagcggcggcggctatcagaacctcgcgacgtcggcctccccagacctggcgaccgcggtcaacgcgttcctgagctgagcggccgggcgccgtcccccattggccggtgatagatccgcgccttagggactaccgcgcccgcgggggccgcgggcggccccggcgccgggatcgcgcgcaatcatggacaaatcgcgccgagcctctgtcgcacggacgccgtctgtgccacactccagcgatagaacaaaattggatttctatcaacgctgacccgggcaggcgcgacaggccggccgggccaaccgtcgcgggccaccacccacccacccactcaaggagaagcggtatggcgacgacaagccgaatcagccggcgcggcaacgattccgcggcgactgccctggccgaacccgatcagccggacgcgcaccgggcgttggctgaggacgtccggtggttcgcgggctcgccgttggcggcggccttcggccggctggccctcgaccaggtggcgcatcgggagatcgcggcggcggtggaccgcagcgggcggttcgccgacaatttcaccgaccgcggcatccgcagcgccgcgttcaccgcccttgcggccttcggtgacagctccgacgtcgaggcgtcgcgggccgacctcaaacgactgcatcgcgacgtgcgcggcaccggcaagggggcgttcagcgacacccgctacagcgccctggaccccgagttgtggacctgggtggcggtcagcggcctcaacctgctgtaccaggcttacctgcgggtgtgcgggcaccggctgagcaccgacgagaaggaagtcgtgtatcagacgctgcgccgcgaactgcaattcctcgagctgcccagcaagcagggcaagctgccggccaccctggacgagatgctcgactactacgacaccgtcgccgcaaaacacttggcggacaacgagtttctgcaattcgccagccgcagcttcgtggcgccgccggtcccggggctgttgccccgccagctgcggccggtgctgcgactggtctggccggtgctgacctcgctggccgcgcggccggtggtggtgtgctcggccgcggtcgcccaccccaccatgcgccggctgctcggggtgcgctggggcgcgcgggagcaggccgagttcgccgtctacgtcgccgcgctgcagctgggctggcgatggctgccgcgccggctcaccctggagcccttggcgtacaaccggtaccagtacgagcggctgcgcgaccgctaccgttcggtgttgctggattcgttcgccgcgccgggccgcggttagatccggcaggatgagtcccgataccgcgtcgagaccccgatcggctggaggccagatggttgaccccgcgatgctgctcggcttgctgcccgacagcctggccaccctcgatccgaccgcccgcaccatcgtcaccgcggcgcgcacctgtttcaccgagcgcggcttctccaacaccaccatgcaggacatcgccgacgcggccggcgtcggcgtggccaccgtctaccgccgcttccggcacaagcgaaacctggtgcggctgaccatcattgacgaatccgtgcggctgagcaccctgatctccgacgtcgcgggccgcgcggcgagcgccgaggaaggcatcgccgaggtgttcgccgcgttcgtccacgaagcgtcggcccccaagctgctgacccgcagcatccgggaatcgcccgcggccggcgagctgtccgcgttcctgaccgacgagcatctgatcgccatctcgcgcacctacatcgcgagttggttgcgccgctggcaggagcgcggtgaactggccgacgacctcgacaccgaggtcgtcggtgagatgatcgggcggctgatcatctcgctcatcgagacgcccaagtccgtcatcccggtctacaacctcgccaaggcccgcgatttcgcccgccggtacctggtgccgctggtgctgcccgccccggcggcgctacccggctgatcgggcaacgggcacaagacgaatgggtcaggcgaacgcctcgaccggcgggcacgagcacaccaggttgcggtcgccgtaggcgccgtcgatgcgccgcaccggcggccacaccttgggtcggaagtccttgcccagcggataggccgcctgttcgcggctgtacgggtggtcccagtcggtggtcaccaggcactccgcggtgtgcggggcgccgcgcagcggattgtcctccaccggccactcccccgcacccacccggtcgatctcgccgcggatggcgatcatggcgtcgcagaaggcgtccacctcggtgagggtttcgctctcggtgggctccaccatcagcgtgccggccaccgggaagctcatggtgggagcgtgaaaaccgtagtccgccaaccgttttgcgacatcgtcgacggtcacgccggtggccttggtgatgggacgcaggtccaggatgcactcgtgggccaccatgccgttctcgccggtgtagagcaccggaaagtattcgtcgagccgccgggcgatgtagttggccgaggtgatcgcggtcagcgacgccgcgcgcaggccgtcggcgcccatcatcctgatgtaggcccagctgatcggcaggatcgacgccgagccgtagggcgccgaggacaccggatgcccctgcggcagctccggggcgtgcggatgcccgggcaagaacggcgccaggtgcgagcgcaccgccaccggccccacccccggcccgccgccgccgtgcgggatgcagaacgtcttgtgcaggttcaggtggctgacgtcgccgccgaacttgcccggccgggccaacccgaccagcgcgttgaggttggcgccgtcgacgtacacctggccgcccgcgtcgtggacggccgcgcagatctcggcgatgtcgtgctcgtagacgccgtgcgtggacgggtaggtgatcatcagcgtcgacagccggtcgcggtgttcggtgaccttcgcgcgcaggtcgtcgaggtcgacgtcgccgttgtcgtggcagcccacgaccaccacccgcatcccggccagggccgccgacgcggcattcgtgccgtgcgcgctggacgggatgaggcagatgtcgcggtgcggttccccgcggctggcgtggtagtcgtggatggccagcaggccggcgtactcgccctgcgacccggcgttgggttgcagcgagacggcgtcgtagccggtgatggccaccagccagttctccaggtcgccgatgagccggcgcagccccggcgtgtcggacgccggggcgaaggggtgctgacgtgcgaactccggccaggtgatcggctccatctcggcggcggcgttgagtttcatggtgcacgagccgagtggaatcatgctgcggtccaacgcaatatccttgtcggccagggtgcgcaggtagcgcatcatcgccgtctcggtgcggtactgggtgaaggcgggatgggtaaggaattccgcagtgcgggtagcgatttcgctggcgacgggctcggcgggtgcgacgccgaacgcctcgagcaccgcggcgacgtgttcgtcggtggtggcctcgtcgcaggccaccgagacgtggtcgtcgtcgacccgccacaggttgatgcccctggccttggccgcggcgatcacctcgtcggcccggcccggcacccgcgccagcacggtgtcgaagtacctgtcgtgcaccaccgcggtgcccagcgcggccgcgatcgcctcggcgtgcccgtgcacgcggcgtgcgatcgcggtcagcccctcagcgccgtggtagctggcgtacatggcggccatcaccgccagcagcacctgcgcggtgcagatgttgctggtcgccttgtcgcggcggatgtgctgctcgcgggtctgcagcgccaaccggtaggccggcgaaccgtcggcgtccagcgagacaccgaccagccggcccggcagctgccgggcgtggttggcgtgcaccgccaggtatcccgcgtgcgggccgccgaatcccattggcacaccgaatctttgggtggtgccgaaggccacgtcggcgccgatctcgccgggcggggtgatcagggtcaaggccagcaagtcggcgccgagcgccaccagcgcgccgcgctcgtgcgcctgcgccaccagggcggcccaatcggtgatcgcgccgctggcgccgggcagctgggcgatgacgccgaagaagtcgccgtcgggcagcccgtcgcgcaggtcggcggtgacgatctcgatgcccagcggccgggcccgggtggccacgatggccgcggtctgggcgaacacgtcggcgtccaccgccagccggttggacttgccgcgagatgcgcggcgcatcagcgtcatcgcctcggcagccgcggtgccctcgtcgagcatcgaggcgttggcgatctcgaggccggtcaaatcggccaccatggtctggaagttcagcagcgcctccagccggccctggctgatctccggctgatacggcgtgtaggcggtgtaccaggcggggttctccaggatgttgcgcagcaacaccggcggggtcagcgtgtcgtagtagccctgcccgatcatggacacggcgacggtgttggcctcggccaggccgcgcagctcggccagcgcctcggtttcgctggccggcggcggcagccggtccaggcccggcgcgatcccgtcggccgagagccggtcgcggatgccggccggaacggccttggcggccagctcgtccaacgagccgacaccgatgacgtcgagcatggccgcgacggcctgagggtccgggccgatgtgccgggcggcgaaagtggtgtggtcgggcacgggaaactcctgacgaagacgctcggggcgaggacggcggtgctgcggtggtcctcttcctctgtcttcacccgttcgccgggcgcctgagagattcggcggccgatgctgtcgcggccgcctttccccatcggcgggtgcgggcccgagggccggcaccgctttccagaggcatcatgtttcgcgcggtccgggtgcctgagaggttgacggagaggtgttgctccttcggcgtccgtgactggccgtcacggaactctcccgctcgaatgcgatgcgccgcccagtttacccgcccgcgccggccgcccacgcgcgcggcgccgggcgtgatcagccgatcttgcggtcgcggtgcttgcgccgggacgccagctcgtcctccggctcggcgatcgactcgccgccgtcggcccgctcgccggggaagtccgcgatgacgccggtcagctcgcgcatggcgccggagaccgcgatgccgaacacgccctgcccgccctgcagcaggtcgacgacctcctcggccgacgtgcactcgtacacggtggtgccgtcggagaacagggtgatgttggccaggtcctccaccccgcgctggcgcaggtggtcgacggccacgcggatgttgtgcagcgagataccggtgtcgagcagccgcttgacgatcttgagcaccaggatgtctttgaaggagtagagccgctggctgccggagcccgccgcgctgcggatcgacggcaccaccagcgaggtgcgggcccagtagtccagctgccggtaggtgatgccggcgatctggcaggcgctcgggccgcggtagccgacaagttcgtcgggcaccgagtcgtcggggaacaatccgggctggaccggcgcggcggccgcggtgacgctgcgctcaccggtgcccgcattcccgtcctcggccaaattgagctgctcttggcgtggctgctcgctcacggtggttccttcccgcgatcgcgctctcgtcggtggctgcgtctccaaggctgcatcgcagccacgtctgctcaggcccgagtgctagtgagcttacgcttgtcgatagccgccgcgcctgaagtcgtcctcaaagtatggccgtcgcgggcccaagtgggcgagctatccgccagcgtgtcgacatcacgccgccagttgagacgcatccgtgatatcgccctccaggctaatccagccgccgcgtcgttcccaaagcgctggtcgcgggcgcgccggatgtctaggtggccttgaaatcgtcgggcgagacgctgtcgaggaattccttgaacttctccacctcgtcctcgcggacggcggtgccgccctcctcgtcgctctcgtccggaatcagcagcccggcctgggccagcaccgcctcctcgacgtagatggggacaccgacgcgcagcgcgatcgccaccgaatccgaggggcgcgccgacaccgtgatgttgcggtcgaacaccaggtcggcgtagaaagtcccctcctgcagatcgacgatccgcacctctttcagcgaatgtccaagcgcggcaatgacatccctgatcaaatcgtgcgtcaacgggcgaggtggctcaacgccttgctgctcgagggcgatggcggcagcctctgactgaccgatccagatcggcaggtaacggtcaccgttggtttcgcgcagtaacaacaccggctggttttgcggctgctctacgcgaatgccgacaacacgaacttcacccatttgtgtctgccctccgcattagtggcgccggttgaattggtactcgccagcgacggcgaggtcaaaaatccgccccactgccgaaaccaagctgtcgaccgaagtctagtcctcagcgatcgagaacgtcgcgaacggcggatttgatcaacgacgtgtgcaacgtaatggccagcgccgcaacctcacgcgccaagtcgtcggcgcgatcgcgggcgcccgccttgccggctttgcctaccggcccggcgatttgggcgatcaggtccgactgccggtcggctgccgagcggaacgcgcgcagatgccgcggctcgacgccgtagtccgacagcgcccgcgagcactgcaggatgacgacggcgtgctcgtcgaagaacccggcgggcccggcggtgatgatcccggccttgagcaacgccgtcagcagttcgtcgtcgacgcccgcgcgccgcagcagctcttcgcggctgagccggacgtgggccggggccaccgccgaggtgtccgagccgaggcccgcgttggcgccggcgtcggttccggccaccgacaccagccggggggcagtgtagggggtgttgaaagcgggcagctcgccgtcgggttgggcgtccagctgcgcccggatgaccttgagcggcaggtagtgatcgcgctgcgccgtaaggatgaaacgcaaccgcgcgcagtcgtacgcggtgaaccttcgataccccgacgcggcccgttgcggcgtcaccagcccttcggcctccaagaagcgaatcttggagatggtgacatcggggaagtccggcctcaacaattccaggaccgccccgatcgacatcccggccagcgccgagctatcgggtgcgctcactagcctgaagatcctccgtcctcaccctgcttgggcccggtcaaaaacaccaagcggaacttgccgatctgcacttcgtcgccgttggccagcaccgcggagtccacgggttcccggttgacgtaagtgccgttgagactaccaacgtcgaccacgctgaattcgttgttttccaacctgaattcggcatgccggcggctgacggtgacgtcgtcgaggaaaatgtcgctgtccgggtgccggcccgccgaggtggtggcctggtcgagcagaaaccgcgatccggcattgggtccgcgcttgacgaccagcaacgccgagcccgccggcaacccctccaccccggagaccgcgctctcggtgcccgcctgggcgggcgcgtccagctcgttgaggaagtcggcacggaagacggaagtcgtctctaccgtgacttcgtccccgttctggtcctgacttccagagtccatgtccgtcacgcgctgctcctcactggccgctgtggcgttgtctgtccgggccgctcggccggccgtcgcaccgggctcgtccgcccggtatgccggttactgccgtctcgtagtttcagtgtcttacacgtgtcattcaacggtcttcaatggtccttcacggatcgctgcacggatcccttcaccgatcgatgtgtcgacggtaccgcgcacgtcgccgcaatgcgcccaccacctgacgatccgaaacgttgatttcccccgtgtgccggccgcaccgctcgcttggccgggcgggctgcagggacattagcaaccgtcattcggtcagcgttccgcggtaggcctcggcgtcgagcaatgcggtaatggccgactccaaggcggcggcgtcggacacctggacatccagcaaccagccggccccgtacgggtcggagttgaccagctgcgggctgccttccaggtcggtgttgaccgccgtcaccgtgcccgacaccggggcgtagaggtccgacaccgatttcgtggattcgacctcgccgaaggactccccggcggtcagctgcgcgcccacctcgggcagctgaacgaaaacgacgtcacccaacgccgactgggcgaagtcggtgatgcccacccgcacggtgtcatcaccgcttcggcgaacccattcgtgttcggcggtgtagtgcaggtcgggcgggatgtcgctcacggtgatcctgtctgttcgggagttgctcacttgacgggctgagcgtattggtgcggttttggttgccgcaaggtggtcacgtccacccggtcggcctgctggacggacatccgtccgcccacccgcttgacggtgtcctgggcgccaccgggaatgttcatggccgcggccagggtgggcggatcgccaatcgccagaatcgaatacgacggcgacagcgttttcgagtcgatggtcaacgaccccggcgtacccgccacccaggtgtccacacccacccgcaccgactggtgcgcgtcgttgacttcgagcgcctcggcgccggcggcgcgcagctcgttgaccacgtcgagcagcgcctcgggggacactcccggcgcggggtcgtcgatcgtgacggtgacaccgggcccggtggcgcccaccgcgccgaccaggatggacagcgccgccagccgggattgcgcggactggatcgcggcctgatcgttattgccggacgcctgaagcgaattcagcgtgttctgcagttcgctcacctcggcgctgagcgtgccctcgcgctgccgcaacgaatccagcaacaccaacaggtccgcgggccgcgccgtctccagcgagtcccccgattcggtctggcggacctgggtgacgatcgcgatgcccagcagcagacacaacagcacggccagggtgccgaaaccgaaccgggaacggcccccgcgcagcaccccggacaacccggtgcggcgcagcggcccgatcgccgggcggggctgctttcccggcagttcgtggcgcccgtgcgccgcaccctgatccggcgggtcggccgggcgatccggcgggtcctgactcatgttcacctcatgcgccgaacagcctgcggcgcagcgccgcggcgttgccgaagatgcggatacccagcaccacgatgatggccgtcgacaactgggtgcccacccccagctggtcgccgacgtagacgatcagcgcggcgacgaagacgttgaacacgaacgagatcacgaacaccttcggatcgaagatgcgttccagatacgcacgcagaccgccgaacaccgcgtccagcgccgcgaccaccgcgatcggcaggtagggctgcacgacctcgggcaccgacggatggaacaccagtcccagcacgatgccgatcgccagtgccgcgataccgatcatgcgcggcttcccgtgtcgcgccggaagggaaaccggaatgggaagctgttcgggattcttctcactgtggcccaatctgcttggcgaacttgacatcccggaccgatccggcaggcagcgttagtccgtcggcgacatccacggtaaccaccacgccgtaggagatctgcagcagcctcagccgctgcatccccgggctggtgtcgaaggcgtcgcgcagcgcgtgcggcggcccgatcgccaggatcgtgtaggggctgctggtcgggttgttgtccaccaggatcgcgccgccggcctgccggatggtcacggtcgggccgatccgcacgccgccgaccgagacggcctcggcgccgccggcccacaacgagttgaccaccagctgcaggtcgcggtccaagatgatctgcctgctgccgctgacccgctgcttggacacgtcggaaaggttcggcccggcgcccggatcggtcaccgtgaccttcaggccggggccgatcaccgccgtgctggccgccgccaggccgagcgcgtcgaggcgtttgagcagccgctgcccctcggcgtcgtcggctagggcgtgccgctgcacgtcgtcgaccttcgctgacagctcgttgcgccgctgcgccaacttcgccgccgagccttccgtggcccgcacattgcccagcagcagctgctgcgcgctgcgcacgccgggggccaccgagcgggcctgggcgaccgcggcggcgaagacggtggcgatcagcagcgccgccagcgcctgccacagccagccggacacccgcgggcgccggttgcgcgtttcgtcgacggcgccgcgtttggccgccgccgcggcgtagccgggatccagatgctcggagagcagggcgcgcagcagcgagggcaccggaatccgctgcgggcgcgccgctaggtgcgcgctgtgaccggcgttggggtcatagccgccgagcgcgcggtccacgtcagccatggtcgacgaccttcgccatggtcgacgggcgtgccgcgcgatcgaccttgggcatccggcgcaccaccagcgtcatctgcaccgcgtactgcgcgaacgcccacaggtacgcgtacaggccccagatcaggaaggcccagccgcaggcgcccaccacccggctccacaacgcgtcccaggtgcccaacagcaccagcgggaacccggacatcaacgcgaacatcgccgccttgccgatgtaggtcaccggcagcgccgacaggccgcggctccacagcagcggcagcgtggcggccaacaggccgtcgcggacgagcaggaccacgacgaaccaccacggcacgatgccgctcaacgccaggaccacgggcacgaccaccatgtagaggcggtccaccgcggggtcgagcagcacacccagccgcgaggactggttgagcagccgggcgattttgccgtcggcccagtccgaggcgccgctgaacatcaggatcgccaccgcccacccgttggcgtgggcgaccagcaacgcgtagacgaacacggggacgagcgccaggcggatcgcgctgagcgcgttgggcaccgtcagcacccggttgggtggaagcaccggctccatgtgccgtgacattagccaagcgcggcgccccgtgcgcggctggccgcgcaccggctagcggaacaccccgggcaggctcagggtggacagcgtgtcgtccgacagcgggttgtcgttgaccatgtacgtccacgtcgacgtcggccgggccagcttggacagatccaggcccggctcgtcctcgagcacgttggcggtttcgaacgtctgctgggccgcctcgatcgcgtcggcggccagcgacgcgaacgcgtcgaccgccaaccggtggaattcgtccagcggattctgccggcccagcgcccgcaggtggatgctctcgcggatgtcggccaggtacgccagatggtcggcccagccgcggtcgaggtggtagagcatgatgtgccggcagatggtttccaggcgttcctcggggatctcgtcggccagctcccggtagcgcttcggcgccagctccgccagctcctcacgcgcggttgcggtgcgcagcaacgtgttacggcggtcgacgatgatcgcgcgctgctgggcgatcagctggttgtagcgccaggtgttcgcgtgcacgtcgagcatgcggccctcggcgacgcgctgggcgtgatcgagcagcccggcggccttggggctgacgattcggccgtcgcccgtttccgggtcggtttccatcggcagcttgttgcggtcgaggttggccgccaccacgtcgtcctcccagctggagaagaacaccgacgaccccgggtcgccctgccggccggcgcgcccgcgcagctggttgtccagccgctcggtgtggtgccggccggtgcccaccacgtgcagcccgcccagctcggcgacccggtcgtgatcggcctcgtcggagccgccgagccggatgtcggtgccgcgcccggccatctgggtggacaccgtcaccaccccgaacttgccggcctcggcgatcacctgggcctcctcggcgtcgttcttggcgttgagcaccaccgccggcacgccgcggcgcagcagccgctcgtgcagctcctcggattcggccacgtcgcgggtgcccaccagcaccggctgcccggtttcgtggacctcgatgatgtgctcgacgatcgcgtcgttcttggcggccgccgtgatgtagacgcggtcggcctcgtcctcgcggatgttgggtttgttcggcggaatcggcgacacaccgagcttgtagaactggcgcagctgctcaccggctgccagcgcggtgccggtcatgccgcacaccgtggcgtaccggttgatcaacgcctgcacggtgatggtgtcgagcacctccccggtttcggtggtctcgatgccctccttggcctcgacggcggcctgcaggccgtccggccagcgctgcagctgcgcgatccgcccgcgcgaggcgttgatcaggtgcaccgcgtcgtcgcggacgatgtagtgcacgtcgcgctgcaacagcacgtgcgcgtgcagcgcgacgttgacctcggtcagggtggtgccgacgtgctcctcggagtacaggtcgatgccgccgagcgccttctccaccttgcgcgcgccgacgtcggtgagatggacgttgcggctgtcggcgtcggtgtcgtagtcggtgccggcctccagctcgccgaccagcttgatgatctccagccgcggcgtctcgcggtgcgtcgtgccggccagcaccagcggcaccagcgcctcgtcgaccagcaccgagtcggcctcgtcgatcagcgccacgtcggggttgggcgagaccaggtccgcgacgtcggtcaccagctgatcgcgcagcacgtcgaagccgatctcgttgaccgaggcgtaggtgacgtcgcagccgtaggcggcccggcgctcctcgctggacgactcggcggtgatccagccgaccgtgagccccatcgcctcgatcagcgggcccatccattccgcgtcgcggcgggccaggtagtcgttgatggtcaccacgtgcacgtgccggccggccagcacgtagccggcggccgcgatcgccccggccagggtcttgccctcgccggtggccatctcgatcacgtcgccggccagcatccgcaaggccccaagcagctgcacatcaaatgggcgcaagcccgttgcccgctcggcggcctcccgggcgatggccaggaactgtgggatgtcctcggactcggcgagatcctccaggttgagcagcccggcggccttgcgcagctgctcgtcggtcagcccggcggcctcgtcgtcgtattccgacgagtcggtcaccagggtgagcgaacggctgcggttcttttccgtgctggcgccgagcaggcgccagaatcggctgctcagccggccgggttgagctcggttcgtcttaggcacaggtcaacggtaccggtggggcgagcccgcgtgttcgcacccgacacgcccgtcaggccaggttcgaccgccgcgggtaggcgaccgtggggtcggtgagcacgttgacgacggcgggcaggccgctggcgaaggcgcgttccagcgccggtcgcagctcgcccggcgcggcgaccaactcgccgtgcccgcccagcgcgcgcgccacctcgtcgtagcgggtgcccgggcgcagctcggccaccaccgaatagccgtacagctgctccattggatgcttttccagcgcccagatcccgttgttgccgatcaccgagaccaccggcacccggtggcggaccagggtgtcccattccatgccgctgaagccgaacgcgccgtcgccctgcagcagcaccacctggcgctccggccgggccagcttggcggccagcgcgtagccgggtcccgaccccaggcagccgaaggggccgctgtccagccagcagcccggccggtagctgtcgatcacccgcccggcgtaggagccgaagtcgccggcgtcgatgacgacgatggcgtcgcggtccagcatcggcgccagctccgcgtacacccgcatcggatgcagcgggacgcggtcgtcggccagctcggcccgctcggcggcgcgcgccgccgtctcggccgtgcgcagttcgtcgatccagtccgggtggtcgcccccacccgcggtggccaacgcggccaggatcgtcatcaggtcgccgtacagctgcgcctcgacgggccggggatgcttgcgctcgggcgccacccggtcggccacgatcagccgggtgtgcggcccgaacaccgcgccgaaaccgagccggaaatccatgggcacgccgacgatcagcgcaacatcggcctcccccaacgcttttccgcgaacgcgggagaaggccagcggatggtcggcgggcaccgccccgcgcgccatcccgttcatcagcaccgggatggccagttcctcggccagccgcagcagagccgcttccccatgcccccaccagacgttggtgcccgccatgatcaccgccgcttcgcgccggacagcaggccggcggcccggcccagcgcggcgccgtcgggttcgggttcgcgcggcaggtcgatgagcgccccggggcggccgtcgtccgcggccatggagaacacgtggtccatcgggaagtccacgaagcccacgccggacggggcaccgacggccgcgcgcaaggcgtcgtcgaccagccggccggcgtcggcggccgattgcgcggtggcggcgaaacgggccagcggcgccacgaacggcacgtggtcgatctcctgcagcgaacccatgccccaccgctgcgccggcgcccggccccccagcaccaccagcggcgaggagttctgttgcgcggcggccatcgcgctcatcccgttggtgacgccgggtccggcggtcagcgcggccaccccgggcagccgggtcaccttcgaccagccctcggcggcgaacgtcgcggtctgttcgtgccgggtgtcgatcagccgaatgccttcgtcgcggcagccgtcgtagatggagaacaggtggccgccggacagcgtgaagacggtgtcgacaccgccggcccgcagccggcgcgcgaccagccggccggcgtgcagggtcggtgcgggggtggcgtcactggtcatcaccgcagcctatccagatccgtccggtaccttcgccgaaggatttcaagttgaggagagtccgaccacctcgaccgtaaggagacgccgacgatgggtgccaagccgttcaagccgtcgatcgactggtcggcggcgtttgtcgattccttgcggtggctggccatagcgtgggtgatcagcgccgtctgcctgttcggggtgctgctggcgttccggttcctcacgccctggggccggcagttctggcggatcacccgcggttacttcgtcggcgcccacagcgtgcgggtgtggctgatgctcggcgtgctgctgctgtcggtgctgctgtcggtgcggctgagcgtgctgctcagcttccaaagcaatgacctgtacacggcgctgcagaaggcgttcgaaggcatcgcgtcgggcaatgacgcggtcaaacattcggggatacatggcttttgggtatcgctcggcatcttctgcctgctggcggcgctgtgggtgacccgcttcatggccgacgtctatctgacgcagcggttcatcatcgcgtggcgcatgtggctcaccgcgaacctcaccgacgactggctggcgggccgggcgtattaccgggacctgttcatcgacaacacgatcgacaacccggatcagcgcatccagcaggacatcgacatcttcaccgccaacgccggcgggacgccgaacgtcccgtccaacggcacgggcagcacgttgctgttcggggccgtcaacgcggtggcctcggtcatctcgttcaccgcgatcctgtggaagctgtccggggacctgaacctgttcggcttggtgttgccgcgcgcgatgttctggacggtgctggtgtacgtgttcatcgcgaccgtcgtcgccgtttggcttgggcgcccgctgatttggctcagcttcaacaacgagaagttgaacgccgccttccgttatgcgctggtgcggttgcgggacgccgcggaggcggtcgggttctaccgcggcgagcgcgtcgagcgggcccagctgtggcagcgtttcacgccgatcatcgccaactaccgccggtacgtgcgccggaccatcatcttcaacggctggaactggtcggtgacgcagatcatcgttccgctgccgctggccatccaggcgccgcgactgttcgccggcgagatcgctttcggcgatgtgacccagacggccacggcgttcaacaacattcacgactcgctgtcgttcttccggaacaactacgacgccttcgccgccttccgggccgcgatcatccgtctgcacggcctggtggacgccaacagcaagggccgggcgctgcccgccatcctcgtcaaacccagcgaagagacggcggtcgagctgcgcggtatcgaggtgcgcacccccgagggagatcagctggtcgactcgctggacatccagctcgacgagggcgacacgctggtgatcaccggacgctcgggggccggcaagacgacgctgctgcgcagcctggccgaattgtggccgtacgcctcgggaaccctgtgccggcccgacggcgacaacgcgacgatgttcctgtcgcagttgccctacgtgccgctcggcacgctgcgcaccgtggtgtgctacccgaattcgccggacagcatcgccgattcgcagctgcacgaggtgctcaccaaagtggctctggcgccgctcatctcccggctggacgaagaccaggactgggccaaggtgctctcccccggcgaacagcagcgagtcgcgttcgcgcgcgtcctgctgaccaggcccaaggcggtcttcctcgacgaggccacctcggcgctggacgaggggctggaatacgcgctgtaccaattggttcgggccgagctgccggggtgcgtgatggtcagcgtgagccatcggcccaccgtcgagcagcaccacgaccagcagctgcacctgctcggcggcggcccgtggcagctgagcccggtggaaaaggagcccgcgcgggtttgatgcgcgcctacgctttcgcggcgcgccgcgccgcgtgcgctccggcgcggcgcccgaagaacgaaccctcacccagctgcgtcccgctggcgtaccccttgccgtcctgagccaggttcgacgcgcacgcgccggcggcatacaacccgggcaccaccgagccgtcggcccgttgcacctcgccgtcgacgctcaccgccaggccgccgatggtgaaccccgagtacatcgcccgcccgagcgacaggtcgaacaccgcccacggtccattgtcttgtgcggcaaggtattccggctgcttgtggaaatccgggtcttcgccggcggtggcgaacttgttgtagcgctccagcgtcgcggccaggttgccggccggaatgcccagcgcggcttccatttccgcgatcgtctcgtagccgtcgaggaaccggatcagcggcatctccggcatctcggtgtgcgcctcgtccacgatcaggtatgcggtttgctccggctgctccaacacgaaagccgaagtgcgcgaatgataggagtcctcggcgacgaagcgcttaccctccttgttgacgatgatcccggtcagcagcacctccggcgggtaggcggccgcggtgatgaacagctcgtccatgtgcttggtcgccccgcccgccgacacccccatccggatggcaagcccgtcgtcgtgcggattgcccagaatgtacggcgccaccaggccgtggtgcttggtgcgccgcggctggcccaacgccggcgtgtgctcggccaccatctgcggattcatcgcgaagccgccggccgcgaggatcaccgcgtcggccttgaccgcgccggtctcggtgaaatgcttccaggccacaccgaccacggcgccgtcgtcgtccacgatcaggttggtcgccccggtctcgtaacggatctgcacgcccagcgcctcggcgcgtttcaccagcaggtcgatgaccatcgcggccccgcccagctccccgggcaccggcacggaatgcccgcgcggcgccggcttggcctgctcgcagaacggccacaccttctcgttgccggtgtagctcaggccctcggtgcccggcgggacgaccaccttgcccgggtagtagctgcgttcgaactgaaaacccaagtcttccaaccagttgaagtgctcgacgctgccctcgcagtaggcgcggatcttgtccagctcgggctcccgcgacaccgccaccaggtacttgtacatctcctcggcggagtcgtcgtgaccggtcgcctgctgcaccgcggtgccaccgccgaggtaaaagtggcccccggcaagcgaagtggtgccgccggccgcggccgcgcgttccagcaccaacacccgcgcgccatcggccgccgcgctgaccgcggcgcagccgccggcaatgccgaagccgatcaccaccacgtcgacgtcgtcggaccacgacgtcacgtcatgggcactgacagttgccggtatctcggtgctcattggcgccattcctcctcatcgccgtgccgcgcgtccgcgcgggcgcggctcaccgctgctgctgtttgatgtagtcgtagaacgcccgcatctcgggcgcgatgtaggcgaactccacgaacggaactcccgcctgcggcgccgagacataggcgaagtggattccgccgggcatcacaccctgctgcaccaccggggcgccccgctcgccggcccgcgccagcgcttcggccaactgctcggggctgtcggcctcgacgcagatgtggtgcaaccccggccccccgtcggacagaaagtcactatagatgttctcgccacgtaccggttggatcagctccaattgcatgtcgccgagatagctcagcgagatgctcgcgacgaagtcggcgggcttaccccggtagctgcaggcattcgcagcaaagtgcacgtccggtatccgcacccacttgcgcacacctaacaggccggtgagggccgtttcggtggcatccaggtcgccggtgacccaggcgatctgcgtcggcgactgcacgggaagcgtcatcgtctcgcacaatagtcgagccgccgggcggccagaaagggcccgaaagaatttgccatgccgatccggtccgaaccgggaaaccgcgggtgaacacgttctaattccgtgctccgcggtccgtgaccggccgtggccggatcagtgccgggtcagcacgtcgaccagcagccgcagctgggcgtcgaagacggcttccacatcggtcagcgtgtccgccccgtactgtccgaacacctcgaggctgatcgcgcccagcacccccgcccacagcaaaaagcacttggcgatcaccaggtcatcgcccgggaagccgaattcgtgccggatccgttcaaagtcggatgacatcggttgcggcgcagggtcattggtcagccggatatcgccggtggtgatccccgccgccacggcgtcgaacaacgccgcgaccacccgggtgccggcggcaacggtgcgttcggggggcgcgtggtacccgggaaccgggctgccgtagagcagggcccagcatgccgggtgctcgacggcccagcgccgggtggcgcgcgcgatggcgatgacgtcgtcgctccactgttcgcccgcggtttcgcgggcccggtccacggtgtcggccaggtcggaataggcgtccaccagcagcagggtcagcaactcgtcgcggctggacacgtagcggtacaccgccgaggacaccatgcccaggtcgcgggcgatggcgcggaccgacagtccggccgcgccccggtccaccagttggcggcgaccgagttcgatgatgcgcgcctcgatctgctcccgggactgctggcgtttgcccacccggtcagtctgacacaaccgagaacaccgctcttgctttcccgaccgcggtgtggcagcgtgttcgaaatggagagcaccgctctctggcattgccccgggattcgctgagaggacggcgcccatgtccacccgatacgaagaaccgaaccgggccgcccgcgccgccaacgtggtggtccgctggctcgccgacgcgggcgtcagcatcgcgggcacccgggcgctgcgggtccgcggccgcaagaccgggaagctgcgcgcggtggtggtcaacctgctcacggtggccgggacggactatctggtctcgccgcgcggcgacacccagtgggcccgcaacgtgcgggccgcgtccgtcgtcgagctgggtccgcgctggcgccggcgacgcatgcgggtcagcgaggtcgacgacgcggccaagccgcagctgctgcggcgttacctcgaccggtggtactggcaggtcaaggactacgtcgccgggttgaccccggacagcagcgacgagcagttccgcgccgcggcgcccaccattccggtgttcgcgctgacgaaggcgggctgaacgggcctatccggcactcagcgcgcgttgtcgcgcaccccgaggtcttcgcggacttcctccgacgtcgcctgccacgacaccgcggccggatactccccccacacgctgttgaagatcccgacgatctgccccgggccgccgctgggggccagatacaccggcccgccggagtcgccgttgtggctctgcaccccgtgcgacatggtgaaccagccgttgttcacgctctccaccgtgccgcaggtctccccggtgatcaccccgaaatggcagaccggctgcccgggcgtcagcgccagcccggggtcggagacgagcggccgcccgcccggcaggatgttgttcgcggtgacgccgttgtccagcacgatcgcctcgtagtcgttgatcacctgactggtcgacaccgtcgttccgctgggggtgttgtcccggaaggccgccatccgcccgatcaccgtgccgccgcggtcggtcaccactccgccgccgccccggcagtgtccggcggtgaacgcgatcttcaggccggggtcgacgtagcccagcgtgcagacccggttgtcctgccgtatctccatgcccggatacaccatgacgtcggcttttgccgccgacgcgggcagcgtggcggccaacgctgtgacagtgatcgatgcggcgaaggcgcgtgttgccaggcgatgcaccatgaactccgatccatcgggccaactaccgacgggaggtcgaggttacggcgtaaccgtcctccacgctcagcttttcgcgccggccagcgccgatgttacagagaggtcacgacgggcgcgccggccgcggttcggccggcgctgcgcggtgcccagccgggcggcccgaacacgtagcccaaccggtcccgcaaccggctcgccgaccgccagtcgcgggcgatggcgacggattcgcgggtctgcagcgtccagacgttgaaggtgtcgacgtgcttggtcaggccgtagtgcgggcggaacagctcggcctggaaggtgccgaacagccggtcccacacgatgaggatgccgccgtagttcttgtccaggtataccttgtccatgccgtggtgcacccggtggtgcgacggcgtgttgaacacgaactcgaacgggcggggcagcttgtcgatccgctcggtgtggatccagaactggtaaatcaggttcaccgagaagctgaagaacaccatccacggcggaatccccaacagcggcaacggaagccacatcaagatctcgccgctgttgttccacttctggcgcagtgcggtggcgaagttgtagtactcgctggagtggtgggcctggtgcgtcgcccagatcagccgcacccggtgcgcgatccggtgataggcgtagtagagcaggtcgacgccgagaatcgcgatcgcccaggtgtaccagcgggtcgccggaaggtgccacggtgccaggtaggcgtagatcgcggcgtagccgaacagggccagcgtcttccagcccgcggtggtggccaccgacaccaagcccatcgaaatgctggtcagcgagtcgcgggtctggtgcgcccccggggccggacgggcggtgaggtgttccagcttgcgggccgcggtccattcgagcgtcagcaacaacaggaagaacggaatggccaccagcaccgggtcgcgcagctgcggcggcagcgcggtcaggtagccggacagggcgctcacaccggtaagcgtacgacgaacgccgcggcgctcagcgccgatcgtcggacgcctgcgcctcgtcgccggcgtaccactggaccgcccgcacacccggttgcagggacagttcggccaccagccgctccagccgggccggggcgtcgccgttcatcagcaggtgcgcggtcagggtgagctcgtcgtcggcgggatggccggtgtggatgccgcgcagcgtgatgtcgttgccgccggcgtgctggacgatctgggcgcgggcgtacttctcgtgtttgggccggcacaccacctgcaccagaaacggcagcaggctttcgtcttcgtcggcgctgctgtcccggtcgattagccggccgagcgggcgtcccagaagatgaatcccgatcaccgtgccggtgccgatcgcggcgaacaccagatgcccggacgcggccagcacaccgatcgccgccgaacaccacagggtggcggccgtgttgaggccgcggacgttgacgccttcccgcaggatcaccccaccgcccaggaacccgatgccggagaccacgtaggacgccacccgggtggggctggtgtccgaggtggcggcggcgtagagaacgaacagtgtggcgcccgcggcgaccagcgcgttggtgcgcaatcccgcccgacgggcgcgccattgccgttccagcccgatcagggcgccgcagcccacgccgacgcccagccggagcaggaaatcgacggcgctcaacgtctccacgacactctccttcccgggtgcgaggcggcgaagaagggagctaaccaaatccgggttaaccgcaagtggagcccaacccaaccgccgacgtcgggagcgatccccggcgcgcggcgaatctcaggctaaccgcctttgggcgcgagatggtgggggcagtaggcgttcgaggcgagcgccgcgaattgggcggcgccgtccatcgtcatgccgggattctggtccttgatatcggtgacgacctgcagccccgtttcgccccggcccatcaacccacacacggccttggcggacgcgatgacctggaccgggctgctgtaggtgatgccggactggtcgaggctggccaggaacgcggcgtcgtcgccctgcggctcggcgcgcgcgggcgcggtgtatccgagtgcggcggcgccgattccgagcagcgcgagcacgcgtttcatgcgcttcccgccggcccggcgccgggcagggtcacggtcggtttgccgccgctggacacgtgcaccgcatggatgccgggctttttcgacaaacggtcgagcaggtcgtcgagtccggccttgtcgacgttccagtgctgcacggcttccggttgccgttgcagcttggcgatgacgtcgtcgagtttgacgggttcggcgggtttcgccgcgcggacccggacgccccggccgctgccgacgtgcggcgccacggcgccgagggcgcccccggtgacgcttcccaacgccatctggccgagcaggccggccgggatcccggcggccggggccgcggccgctgcggtggccggcgtcaggccgctggccaaccggatggccggggtcgccgacgcccaggtcggcggcaccgacagcctgcccacggtgttcgcctcgccgacgcccaccgagacggcgccggtcagaccggcgccggccgaccgcaggcccagcccggcgcccaatgcggacttcgggatgtccaggccctcgacggggagcttgtagaacatcttgaactcggtcatggcgaggttgatcgggctcatgctgtcgttggcgaccgtgctgaaccggccgatgtcggcgaggatcccgaaggtgttctgccatgtcgtgcccgccaacggggatcccgtgagggtgttgagcacctggtcccagaagtccatgtatccgcgcgacgcgttgccgagcgcctcgagcagctggctgatgatgccggacggcggggctgtggcgtccgcggcgacggtaccggccccccggccggtggcctcgcccagcgcagccgcctgcgcggcgattcccgcgtcattggtggtcttgggcggctcggtgaagggcgccaggcgggtggcggccgccgacgcgctggcataaccgaacatcgcggcggcgtcctgggcccacatctgcccgtactcggcctcggcggcggcgatcgcggccgagttctgcccgaaaacgttgctggccaacaacatcgcgagccgggcgcggttggtcgcgacctcggcgggcggaaccaccgccgcgaacgcgctctcgaaggcgctcgcggccgccgtcgcctgctcggccgccgtcctggcctgcgccgaggtcgccgacagccatgcgacgtagggcgccgccgcggcggccatggcggccgccgacgggccggcccaggcctcgtcggccagaccgttgacgacggctgcgtacgacgacgcggcggactgcagttcggccgccagcgcgtcccacgccgcggcggccgtcaacatcggtccggcccccggacccgtatacagctgggcggaggtgatttcgggtggctgcagcgcgaagttcatcggatcgatcccgctcgagatgtcatggtctgccccgtcaatccgccggcaccacgatgatcgtggcggtcgtcgcggcaccgtcggcggccgcagcggtcgcggcgccggtggtgccgttgccgacggtgcgcacccccgcgcccgccagggcacgtccggccagactcgccgcggccatttcgccgaacacggccccgcccgacgcgggcagcgccgcggcggttgccgagctcgcggccggcagcaccgacgtaaccgtccttaggacgggggcggccgtggtccagcccggcggcaccgacagggaaccgaccagggtcgagcggcccatcgacccggccacgccgccggcgtcgggggtcaccgccgagacgtagccgccccgcagcggcgccagcggcgacagcccacccgcgatggctttgccgccacccagcagttcggcgacgcccggcgcgttttgggccagacccagcgcctgcagggacagcagccaccacccgccgggcaggatgatcgccccgatcgggctgtaggcgccggtgacggcggcgaaaaagggccgcagcgcggccgtgatcggatagatggcctcgatgatcgacgccgccggcgtcgccgccgccgccgaaggggtcgtcgccaggccttgcagcatggtgggcgtcacgtcgatcagggtcgacagctgggccgggaggtccgacgcggcgctctgcgcgactgcggcggattgccttgccgccgcggacgattcggtggtccgcggcggttcggtgaagggcgtcagctcggtggctgccgccgacgcggcggcgtaggcgtacatcgccgccgcatcctgggcccacatctcggcgtactccgcctcggccgccgcgatggccgcggtgttctggcccaggatgttggtggcgatcagggtcatcagcaggctgcggttggcggcgatcaccggcggcggcaccgtcgccgcgaacgcggtctcgtaggccgcggcggcgagcctggcctgcgtcgcgacctgctcggcccggccggcggttgtcgtcgcccaggcgatgaagggcgcggccgcggcgctcatcgacgtggccgccggccccagccaggagccgaccgtcaggcccgcgatcgtcgacgtgtaggccgccgcaaaggaatacagttcggcccccagcgcatcccatgccgcggcggcggccagcagcggccccgatcccgcacccacgtacatccgtcctgaattgacctctggtggcagcgccccgaagtccacccgttgcctcccgtcctgctctgggcgccagggtaggagcggagatggggtcgtcccgccaacgagccgcggctcaaatggaattcatcagatcggcagtgaaggatatggattttccatggattcacccgccgcacccagccgtcggttgaccgccggcgtgccccgcctggcgccgagcctggccccgcctagcctcgccccgcctggcgccgagcgtgaaactaggcgcacgttcggcggcgagcgtgaaactaacttcacgctcgcgcggcgttcacgctcgccgcggcgctcgcgctagcttcggttaagttgctgcgggcaatagtatttcgccgcgatcgcgaggaacgacgtggcgtgatcgttggtgagcccggggttttggctcttgagctcgtcgagcagctgcggacccgattcgccgttgcccatggacacgcacaccgcttgggcgaacttgatcgcgccctgcggcgtcgcgtaaccgatgccggcgctgcgcagcgacgcgaggaacccggcctcgtcgacgcccggatcggcctgcgccggcggggccagcgcgatcgccgccgcgacgcccacacccagcagcagcctcatgacccgggatcgtcgcacgccgcaacgacggacccgccaacggcagagttgttggagggcaaccacattcgcccttctcgcggcgccggtcaggccttggagagctgatgggggcagtagtatttcgcggacagcagggcgaagttcgatgccatctccatgtccattccggggttgtgggttttcacgtcgtgcaccacctcgagccccggctcgccgttgttcaggcacgagcacacggcgcgtccggcggcgacggccgagccgggactgctgaagctgaagccggcttgctgcagcgcggcgacgaaacccccgtcgtcaccgtcgggcaccggtggcggatcggcatgtgccggcgcggccagcccgatcgtggcgccgatcatggcggacgcacccagtgccgcgagcagtcgtttcatcacgtgtcaccctcctgaactctgattgccttgccgctcaacccaactgggcatcggccggcaggaccttggacttgtcgccctttttcaggtgcaccgcgtggatccccggtttcttggccagctgctccagcagcgcgtccaggttctcctggtccacgttgtggtgctgcacgctctccggctgctcggagatctgtgcgacaaggcgtttcagctgttccggcgattgcttgtctttgaggtccttgatcgcggtcatccggttgcggacgccgccccgcaccatggtgggcccgccggagccgaccgcgctgcccagcatcccggccagccccatcgaactgaacaggctgccctcgcccagcgcggccgccggcactgcctcggccccggcggccgacagcgcggcggcgacggtccggatcgacggcgtggccgtggcccagctgggcgggatggacagcttgcccaccagggtgccggcgttgcccatcccggcgaccgggctgatcgcgctgtacagcgtgccgcggccgaagcccagggcgcccagcccggccccgagcgcgtccttgggcaacgcgccgtagccgatcggcggggcgaacttcagccactgcgacaacgggaagttgaccagcaacccgacgtcgttgaactgggtggtcagccccagcggcaccttcacggcgttgtacatgctggtgtagaagctggccccgcccgggacggtgttgaacagattcgtcatgaaggtctggtacagatacgccaggttcgccgggccggagaacgggccgctgtagggcagcgtggtgctggccgcgctggccgcggtctgggcgacattggcggccggggtgctcgccgccgacgacaccgcggcggcctgcatcggttgggccgcctcgtttgtcgtcttgggcgccgggccgaactccgtcaacttgttggcggcggtcgccgacgccgcgaagtaggtgtccatcgcggtggcgtcctgcgcccagaactcgccgtactgggcttcgttcgcggcgatggcggcggtgttctgcccgaagatgttcgtcgccaccaattgcgccagcagggcgcggttttcggtgatcacggcgggcgggacgtgcgcggcgaacgcggtctcgtaggcggtggccgccgcggtggcctgggccgcggtttcggcggcctgcgcggcggtctgctgcatccaagccacgtacggcgcggccgccgacgccatggccagcgacgacggccccacccagggcccggccgtcaggccggacagcaccgtcgaatacgacgccgcggcggactgcaattcggcggccaggttctgccacgccgtcgccgcggcgacgaacgaccccgcacccggaccgctgtacatccggcccgagttgaactccggcggaaaggccccatagaacatctctgctgccccctacctggccgcgcgacgggaaagcgattggcggccaatcggtttggtctcggtaatcatggtgctcattcctcgatgcacgggatcacgatgatggtggcggcggccgggtcggcctcggcggccaccccacccagggagttcgcggccgcggcggccccgccgaccgggcgagtggcggccgcggcgacggcgcggccggccaggctggacagggccatctggctgaacacgccctcttcgccggccatcgcggcgggtgccgccgccatgtttccgggcagcacctgggcgagggtccggatcgccggggcggcttccgtccagccctgcggcaccgacatgctgccgaccagggcggccttgcccatcgaccccgacacctgccccgccccgaccgcggagctcagcatgggcttgacggcgttgccgccactggccagcggtgccaacgcccccgaaatcgctttcggcccggccaaatacgccgcggcaccctgcccgttctggccccaggcgtaggcctggccgaacgacaggaacgggccgccggggatggtgctccatgactgcggcgagtacaccccggtcaccaccgaccagaactcgttccagttggtgatgaaactcggcgtcgtcagctgggtcgacgcggtcgtcgtcgaggcggcattgccggccgcctgggccgccggctgcgcggtcgcgctcagctgggacaggtgggccgcggtgttggagccggactgcgcagcgctctgggcgaccgcggccgactgcagcggtccggccgactcgttggtggtgcgcgggggctcggtgaacggtgtcagctgggcggcgctggccgaggacgccgcataggcgtacatcgcggccgcatcctgggcccacatctccatgtagtgcgcctcggtggcggcgatcgccggggtgttctgccccagcatgttggtggccaccagcgtggcgagcagggcccggttggccgcgatcaccggcggcggcaccgtggcggcgaaggccgtctcataggcggcggcggcgagcttggcctgggcgccggcctgctcggcctgcgcgccggtggcctgcagccacgccacatacggtgcggcagcggccgccatcgcgatggacgagggcccggtccacgggccggtggtcagcgtctcgacggtcgagccgtacgacgccccgacgctctgcaactccgcggccagctcgtcccacgccgccgcggcggccagcagcgggcccgaacccgcgccgacatacatccgccccgagttgtattccggcggataggcaccgaaatccagcatttaggacctcccccaccccgcgccacgccgagcaccccgcccctcgccccgcagcgacgaattcgcgacgccgagtgaattcatcgaaagcgctttcaaatacatgcgcgcattccgcgcgttgaagacagcaagcccctactctcctagctgtgcaccggcgtcaccccgccggacgaaggaccagtcagccacgctgctaatgcacagacaatgctgcacaaaagttattcagcgggcgttcccgtcaggtaaacccatgtaaaacatcgatgtcgcggcccgccgtcgcgtgtgagaacacgcggactgaaggcccagctcagtggcgcaagtcactcgaccaacgtgctgtgggcagcatccgaccacgggccgatcccggtgaacaatcggttatcggttcgacgggaaatgctcgcgattcggcgtcatcgccgatttatacaattggccggaaagccatccttattgcgcccgaaatgcgtaaccttgtaaacctcccgtctcgcttatctcagcgacggagttctggcattacggttgcctcgcacacccctgagcgacccggcatcaccagggtgtgtcgcgcatcttcagtcgatgctcgtcaccatttcggtgaaatgcatcgaccgaaaatcgagccgacagcgctgtcggtgacgtccgcgctcgtgcggccgcacgagcgcggcgacgtcctctcatacgagtagacgcggccaatctgccctggcactgattagctactgacagtttcctgtatggcaataacgacgtggtcagatcgattttcgggcagcgggaacgcgtcggttcgggtgtctcgcgacattgccggtgtgacggaatttactgaattgccgttggagaaaaccggcgtcgtgtagcgccctgcgggccgggccggggtggcggtacgtaccgccctagctattgctgtgcgggttcgtgccgccgtcgctgatcgacagccggtcgggacagtaggcgccggcggcggcctgaacgaacagggccgcctttgccgtactgaatgcggggttgagctcgtggacatcccggatgatgtccagctccgtggtgcccgagccggccaggtcgcacaccttctggccggcccttatcgcgcgggtggggtcgggataggtgatgccggccttgttgagggcggcgaggaacgcgtcgtcatcggaatcggcgtgcgccggtatcgccatgccgaccagggcggccgcgccggccagcagcgctagggttctcatgtcgcgaccccccgtcctcacccggcggccggcgggcggccgatgatgcgcgggcggaacccgtacatcggctcggagaactcgtcctcatgcgcaccggggaggcccgccagcggcacccccggcatgcccactgccccagcctcttccatcaccatcggggtggccgagccgaagccgtggtaggcgcccaggccgacctgagtcgtcgccgccagcggcgtgatcgccgctccggttgcaccccaggtcggcggaaccgacagcgccccaaccagactcgcctgccccacccccgccgccgctgccgcaccgggcgcggccgccgacgccaggttcgccgtgccgccgagcccggcggccagcacgcccagtcccgacgtggtggagtcgacggcgttcagcgagttgatggagttcatgttgaccgccgcgtcgacgaacgaggtcgggttcagcagcccgctggtggtgaaggcgttggagaggttggcgaccgaggcgttgttcaggaagcttcccaacacattcccgtcggatccatccaaaaagttcatcagtcccgcgagcccgggctggccgggtccgttggtgttgggcgccaggccgagccaggcgagcaagccgccggagggatccccgctgccggcgtcgttggcggcttgggcgaccgtgttggcctgggcggcaatgccgttggcggcggtgtccgggcgcggcggggtgaacggtgtcagctgctgggtggccgcgttcgaggcgctggcatagccggtcatggcggcggcgtcctgcgcccacatgtcgccgtattgggcctcgttggccgcgatcaatccggcgttctgcccgaagatgttgccggccaccaggttcgccagctgggtgcggttggccgcgacgacggccgggggcacggtcgcggcgaacgcggcctggtaggcggcggcggccgcgttggcttgggccccggcctgctcggcctgcgtggcggtggtgtgcagccactcgagatacggtgtgaccgccgccgacatcttcgccgcggacggtccgaaccagccttcgccggtgagcgtcgcgatcgccgactcgtaatcggttgcagcggagcgtaattcagaggacagggcgttccaggcggccgcggcggccagcatggattccgagcccgggccggaatacattctcgccgagttgacttccggcggcagtcccgcgtagatcgacatgacatcttctcccgagttctcagccggcggccggcggacgtggcatgacgacgggccggaaaccgtatttggggatggcgcggcgaagtcgcctgccggtgccgcccaccggccccgcgacgcccccgggcccgcccgccgccggcgccgcgtcggtgagaccggtgacgccggtggcgggcacggcggcttgaccggggttgatcgtcgcggcgttggcccagccctgcggcaccgacagcgaccccaccagctgcgcgcggcccatcccggcggctaccgggaccgatccccccgtgctggccgccaggtcggcggtcgcggcgccttcggcgtcggcggcgaagtcccccagcccgcccagtgtggtggcgtgctgcgcggccaggacgccctgcaccgaggagatgatgaattgcgggttgaacgcgccgccggcgagggatccgttgaccacggcggtgctgaagaagttgccgttggtgaaggttccgaaggcagagttgtccgaaccgctcaacaggccggccagcccggacgacgacaccgtcgactgcaccgttcccgccggcgcctgggcggcgttggtcaccgacgtggcttgggctgcaacaccttccgggctggtgttcgaccgtggcgccgtcatcggtgtcaaccgtgtcgccgcggtcgaggcgacggcatacccgttcatcgccgcggcgtcctgggcccacatctgtccgtactcggcctcggtggtcgcgatggccggggtgttctggccgaagacgttggtggccaccaacattgccagctgcgcgcggttggccgccaccaccgccgggggcaccgtcatggcgaatgccgcctcgtaagcggtcgccgcggagttggcctgcgcggccgcctcttcggcccgggtggcggtgtcggtcagccaggccagatacggcgtgaccgccgcgagcatcgacatcgacgacggaccgaaccagtccgcactgttcagctccgaaatcaccgcgccgtaagaagctgcggcagaacgcatttcggcggccatggtgttccacgctgcggcggccgacatcatcggcgccgatccgggtccggcgtagattctggccgaattgatctctggcggcaacgccgcgaagtcgatcacgggtccccccttgaaggctcagcgggccgccgccgcgttcgcggcctcggtggccgcgtacgatccggcgctggtctgcaaggtggtcacgaacatctcgtggatcgcggccgcttcggcgctgaccgcctgaaaagcctgcccgtgctgggcgaatcgcgccgcggccagcagcgagaccgggtcggcggcggccgggacgacgccggtcatcggcgcggagttggccccggtctgggctgccagtgcggtgccgatctgctgcaagcggtcggcggcggcattcatggcttccggctgtgcggtgacatacatcatcggagtgctcctgttcaggcgcgagcgagcccgagcgctcgggaaggttccgcgcgcgcgtcagcgccaccgatcggcgcacaggcgcacggagtaaagttggctatttacaagccaattcaggcaaaaacgatgccgaggacggatcgaagcgacgtcgtcgtcgatctggagtaaggactgtcatcgggactcaatcgctctcacctcctcaaggccgcggcacgcgagggtgccatgggttcgcacatggggaggagcgaccagccgaaatagccgggcgcggcacccctctcgtcagagcttcggcaccacacggcgtatccggccgtcaaaagccggaagccacttgggctcaacccttaatccgggaggagctgtcctgaccctgggcgtctttcgacgttcgaggtcagtggcctgtgtccgtgcagacgcctcacctagcgaggtgcttgcattggcaatggtggcactcgggggtcggctagtcaagctgatccacaacgcgataccaacggttcacgcccgcgtcacctcgggggaaggctaggtggtcttcttctctgccaccgccgcgctgaggccctcggcgaggtcctcgcgggtcagctccttgaaacgcagcagctggcgctcgctgaactcggtcccgtcgctggccagcacggcatccaggtcctcgtcgtccagccggaagctgcggtgatcgcgcgccttctccaccacgttgcgcacgaagccggcgttgcccagcgtgtcgatgccgcggatgagatcgccgtcctccgaatagctttcgtcgagatagaacttggtgtacgacggcagcagggcctgcgccgcttcgtcggtgatgacgtcctcgttctcctggcccatcaaccgggtcagcgcgaccagttcgtccggggtgtagctgaagaactcgatcacggtcgaaaagcgccgtcgcagaccctgattcacctcgagcatcttgtccatggccttggcgtagccggcgccgaagaccaccagctcgtcgcgatggttctccatgtacagcagcaaggtgttgatgatcgcgttgccgtacgggtcaccctgctggtagcccttctcgtgcagggtgtgcatctcgtcgaagaacaccgcgccgcccagggcgccctcgagcatctcctcggtgttcttctcggcgtcggccatgtatcggcccaacagcttggtgcggctggtctccaccaccagcggcttgcgcagcaccgtcaacccgcacagctgcttggtgaaagcccttgccaccgaggtctttccggttcccggcgggcccagcagcagggtgtggcgcgacgtcaccggcaccgggagtcccatcttggcgcgggccaggttcaccttcgtcgtcgacttgatcagcttgatctcgcgcttggcccgctccatgcccagcatggcgttgagttcggcgtcgccttcggccaggtacttggccgcctcctcggcgtggcgggcggcttcggcttcggcgcgggtgggcgcgctgtcggggtcccacgggtcggtgcgggcctcgatcgtttccgggtcggtcaacaccagccggtaggtggggttgtccagcgcttcgcgggccggggtgaacttggggtcgcgcgaatacacccgccgcagcagttcgacggcctcgtcctcgcggcccaggtgccggaggcacatgccctgggtgtacagggcgatgttggccgcgcccggcacccggtcgccctcgatggcctcctggccgcggcgcagcgcctcctcgaacaccccgagcgaggccagcgccgtggtggccatggccgccccggcggccttcagctcgggctggcgccagcccttgccctcggggaactggttgagcacgtccggccaccggccggtgcggaagtacagcacgccgcgcacgtaggagagcagctctccgtccaccggctggcgcggttcgacgccgtcgatcagtttggccgcctcagcgtagtgcttcgcctcggcgagcaccacggcgtaggcgcacgccagcgattccacgctggtgacggccagctgcaggaacaggccgtcggaaacctctgggcggaactgcaattcggtgacgcccaggcggcgggtctcccagccgaacgtgcggatggaggaccaggcaccggccagcacgtcgaggctctgctcccccgccaggatccgcgccagccaggcgtcacacatggtgggatccaggttggtcgcggtggtgaacatctgcgccgcgacctgtggattgtggctgggctgtaacccgttgaccgacacccccgatgccagcaggccggcgaccatggcgttgcgggcgccctcagcggtggactgcggccgcgtcattgcgccacgggtacgcccgccgcgctctcccggggtgcagcgagcgatagcgacagctcgtcatcgtcggcgcgcagcggacggctcggcacctccagcagcggccgggcggtcgggacgggcaggctggcccgcaccgcggccagctggcgcccggtgagacggttcagccccgacgagatgttccggcgcagccgtttctcggtgtggtagcgcacccacgccgacacgtgcggccggccggcgcgggcggtcagccggatggtcagcacggtggcgaaggtgtcgtcgtcccacagctcctcgagcttgtcggtggtgatgtcggacggcgacagccacaggctcgtcacgaacccgttgaagtgcttgaggcggcgccacccggggcggctccaggtcggttccaggtcggccagcaccgcccggtccacctcggcgatctcctcggcggtcagtggccgggccgcgcaggtcagcccgtcgagatcctgggccagccgttcggtggccgccaccagcgtcgaggccagcgaatcgcgggccgccaccgctgcgacgttgcgctgcgggttcatccgcaacaccagccaggtccggcgaatgtaggaggtgggttcgtcgccgaccacgtcccactcctcggggccgaagttgtcgagcttcgacagctcggcggacctggcgtcgggaccgccccgccggaccttgaccgacacgatgtcgatgtcgtcgaggtggatatcgaactggcgcagccccgaggcgacggccgccaccagcagggtcggggacgcggcgcggtgccgatgccgcgaccccgtctcgtcctcgccgccgttgacggcgatcacggaaacgagttggcctttgtactcgcgcaccccgaccttgtcgcggccgaaccggcgctggtggtccagggccggcgtgcagcccgcggccagcgcggagccgggatcggcggaccagtcccacagccaggtggccagccccgacgccaccgtgatgccgtggtaggtcaccagcgacagcagcgtcaccagcacggccagcccgacgccgacccagaacgcgatgcgataggtgccctgccaggattccgggcagtggctggccaccaccatgatcacgatgtcgaccagaaacaccgtggtcagccggggccacgtcaaggacaaccccaatctgcgctgagccttcatcagtcttgctgctccgcccctattgctgcctgcgcgatcgcttcatcagcatcgccgtaccgaacactgcgccgccgatcaggagcgccccgaacaatcctccggccgccacccatattggcaccatatcccggtgcgggaccggtttcggaatggtcagcggcgccgagagctgctgcggcggcttgaccggcccgtcgggcacgtcccaggtcagcgccgcgaccgggtcgacgatcccgtgaccgacctggttgtccaccccgcgcgcgggcgcccgggcggtccgcgtcagccggttgatcacctggtacgccgacagctgcgggtatttggcgcgaaccagcgccgccaccccggacacgatcgccgcagagaagctggtgccggacgggaccagcagggtgttgtccggcccgtcgatggcgttgatcagcccgtcgtcgcggggtgagagtccgacgacgtcggtgccgggcgcggcgattcccacccacgggccggccacgctggtcgacgcctgcccctggttgccctggctgagcgggtggccttcggtgtcgaccgcgccgaccgtgagcacgtagtcgctgaaccaggacggcgtcacgacggtggtgacggagttccagttgcgaggatcgttgggctgcaacggatcatgcggcgggttctgtttgcagtccttcttgctggtatccccggccgcggcgacgatgacggcgttcttgtcgaccgccgcgtagcgcaccgcggcgcccagcgcccgctggtcgatgatgttgcgggcgctcatgcaggtcacgtcggagatgttgatcaccgacgcgcccatgttggcggcgtgcacgatcgcgcgcgccatcgtctgcacgttgtcgatcttggcctgcgtctggggatcctcgtcgccggtgtaggcgtctttgaggccgaacgcctggctggattgccggatcgcgatgatgtcgacgtccggggccaccccgctgaacgcgtcggggcccggcttgggcggcgccggcggcgggtcgagcgggcgcgggccgcgcaggttgtcgacgttggtcacccgggcggcgcccgcgtggcccgggatggtcaccgtgccgccgccgtggttgccggccggggcctgcccgccctgcggcggcccgggcggtggtccggccggggccggtcctgccgccggcggcgggggcggcgccccgaacggtcccggtggtggctgttgctgttcctgcgacggcgggggcgggaccatcgtcacggtctgcggcagcggcgagagcgtcaccgtctgcggcggcggcgctttgggcggcggctcggtggtggggatggtgaccggtttgcgcggcgccgccggcgggacgcccgcgccgtcggccgacgccgccccgatcatcgaggccaccagggtgccgtgcgcgtcgcagtcggacaggccgtcgccggacatgatgtagtcgccgcccgggatcaggtgcggaaaccgcgggtgcggggtgacgccggtgtcgatgacggccaccttctggccggccccgcgaccgaactgccacgcctcctgcaggttcagcatgtccatgtacttgggctgcaaccgaaaatcggtgcccggcagcacgccgacctcggtgcagtacgagttctgcttcatcggcgcgcccggaccgggcggtccgtccggcggcaccgccgcggggtcgatcgtcggcggcgaaatcgcggcggccggcggcagtccggccagcgcgcccgacgcgagcaacagggcggccagggccgcggcggacgcgcggccgcgccacacgttggcctcagcggtagcggatcgctgcatagacattcatcaaccacaatgccagcgggaagatcggcatcaggcagaggtattcgatccattccacgaacttgcggaacagcgggctgtagacggtgttcggcaccacggccgccgacgtcaggcccgccaccggcaccagcaccaggatcgcggcgctgatcgagaccgcgagcggcgactgcagcaccagcgcgtagcgcaccaccaccgcgccgacgatcagcaccgccgtcccggccagggtgatggcctgccagcggtcgacgtaggagcggccgcgcagcagcaggaagcccgcgcagaaaccggccagcagcaccggcaaccagcgttgcccggtgcgcgggtccgacagcgcggtcagcgagacgaccatcagcacgccgagcccgatcagcagacccgacaggaaggaacgggcacgctcggcctgggtcagcacgtcgcgcaccgaggcgggaccctccagcaccggcgggccgccgtcggaccgcaccacggtggtgggcaggtcgggccgggcctcgaacacccagcggctggtggccgacgggaagacgggcagccggatgccggccagccgccgcgagatcgccggcgcgctctggtagatcagcaccgacaccagcaccacgcaggtcaacagcgtcaccgcgccggtcatcgcgaccatgcgggccagggcggccagcgccgcgatcgcgctgacggtgacgatcgcggtgtagatcgccagccgacgcccggtgaaccgcaacgcgagcaccgcggcgatggtcagcacgccgaagcccagtacggcctggggcgagcccacgcccccgggtggcgcggccgcagcggcgaccgacaccggcgccaggctgctcagcagcagggtgtcgcccacccgccgctcctgctgggtggtggcgcgcatgagcagcagcaccgacacgcccagcatcagcacgccgatcacgccggcgtagacggtcggcaaccaggagttgtggtgccagcgccaccagccgagcaggccggacgcggcggtgacgccgacggccaccatggtggcaccgacctgcacggcgaccactgggtcgatggcggcgaagcgcttgctgaggttggccgcgacggcggtggagatgtgctcgatgacctgtgagcggtgttcggtgtccgggatgaaccggatccacagccggtcgccgtcgtagacgtcctgctcgctgagcgactgggtggcccgcagcggcgagccgtccaccaggcacagcgcccagcggacccggcccgtggcctccagcggggtctcgccgagctcacgcagccgactgttgaccaccttgagcagcggctcggtcatcaccgagaccggggcgttggcgtccagcagtacgccgatctgcacacccgcgccggccatcacgccgacgacgaccgcctggggctgcgagatgccctctacgtcaggctgtggtacttcaacaaccgcagtcatcgccttgcactccctaccgtgatgaatgtgtgggcccgcgccgccaatcgggcgcgggccggttccggcctcctcgaggcgtcgcggacccccgcacagtgcattccgatcaactggaattccatctgcctcgccttgcgatcaagagttctggtggacaccggttcaaaatttgctgatgcctgagagaagtatgccgtgtccgcagctcaaccgcatgttgagcgcaagacattgacgaaatccgtatttggtgtgggtcacaccctgctgtgggttttccactccccgtagggaagtgtgtccagcacggttttgacgcccacctggaccagctgcggggtggccgggcagatggccagccacgcctcgccggagcccgcggtccgggcttgctggtagagcgcgatgcggccgccggagccgtctttgagcgacagcaccgaggcgctcgggcctttggcgtcgtcctggtactggcgggcgtacaccgcgacctcggcggcgggatcggacagcgcctggcccagcgcggccaccgtggcggcactgatgcccatccggcgcaggtcgccgccggagaacacgttgaagccggactcctgccacgacttggtcgcttccagcatctcctccagcggcacgttgaccgcgttgatggcggcgggctcggcgtggtggatggattccagggcgtcgatcaccagggacgcgatcgaggcgctgtcggcgacggcgacgtcgtcgacggtgatctcaccgcccacccggaccgccgacacccagtgctggccgcggcgggccagcaccacccggaactcgttgtccgggatgtcgcgggacccgggcggctggttctggtcgtcgatgacgccgtaggccagcttgccgcgggacagcagcgcgatcacctcgaggtcgggcgccgcgagcacccgcatccgcgcggcgacctgctcgttgacctggtcgccctcgacgatgccctgctcgcgcatcaccgccatcccgggatggtcgttgagccagtcgttggagtcggtggagacgtacggccggcaccgcagctccggcgcgacgtgccggatgtccagcaacgcctggagcatccagaaaccgtcgacgttgaccgtgatgtcggtgcgggtgctctgttggtccatcaattcctcaattggtcgctgaccggctcaagcgtcaaattgcacgataaccgcaggacgcggcagcacaccgacgggtggtgtgctgccgcgcctgaagtgaaggcgtcaggcccagctggacccgacggcgctgtcggtgctggccatgttgctgcccgcggtctggaccttctggccgtgggcgttggcctgctcgtagatcacctggaagttgcgacccaactgggtgatgaactcctggcaggccaccgaaccggcaccgccccagaagtcaccggcagccagcacatcacgaatgatggcctggtgctcggcctccagggacgcggcctgggcgcggatgagcgcgccgtgggcgtcgacatcgccgaactggtagttgatgctcatagcgattgctccttaaaagtgttggacggcagcagttctgggctagctgctgaggatctgctgcgaagcctgctcttgctgctcgtagttgttggcgtcgcggatcagcccgtcacgcaccccgtgcagcatgttgacgatgttgcggaaggcctggttgacctgacccatcgtgtcgtacgaggtcgcctgggcctgaccactccagcccgcaccggcgatgttcatcgacgacgcccacatcttgcgggcctcgtcctccacggtctgggcgtgcacctcgaagcggcccgccatcgcccgcatttcgtgcgggtcagtcataaaacgtgttgccatctcggctgtctccttattacgtgattactggatgtgattacgacggtggccggatcgattacgtgttaggcaaccgccgagccgaatatgtagaaatgacccccccttcccgtcagccggcggccaccgggtgttgtcacggtgcgacggacgtcaaacccgaaccgcggcgtttgagttgacggtgtgcgctgggcggctgcgttggaacccacgtcggtgacgacctgccccaagccctgaaccggcgatccggatcagagggccgcggcggcgttggctgcttcggttgccgcgtaggaaacggagctggtcgacagggtgttgacgaacgcctcgtggatggcggcggcctgggcgctcactgcctggtacatctgcgcgtacgcggcgaactgggctgcggtcagcgccgagacctcgtcggcagcggcgggtaccacccccgtcgttggggctgcagcggccgcgttctgggcgctcaaggtccacccgatagcctgcaggttcccggccgccgcggccagagcctccggctgtgtggtcacgaacgacatattttccctcctagttggatccccgactctgcgagattagatgacagcgagccgcgaagtcgccgcggaaacggcgtgtttgcaattgttcacttggcggtacggcgaattcacttttggtaacgacacagtaacagcgcctgacctcgaccgctgcccttcgcgcgacggtcatggcaaacgctaccagcccccggtcgaaaacgttgctggtaattcgtcacaccggctgcgcggccacgtcggccggcgtaaaaatccggcggccgattaactcgcggctcgagtcgatgtgcgggtgtttcccgctggcgtgtcgctggtacctcctttcgcccgtttcggaccgctgagtgcagcggtgctcggccaattccggatgacactgggtgtgggttatccggcgaagggtggtcgggccatgacggtggggcggaagccgtatttgggtccggcggcaccgtggccacccgccccggcacccgccaggggcataccgccgagcaggttgcccggtcccccggccgcctcgggcgccgcactgatgctgctgaccggaatggcatgccccaacgccggtgcggccggggcacccgaccaggccaccggcaccgacaacttgcccccgatcgaacccgcaccgcccaacgccgccaccggatgcgccgcggccgcaccaccaccaccgagcatgccgcccaacccccccaggccgggcaacgccttggccgccgccggagccgccccaccaatggcccccaccgacttggcgatctgggtgaacgtgttggccataccagtactgaagtacggcaacccctccgtgttatagaacaggctggcgaacgggctgtagccgttgacggcactacccaggctggtcggcaacgtcgtctggccggtgagcaggaaccagatctccgagagcggatcggtgctggtggtggaggccgccgtggtggccgccttggtcgccgtggtcgaactcgacgccggctgggccagcgactgcaacgccttggtggtgttggtcgaggtggaattggccgtcgcagtgctgaccgccgcactctgggcaacctgccccgacggattggtcacctgcggcgccttctgaaacggcgtcaccttactggccgacgccgactgccccgcatagctatacatcgccgccgcatcctgggcccaatactccccatactgcgcctcaaactgcgcaatcaacggcgtgttctgccccaacacattcgtcgcctgcaactgcgagacctgcatccgattcgccgcaatcaccggcggcggcaccgacgccgccaacgccgcctcaaacgccgccgccgccgcccgcgcctggctggccgcctcctcagcctgcgccgccgtcgtactcatccaccccacatacggcgccaccgccgacgccatcgacgccgacgccgaccccaaccactcctcactggccagcgccgtaaccaccttgtcataactcaacgccgccgcattcaactccgccgccaacgaactccacgccgacgccgcagccaccaacgaacccgaccccggacccgaataaatccgcgccgaattgaactccggcggaaacgccccataatccaacatcattgactccttaaccagccgcggccgcgttggccgcttcagtcatcgcgtaggacccggagctggtgctcagggtgtggacgaacacttcgtggaccgccgcggcggccagcgcctcgggcgctgtggtgacgaatgacattgaggttcctgcctttcgatgcggcccggcgcccgtgccggagtggtgtgcgggtggactcggtcgtgttgaggtgggcatgggcgtcatccggccgagggtgggcgggtcaggacgctgtagcggaagccgtatttgttgacatagcccgcggccgcgccgcgccggcccagcgcccccaccggcatgccgcgcaacaacccgttggccgcaccccccggggccccaccggccgccgcctgcaccgcgctgccctcctcggagaccgccgggctgaccgccgaggtcaacgtcgcccactgctggggcaccgacaacgcccccacccggcccgcgccggccgaggtcgcgctgacatggctcgccccgcccacactgcccaggttgcccaaccccagtttggcgaactgcggcgtcggataccacgcacccccggcacccgccgtgctaccaccgggccccgacaccagctgctgggccagctgcgaccagaatgccgtgatgccgttcgagaagtaacccagcccggaggtctgtttgagcatcaccgtgtagaaggtcggactcagtccgaggtagttgttggtgggggtgggcagcccggactgctgcaggttctgcaacgcactggtcagccaggtgaacggcccggtctgcgaggcactgctgctcgaggcctgcgtcgccgcctgcgacgtgcccgccgacaaggcctgcggcgtggccagctgcgaggacgtgttggccgcggtctgtgcgctgttgccggccggttctgccgccgcctgagccaccacggcggcctggtcggattcgccctcgggtgcggtcgtattcggcggtgccgcaaagggactcaacgtcgacgcagtctgcgacgccgccgcatacccatacatcgccgcagcatcttgagcccacatctccatgtactgcgcctcagtggccgcgatcgccggcgtgttctgcccgaagaaattcgtcgccaccaacgtcgccaacaacacccgattcgccgcaatcaccggcggcggcaccgtcatcgcaaacgccgcctcaaacgccgccgccgccgcccgaccctgactagccgtctcctcagcctgggccgccaccgcactcaaccaccccacatacggagtaatcgccgacaccatcgacaacgacgccggacccacccacggcccactggtcaactccgcaatcaccgagtgataaccactggccgcaatccccaactccgcggcaacctcatcccacgccgccgccgcagccatcaacggccccgaccccggacccgcatacatacgaccagaattgatttcgggcggtaacgctccgaagtcaaacaccgtgtcgtcctcctcagtcggccgtgatcgcaggcgatctcggctggcgcatgggaatcagtggtggccgtggtcacggctctgtaagcgacgccaccggtcggtcgctgcccccgaaaccagcccgtggcaggagcggtccgccccccatcggtcgagccggccggcgcatgctgaccaagtggctgcgtccgcaaaggtggtgggccaccacgcttctgcgacgtctggtcaggaacgacatgcaccttctgcctcggccaatcccgtcatcagcaaccgagcgacagcccgtttgtgtgcccgaactgccgctcggcactgagattagttcgttatgcggcgaactccgacacgcaaaggcatctgttcatcaatggccagccactgttcattcccggtcggcaggagttcatacggggcaacggattgttcattttccgtttgccttcgacgggcctcgcaaccggcgttgtggtcagtcttcttcgagaatcagcgccatttccgggcaggaggcgacgccgtcccgggtcgcttgctcgtcttcgggtttgacctcgtgctcagccagaatcgagtagccggactcgtcgatgggaaaaaggtccgggtcgacggcgtagcactgcgcgtggcccacacatttggactgctccagacgaaccctcacgagccttcctcctttggcgagcttcggcgagcattggcgagccgatcgggactttgcgaacgactgacaatgcgcttggtgctccgatatcggcgcccgatatcgatgtccgatatcaaggttagtcggccggtaaagtggcgaaggtgtttggccgacccggaccgggtgcgcgaatgcctcgaattggttcgggcaggcgaattcgtgttgggttgccgcgcaggcaatatggacgtgcaccccgacagatgaccggagatccgagcgcatgagcgaaggccaatacggcaccttccacctaccccggctggattttgcgacgttgccgatgagcgtcgatcgcggtctggggtggaagacgttgcgcgacgccggaccggtggtgttcatgaacggccactactacctcacccgccgggaggatgtgctggcggcgctgcgcaacccgaaggtgttctcgtcgacggtgctgcaacctcccgggcatccgctgccggtgctgccgttggcatttgacccgccgcagcacacccgctatcgcaaaatcctgcagccgtatttcagcccgcacgcgctgggcaagtcccggccggtgctggagcgccatgccgcagagatgatcgccgcgttggccgaccgtggcgagtgcgaagtgatggcggatttcgcgcacctgtatccgttccaggtgttcatggacctctacggcctgccgctgcaggatcgcgaccgcctgctcgactggaaaaacgccgtcgtcggcgagaagccgttcgtcaccgagtccgacgtcgagaagtccgagcaactgctggcctatctcgcggacgcgatcgcccagcgccggcagcaccccggcaccgacatgctgtcgcaggtgatgaccggcgagggcaacttcaccgacatcgaattgctgggaatgagccacctgctgatcctggccgggctggacaccgtgaccgcggcgatcggtttttcgctgttcgagctggcgcgccggccgcagctgcgcaaggaacttcgcgacaacccaaagcagacaagggttttcatcgaagagatcgtccgcttggagccgtcggcgccggtggccccgcggatcaccaccgaatacgtcgaagtgggcggcatgacgttgccgccgggcacctcggtgcggttgtgcatggccgcggtcaaccgcgacgacagcgactcgatgtccaccaatgaactgaacatggacggaaaagtgcaccggcactggggtttcggtggcggcccgcatcgctgcctgggatcgcacctggcccgcatcgagctgaccgtggtggtcgccgagtggctcacccagatcccggatttcgagctgcccgacgggttacgagccggtgatcaattacccctcaaagagtttcgcgctcaaggagctgccgctgcactggggctgaaagacccgccccggtgcagcggcaccgtccctgcttgccgaactacttgcggaattcggtcgcggcgacctgaacgaacacgccggtgtcctcggccatcagcaggccacggccgcggggcagcggaccgcccttcatcttgccgcggatgaatccctcgtcggggtcggcgtccatcaccagcagcggcgcgttggcctgggccagcgcccgcagcatcgggtcgctgccggccgacgaccacccaccgaaggtgcgggtgacgatgacgtgcaggccgacgtcggcggctcgggtcacccagggcgcggccttgtgcagcggcgagtcgaatcccgccggcagctgctggatgtcgtcgacgatcaggaagatctccgggccgctccaccagttgcgcgacagcagctcctcggcggacaaccccggcggcggctcgcggccggccagcgccgcggccagttcgcccatcatggcctgcacaccgtccaggttgtaggcgaacttctcgacgtagtccgagccgagcgtggtcagcagctggcggcgcgggtccaccagccacacctgcgccgacggctggcccgcgggcggcgtgggcgcgctgctcgctccgggcgcgtacagccggccgatttccttcatgatggtggccagcgtcgtggtgcgcccacattcgcggcggccggtcaccatcaggtgcgcgttctcgtcgaagttgaggtacaccggcgacaggtccaattccgagatggcccaagcgattccgcccgcaccgacgccctggcgggtgtcctgggcggccagctcgcgcagctggtccaggccgaacgtggccggcaaccggcgcaccggcggcgcctggccggtggcgagccggctcacggcttccaccacgctgtcggactcgaaccggttgtccggcgtgctggccagcgcgggccgggccaccagggtgtgcagacccgactgcgggtcggcgtccaggcggacgtagttgaccgccaccatgccgcgacccggcttgaccggaacgtccttggcgaaccgggaccgcaccagcttggcgtcctccacggcggccagccgcagctcgacccgggagccgaagccgctgcgcaccgggggccgcagctcggattcgcgatcggcggtgaccaccacgtgcaccccgaacgaggggccctggttgatgatcacgttgacctgctcgatcaacacctcgttctcttcggccagcgcccggtagttgtcgaccaccaggtagacgtcgccgaacccgtcgttggggaccgggccgggttcgccgccgaacttgcgccgccggaacacctccatcgaggggatcccgtactcgaggaagctgcgtttgcgctcccgcaccaacgcgagcagttcggccaccgtgcggcggacgccgtacgggtcggtcggaccgaccacctcgccgacatggggcagccgggccaccgtggtcagcgcggtgctgctgtaggccaggcagtagaactggacctgctcgggggtgtgggtcagcgccgccgaacagatcagcgtctgcagcgcggtcgtcttccccgagccaccggcgcccaggatcagcacgttggcgccgggccccgacgtgtcgaccgtccacggcggctggtcgtgcttgaacgggcggtcgatgatgccgatcgggaacaccaggtcccgcgcggtgccgtagtcctgctgccaggggtggccgaggaaccggttcaccagctcgtcgatggcaatcggctggtccagcggcggctgccagagccggtacggctggaagtcgatcttgcgcagctggtcgatgatcaccgtgccgaccttgggcgtgcggatgccttccacgtcgtcgtcgtccggcccctcgatctcgggcatgtccgcgccggcggccgggatggccgggacggtgacatcgggtcccccgacgctgacttccagcggggtgaacgagttggtgaacagctgcgggcggacgtagtcgatgctgtgcaccagcgccggcgcctcttccccgtcgtcgctgatgccgcgggggaagtagtcgcgccacaggaattcggcctggaaccggacgatgtcctccaggctgcggcggaagtatcccaggccggcctgggcgggcaggttgaccgcgttcggcaccccggccgcctgagcggcaccggcggtgcgcgccttgagcaccaaccggtaacccatgttctccatgagcttttcggcgcggctttcgatggtctgcgaggccatcatcagatggatccagtaggcgcggccctgccggccgatcgagtcgagcacgtccacggcggtcggcatgatgcggaaccactcgtagaactcgtcgatgaccaccaccagcatcggcagcggcggcatgtcctggccgcgggcccgcatccgggcccggaccgcgttgtactccttggcgtcgtcgacgccggcgctgtcgcagatggccttgcgccgggcgatctcgccccacagcgcgtccaggaagcgttccatcagcgcctggtcctcttccaggtcggtgatgatccgcgagacgtgcggcaccccggcgaacggcttgaccgccgacccacccttgaggtcggccagcacgaactgcagctcctcgggcgggtggctgagcatcagcgattcgatcaccgtgcgcaccagggtcgacttacccgaaccggtggttccggacatgacgccgtgcgggccgtcgccgccctcgtccagtgacttcatgtccaagaacagcagctcgccgttgtcggagcgcaccccgaacggggcgcgcagccgcgaccggcccatggtgtcggtgcggccgccccacagcgcatcgaagtcgatgttgccggggtcttcaatcccgtagtaagacaagatgtctcgggcaccgatatgcgccacccgctggccgatctcctcgtaggcctccgcgagccgccagcgggccagcttctgcgcgaactcctccgcctcggcgacgctgaggtggtcggtcagggcgaagaaccacggcttctcgtcgatcaccatccaggtgtcgcggtcgcggggcagcgcctcgatgacgcccttgtcgtcgaaccgcagcgtgcgctccgggacgctgctccacatggacgaaccggtcaggtcgaagaatgtcaccccgtcgacaccttcggcgctgatcacgtattcccattgcgggtcaacggcgtcggcgatgatcacggtgtgcggtgtcggggtctgggccgacgagctggcgtgccggggcgtgaatgatccacggccggcgaacaattcggcctgctcggcggcgaactcgcgcaccgagctgtacaccatgcgggcgttgcccgcggcgtcctggcggcgcggatcaccgaagtggggcagccatttcacccagtcccactcgtcgaggtcggagctgaccacgatcatccgcacatggtcgggcccgtgcgagaaggtcagctggcagatgatggcccgcatcaatcccagcacctgctcgcggtccccggccagcgagtaccagggctcgaccagcagcgagatcatcttgggcaggttgtagacgacgctctggtagcggccgaactcctgcagcgccttaccggtcaccggctccagctcgatgtcggtgggcatgttctgcggctcaccccaggtcacctcggggcgggtcatgccgacgcccacccggaccacgccgaagttgaggtccttgccgtcgggcttgcgttcccacatccgcggcgacccgaccgcggcggccagcgtggtgggcgcggggtggaaccagcggtagttggcgtccatgctgtcggccgactcgtgcgcggtctcgcgcagcatgtccagcatcaacatgaactgggcgcgcatcgagtccagcttgggccggctcatctgctgctggccgccgaaccggccgccgaacatcatcatcgcgacgccgccgatcatgaaaatcgggaagatggcgccggcgccgccgaacacgtgcgagccgctggcgaaggtcatgccgaccatgccgatcagcaggccgaccaccaggacgccgaccaccacgagccaccacggcttgccctccggcggcggaatgctcagcggggtgggtaggacgatgttctccggcttgatcaccgggggcttttccggtgtgggccgggcaaatccacgtttcacttgggtaccgccaactctgcaggggacatgtccatcggtagcgtgtcgtgctgcaccagcgcatccgcgcgcgacagggtcggaccctgcggcagcagccgcagcgccacccacggcgccacgctgggtttggtcttcaagcccagcgcctctcgcacgtcgcgggtgtcgtcgaccccgaaccgggcgccggcatcggtgagccaccacagcgattcggtcgtcttggcgccgggatcgttcccggtgaccgccacgaagttcgcatagtcgggcccgaagaagacctgatcggcctcgcggcccgtggtgtcggccttgaccagcgacaccaccttattgacgtccttctgcgcgaccgggatggtcgcgccggacaccacctggacccgggcccggttctcaccggaggtcttctgccaccaccagcacgtcgccgggttctcccggatgtccatcacgttcagcggcgcgtccgggtaggaggacaggtccagcttgttgaccaccggcatcttcgccagggccgacggttccacggtcaccggtttggtgttgcccggcccggcgttctgcaggatctgggccaccagcggcggcagcgtctgcacaccgtcggccagcaccagcgaatactgttgcggcccactgatttgcggggtgaccagcacggtgccgatgggtccgggcgcaccggggaaggaggccgcaccaccggcgttctggatctgcggcaccgtcagttccgggcccaccggcagcgcgtcgtacagcgcgcggctcatcggcttggccatgctgacctgttcgggcgtcagccccagcggcagcagcaccgaacggttggtggcatcgatccgggaccggcggccgtcgcggatcacccaggcgtccccgccgtagttcagcaccaccgcgtcggacccggtcagcaccttgcggtggttgctcaggtccggggcggcgtcgatcaccgtcaccgtcaccccggacggcgcgccggcgccggtcgagttggacacggtgtcgcagaccagccacgacgaggtggacgggccggtgggatggaagttggacggtgcgcccgggatgcccaccatcgggccgcgcggcaggctggcgatctggttcgacttgaccaggtgcgggttgtccggacggccggtgatcaggcgcgccgacgccaggttcagcgccggatacagccggtccccgacccgcacatacagggcgcccgagtcgcggtcggcgatgatcggcgagtccccgacctgaccggccgggctgatgaacgaccacagcagcgcgcccaggcagatcaccagcgccgccgacaccgaggccaccacggccaggttctgccgccgccccggctcgacctccatccgcacccgccagcgagtcagcgccatcgcggtccggcgggcaaggaactgatagccggtcacctgcgtccgcgtcgacagcccgaggccgtaacccgacccgcgctgcccgcgactctcttccgccactaattcaccatccggtttgctaacacgcctggatattgtccatctcgcgaattacttccgaccacccgtgacaacggtaaggcacctgcacggacctcgccacgcggcgccgaagcgcactcagttccacatctgttcatgcacccgaatccggtgccggtcaccgtgcccgatccaccgccgcaccaccggccgacggtgcggttgcgctggcggtattccctcccccacggatcggccgaccggattctcgtcagtctcctccaccgcatcgtaatgggccgcgggcgtctcgtcctgtcgaacgacgacgggcccgcccgcggcccggccgggtgaacggtcggcggccgttcagcaaacacgacgcgaacgggtgccgcagccaggtcgccggtggacgaatccgggcagcaagatggcggtatgacagaactcgcgccgtcgctgatcgaactcgcccgcagatacggcatcgcgacggattacgaggactggaccggccgccgggtgcgggtgcccgagaccaccctcacggcggtgctggccgcgctcggcgtggccgccggcaccgagcaggaacgcaacgacgcgctgaccgccaagctgcgcgcgtactgggcgcgccggttgcccgcgaccatcgtcgggcggaccggtgagcagatccggttctgggggcacgtcacccacggcgatcccgccgaggtgtgggtgcggctggaggacggcaccgtgcgcgacggcgtcgaacaagtcgacaacttcaccccgccgttcgacctggacggccgctgggtcggcgaggcgagcttcgtgctgcccaccgacctgccgctcggctatcaccgggtgtggctgcgctcgggcggatcggaggccagcgccgcgctgatcgtcacgccggattggctcggcctgccggaacgcctgggcgcccggcgcgcctggggcctggccgttcagctctacagcgtgcggtcccggcagtcctggggcgtcggcgatctcaccgatctcaccgacctcgcggtgtggtcggccttccgtcacggcgccgactatctgttggtcaatcccctgcacgcggccgggttctccggccccgccaaccggatggagccctcgccctacctgccgacctcgcggcgcttcgtcaatccgatttatcttcacgtcgaggcgatcccggagttcgccgaactgaccaagcgcagccgggtccggcggctgcgcgcggacgtgcaaacgcacgccgccggcctggacgccgtcgaccgggacagctcctgggcggccaagcgcacggcgctgcagtggctgcaccaacagccccgctcggcgggccggcaactgtgttacgccgccttccgcgaccgcgagggccgggcgctcgacgacttcgccacctggtgcgcgctggccgaagaatacggcccggactggcattcctggcccgagacgctccagcacccggacgcccccggggtcgccgatttcgtcgaaaagcattcggaggcagtcgatttccatcgctggctgcagtggcagctggacgagcagctggccgccgcgcagtcccaggcgatccgggccgggatgtcgctgggcatcatgcacgacctggccgtcggtgtgcatcccaacggcgccgacgcctgggcgctgcaggatgtgatggcgctgggggtgaccgccggcgcgccgccggacgagttcaaccagctcggccaggactggtcgcagccgccgtggcgaccggaccggctcgacgagcacgagtaccggcccttccgcgccctgatccgcgcggtgctgcgacatgccggcggggtgcgcatcgaccacatcatcgggctgttccggctgtggtggatcccgcgcggcagcgccccgaccgagggcacctacgtgcgctacgaccacgaggccatgatcggcatcgtcgcgctggaggcgcatcgggccggggcggtggtggtcggcgaggacctgggcactgtcgagccgtgggtgcgcgactacctgttgttgcgcggcctgctggggacctcgatcctgtggttcgagttggaccgcgacggtaacggcggcccgctgccggccgagcggtggcgggagtactgcctgtcctcggtcaccacccacgacctgccgccgaccgccggctatctggccgccgaccatgtccggctgcgcgattcgctgggcctgctgacccggccggtggccgacgagctggagtccgaccgcgccgacctggcggcgtggatggccgagctgcgccgggtggggctgctcgcggacggcgaaaccgactcggagcaagtcattttggcgctctaccgctatctgggccggacgccgtcgcggctgctgggtgtggcgctgaccgacgccgtgggcgaccgccgcacccagaaccagcccggcaccaccgacgagtaccccaactggcgcgttccgctgaccggtccggacgggcggccggtgctgctggaagacgtgttcaccgatcgccgggccgccgccctggccgaggcggtgcgcgccgccatcgcgccgtgaccgccacctgttagcttcggggccatgaaggtctcagtcgtggccccggttgccgacggcgtcaccgcggaccccgactggatggtggccttcgcccgtcacctcgaggcgtgcgggttcgaatcgatcgtggccgtcgagcacaccgtcctgctcacccggtacgacagcgtctacccctacgacagctccgggcgcgtcgggctggcgccggactgcccgatccccgacccgctggacctgctggcgttcctggccgggcacaccacccgcctcggcttggcgacgggggtgctggtgctgcccaaccaccatccggtggtgctggccaagcgggtcgccacgctcgacgcgctgtcgggcggcaggctgcggctgtgcgtgggggtgggctggctgcaggaagagctgcgggcctgcggcgccgatttcgacaaccgcggccggcgggccgacgagcagctggccgtgctgcgggcgttgtgggcgcaccggcccgacggggcgtcgttccacggcgaattcttcaccttcgacaacgtcatgtgttatccgaaacccgttgccgccgagcgttttccggtgcatatcggcggccacagccgggcggcggcgcgccgggcgggccggttcggggacggcttccagccgctcggcgtcaccggcgcacggctggcgtcgctgatcgggttgatgcgtgacgaggcggtcgcggcgggtcgcgatcccgccgccctggaagtgtctctgggccatagtgtttccaagatcgacgccgagcgcgcggcccgcttggccgaccagggcgccgaccggctggtgctggccatgccgccgacctccgatatcgagcaggccaaggacatgttgtcggcgtgcgcgcagcggctgtcgctgcgcccggtgagcgggccgtgacgctttcggccgacgaccgcggcgcgctcagcgatctggtgcaccgctacgcggcaggcgtcgacgatcgccgattcgatgctgtcgcagagcttttcaccgccgacgccgagctggtggtgcccgcgccgccggccgagctgcggcccgtgcacacccatcgcggccgggcggccatcaccgccgccgtcgctgccgtcgccgccgtggcgcgcaccgagcacgccatcgtcggcgaggtatacgacgcgacgacgccccccggcgccgcgcggggccgcatcgcgtgcgtcgcgcaccactggagcgagcgcggtgacgagctggtcgacgtggtgtggcacctgcgctacgacgacagctaccagccgaccggtgacggctggcggatcagccgccgggccctgacggtcaccgcgatcgagacgcacccggcgcgccggctgctgccgcacgaccccgcctagcgcctgcgcggccgcgcgcgaccctccgaacccgccggaagcacgctggcagcagattatgcgctgactcacagctagcaccggggtgacgcagttgcggcggcatgaccggcgttcgtctggcaggtgcggctaaccccgccggcgccggcgcgaattttgcgcgcccccgcgccgcccgccgaacgccgcggccggccgccccgcgagccgcccggtcctttcccgatccgatccaatttatccaagtgcgttcgtgtattttcgggcgcgtgacgaacaccgttgattccgcgggcaccggcggagggcgggcggcaccgggcggctccgcatcggcactggcagtgggcacgccgctgacctccattccggactaccgcaacgaaatacacaccgccgaagacgtcatcgacgtggaggcatacggcggcggcttcgatctcacccgccgggcgaccgcccccaagctgcgggtcggccgcgaccggtggttcaacctgttgtggctgatccccatcggctttgccctgctgatcgcgggggttgcggtgggcaaaggcctgcacaacatgccggcggtgcagtcgttcatccagcgctacccgggcaccgacagcgccggtgtcccgcccggcctgccggcgtggatcggctggacgcatttcttcaacctgttcatgatgatgttcatcatcaggaccggcatccagatcctgtgcgaccatccccggctctacttcagccgcaacgccacccccggtaaggacgagtggctgcgggtcgggccgccggttcccgacgacgagctgtggaccgccaacgccgacaccgtcgccctgccaccgcaattcgggcttcccgggttccgccactcgatcgggttggcccgctggtggcacctcggcgtcgacgtgttgtggttgctcaacggggccgtcttctacgtgctgttgttcgccaccgggcagtggcgccacatcgtgccgaccagctgggacgtcttccccaacgccgcgtcggtggccgtgcagtacctgtcgctggactggcccaccgacaacggctgggtggcctacaacgggctgcagctgctgtcgtatttcacgacggtgttcatcgccgccccggccgcgttgatcaccgggctgggcatgtcaccggcgctgtcgcagcgggtgcactggctgagcaagcggctgagcatccagcacgcgcggtcgctgcatttcctggtgctggtctacttcctgtttttcatcctggtgcacgtcaccatggtgctgaccaccagtgcgctgcgaaacctcaaccacatgttcgccgcccgcgacgacaacagctggataggtttcggcatcttctccgcggccatggtgctgaccgcgatcgcgtgggtttgggccactcccttcaccattcgccatccgcgggtggtgcagcgggtcggctacgcgctggtcggcccgtttcagcggatgctcgagcagctggatcccaagccgggcgccttcaccgagaaggacatctcgccgcaccactggcgcaacggccggctgcccgagacggtcgagtacaaggagctggaggccaacgacttcaaggactggcggctcaaggtctacgggctggtcgagcacccgatggagttctcgctcgaggacctgatggcgctgccctaccacgagcagatcagccagcacttctgcattcaggcctggtcgggtgtcgccaaatggggtggcgtgcagatgaaaacgatcatggacatcgtcaagccgctgcccgaggccaaatgggcggtgttctactcgatgggtctcggcgccacgggcggcatctactacaacgcccaccacatcggccagatggaccatcacatgacgatgctggcctacaagatgaacgaccagcagctgccctacatgcacggccggccgctgcggctgcgcaatgagctgcagcacggcttcaaattggtgaagtggatcaagggcatcgagttcgtcgccgactaccgcgacatcggaagcggttacggcggctacagcgaagaccacaagtatttcgggcgccaccaaacgctctgaggcgctcccggccgcacacgcgggccgcgccgcccgaagtcgtttgtccgaccggctttttgggtagcacccaggaatcggcgcgagccaagcgacagcagaggagacgcccatgaggcacagccctgtgcagcatgcccggatcgtcgggcggggccaaccgatccggtacccgtcggcgcgggatgcggcgcccacgtcgggcctcgccgcggtcggggtcgccgcggtggcgttcgtggtgtgcgtggccaacttcgcgttggggcatgccggggccggggtgacggcggcgatcgtggcgatgctcgcgttcggcgccgggctggcgtggcttgccatggaccgcaggcggattcgccaggaacagcgcgactggacgatcagccgcccggcgcgctaggcccgctcggctgcagcgccgcgaggttgtgcaccgacttgtgcacgtccgagcgcagcacccgggcgaccagtcccccgatcgggccgctgagcacgccgccgtcgatgtcggcggtgaggtgaaagactgatcccgggtggtcgtcggtgacggtcatcgccacggtgagccggatcccgccccggccgcggccttgcagctcaatcgatttcggttcgtcgtagcgggtgacggtccaatggatgacgttgcggaatcccttgaccttgacgcacgaggcgacgcgggtgccctcgccgatggtgtcggggaccgggccgcgccagccggcgaagatcgtcatccactcgccgaaccgatccaggtccgaggccagtttccaggcggtttcgggctccaactccgacgacaccgacacatctactcgagccaacgtgatcctccgcttctccccgggttcccggctggatacccgcagcgccgcggagctattcgtggccccgggctcagccgggccaggcctgttccagctgctgggccacgtcgatcacctgggcggcctgcgagtgcggggcgtcgatctcgtcggcgacgtactgggcgatgaagcggcggatctcgccgtccaccccggccaggatgcgcagcacctcgccgcggatggacttcgacgagacgttgacggtgatatccgacggccgcggcttggcgacgtcgacgatcagcagcagcggttcggccgcccgcgccgtcgcgcgcagggcgatgtcgccggagaccacgaagcgctgcttgtccagccacaggtcgaccagcaggtcgatcgacagcgggatgtggatgacgaaggtgatggtgtcaccgaggcgccgggtgacgcgcggttcgtggatcttgacgttcgcgctgaccttggcgatcttgccgggcccctgggcgatcggctccatggcgaactcgctgccggcgatgtcggcgaacgcggcggcgacccgttcgggggtgaccgcaacctcgaagaatctgcggccgaactcttcgtaggtgacataatcgtggttcgacataggcttataccgtctcacgtcacctgcccgaacggccgctgatccgctcgcgtcgcaggaattgcgcatcggatcccgaccgtggccccggcccacccacaccggacggtgatgagctgcgccgatcacgcggcgctgtgaagcacaccacaggcggtggcttggattcgatgtgtcgggcggtggcctgggaggctggacggtgctcgacggtggaggtgttttcggttcatgccccaagacgtaactgagccccgcccgggtccggcccgggtggcgggggtgctcatctggctgggcggcggggaagccggcggccccggggaacgccacgagcggtccgcgcacgccgtggccggcgcggtggtgctgctgggttccgcgctggcctggctgctcgccgggctggcggcggcgggccgttggccgctgccggcgctggtgccggcgacgctggtcttcggcttgctgctgggcgcgatcgtccgcggcaccgccgcgccggccgccggcgcgaaccatccggtggcacgcggcgcggtcgcggcggcggtcggtgtcgtcgtcggtgaactcgccgccctggtcatcctttccgaccccatcgaccagcgtctggacgaacgggcatcgcgcaccgcggattccgccccggccgtcgtcacggcgtcggcgacgctgcggcaggccgaggaggcgcgggcggcactcgacggcgcggtggcgcaggcgcgcgaccgccaggacagggcgctggtcgtggcccgttgcgaatatcaccccactccgggctgtccgcagacccggatcaccggtgtccccggcccgggccccgaaacccgcacggccaacgagcttctcgccgacgcccagcgcgagctggacgaggcgctggcggcccgcgacagccgcgcacccgaattggacgccgcggtctcgcgggcccagcgggccgtggccgacgcccgccgcgccgcgatggcggacgccggccggggcccgggcgcgcgctggatcgcgatgaacgacgtcaccgccggcaacgccggagcattggccttgcggctgttgacgatcgggggctgcgtgctgctgtacctgacgcccctgatcctggggctgtggcgcggggagacgagtcacgatcgccgcgccgcggcgcgcgcgcggcgcgagcgcgccgaactcgacgccgacaccgcgatcgcgatcaagcgggccgaggttcgccgcgaagccgaaatcatgtgggccgagcaccaattgacacaggcgcggctggccatcgaggcgcagaccgagatcgaccgggaacaccagcgccgccgcgtgttggacgccgtcgccgatccgccgccgccgcgggcctttgaaccgacatccgaactcacatccgaactgacatccgagccggcccgcgatgacgtctatctgccgatcgccgccgaggccgaggcggccagccgggccatcacccaggcgccgcaaccgcgcgtggaatgcgaccccggcccgcagcagctgccctcttccccaccgccgaacgacgcggtcgagcaggatcggagcacgccgttgatcccgtcgatcccagacgcgaccaaggccgcggcccgctggattcgcccgttggcgccgccgctggtggcgcggatgatggacacgacgacccatcggctgacccatccgctgcgcaccgcgcgccaggtgttcgaaggcgtcgtcgaggagaccgaagagatcaccttcgcgctgcgccgcacccgcaaggtcacggtcaattcgcaggccacccagaccgcgtcagcggacccgaccgaagacaccgaagacaccgaaagccgcgccgccgggccggatttcgtcacctccacgcggcagcaaccgggaccgcgggcgcaccggcggatgaccggccgcgacacgcgctcgtcgttgccgcgctcgtcggcaccggatgcgggcaagttgtcggtgccctcggccgcggatgaccgcgccgaattgacccagcgggacgggccggcggaactgcagccgcccgacggcccgcgccagctgccgcctgcgcctccgcactagccgcgcaccagcgcgcaattcagcgcagcgatcagcggaccaggttgatgccgaagtcggtctcgggtccgggcggggtgcccgcacgccggcgccggcgtgcaccccgcctccgggtcggccagcgcaattcgagccctaacgcctggagacccgccggggtctcgaggtggttggagacggccgggttaccccgcgagaactcggccgtcccaacgtcttgatgcccgctcaacagggcactgcggcggactcgaacagcggtccccattcgcgccgggccgccgattgcgcatcgacgaagctcggtgtctgctgcccggcaccggccaggtgcaccagagcccatgccatcgcgaacaccggcaccttgtgacgcaatgccgcgctgtgcaattcgtccagggcggcctcggaggggcaacggcgaaggccgatcaaaatgccccgtgcggtgtcgaggatgcggccggagtgcgggccacacgaagtctgggtggggacccagttcgatgtcatgacgtggatacctcctgcggcgccctaccgaatccgccgccggaggcagcgggcgaggaattcctgcgctacgcatcgtcgcggccgcaaacctcaaaagcgccctgtgccatgatttgtcgatcggtggcgatctgccagaccaccaccgggattgatatgcgcctgtgaccgtttcgggatcggctgctcaccaagcaatccgcgacgcgtggtatcgaatcaggttgcggcgaaacgcaatcaggcccgcatcggcgatagctgtgcaacccgatccccgggcgttacagaattgccttgagcgccttggccttggcgatgtcgtcccaatcgacatcgagctccagcaggatctcctcggtgtgctgaccgtgttcgggcgcacgcgccggtgccggtggtgtctcgtcgaattgcactggcgcggcgacgatccggtacttctcaccatggtcgtcgacattggtcaccacgtacccgctgggctcaacctgcggatcgttgagggtctcccgcggtgtcgcgagcgcgccccatacccccggttcgtccgccagcacggtttgccagtgcgaaaggtcgtggcgggcgaacgtgttcgccagcagctcggtcgccgcggccgcattggcgatcaggttgctcgacgggacgaaacgcgcgtcgtcggccagttcggccaggccgatgcgccggcagaagcccgcccagtacttgtccggctgcaggaacaccagctggatccaccggccgtctttggtccggtaccggttgaccagcgggttgatggccaggcccggcggcgcccccgggatgccgtcgatgtcgaagagtcggccgccgagatcgacggtgctatcgaccacatcgcctgggccagcagcgaagagtcgacgatcgtcggctcaccggtgcgttcgcgatggaacagggcggcgcacacgccgccggcgagggtggcgccggcttgcaggtcaccgaaaccggggccctgcacggcgggcgtctcgctgccgaacggcgtcagggtgtatgcgaccccgccccgcgcgaggtaggtggcggcgtcgaacccgccccgatcccggtccgggccccgcacgcccagaccggtgccccgggcgacgatgatgcgcgggttgaacgagcgaatgtcggccacggtcagccgggcccgctccagggcgcccggcagccaattggtcaggaacacgtccgcactggccagcagccggccgaacagctcacggccggtctccgacttgatgtcgttggcgatgctgcgcttgccccgattgcccaattcgaggatgaagtcggcgtcgggccgcgccgcctcgcgggtgaacccgccgaccaccagcgcccgccccgggtcaccggagctcacgccttccaccttgatgacgtcggcgccccagtccgccagggccgcaccggcggaggggacgtaggtccaggacgccaattcgaccacccgcacgccccgcaggacaccaccgtgcacgcccgacatcgccaatcccctcggtcgcggccattccttgctattttagatattctagttagtcttgggcgtagtgatagcccatctgcaggtcagcgcagtttctccgggaagagacgcgatggagccgactgttggtctgagtccggcgcccgctgcggtggccgggcgccccgtcacagcgcggcctggtgtccggccgacccgtcaccgcgaccgccggacgcccgaatggcattgggccccactaggagtcgcgaggtaacgggcgatgggcagggtgacgggcaaggtggcggtgatcagcggggccgcccgcggtcagggccggtcccacgcccggatgctggccgccgagggcgccgacatcatcgcggtcgatctgtgcgcggacatcgagaccaatgaatatccgctggcccgtccggaggatctggacgagacggcgcggctggtcgagaaggagggacagcgcgccatcaccgcggtcgccgacgtccgcgatcgggtagccctgtcggcggccatcgacgccggtgtcgccgagttcgggcacctggacatcgtggtcgccaacgccggcatctgcccgctgaccgccggcctgccaccgcaggcgttcgccgacgccgtggacgtcgacctgggcggggtgctgaatctggtgcacgccagcctcaaacacctccgcgccggcgcgtcgatcatcgtcatcggttccaacgcggccttcatgtcgtcgctgaacacctccggcgccgggagcgggatcggcggacccggcggcgccggatacgcgttcgcgaagctggctgccgcgcactacgtcaacgacttcgccctggcgctcgccccgttctcgatccggatgaacgcggtgcatccgaccaacgtcgacaccgacatgctgcacagcccgccgatgtaccgcgccttccggccggacctgccggcccccacccgcgaggacgccgaaccggtgttcccgctggtgcaggcgatgccggtgccctacgtcgaacccgaggacatcagcgaggcggtgctgttcctggcctcggatgcggcccgctacatcaccgggcagcagttgcgcgtcgacgccggcggcttcctcaaggtcaaaccctggtcggtcgggtagccgaatgacgcagtccgccaagacttcccccgacatccaccgtcgcctctacgcgctgatggtgttgatgaagacggccgacgaccggctgtcgcggggcatcggcaccggcgagttcctctgcgtctactggccgtcgcggggccaggaggcgatcgccgccgcgatgggggtgacgctacggcccgacgaccagctggtgaccacctatcgcggcctgcacgacctgatcggcaagggggtcgggctcgaggagatctacggcgagatgatgggccgcaccatcggcgccgggcggggcaagggcggcaccatgcacatcgccaaacccgaagtcggcgtgatgctttcgaccggcatcgtgggcgccgggccaccggtggcggtcgggctggcgatggccgcccgacgcaaggggctcgatcgggtcacggtggtcagcttcggcgacggcgccaccaacaccgggtcgttccacgaggcggccaacatggccgcgctgtgggacctgccgatcgtgttcgtgtgccagaacaatcggtacgccgagatgacgccgaccaccgacaccatgaagctcgagcacgtcgccgaccgggccgccggctacggcatgcccggggtccgggtcgacggcaacgacccgctcgcggtgacggccgcgctcgaggaagcgctgcggcgcgcccgcgccggcagcggccccaccttcctggaatgcgagacgttccgcttccgcggccactatttcggggaccggatgccctacatacccgccgatcaactgcaagccgcgctggcggccgaccccgtgccccggttccggcggcggctcgccgagacgggggtgtgcggcgaagcggaactcgcccgcatcgacgacgacgcggcggccaccgtggaggcggcgctgcggaccgtgctcggcgcggattcgccggcggcggacgaactcgaccgggacgtgtacgcggcgccgatccccttcccgacctgaggacgcgtgcgatggccgaccaagagatgacgatgcgcgaggcgctcaacctcgcgttggatcaggcgctcgccgccgacgagcgagtcttcctgctgggcgaggacattgccgatcccggcgcttccggaccgaccgcgggtctgtcgacgaaatacggccgcgaccgggtgctggacacaccgatctcggaggcggcgatcgtgggggcggcgatcggcgccgccatcgacggcctgctgccggtcgccgagatcatgatcatggatttcatcggcatcgccgccgaccagctgatcaacaacgccgccaagctgaggttcatgacggccggacgcacgtcggcgccgctgaccgtgcgaacccaggtgtatgccggattatccaccggcgcaacgcattcgcagagcctggaggcatggttcatgcacatcccgggattgaaggtgatcgtgccggccacaccgcgcgacggcaaggggttgctgagctcggcgatcttcgaccccgacccgtgcctgttcatcgagacgattcggctgcagggcaagaagggcctggtccccgtcgaccccggcttccgcatcccgctgggccaggccgacatcaagcggcccggcaccgacgtcagcctgatcggttacgggcgcccggtgcacgacgcgctggccgccgcggcgatgctgggcgaccagggcgtcagcgccgaggtggtcgacctgcgcaccctggtgccgctggacgtcgacaccgtcgtggcgtccgtgcggcgcacccgtcgggccgtgatcgtgcacgacgcggtgcaattcgccggtcccggagccgaagtcgcggcgatcctgcactcgcggctgttttcggagctggccgcgcccgtcgaacgggtcgccgcccggttcgtccccaatccggccgcggccgcgctggaggcgcaggtgtacccgtccccggagcgcatcgcggtggcggcgctgaagacgttggggaggacgctgacgggggccacggcgcatggctgacttcatcattcgcattccccgggtgtcggtggcggtgtcggaggccgagctcaccgggctgctggtcggcgccggtgagcacgtcgaggcgggcaccccgatctacgtgatcgccaccgagaaggtcgagcaggagatcgaggcgggagcatccggcacggtgcggtggaccgggcaggtcgggaccacctatcagatcggcgccgaaatcggggtcatcactagttgaatccacatgaaccaaggtgaaccaacgtataccaggaaaggttgaacgcgtatggatctcaacgagacccgcgagagaatcatctaccagaaggaaggcccgatcgcccgcgtcaccctgaactggccggagaaggccaacgcccaggaccagaagctggccgaagaggtcgacgcggcgctggccgacgccgaccgcgactacgacatcaaagtgctgatcatgaaggccaacggcaagggcttctgctcgggtcacgccatcggcaacaacgcggtcgactacccggcgttcgtcgagggcgcgaaggtgatgggcaccccgtggaagccgcagaccgatctgttcgtcaagccgatcctgaacctgtgggagttctccaaaccgacgatcgcccaggtgcacggctactgcgtcggcggcggcacccattacgggctgaccaccgacatcgtcatcgccgccgaggacgcctatttctcctacccgccgctgcagggcttcggcatgccgtcgggcgaatgttccatcgagccttggattttcatgaactggcgccgcgccgcctactacctgtacctggccgaggtgatcgacgcccgcaaggcgctcgaggtggggctggtcaacgaggtggtgccgcgcgaccagctcgacgagcgggtcgaggccatcgcccgccacatcgctcaggcgcccatgacgaccctgctggcgaccaaggcgaacctgaaacgggcctgggagttgatgggcatgcgggtgcactggcagagctccaacgacctcgtcgcgctcgcctcgatcagcaaggatgtccaagagctgattcagaccgtgttcaaggacaaggtgctgccgtccgagcaggcccgccgccaggccgccgccgctgcccagaccgacggcgccgcaacgacttaggccggccgggtgaacatcgccgagcacgcgctcgcggccgcacagtcgccggccctgatcaccgacggcggcacgatctcgtacggcgaactgcacgaccgcagccggcgggtggccgcggcgctgcacgagctggggctgcgccgcggcgacggtgtggccctggtcttgcccaaccggccggagttcctcgaaatcacttggggctgccagctttccggcctgtactacacgccggtcaacacccacttcaccgcggacgaggtcgtctacgtcatcgacgactcggatgccacggcggtgttcgtcgacgcgtcgctgcccggaatcgccgcccggctgcgctccgccaacccggcggtgcacatcggggtcgggggcaagctgcccggctggcgcgactacgagggggtactcggcgccgccggcgatgccccaccggtgtcggacggatcggagatgctgtattcgtccggcaccaccggccggcccaaggcggtccggcggccacttccccaggacggcaacgggtcctgggcgcagtcggtgctggagctggcgctgatccacaagtacggcatgacgcagcgcagcgtctacctgtcccccgcaccgctctaccacgccgccggcgtgaactacacgatggccgtcaaccgggtcggtgccgcgtcgatcatcatgaggaagttcgacgccgagacggtcttgcggctgatcgagacgcaccgggtgacgcacgcccagttcgtgccgacgatgttcgtgcgcatgctcaagcttccggaagcggtgcgggaccgctacgacgtgtcgagcctgcgctgcgtcatccacgccgccgcaccctgcccggtcgacgtcaagcaccggatgatgcgctggttcggcccggtcatccacgaatactacggcggcaccgagggtttcgcgggcaccaccatcggcccgcaggaatggctcgcccaccccggttcggtcggcgtcccgctcgcaccggtgccgtgctcgacgaggacgggcgggaagtcccggtcggccagaccggtgagctgtatttcgaaggcgggcccgacttcgagtacttcaaggaccccgtcaaaaccgcgtcggtgtacaacgagcgcggctggcgctcgctgggcgacatgggccatctcgatgaggacggctacctctacctcaccgaccgctcgacgttcacgatcgtgtccggcggggtcaacatctatccgcaggaagtcgagaacctgctcgtgatgcacccgaaacttctcgacgcggcggtattcggggttcccaacgacgaattcggcgaggaagtcaaggccgtcgtgcagcccgccgacggcgtgccgcccggacccgacctggccgccgagctcatcgcatactgccgggcccacctggccggctacaagtgcccgcgcaccgtcgagttcgacaccctgccccgcgacccgaacggaaagctctacaagcggcgtatccgcgaacgttactggcagggacgggaatcccggatcgtgtgacctgatgaggatggcgagatggctgtagagacgagcaagccgcacaccggcgtgaacgcgacgccggtgccggtgccgtgggcggtgcagacccccgaccggatccccaagcagcgctactacgacccggagttctacgcgctggagaaggagatgttctggccgcgggtctggcagatggcgtgccggctcgaggagatccccaagcccggcgatttcgtcgaatacgagattcacgacgagtccgtcatcgtggtgcggctggacagccagaccgtgcgcgcctaccacaacgcctgccggcatcggggcgtgaaactggtggaaggcaacgggaatcggcgcaccttcgtgtgcccgttccacggatggtgctggagcctggacgggcgcaacacgttcgtgctgcggccggagaccttcgcgcaggagaatctggcggccgccgacctgcgactggtgtcggtgcgctgcgaactgtggggcggctgcgcgtggatcaacctcgacgacgacgcgccggcgctgcgcgactggatggagccgttcgcgtcgacctacgacgcctggcgggtcgagtcgctgcgggtcgagtggtggcaatcgtgccggctgccggtgaactggaaactggcgacggcggcgttcatggagggctaccacgtgccgcagacccatcctcagctgctgccgggcgcccagaccggcgagccttcggccgcagtacatcccgtcgtcgcgagcagcctgtacttcatgcgcacgctgggcgagggcatggccggcatgacgcaccagaacgacatccgcatcgccgagggcctgcagaccatgcggctgccgtccgacccggccgctgcgatggcggcgtggcgcagcgccctcaacgatgccgtcgttgactggcatcgcgcccggggcagcggcatgcccgatctcaacgaactggaccgccgcgggatcaccgatgcgatcggattcgccttcccgcaccacttcatcctgccgacctacagcagcgcatcgtcgtatcgcatccggccgctgggacccgaggaaaccctgttcgagatctggtcgctgacccggctgcccggcgacgcctcggccggcaaaccgacaccgccggaaccgatggcgcccgacgacccgcgctggccgccgatccccgcccaggacttctccaacctgccgcgtcagcagaaaggcttgcactccaagagcttcgagttcatgcggttgtccgaccggatcgaaggcctgatctccaacttcgagcgggtcatcgacggcttcctggccgggctgcgctacgacgcgctgctgccggccatccacaagaccaacaccaccatcgacgtgccgatcgtcgacctcggcttcggcgccgtggaggcgcgatgagcgtgacgtgggatcgctcggtggatctgctcatcgcgggcagcggcgggggcggcatggtggccgggctggccgcgctggacagcgggctcgagccgctgatcgtcgagaagcagtcactggtcggcggttcgacgggactctcgggcggcatcgtctggttgccgaacaacccgttgatgcgggccgagggcgtcgccgactcgcaccaggacgggctggcctacctggccgacgtggtcggcgacatcggtgcggcgtcctcccccgagcgacgtgaaatgttcctcaccgcgggccacgaaatgatcaatttcctcacccgcaggggcgtcgcgctgatccgctgcgccggctggagcgactactacccgaatcacaagggcggcaacgcgtccggccgcgccgtcgaggccgtcccgttcgatgccgcgaagctgggcagctggagcgggcgggtgcagccgccgctggcccgcaactacggatacgtggtgctgaccaacgaattgcgttcggtgcagtacttcaaccgctcggcgcgcacgttcgccgtggcggcccgggtgttcgcccgcaccgcggcggcgcggatgcggcgccgacaactgctcaccaacggcgcttcgctgatcgcgcacatgctcaaggcgctgctggacctcagcgacgggcaaccaccgttgtggtcggatgccgcgctgaccgagctcgtcgtcgaggacggccgagtggtcggcgcgcgcgtcgtgcgcgacggccgggcgtgcgccgtcgaggcgcgcaagggagtcttgctggcggcgggcggtttcggccacaacaagcagatgcgccggcgctacagcggtgaccagcccaatgaggggcaatggtcgatcgccaacgccggcgacaccggtgaggtgctcgaagcggcgatgcggctgggcgccaagaccgacctgatggacgaagcctggtggctgccttcggttttcatcgccaacggcggggcggtcgctgcctcgctcggctcggggcggcagcggccgggcgcgatctatgtcgactcgaccgggcggaggttctgcaacgagtcgaactcctacgtcgaggtcggcaaggccatgtacgccaacaaggcggtgccgtgctggatgatcttcgacgacggttacgtgcgccggtacgtcacgagcgcgaacccgctgaaaaccctgcggcgccaccagccgctgccggcggagctgatcgagtccggcgccgtcaagcgtgccgcgaccatcgcccggctggccggcgaaaccgaccttcccgcagacgaactcgcgcgcaccgtcgaacgcttcaaccggttcgcggccaagggcctggacccggacttcggccgcggccagtcggcctacaacgactgcctgggcgacccggggtatcggcccaacgccgcgatcggaccgctcgacaccgcgccgtattacgccacccgggtgttccccgccgatgtgggcacgtgcggcggcgtgatcaccaacgagtacgcgcaggtgctcgaccaacacgaccgggtgatcgagggcctgtatgccaccggcaacaccaccgcgaccgtgatgggccgcacctatccgggtgcgggggcgagcatcgccaactcgatggtgttcgggtacgtcgccgcccggcacgcggccggccgcaggatcgccggcacgcctccgcgcgccatcgccggcgtgcctccgcgccgagtgtgcgactagtttcacgctcggtcgcgagcgtgaaactaacttcacgttggcggagaacccttttcgtcgggcttgtcgacgaattcgcgcggcttcatgcccgaccgcatcagctcggcccgccgcgcctgcacgtcggaggcggcgccgaccatgttggtcaggatgtggctgacctgcaggtgcacccgcatgcccatcaactcccacgcccgtttcacgttgttcttgaccgccatcagtgtggtcaacgggatccgggcgatcttgcgggccatctcctcgacagtgtcctccaggtcgtcgcgcgccaccaccttgttgagcagcccccagtcgagggcctgttgcgcggacagcgtcggcgccagcagcaaccagtccatggtgcggtgccagttcatcatcagccagggctcgatcatggtgtgcccgccgggctcgccgaggctctgggcaaggggcatctggaaatacgcgtcctcggaggcgacgcagaagtcggtcagcaagccgagatagattccaccgcccatgcagtagccgtggatttgggagatggtcggcttgggaaactcccacagatacagcgtcggccacaagaacaggtcggcggtgcccttgtagaggtcttcgaaggtctccccgaaatcgggatacgggttttcgtccgggccccaccgggccacgtggccgccgcagaatcccttgccgttggccttgatgatgacgaccttgatgtccttgtcccggtcggcctcgtgcaggcagtcgtcgacctcggtgaccagcaccgcgtccttggtgttggccttgtcgacccgattgagcacgatccgcgcgatcggcggttcccgctcgtagatgaccgcttccaggacgcgccgctccatcaggcagacattaccggagaccggcccggccgaaatcggctttgcgctgctcaccgtgctcgggttgcggccgctgtgcggccgtttagtggtccggggcggcgataggctaggctggtcgcaacgttggcgtcactgtcacgagcacagtcatgaacactgacatgaaccgccaacccgtcgtggaaagtttctcatcccaccggtgccggcgccgtagaccgcgcccggcacccggatgatccgtgcatcccgcactggcttgtctcgcggcgatcgattttgccagccggcaatctcgccacctcgcgccggtccgcgggacgtcctcgtctcccacccggtgctgcctgaaaggcaccgaaaagtgaccacccccaagacttttgccgatctcggcgtgcccgcccggatcgtggatgcgctgacggcgcgcggtatcacgagcccgttccccatccaggccgaaaccctgcccgacacccttgccgggcgagatgtgctgggccgcgggaaaaccggcagcggcaagacactcgccttctcgattccgctcgtcggccggctgtccaccggaaaccgccgtcccgcccggccaacgggtttggtgctggcacccacccgggagctggcgacgcagatcaccgcgacgctcgagccgttggcggcggcgtgcggcctgcgggtcagcacgatcttcggcggcgtctcgcaacaccgccaggtgaccgcgctgaaggccggagtggacatcgtggtggcctgccccggccggctcgaggatctgatgcggcagcgtttgatcaccctggaggcggtgcgggtgaccgtgatcgatgaggcagaccacatggccgatctcggctttctgcccggcgtcacccggattctggccgccacgcccaatgatggccagcggctgctgttttcggcgacgctggacaacggggtggacaagctggtcacccggttcctccgcgacgcggtgctgcactccgtcgacgaggccaattcgcccgtgtccgagatgacccatcatgtgttccacgtcgacagcgtgcaggcgaagaaggagttggtgcaccggctcgcttcgggcaccgggcgccgaatcctgttcctgcgcaccaaacatcaagcgcgcaaggtcgccaggcaactcaccgaatcgggggttccctcggtcgacctgcacggcaacctgtcccagcccgcgcgggagcgcaacctggccatgttcgccgccggcagcgcccgggtactggttgcgacggacatcgcggcgcgcggcgtgcacgtcgacgaggtcgagctcgtcgtgcacatcgacccgcccagcgagcacaagtcctatctgcaccggtccgggcgcaccgcgcgggccggcagcgccggcgacgtcgtcacggtggtgctgcccgagcagcgcgaacacacccgggcgctgatgcgcaaggccggtatcgacgtcgcaccccaacgggtgaccgccggctcgcaggcggtgcacgcactcgtcggcccgatcgcgcccccgaagccgcccgcggccgccggtgtgccgtcgcacccggccgggccgcatcggccggctgccgcgggacaacggcgccggcgcagcggccggtcggcgaggacgaccgcggcccacgccgtcccgcaccggccggccgcaccggtccggcgacccgaccgtcgccgcgccagccgcgcccagggcagcgcgggataggctgcggctcaacgcctctcaaccaccggctcggattgtgagggccgggccagcagccaggcctggccgtcagcctctccggcggcgatcggctgcagatcggcgaatgcggcggtcagttcgccgggcgccgcgcggaacgggcccgggccggctcccacctcgctgagcacggcgatggccagcagcccgcccggcgccagccgttcgacgatggcccggtcgaggcggcggtcgcggaacttgcagcagacgatgacgtcggcgggtggccctaccggcagcccgcggtcgagatcggcgacgtcgaagcggcaccgctcgcccaccccggcgcgccgggccaggtcccgcgcctggccgatcgccaccggcgagacgtccaggcccagcacgcgcagcccgcgcaacgccaaccacaccgccgcggtcccctgcccgcaggccaggtccagcgcccgccctgcagccgggaacacgtccgcgtggcgcgcgaaaacaccgggcggcgcaaccgaactcagcggcggcgggccgttcgccgcgtaccgctcgtcccagcgatgccggtcggcttcgcccatccgcatctcctccgcccagccactctaggcccggccgccgcgtgctgaccgggcggcactcgctgtcggcggcgggctcattcctacactcgacgggtgcccgaagatgcgtcatcgccggtcatcgccggcggcgccccccaccggaccggcgcgtcgatccgaccgccggcctggacagacgatccgcaaagtgcttgacgccgggttgcaggagttgcgggaatcgtcctacgccggcttgacgatgcgcgctgtggcgacccgcgccggggtatcaccggccagcgcctacacctactttccgtcgaagagcgccctggtggcggcggtgtacctgcgctttctgcgcgacctgccggtgcacaccgacgtcaacgagacggcccagcgcagggtcagcgcgacgctgcgggacatggcggtggtggtcgccgatgagccggagttgaccgccgcctgcggtgcggcgctgatggccgacgatccggcggtcaagccgctgcgggagcagatcggcgaggaggtgtcccggcggatcgcggccgcgttggggccgggctggccgcgcgccgtcaagtccaccctgcagatgaccttctcgggtgcgctgatgactgcccggttcgtcagcttcgccgagatctccggacagctcgacgaggccgtcgacctcatcctgggcgccgcgcgggcgtcatgaacacacgaaatcgactgtgctgcgggctggttcgcgctagccggtgctgaccagggtgcgcgacggccggccggcgcgaaggaactgaccgtatcgctgccggcccagctgcggcgcggcccgaccggagccgaacgcgagcttcccggccaccagcaccgcggtgaccgtgtcgtcgttgcggttcaccatccgcgacaacccgccgtaggacgcaaccggatgctcggcatagcggtcgagcgactcgtcgagcctggcgggatcgatgacgacgatgtcggcgcggtcgcccacgcgcagggtgccggcgtcgatgccgtaccaccgcccgagttcgccggtgagccggtgcacggcgtgctccatggagatgaagggcttaccggctttctgggcgtcgtgcgcgtgccgcagcagccgcagcccggagttgtagaacgccatgttgcgcaggtgcgccccggcgtcggagaaccccatctgaacggtggggctctgggccatcttccgcagcacctcggggcgatggttggaaatcgtagtgcgccagcgcagccgctcgccgtgctcgacgaccaggtccaggaacgcgtcgaccgggtgaaggccgccgcgctccaggccgacctgcccgaacgacttgccgacgacggcctgctcggggcaggccacgatctcggcgtcgaagaagtcgcggtgccacacccggggcccgaatctgctgtcgtagtccttgcggaaccggcgccggtacccttcgtcccgcatcagccgattgcgctcgatctcggtctgcaggtgcagggccgcggcgccggaaccgaactcctcgaacaccaccagcgaaatcccgtccgcgtacacctcgaacggcaccggcaggtgctgccagcggaagtcgccgccaagggcattgacgacccgggcgagccggtccatcacgtggatcacgaacggtatggccttgatgtcggccgccgacagcaggctggtcttcagccgcggccggccgaacccgagggacgtcatcagctgcgacagcaccgacagcggattcgtgatgtccggccccgactgcaggatcttgtcgcgccgccgcaggatcgcgttcagccggcgcagctcgcgcggcgcggcgtacgtcgagggcagggtgcgcgaccggcacacctcgccgtcgagcttgtcgaacaacagctgctgcgaggacatcccgacgaacccctcgtcgagtgcctcgttgagcatcgcctccatccgggccagttcggccgcggacggccggacgtccttgcgggtcgcccggtccagtcccatggtggcggcgcgcatgtccgaatgcccgatgaacgccgcgacgttcgggcccaggttgcgccgctcgagttcggccacgtactccttggggttggtccaggaccgggccgcctccaggtgctcgatgacgtagcgccgcgggatcgcctccacccggccaaagatgtcacccgcgtcgacgttgtccaggtagaccgtcgacagcgagcacgaacccagcagcaccgtggtcacaccgtgccgcaacgactcggaaagctccggctcgcaaagtatttcgacgtcgtagtgggtgtggatgtcgatgatgccggggatcacccattggccggaggcgtcgatgacggtcgcgccggcggtgtccagcggccccgcggcgatcgtgacgacgcggccgtcgcgcacgccgatgtcccgcattgccgacggtccgcccgtcccgtcgaaccagcgcccgttggtgatcacggtgtcgtagcccatcggtcggcctttctgtccagccggcacgccggaagagattcgcagtgatcatacacaatgggaatagtgtcttgccgggttgcgggcgccccgacgcgtgggttagccagcgacgatccggcggtgacggaggctaagatccagctgtggggatcaccggctacgagtttgccatcgggtaatcatgcgcagtcatggctgggcgggaaacacgccggcatccgatgcggaggcgatcgagcgcatcctcgacgccgccgaccggatcatcgccgaacgcgggtcggcgttgcggatcgccgacgtggcgcgggcactgggcgtgacccggcagacggtctaccgctacttcccggggacgcaggcgttgttggtggcctcggcgatgcggtcggccgacggcttcctggaccggatggcggcccatctcgacggcgtgaccgacccggtggtggcgatcaccgaggggatggcgttcgccgtcgaggagctggcctgcgaccaccaggtcgagttcgtcctcaaccagcgccaccgcggcggccagaaggtgtcgatcatctccgacaccgcgttggcgttcggccgatccatgctgcaccgttacgacatcgactgggagagttatggtttcgacgaagccgggctggaagagctgaacgagttctcgttgcgggtgctgcattccttcctcaccgacccgggccgtccgccgcgcaccggcgcggatctgcggcgctacctgacccgctggatcgggccggcgatcgcctacccgcagttgctccgcgcgatggacgcgctgggcgccgccgagccgcagcaacgcccccgccggcgggcgtcgaaagcgtcctgagcacccacgccggcattccaggcccaggccccaaggccccggcgcggtgaccatacatgcgcaccgatatgtccgtcgcgggtgcccgcgaggccggccggtggttgtcttcgtcacagcacgatcgcccggcgcgcgccggcggccgtgctgtggcaggatcgcgatgtgaaggcgcgtcccctcgctggcttgagttgtgctgtgctgtcgccgttttgggcgctgctcctcggtccggcgctcgtcggtccggccgcgccggcagccgcggattcgtgccctgacgtcgaggtggtgtttgctcgcggcacctccgaacctcccggcgtcggacggatcggccagagcttcgtcgacacgctgcggtcgcgcctcggcgcgaagtccgtgggcgtctacccggtcaactaccccgccaccaccgacttccccaccgccgccgacggcatcagcgatgccggcgcccacgtgcagcagatggccgcgaattgcccccggaccaagatggtgctgggcggctactcccagggcgccgcggtgatgggcttcgtcaccgaaagtgcggtgccggacggggtccagctggtgcagtcgctgcagccgatgccggcggccgtcgccaaccacgtggcggccgttgccctgttcggcaagccgtcggcgcagttcatgagcatcatcaacgagccgccggtcaccatcgggccgctgtatgccgccaagaccatcgaattgtgcgtgccgggcgacccgatctgttccggggcggtgaacccggccgcgcatcggcagtacgtcgaggcggggatggtcgatcaggcggtcgacttcaccaccgaccgggtgtaggccgcaatcgtcggcacgtccggatccggcgggtcatggcgtcgccgccgcgccgatcatcgtgtgcacctcctcgatcgaccacggcccggcccgatgatgatcgcggtagcccagcaggcgcggtgtttgacggtcgaagctgcccacgaaaccgcctgcggcgacaaggatttggcccgtcacgtcgcgcgccaagtcgctgacgaggtaaccgtagaccggcgccacgaagacgggcggggcgctgtccagcgaggcctgcctggtcatgtcgtcgagcagcccgcgacggtgcaggtcctcgatgtgtcgttcgtagtcggcgccggtggacagccgtgtccgggcgccgggacacaccacgttggcccggacgccgtaggccttcagttcggcggcgatggccatggtcagcgcgttgacggcacccttgcccgccgggtagccggtcccgccgtagtcgcccaggaacgccaccgagctggtgttgacgatggacccgtgccgctgctcgaccatgaccggggcggccgcccggcaggtgtggaaagcggtgcccaggtgggcgccgatgaggtggtcgaattcgtcggcggtgatgttcaggatcgacgagcccgcgggttcggcgatgccggcgcagttgatcaaggcgtccagccgcccgaacgcgccgatgcactcgtcgacgaggcttcgggcgatgcgctcgtcgtcggcggcgcccaccaccgcggtggcccgccccccggccgcggtgatcgccgcaaccgtctcctgcacggcctgcgggtcgcggccgttgacgaccaccccggcgcccaggccggccagcagttcggcgaccgcgcgcccgatgccgcggctgccgcccgacaccaccgcgccgcgcccggacagtaacgcatcggcgccgctcaccgcggccaccgcccagcgccggcatccgggcgaggtaaaatcttgcgcgcgaacggttttcgcgatcggatgccggcgagccgcccggcagggatgtcgaacattagccgaacagtaccgagccgtcgcgaaaatgagaaccggcgctcccggccaaccggatggtcggccacctatgcgactgccgggtgcgcggccgcgccgaaaatccgaacggatacgcccccgcgcacaccggcgtgaaacgggtcaccgagggccgtcgggaccccacaccaggctgcgacgctgtttgctcacggccaatccggacggcagggagcactggtgacgcggccgccgggccatccccgagccttgctgggccggcgctgatacacatcggaaactgttaagaaaagcccgcaatctgctgctgtaagcgatcgccgggtgcggcgatggggcgtatagtcgccactgaagtccgatatggacgcgtcgccgtttagctaaaagcggcccagtcagccgcacggctactgagcttggtatggctccggcgatccacgatccgagtcaccttcctgctagtccgtgcgacgggtaaccgaccgtccggcggataaggatgcagtggaggcgaccgtgcgcatcgctgcgaggtcccgctgcacgactcgaggagtgagtcagcaatgcaaacttgttcccgcgcagttgtttacccgattcgtcgagtgaagaggtgcgccagcctatgaccaacgcaatcgctccgacacctacagctgcccggcccaccagccaatccgacgattcgtacgaagacgtcgtcgagatgttcctggaactgcgccggatgcccgcggaatcgcacgagtatcgccgtcagcgtgagcgcatcgtggcccgatgcctgcccctggccgatcacgtggccagccatttcgcccgccgcggcgagggtctcgacgacttggtccaggtcgcgcggctggggctgatgaacgccgtcaaccgcttcgatccggcgaagggtcccagcttcatcgggttcgccgtgcccaccatgatgggcgaggtccgccgctatttccgtgactacagctgggggatgcgggtgccgcggcggctgcgcgagttgcacgtgcagatcagcaggacgaccgccgacctcgcccagcagctcggccgggcgccgaacgccggcgagctgtcgcaggtgctcgaggttccgcgggaagagatcgtcgaatgcctggtcgccggcgacgcctatcgcctcgactcgttggatgcgccgcagggtgcggacagttccgggacgccgcgctcggtggccgactcggtgggcgacatcgacccgcagatcgagcacatcaccaaccgggaagcgctgcgggtcctggttgccaccctgccgcaccgcgaacgcgaggtgttgcggatgcggttcttcgaatccatgacgcagagccagatagccgagcggatcggcgtctcgcagatgcaggtctcgcgcatcctggcaaacaccctgcgctgcctgcgcgaccaactcgagtaaaccgttcataccaggagtgctccgcggcattggctgccgcggagcactgtactgtgcgatgcggaagacgaacccgactgtgtcgccaggaaggtcgccaggaagcctggaagggagctcgatgcgatgaggacttcacgtgcggtgatcgcgggggtggcggcgacgacggcgctggccgtgtcggtcgccgggtgcggcagcaacaacaagtcgcagccttcgacgtcgaagaccggatccgccacctcgtcgacctcggccaccagccccgccgcggcaccgccctcgtcgccggcgccggcgacgcccaacgagtacgccaagctgctcatccaggcgagcgacatcaacgcgccggtccccttcaccggcgctccaccgaccgacaaccccaacggccagcccggcgtgtccaccaccttcaaagacgaggacggcagccacgccatcaagatcaccatcggcatctacgacgaccccggcgccgcgaccaacgcattgaacgcggcgaagggccagcagggcgccgtggtcaaagaccccagcacgcagccgtccaacatcggcagcggcggcacgacgctgatgggtaacgcacccgaccgcagcaagggtgtggtggtactgctgttcaccgagggcaaggcgctggcgacgctggagttcgacggtcccaccgacacgctggccccgcccgaattcgtgaacgacgtcggccagaagcaggacgcggccatcaagaaggggctgggcggctagctagcggctgcggaggggcgcgacgtgaacgtcatcaacgggatgccggcccatgcgctgctggtgcatttcgtgctggtgctggtgccgctgacggcgctgctggacatcgtgtgcgggctctggccggcggcgcggcgcgggcagctgatgctgctgacggtgatcctggccgtggtcacgatggcgctgacgccgatcaccatcgacgccggcggatggctgtacgaccagcgggccgaccccagccccatcctgcaggagcacgccaccctgggcagtgcgatgacctacttttccgccgccctgctggcggtcgcgatcgtgctggcactgctgggcctgatcgaacgccggtcggacaagcggcgtctgctgacccgcggcgtcgtcgcggtcctggcgctgggcatcggcatcgcctcgatggtccagatctaccgggtgggtgacgctggggcccaatcggtttggggcggcgagatagcgcacctgaaaaaggcgcacccgggataacggtccccggatcagccggtcggggtgagcagaaacagccgaaatcgccgcgcacccgcgagttcttgggccagaccgtaattcggccagtgcgccagcgcggcggcccaggccgcgtcgcgctcttgtccactgagcagctgcaccgccgcgacgaaacgatgcccccgcctgcgcaccgtgacccgttgtgccgctttgagattcgccgaccacgacgggtgccgccggcgtccccagttcgaaccgaccaacaacagaccgtcacgaaacgggacgtactgcaccgtcgcgcttcgggcgaggccggtcttgcgtcccgagacggtgatccgcacattcggcagaccggcgaggtcgagcactcccagccgccccttcgtggcgaaccgcagcagcgcctccacgccctcgacgatcggccgcccgtggcccatcagcaggcggtagaccgcccggctgcgggccaaccgctgcagcgaattcatgccacgactgtattcgccgtgagccgcctgcaggcgtcagcgcgatgaaatgccgtcgacgcgcccacctttgaccgaggcagcccgggccacccgggtccgcctggcgtcgcccgcggtgcgacgcctgccctcgcgcgcggtgcgacggtaaataaattgcttgatttaacacgacggtgggtgttcactgaggcgatgaccgccgagcgcatcgctcgttccgacagatcgacgggcacccgagaggccatcctgtcggccgccgaggtgttgttcgccgagcgcgggatgtacgccgtgtcgaaccggcagatcagcgaagccgccgggcagggcaacaacgccgccgcctgctaccacttcggcacccgggtcgatctgctccgggccatcgagggcaagcaccgcgagccgatcgagaagctgcgcgcgcagatgttggccgccgtcggcgattccaccgagctgcgcgactgggtgggcgcgctggtgcgcccgctgaccgaccacctgtccgcgctggacacccccagctggtacgcccggttcgccgcccaggccatggccgatcccagctaccgccacgtggtcaccaaggacgcgctgagttcaccgttgctggtgcgcaccctcgacggcatcaaccgctgccttcccgagctgccccggcgggtgcgggccgagcgcatggtcatggtgcgcaaccttctcatgcacacctgcgccgagcacgagggcgcgctggccgaacacgggccgcggtcccggtcggcgtggccggtcgccgcggaagggctgatcgacgccatcgtcgggctgtggcgagcgccggtgcacgtggcggccgcggccggtcccacggcgcagaccacggcaccggccaccgggcagaccgatcaccgaggagcaccatgacgcagccgtcgaccgacgccgacaccgacattccggacttcccgatgacgcgggccccgggctgcccgttcgccccgccaccgaaggtgttgcagctcaacgccgacaagcagctgagcagggtgcggatctgggacggcagcaccccgtggctggtccacggctaccaggcgatccgcgcgttgttcgccgatgcgcgcaccagtgtggacgaccgcctgcccggttatccgcactggaacgagggcatgctcgccacggtgcacaagcggccgcgttcggtgttcacctccgacgccgaggagcacaccaggtttcgccggatgctgtccaaaccgttcaccttcaagcgggtggaggcgctgcggccggcggtgcagaagatcaccgatgaccacatcgacgcgctgctgaggggtccgaacccgggcgacatcgtcagcaccgtctcgctgccggtcccctcgctggtcatcagcgaactgctgggggtgccgtacgaggacgcggagttcttccagacccaagcccagcgcggcatgggccggtacgcgaccgaggaggataccgctcagggcgcggcctcgttggcgaagtatctggccaacctggtccgggccaaaatgcaaagtccctcagaggatttggtgtccgacctggcggagcgggtcaacgccgaagagatcagcgtgcgcgaggccgcgcagctggccaccggcgtgctgatcgcgggccatgagaccaccgcgaacatgatcagcctcagtgtggcggcgttgctcgagcatcccgaccagcgtgcgctgttgtgcgacaccgacgaccccaaggtcatcgccaccgcggtcgaagagctgatgcgctacctgagcatcatccagaccgggcagcggcgcatcgccatcgaggacatcgagatcggcggtgagacgatccgggccggcgagggcatcatcctcgacgtcgctcccgcaaattgggatgcccgccaattccccaacccggaccggctggacctgcgccgcgaagacgggccccacgtcgggttcggctacggtcgccaccaatgcgtgggtcagcagctggcccggatggaactgcagatcgtcctgcccacgttgctacgccgcgtccccacgctgcgcctcgccgcgccgctggacgaactgccgttcaaacacgacgcactggcctacggcctctacgagctgcccgtgacatggtgaagcccaacctgaccctcgaaatccccgatctgcgaggcaaattcgccgtcgtgacgggggccaacagcggcttggggttcgggctggccaagcggcttgcggccgcgggcgccgaggtggtgctggcggtccgcgacccggccaagggcgaccaggcggtcgccgcgatccggcgggaggtcccccaggccaagctcacgatccgccagttggacctgtcgtcgctgcgcagcgtggccgcgctgggtgaacagctgaccgccgaggggcgtccgatcgacatcttgatcaacaacgccggcgtgatggccccgccccggcggcagcagaccagcgacggattcgaattacagttcggcacaaaccatctcgggcacttcgcgttgacgggacggctgctggcgctgctgcgcgccgcggactccgcccgggtggtcaccgttagcagtatcgccgccacccaacgcaaactcgacttcgccgacgtgaacgccgaacacggctaccaacccatgtacagctacggggtggccaaactggcacagctgatgttcgccgtggagctggaccggcgcagccggctcggcggttggggtctgatgtccaacgccgcgcaccccggactggccaagaccaacctgctcagcggcgcctcctacggccgcagcgcgccgacattgcaggctcgcctcacccggctgacgtggcggctgctgccattcatgtggctcgacatcgacgaggccgtcaagccgacgctgtatgccgcggtgtcaccggatgcgcagggcgctcgctactatggcccgcgcgggttctacgaaaccgccaggggcggcgtgactttcgcgcgcgtgccgccgctggcgcgcagcgagcccgagatggcgcggttgtggcggctctccgaacagctcagcggcgtcgactatcccggctgaaccgcagcaacgaccacgaagggacgatggtgctgatgccggggcgaaagcaattcctggggatttcagcgtgacggcctcagcgcgcggatcggtgatcgacatccccgacgagccggactgggcgcggatgcgcgccgagaccggggcccggttgcgcggcgcgatggccgaccacggcgtcgacgcgttgatcctgctgatgaacggctacgtgggatatgcgacgggagccagctggccgttgctggacgcgggcctgtcccacgtggagcgcccggtcgccgtcgtgctcgccgacgacgagcatccgcacctgttcatgccgttccgcagcggcgcatccgcggaatcaccggtacccgacgaccacctgcacggacccgcctacctcgaattcgaccacggcgtccaggatttcgcgcggacgctggccgatctcgtcccgctacgggggcgcatcgccgtcgacgaactcaccggggcgatgcgccggggcgcggccaccctgtttccgtccggcccgccgacggatgcggcgacggtgctcggcgccgcgcaactggtgaagacccgcgacgagttgtcgtgtctgcaccgggccgcccggatcaccgaagaggccattgtcgacgtgcagcgggcgctgcggccgggggtacggcagatcgacctttcggccaccttcgtccgccgcgcattcgaactgggcgccaccaccaacatgctggaggcgatctggcaggtgatgccgagttcgcgggaagccggggtatggacgacgcatggcgatctggcgcttccgctgctgcccaccgagcgggaactggccgccggcgatgtgttgtggaccgacatcagcatcacctacgccggatactgttcagacttcggccggacctgggtggtcggccgggagcccacgccgcgggaacaggaccagttccactgctggcgcgacatcctggacgccgtgctggcggtgaccaaagccggtgtcacgtcgggtgatctggcgcgtgcggcgatcgccgcgaacggcgggcgcaaaccgtggctgccgcatttctatctgggccacggcatcggcccctatcccgccgatgccccgatgatcggcacggatctcggtgaggagttcgacgacaacttcgtctttcccccgggcatggttctggtgctggaacccgtggtgtgggaggacgggaccggaggctatcgcagtgaggagatcgtggtgatcaccgaggacggctacctgccgatcaccgactacccctatgcgccctatggcgactgaggttctgcccgatgccccggcgctgcggttggcacgccggcaacgggcgctggcggcgatggatgagcacggcctcgacatgctggtgctcggccggcaggccaacatccggtacgtcaccggcgcgccgcagctctggatagccggaacgcgaccgttcggcccgatgtgcgtgctggtgcgcgccaccggggacatctatctgaacagcaccgacgacgagggtgtcccggaggagatcgaccacgatcacctgtacggcctggcctggaatccggtgacgctgatcgacgtgctcaggaaggtcgagggcgccgaatcggcgcggcgggtcggaaccgacgcgctcacaccgactttcgccgccttgctgcccgaggcgttccccaatgccgaactcgtggacgccgagccggcgatgcgtgcggcgcggcgcatcaagacgcccgacgaaatggccgcgatgggtgcggcgctgcgcgtcgccgagcgcggattggctgctgcgctggccgaattggcgccgggtgtggcggagcggacgctggccggggccatgatggaggcgatggccgcgggtggggtcagcacaccggccacccaggatgccgcgtgggtgacgtcgcgggaacggccgtggcggcgggccggttcgggcgtggtgcgcccgggtgacctggtggcgttcgccgccggggcgctggccgacggttatgtggccgaggtgggccgcacctggccggccggtgatacggtcggcggtcaggttcgcgcgctgttcggccggtcgaatgcgttgtacgacaggatgcttgccgcctgccgccccggtgcgtccaccggtgatctgctcgccgcctatcgcgctgtcgatgagccggtaccgccgatgccggtggcgcacggattgggcctcggtttcgatccgccggtagtgtccgaaacactgggggccgcaggagaacgggattgcctggaggccggcatggtgttggcgatcaccggctacgtgtggcagcgcgggatcggcgcggtgttccgccgcgacaccgtccacatcaccgagggtggtgtgcaggtgttgacggccagcccgacgtggactggtcaactcccctaaatcccttgtttcacttgggtttctgtggtcacatggcggcgattcttgtcggtgccccttcatacacttcgaggcatgggctgcagcagtcgtgaagagatcgtcaaggtcttcgatgcgctggatgctgcggtcgaccgcttgggcgagttgagttttgacgcgttgacgccccgcgagtgtctatcgttgttgcagcgctgcgagacggtgcgccgacgcctgccggtccccgagcatccgctgatcaacgcgctggcccgcgacgccagcccggcggagttgggtggccggctttcgcatgcgatcgccgaggcgacgctgatcagccgcgccgaggccgcccggcgggtgcacaccgccgctgatttgggcccccgcgtcgggctgaccggcgaaccgttgcctccgctgctggccgccactgcggccgcgcaacgggccgggttgttgggtctcgagcaggtggcggtgatccgtaagttctgccaccagttgccgggctggatcgaccaggcgacgcgggagcgcgccgaaaccgacctcgccaaccagggtgggcagtatcgtcccgaacagctcgccgcgttggcgggcacgctggccgattgcctcaaccccgacggcctctaccgcgacgaggaccgcgcccgccgccgcagcctcaccctgggcaaccaacaggccgacggcatgtccgaactccgcggctggctatcccccgagctgcgcgccaccctggaagcggtgctggccaaactcgccgcccccggcatgtgcaactcactcgatgagagtccgtgcgtggaaggcactccgagtcaacacgccatcgacggtgatgcccgctcggcggcccagcgcaatcacgatgggctgctggccgggctgcgcgccctgctggcctcaggaaacctcggccaacacaacgggctcccggcctccatcatcgtcaccaccaccctggccgacctcgaaaccgccgccggacggcgtctgaccggcggcggcaccctgctacccatgtccgatgtgatccggctatcccggcacgcccaccactacctggccatcttcgaccagggcaaagccctggccctcctgtatcacaccaaacgcctggcctcacccgcacagcgcatcgtgttatacgccaaagaccgcggctgcaccgcacccggctgcaccgcccccggctgcaccgcccccggctgcaccgtccccggctactacagcgaagtgcatcactgcaccgactacgccacctgccacaccaccgacatcaacgatctgaccttcgcctgcggaccccaccaccgcctgctacaacccggcgcctggaccacccacaaaaacgccaaaggggaaaccgaatggattccaccaccccacctggaccgaaaccaaccccgcaccaacaccttccaccaccccgaaaaactcctccgcggggagaacgacaacggggaagacgatggcgacgaggaggaggacgacgacagcggagacgatgacgacgcggcggcgtagcgtcactgccccgcgatcacggaagctgcagggccgtcggcattttcacccgccacggcgtaccgggtgccccgcggcgcacgcgaccacaacacgccgtcgtgcgcggtgacgcccgcggagatcagcgcccgcttgaggatcttgttggtggcggtggtgggcagccggtcgttgatgcgcacgtagcgcggccacgccttgggtgacaagtcgggctgcgacgcaaggaatcgcccgaattcttccgggctcagctgcgccccggcgcgcagcaccagcgcggccatcacctggtcaccgacccgctcgtcggggaccgcgtagacggcgacctggctgatgtcaggcaaccgcgccaggatccgttcgatcggcgcggccgccagattctccccgtccacccgcatccaatccgcggtccggccggccagatagatccacccgtcggcgtcgcggtaggccagatcgcccgaccagtacatgccgtgccgcatccgctcggccgtcgcctccggatcgttgtagtagccgacgaacgggccggcgccctgggtgttgaccagctcgccgaccgcctcctcgaagttggtcagcgcgccgtgctcatcgaactgcgtgacgacgcattccttcagggtggtcgggttgtagatgctgaccccgggatacggcctgccgatggagccgggcggggtgccgtcttcgcgcaccacgatcaccgcgaactcgctggagccgaagctgtccaccacccggcatccgaaacgccttgcgaattcggcgatgtcgcgatcggtcgcctcgttgccgaaggccacccgcagcgtgttgtcggcgtcgtcgggtcgctcgggagtggacaggatcagcgccagcggcttgccgacatagttcaggtaggtcacccggtaacggcgcacgtcgtcgaggaaccgcgacggcgagaacttggcgggaaccatcaacgcgccactgccgaccgcgacggcccacccggcggcgacgccgttggaatgaaacagcggcatcgccagatagcagacgtcgtccgcggtgacgtcgtattgaaagatgaggctggcgccgcacatgatcgccatcccatgcgcgaaccggaccgccttgggattgccgctggtgccggaggtgaagatcatcatgaacgggtcggccgccgtcacctcgcggtgcggaatcagcggcggcgccgcggcgaccgcatcggcataggccggcgacccgacctcgagaacctgaattccgttgaggtccaaccggtccagcaacggcaggtgctcgtcgtcgacaaggaggatctggcagtcggagcggtggatgtcggacagcagcgctgatccccggcgggtggtgttcagcccgcacaggacgtaaccgccgagccccgcggcggccatggcacgcagcatcgccggtgaattgcccagcgccgcaccgacatgcagcgggcgggcggggtcggcgcgggcgatcagcgccgccgcctcggcctcggcctcggccaggtgctcgcgccacgtccaggtcttgtcgccgtatgcgaccgccggggtgtcgtcgtgtcggcgctgccgcaacagctgctggaccgtctcaatcatcgtgtcgtcagcaccagcccggcatagccgcggtcggccacctgctcgcagtgccgccgatacgtgccgaaccctccgatgtagggcatgaacactcgtttcttgccttcgatgttggcgcccaggtaccacgacgaggccgccttggggaacagcgtccgctcagccacctcggccacgtaccgggtccacgccacggccgcgtcccgccgcggctcgacctcggtcacccccagtcggcgcgtcgcacacagcaaatcgacgacccagtcgacttggacttcggcgtgcaggaccatgttggccagcaccgaggggctgccaggcccgctgatgctgaacaggttcggcaggcccggcaccatcatgccgagaaaggtcagtggcccgtcggcccagatgtcgcgcagtcggtcgccgcggggccccgtggggttgatgcgggtcaacgctccggtcagcgcgtcgaagccggtcgcgaagatcagcacatcgcagggatatgtcgttgtgctggttcgcattccgtctgcggtgattgcttcgatgggctcgcggcgcaggttcaccagccgcacattgtcgcggttgaaggtggcgtagtagccgtcgtcggtgcagatccgtttggtgccgatcgggtgatccacgggaatgaggtccgccgcgacgtcgggatcggtgacgatttcccggatccgctcctcagcgaacgtcctggcgatgtcgttggcggccggatcgctggtttggtcggggaacgtcttggcgaacagcacgccaccctcgcgccaccgcttccacagcgcttccgcccgttcggccgggtcggtgtcgacggcgttcttgtggtacatgccgtgcggggtgcccgacgttgcgtaggcggagcggcggcggcgctcgggatactgctcttgaatccgttgctgttcctcggccgaaaacggccggttgggcatgggaatggtgtagttcgcggatcgctgaaagacgaccaggctttcggcttgggcggcgatgatgggggtcgcctggattcccgacgatccggtgccgatcaggccgacccgcttgccgcgcaggtcgggatcctcgcgcggccaggcggcggtgaagtacacctcgcccgagaagtcctgcgccccagggatatcgggccggttgaccgccgacaggcagccggtggcgcagatcaggaaccgtgcggcaaaggtctgcccgttgctggtgccgacgcgccagcggccgtgttcgaacgcggcgtcgacgacgtccgcaccgaagcggtagtggcggcgcaggtcgaagcggtcggcgacgtgccgcaggtaggcgaggatctccggctgtgcggcgaagcgttcggtccactgccagctgcgctgcagctcttcgtcgaaagagtaggagtagtccacactttcgacgtcgcaacgcgcacccgggtagcggttccagtaccaggtgccgccgacgtccggggccgcctcgagcgcggtcaccgacaggccggatgaggcggcacggtgcacggcgtagagcccgccgaatccggcgccgatgacgaggacatcgctgacgtcggtcatgctggggcctctcggtgcgccggatgcaaccacccgtcgcaggccggggcgccgtgcgggcagtagatgcggacgcgcgggaatccggcattcagctgctccggcatggcccgcaccatgccgtccagcgggtcgtccatgtgcacctccgaccgcatcgtcgcgctcatgcgggccggtacttcaacagcgtgatcccgtcctgcagatcgtagaacaccgggctgacccgcatcccgatcctgatgtcgccggggtcgacgtcgaccagctcggtgctgaacttcggcccggcatcccagtgcaccaccgcgggcagctgcggcaccgcgtcggcccacggcgggccggtgggccggcgtgcgacggtgaacgtgtacagcgttgcggcgccgtcgatttcccgccattccaggtcgtcggccagcgttcccggtgacagggtgcgcggatagaacacgtagcgccgcagcgacggcgagtactgcaccaggatccgatgctgcgccaggccgtcccagaacggccgcgagacgggggtgggctcgggaatcgggcgcggtgtcatcgctactccccctgcagcagcagggcgacctgctcgctcatgatgccgccgttgccggtcacgaaggcggtgtggcagccgggcacctgggcgtcgccggcccggcccatgatctggcgggcgccgtcgaccacatggtgcatgccaccggccatgccggcctggccgaaggacagttggccgccggcggtgttcagcgggaagtcgccccgatgggtcaggtcgtggtcgccgatccattgcatgccttggcctttcgcgcagaatccggcgtcttccaggctcatcagcaccgtgatcgtgtagcagtcgtagatggaggcgacgtccacatccggccggtccagcccggccatcgcgaaggcccgttcggcggcgcgcgcgatcggggtggacagcaggtcctcggcgtacgtcggggtcttgaaggcgatgtgttcgccgaagcccttgatccacaccgggcggtggcggccgcggcgggcgaggtcggcgttggcgatcaacaccgcggctcccccgtgcacgcgcatcaccgtttccagcatgtggatggggtcggcgatcatcgggctgtccagcacgtcggccgccgtgatcggggtgccgaagaagacggcgccgggatgggcgcacgcgttggtgcgctggtcgacggcgatcttggcgagcgcggcggggtcgtagccgaattccgcggcgtaccgctgggcgatctgcgcgtagggcgcgttctggccgacgttgccgtacgggatctcgaattcggcctgcggcgagccgtagttgttggatgacgccccataccaattggattcgggcgggggtcggcgcgcggagtgcggcaccgatgcggacccggggaccacggccagcgccgcctcgcagatgccgagttcgacggccgccgcggcccgccacaccatgcccgcggagctggccccgcccagatcgacgcgctcaccgaaatcgcatgccaggcccaggtattcgcacagggtggccggtgcgaacatggccgactcggcgacgccgtgggtcagcaacccgttgacccggccggggtcgacgccggcgtcctcgatcaccagctttgccagcaacgcgtactggtcgagggtgaaccgcggcggaccggtcggccgtcgctcggccggcagctccgcgatgccgacgatcgccgcttcgccgcgcagcccggtcacgaccgggcttcccgccgcggcagctgcacggtggccgtgccgggcatcagcacggtgtcgtcgcgccggccggcgatgtccaaatcgaccaggccggagccgctttcgtccagccgcttgccggtgacccggccgccgaaactgagcggttcgcccggataggcgaccgcccggttctgcaccgagaacgacaccagtcgtccgcgtccgccgatccagtcccccagcgcgcgggccagcagcgccgcctgaagcgcgccgtgcaccagcacatcgtcgtatccctcggcgcgggcccactctttgtcgtagtggatgcggtgaccgttgtaagtggcggcgctgaagaagaacatctgggtttcgtcgacggtgacggtcaaggtggggatgtgatcgcccacgctgacgtcgtcgtagcacagctcggtcatggcggccttttctcggtcggctcttgctagggtcgggcgatcatcgacgtcgacgcctcggccagcagctcgtcgtgctggttgcggtacaccgtgtgccacgtgacgagcacgaatctgccggagcggccctgcttttcgacgatcgaggcaatggtgcggaccatgtcgacccggtcgcggtgataggcgggcaggtggaaggtgaagctttccccgccggccatccgcttgggtgcgcgcggaaacgcgaggctgcccgagaccgcgccggaggatccgtcggggcgcagcgagtccagccgcgagacgccgaggatcgcgtattgcaaaaacagcggcgggcagatgatgtcgcgaaagccgttggcgcgcgcgtaatccgagtcgaaatacaacgggttgtggtcgccgaccgccgcggcccagcgctgccaatcccgttggttcacttcgccggtcgccgacgcggcgaccgtacccacccgcgccgccgactcggcgtcgaccaagctgtcctcactcaccgatctcctcccaggtttgttcgagccacgatgcggcgacatcggcgccgccgcccagcgtcgaaccgagccgggcccgttcgctccacagatgcaggtcggtctcggtgacatagcccatgccgccgtgcagctggtgcgcgtcgagcgtgatcagccgggcagcggtggccgcatgcatgcgcgcgacggccgtctcccggctcgcggtgcggccgcgtcccagccagaacaccgccgcgtgcgcggccaagcgcgccgccgccagcgcgatgtgcatgttggcgaccacgtgctgggcggcctgaaacgaggcgatggaccggccgaattggtgacgcagcttggtgtagtcgacggtgcggtccagcacggcctgcccgacgccgaccaggtcgagcgagcccaacgccaccgcggtgttggccagccggcgcagggcggtcgggatgacgcccgcggccacggcgtcgagcaccgcgtcgtcgccgatcgccacgtcgtcgaagcggaccgcgaaggcccggtgcccgccggccatgtccagcggcgccaggctcacgccctcggtgtgcgggtcgaccaggaacaccagtgtccgcccggccgcggcggccgatgccacgacgaggtcggcgacgtcggcgtcggcgacgtagtcgacggttccgttcacccgccactgggaggccggtgcttcgacccgatcggcgcgcaggaccggggacaccagcgcggcgtcgcgggcgttccacagcgcggtggtggcgcgcaggctgcccgacaccagcggcggcaaccaccgggccttggcgtcccgggacccgagccggtcgacggccagggctgcctgcacgctgttgtgcaccgtcgtcgggcacagcgcccggccggcttcggtgtagaagaccgccaggtcgtccagcgagccgccggagccgccgtactcctcggcgatggccaggccgaagacgcccgcgccgctcagcgccttccacaatgcgggggtgcggcggtcggcgtccggttcgttcagcgctcgcaccaggtgcagcgggttctcggcggccagcagcgcgcgcagcgacgccgcgaagtcgcgctgttcggcggtcggcgtcagtttcatctgggtggtcgggtccgggtcagcgtccgtagctcggcatggcgtgcccgcgctgggcgatgatgtcgcgcagcacctcgttggcgcccccgccgaagcgcatcagcggggccgcccggtagagccgctcgaatttgcctgccagcggggcgttttcgctgcgatgcgccagcagcccgtccactccgagcaggtcgagcgccagatccgcgatgcgctgacgcagctcgctggtgaagatcttttcgacgctgacctcgacggtcgggatgacgccgctgtccaggatcgacgccgcctcgtagcccatcagggtggccaccgccacgtcggcttcggcctgcgccagccggcggcacagccacgggtcgtcggcgggcaccgtccggtcgcggcgcggccgccgcgccagctcgtgcagttcctcgacggcgcggcgcaggtcgcccgcgttggtcagggctccccgttcgagatcgagcgcgccggtgatgtaggtccagccgtggttgacttcgccgatcagattggtgaccggcacccgcacgtcatggaagtgcacctcgttggtgcggtagcccgaccacgcgtacagcgggcggatgtcgatcccggggctgtcgatggggacgatgacgaccgagatgccgcgatgccgggtgccggtgggatcggtgcgcacacagagccattcgtgcgtcgcccgctgcgccccgctgttccagatcttggtgccgttgatcacccactcctcgccgtcgcgcacggcgctggtgcgcaggttggccaggtcggttcccgcgtcgggctcggaatagccgaccgcacagatcatttcgcccttggcgatcagcggcagccattcggttttgttgcgttcggtgccgtgccgcatgatcatcggcgccaccgacgtcacggtcaggtcggggcccggcacgccccagtattcgaattcgctcatcagcaggtgcaggtgcaccgcgcccagccccaggccgccgtactcgcggggccagttcagcccgaaccagcccttggcgccgatcttgcgccggaaccgggccacttcgccgtcgggaaactcgagatcgtgttgggcgagctcggcccgcaactcctcggtgacgttgtcgcgcaggaattcgcgaatctcggccagccaggcgcgctgccccgcgtcgagttcgaaatccattccggcgcctgtgcctttctgcgggtgcctttccgtcggcctcagaccgagccttacaccgagcagcgccagcgtaacgccacggcgagaatgcgcccgggatttcgccgtggcgttacgcccggcgtaccgcgaagggccgggaagggtcccgaaggattgacgccgcgcctgttaatgcgctgtcaagctcccgttaaaacccctcgacacgctcgcggttccgtgcgggggctgggaggattttcagatcggttggtcggcgcggaccagacaccgccgggtcgagggactcgaaggactcgaggagaagtcatgcccaccgttgagatgcggctccgcgaagacttgcgcaactacgccgtcgaattgcggcaactggcttacaccttgccgctgggcgtcggcgagcacgacctgttgcagttgtccgaccggatgcgcgccgcggccgaccagctggtgcgcaagggggcgtaaccgctcagccgcccttgaggcggatcttccagcgcacgaaccccaggtagacggtgctgatcaggatcagcatgcccacgtcgaaccaccaggtgcccgggcgtggcgccagtgcgagtccttgggcgtcagcggcccgggcaccagcttggtcaggtcggcggtggacgccgacgcggcgaatccccagcgcgccggggttgcccaggccatctgatcgagccccacccgcccggtcaccgggatcatcccgccggagaacaccagctgcgacatcaccgccaccaccagcagcggcatgatctgctcgttggacttggcgacggccgacagggccagccccaacatggcggaggcgacgcaggtcagcgcgacgtcggcgaacagctccagcgcgggcttgcccagggccacggcgccctgggtgggcgcgcccttgccgagcaccgcgatcgtggtgacgatcgccgactggacgatcgcgaacacggtgtagatgcagaccttggccaacagatacgccgacgtggacagcccgaccgcctgctcgcgcaggaagatggcgcgctccccgatgaggtcgcggatggtcagcgcggtgcccatgaagacggcgccgacgttcagcagcaccaggatctggcccggctcgttgggcgcggcgcccatcgggttggggatgccgaagccgacgtcaccgggcaccgacatcgacagcgaacccatgatgaacggcagcaacgccaggaacacgaagtagccgcggtcggagacgatcaaccgcatctggcggcgggcgatcgtggagaactgccggaccaggctggtgtgcgcggggtcgccgagttcggcgggttgctccgccggtggcggcggcggtcgcgggccggtgcgggccaggtagcgcgcccgggaaccgtccgggtcgcccgcgacggtgctgaagatgtcggcccagttggtggtgcccatggccgggccgatctggccgggcggcccgcagaacgccgtcttgccgccgggggcgagcagcagcacctggtcgcacacgtcgaggtaggtcagcgagtgggtgaccaccagcaccacgcggccggcgtcggcgagctggcgcagcatggtcatcacctgccggtccagcgccgggtccagaccggacgtcggctcgtcgaggatcagcagcgacggcccggtgagcagctccagcgccaccgacgcacgcttgcgctgaccgccggacagcttgtccacccgggtgtgcagatgctgggtcatctcgagttcttcgagcacccgggccaccacctgggcgcggtcttccttggtggtgtcgggtggcagccgcagttcggcggcatacatcaacgcctgctgcacggtcagctggccgtgcaccacgtcgtcctgcggcaccatcccgatccggctgcgcagcgacgcgtactcggcgtgcacgttgtgtccctcgaacgccaccgtgccggtggtcgggtgggtgtatccggcgacgagccgcgcgaacgtggacttgcccgcgccggacggcccgatgatcgcggtcagggtgccgggcagcgcggtcagcgagatgttgtccagcagcgtcttgttgctctcgatcgtccacgtcacgccgcgcacgtcgaggccgccggtgcgggtcgcggccgcggtctggtcgcggcgggccagggtgccgccgtggaagaccaggtcgatgttgccgatggtgacgacgtcgccgtcgcgcagcacggccgaatcgacacggacgccgttgacgaaggtgccgttgatgctgcggttgtcgtggatctcggtgccggcgggcgtcgggatcagggtggcgtggtgacgcgacgccagcacctcggggatgacgatgtcattgtcgttggcgcggccgatcttgaccgcgcccggcgtcgattccagccccgcgcggcccggccgcaggatcttcatcatcgacgtggcgaggttcgacgagtcgccgccgatgcgcccggtctgggcgggggcgggctgcgcggtggtcggcggcgcggcgtgccccgacggcgcccggtagatctgcggcgcgtgctgcggcccgctgggcggataccgggtcggtccgctgggcgggtggctcggctgcgcgccggtgggcggctgcaccggctggcggaacgaggacgacgccggctgctgtggctggctgatccgctgggtgccgggcggctggccctgcgctgcgcccgtcatcggcccgctgggcgtgctgacgatcggtatcgacgtggtgagcggaggccggccggccgacccctggtggcggccgacctcgaaggacagggccgggccgtccgggttgcccatgttgacccgggttccgtcgttgatgtcgaccatcgggacgcgacggttgttcacgtacagcccgttgaggctgccgttgtcgatggcgacccaccgcccctgctcgtagcgcacgatcaggtgggtgcgggagatcagtgggtgtgcgacgcgcaggtcggcgcgaaggtcacgcccgatcacgacatcgttgcctgccgcgaaggtgcgctcggctccgtcgtagcgcacggtcaacgcaggcgtggctggtgggctcatcaggaccaactctaacggcagcggcgccggttaggcgctatgcgtttcccggcccggacgacgtcgggaggctttgggcggctgcttcgggttccgccgattccggcgcctggggcgggcgacgcccgggcgacgaatcacggtgcagcgcagctactttcgtgctcttcaaccggccgccgcggtgcgcagtctgcgcacgttcgagaatcgagtcccggcggcggtgacgtccttgacgaaatcgccgaggtacttgatcgcgcgcctgccctcgggcaacacgtcggcggccagcgggaagtcgtggatctgtccgtcccaaagatggagatcgcagtggattccgctggcttccaggcgtttcgccatcagctcggcgtcggcaaccaacaactcgtccgagctggcatggatggtgaccggcggcagcgatgacaggtcggcgtccaccggcgaggcgaccgttgaatcgccgtggccctccagcacctgggcgttgctcagatactcggcgaaccgcgaaaacgcccggcaggtgaacatcgagcatttgcgggcgttgcggtgcttgagttttcgggccgggtccgtgtcggtgaagggtgacacggtcgcgatgccggccggctccatgacctcgttctgaatcgccagcagggtggtcatgaacgccaggtatcccccggccgagtcgccggccacgaccacgcggtcgccgtcgaagccgcggtcctgcagccagcgcagtccgtcgaggccgtcgtcgatggcatcggtgatctggtgcgccggcagtttgcggtacgccacggcgagcacggcggcgtccgccgccttcgacaagcgggtcaccatcgggcggtgggtgttgaggccgcaggtcaaaaaggcgccgccgtgcaggtacagaatcgcccgctcccccgataccccgggtgcgcgcacccattcggcggcgcagtgctcgagccgcacggggtgcgtggtgcccgccgatcccaacctcggcaccaatccggcgaagctgtcgacatattcgaggggccagtgcagattcggcgtcagcgcccatgcgcgcaccgcgttcttcacgatcaagcggctggcgagcgacaccgctaccgactgcggactatggcgatgatgcacccgccgggtcgttgccacgctgggcaatacccgacggggcgacatatgactcggatcggctgtactcaccatctgcatcaacctcctaagtcgacaccggatacccgtcacggcgacgggctaacgggagaagtacgtgcggcgaatgtcgggttcatcaccgtttgccgcgggctgagatgggtatcactggcttgtcttccggcctggttgtcaccgatctcggccaatggccgaagatatgagcgatgacgcagcccaagcactttgatccgctgctgagcgaccgggtgacggtggtgaccggtggtggcggcggtatcggcgcggccaccgcgcggcttttcgccgaacacggtgcgcatgtcgtcatcgccgacatcgacgccgaactcgccgacgaaaccgcctcggcgatcgcggcgtccggcggatccgcgcatcccatcaccgccgacgtgcgaaacgcggccgaggtcacccactttgcgcggaccgtgctggaccgctacggccggatcgacgtgttggtgaacaacgtgggccactggctgcgccaccccgggggtttcgccgacaccgacccgcagctgtgggacgagctttaccggatcaacctgcatcacgttttccttgtcacccacgcgttcctgccgaccatgatcgaccggggtgccggtgcgatcgtgaacgtctcgtcggtggaggggctgcgcggttatcccgaggacccggtgtacgcggccttcaaagccgccgtcatcggattcacccgcagcctcgcggtccaggtgggcaatcatggggtgcgggtgaacgcggtcgctcccgacgtcacggaatcgctgcaagtgccctactcgcaatggctttcggccgaggagcagagccagtggccgcgctgggttccggtcgggcggatgggcctgcccgaggatcaggcccgggtgatcctgttcttggcctccgactgttcgtcgttcatcaccggccacaccatccccaccgacggcggcaccaccgcggccggcggctggttccgctcctcacgccggcccggccgggagtggacgaatcggcccgccgacccctgatcgatgtgcggagtgcctgtgcgccaatcactttgagttcttgccagacgagatggcccggccacaggcgtggccgggccatcgacgggtacggttactgttcggccttctggcgagcctcgttgatctcggcggcctttcgggcgctttcggcctcggcctccttctgggcggcctcgcgctgcgcctcggccttgtcctgctgggcctgaccctcacgcatcaggtcgtcgcgtccggcgaccgcgccggccacttccttgaccttgcccttgacgccctcgacgacgccctcgatggcctcctcgggaccgctcttgtccgacatgcgtcctccctccgtgtcgtacgtgtcgaccccagttattgccagccgacgccgtcgcaaaacgtcggcgagcagtagcctgcaccacagccgcaccccgatcccgcccggtctacctccaattcccttgctgtgcatcagaattgatgtcatcgcgtcgcgatcgagccggtgccgccccgcctcaccgcaccgggcaccggcacgggcgcttacgctgttcgggatcgacagcgaggagtcgcgacgatggaaatgtgggagctggtcgcccgcgagcagatccgagacaccctggcgcgctacaactggtccggcgacgcgggccgggtcgacgacctcgcggagaccttctgccgcgacggggtcctcgaaatccggggcttcgagccgttgcgcggccgagcggcgatcgcggccttcctgcgcggtgtcaccggcggcatcggcgtcaaaccgattgtgcgccacaacgtctccaacgtgttgttcaccgagctgcggcccggcgaggcgcgggtccggtcctacttcaccgtcgtcacccacatcgggctggaccattgcggccgctaccgcgacctgctggtgcccgacggcgggggggtggctgatcaaacaccgcgcggtgtccaccgactgggcggcgcccggctcggtcatggcccggtagcaccggccggccggcgattccggtcaatgccggggcgaatgtttgccgaacgccccgcaacggctacagacatcacggcgcaccagcggatcgcggccaccccgatggccccatccgcgcgacggctccggaatgaccgccggtcatgtgaccacaggtcacggccgcgaaacacaaagacaggcagacatgcaacgactcagcgggctagacgcgttcttcttgtacctggaatcaccgacgcagctgctgaacatttgctgtgtgatggagctggaccccgccacgatgccgggcggctacaccttcgagcggtttagggccgcgctgtcgaggcagctggaagccgtgcccgaattccggctcaagctggccgacaccccactcaacctcgaccacccggtgtgggtggacgacgaccggttcgatctgggccggcacctgcaccgcgtcgcgctgccgtcacccggcggaccgaaagaactggcggagatctgcggccacgtcgccgggctgccgctcgatcgcgaccatccgctgtgggagatgtgggtggtcgaaggccggcacggcaacgacacgctgtccgtcgtcctcaaggcccatcacgccgtggtggacggcgtgggcggcgccaacctgctcgcgcagttgtgcggcacggcgcccgacgcgccgccgcccgagccggccgcccgcgccggcacggcgaaccggcttcagatcgccgccggcggattgatcggggcggcgctgcggccctggcggctggccagggtgctgccgacaaccgcgctgacgctggccgaaacggtgctgcgcgcccgcggcggggggcagaccatggcggctccgttcgcggcgccggccacaccgttcaacggaacgttcacccggcgccgcaacgtcgccctggccggcgtcgacctcgagaacgtcaaagcggtcaagcggcacttcggggtgacggtcaacgacgtggtgacggcgatctgcgcgggcgcgctgcgccagttcctggccgaccgcgacgcactgcccgaggtgccgctggtggccagcgtgccggtgtcggtgcacggcaagtcctctcgacccggccgcaaccagaccacctggatgctgtgccgcctggaaacccacatcgacgacccggtgcaccggctgaccacgatcgcggagaagaacgcggcggccaaggagcacgccgccgcgatggggccgaccctgctgcaggactggacgcaggtggccgggcagaccgtgttcggcgtggcgcgcaaactgctgccccgcatcccgctgccggacaaaccgccgcacaatttggtgctgtccaacgtggccgggccacgacaccagctctacttcctgggctgccggctggacggcatgtacccgctggggccgatcatcgccggcgcggcgctcaacatcaccgtgatgtctctgggcgggcggctcggcgtcggcatcctctcctgccccgacctggtgcccgacctgtgggatctcgccgacgcgtttcccgccgcgctcaaagacctgacgaactgcgtcaggtccggccgcgcccggacctgagcgcatccgcgcccgttcagcggaaccgcgtccgccgtcgccggcacggcatggcagggtgatacccgtggcagacactcctggacgaaccggcatcaccgagcaagacctgcgtgaaatcagcacggagaagggcgctttgcgctactacgacaccggcggcgacaccggcggcccggattcggcggccgtgctgctcttcctgcacggctccggccccggcgtcacggggtggcgcaacttccgcgggatactgcccgccttcgcggcccactatcgctgcctggtgctggaattccccgggttcggggccagcgacgacttcggtggccacccgatggtcaccgcgttcggcaccgtcgcgccgtttctcgacgcgctgggcgtcgagaaggtgcacatcatcgggaactcgatgggcgggggcgtcggcatcaacttcgccacccacaatgcggaccgcgtcgggcggctggtgaccatcggcggcatcggcacgaacatcttcagtcccagccccagcgagggcatccggctgctgcaggagttcgtcgaagacccgacccggcaacggctggtcgactggctcaagtcgatggtgtacgaccaggcgctgatcaccgagcagctgatcgaggagcgctgggcgctggccaccgatccggacacgctggccgcggcgcggcgcatgtacggcaaggcggcgttctcggcgatgaatgccgcgctgaacgcatccgatcggccgctgccgtgggccgtgatgcacaagctcaccgcgcccaccctgctcacctggggccgcgacgacagggtgagcccgccggacatggcactgatcccgatgcgcaccatccccaacgcggagctgcacatcttccccaactcggggcactgggcgatgatcgaggccaaagaggcgttcgaaagcaccgtgctggccttcctttcgcgcggctgattcggtgcccggcaggcaccccgcacttcgcaacgtcggtcacgaatcctcctatcgctgagtggcgcccgcgtcgaccggcagggtcacggcggtgatgtaacgcgcctcgtcggaggccaggaacagcgcggcattggcgacgtcgaccggatcgacccacggcacctgaagcaggttcatcgctcgcgccgcttcggcgaactcggctcgcgtcggcggccgatccaggtcgggccgaaacgcgcttcgtacggtgtcgttttggatcaacggcgtgtcgacgttggtcgggtgcacgcagttaacgcgcacccggtgcggcgcgagttcgtgggccaggctctgcatcaggccgaccacgccgtgcttggcggcggtgtagtgcgcgacgccgaccagaccacgcagtcccgcaatggaattcgtcaagatcatcgaaccggcaccgcgtgcgatcagatgcggcgcggcggcgcggcacgtgtgccatacgccggtgaggttcacgtcgagcatggtgcgccagacgctctcgtccatctcgaccgtcatcgcgcgcgacgtgatgccggcggtcgcgcagaccacgtccaacccgccgaaccgtcgcgcaccgcgctcggtggcggcctgaacgccatcgaggtcacgaacgtcgacgagctccgcgtgcattcgcccgcccacctcgccgaccagcgaggccgtgtggtcgagatcgtcgggtgtgctgggcggaaccatcaccgtgtcgaccggcccgcacaggtcgagggccacgatgtcggcgccctcctgcgcgaaccgcacggcttgggcgcgcccgattccccgcgccgcgcccgtgatcaacgcgaccttccccgccagccgccctgcggcactgacttgtggcatccggcgattctgccggcgcgggcggcaccggggtcggtgtgtgtccgatggccgggagacgatcatgccggcgtaccggtcaccgggatatcccggccgagggcgaccgccgggacctaacgtaggcatccgtgaccagtggcagtgaccggcgcgcaaccccggacgtcgatgtggtggtcgtcggcgcgggcttcgccggcctgtacgcgctgcacaaactgcgatcgaacggcctgcgggtcagggtgttcgaggccgggccggacgtcggcggcacctggtacttcaaccgctaccccggggcccgatgcgacgtcgagagcgtggactactgctactcgttctccgacgcgctgcagcgagagtgggattggtcggagaagtacgccacccaacccgagattctggcctacatcaattgggtcgccgaccggctggatctgcgccgcgacatcaccctgaacgcccgcgtgaattccgccgtgctcgacgaagcgcagctgcgctggacggtgaccaccgaggcgggcgagcgcgtcaccgcccggttctgcgtgatggccaccggcccgttgtcggcggcgatgactccgccgttccccggtttggataccttcgccgggcaggtctaccacaccgcggcctggccgcacgaaccggtggacttcaccggcaagcgcgtcgccgtcattggcacgggatcctctggcatccaatcgattccgatcatcgccgaggccgcatcgcagctgtacgtgttccagcgcaccccgaattacagtgtgccggcgggtaaccggccgttgagtgactccgaccgtgccgaggtgaaggcccattacgcggaacgacgacggatgtcgtggcgcagcgggggcggctcgccccacgtcgcccacccgaagttgacgatggaggcaacccccgaggaacggcgtgaggcattcgaaaagcgctgggaactcggcggagtgctgttctccaagacattcgccgaccagatgatcgacccggtcgccaacgaggaggcccgcaagttctacgaggagaaggtgcgcgccgtcatcgacgacccggcgctggccgacctgctcatcccgaatgaccatccgatcggcaccaagcgaatctgcaccgacagcaactactttcagaccttcaaccgcccgaacgtgaagctgatcagcgtccgcaagacgccgatcatgtccatcgatgcgaccggcatcaacaccaccgacgcccattacgacctcgacgcgatcgtgctggcgaccggattcgacgcgatgaccggcgcactggccaagatcgacatcgtgggccgcgacggaaggcggctgagcgacgactggtccggcgggccccgcacgtacctgggcctcggcgtcgacggattccccaacctgttcctggtttcgggtcccggcgcccccgccgtgctggccaacatggtgttgcatgccgaggcgaacgtgaactggatcgccgactgcatcgcatatctcgacgcccatgactacaccgctgtcgaggcgacgacggatgcggtcgacgactggggcgccgagtgcgcgcgccgcgccgacgccaccctgttcaccaaagccgactcgtggtatttgggtgccaacgtgcccggaaagccgcgcgtcttcatgcttttcgtcggcgggttcggcgtctatctcgacatctgcgccgaggtcgccaatgccggctacaaggggttttccttggtcaaggcccgctgatgtcgggtctgagcggacgggtagtgctggttaccggcgccggtcgcgggatcggtcgcagccattgccagcggttcgccgaggagggcgccgacgtgatcgcggtggatgtgcccgcggcggctcccgacctcgcgcagaccgccgccgcggtgcaacagcgcggcgtgcgcgcggcgaccgctctggctgacgtcagcgacttcgccgcgttggcggccgcggtggacgaggccgtcggccgactcggtcgcctggacgtgctcgtcggcaacgcgggaatccacccggccgccgcgcccgcgtgggagatcaccccgcagaactggcagcagacgttggatgtcaacctcaccggcgtgtggcacaccgtcaaggcgggcgtcccccacatgagccggaccgcccgaggcggatcgatcgtgatcatcagctccaccagtggtattcgcggaacgcccggcgccgccccgtactccgcgagcaagcacgccgtcgtggggttggcgcgcaccctcgccaacgagctgggaccgcaaggcatccgcgtcaacaccgttcaccccggagcggtggcgaccgcgatggtgctcaacgaggccaccttccggcggctgcggcccgacctggacaacgcgacggcagacgacgccgccgaggcgctcagcgcccggcacctgctgccggttccgtgggtggagccggtcgacgtgagcaatgccgtggtgtttctggcctccgaccaggcgcgctacatcaccggcacccagatcgtggtcgacgccggattgctggccagggcttaggaacccaagccttgcaacgacgacacatgccgcggcgcccaatttcgtccgctcatcgggatttcctttgggacgggccacgactgcggtagaccattactaagcacccacaggtaaggacaaacaacatgagtgagcgggtaatcgaccgggtcatggccatggccgaccagctgcgcgaccaggccgccgaagccgagcaactcggccggctcaccgacgacaccgtcaagctgatgaagggcgccggcctgatccggctgctgcaaaccaagcagtaccagggtttcgaggtccacccccgcgagttcgccgagaccgtgatggccaccgcggcgctggacccggccgccggctggatcgtcggcgtggtgggtgtgcacccctaccagttggcctacgcggacccgaaggtcgcggccgaagtctgggccgacgacgtcgacacctggatggcctcgccgtacgcgccgcagggcgtggccaagccggtcgacggcgggtacatcttcaacggccgctggcagttcagctcgggcaccgaccactgcgactggatcatcctgggcgccatgctcggtgacgagcagggtgtgccgttgatgccgccgcagatgctgcacatgatcctgccccgcaaggactacgagatcgtcgaggactcgtggaatgtggtggggctgcgcggaaccggctccaaggacgtcatcgtcaaggatgcgttcgtgcccagctaccggaccatggacgcgaccaaggtgatggacggcaccgcccagcgcgaagccggcatgaccgagccgctgtatctgatgccgtggtcgacgatgttcccgctgggcatctcggcagccaccatcggcatcgccgagggcgcgctggccgcacacctggactaccagcgctcccgggtgggcgccaccggaacggcgatcaaggacgacccctacgtcatgtacgccatcggcgaggccgcggccgacatcaacgccgcccgccaggaactgctggccaacgccgaccggatctacgacatcgtcgcctccggcaaggaggtgtccttcgccgaccgcgcggccggccggcgcacccaggtccgcgcggtgtggcgggcggtgtcggcggtcgacgagatattcgcccgctccggcggcaacgcggcgcgaatggacaagccgctgcaacggtattggcgcgacgtgcacgtcggccagatgcacgccatccacgtccccgggaccacctatcacgcgtcggcactgagttcgatcggcatcgacccgcccgaaggcccgctgcgagcattgatctgaagggttttccatgtctgacctgaaaagccttggctacatcacagtttcgacggccgacatcgagcgctggcgccatttcgcgttcggtgtgctggggttcgcggagggtaagggacccgacgagtcggccctgtacctgcggatggacgaacgcgcggcccggatcatcgtcgtgcccggcgacgttgaccgggtggtcacggtcggctgggaggtgcgtgaccaccaggcactgcagcgggtcaaggccacgctggagggcgccggggtggccttcaaggaattgtcgctccaagaggccgacgcccgccgcgtcgaagaggtgatcaccttcgaggatccggccggcacgacgctggaggtgttccacggcgcggtgctcgaccacagcccggtcatcaccccgttcggcgcgaagttcgtgacgggcgaccagggtctgggccacgtggtggtacccgccaccgacccgaacggtctgttcgacttctacaccgaggtactgggattccggtctcgtggcgcgttccgggtgccgctgcccgcggagttcggcccgatccgggtgcggttcctgggcatcaacgcacgccaccacagcctggcgatctgcccggccgcccaacagcgcgacccggggctggtccacgtcatggtggaggtggacagcctcgacgccgtcgggcaggcgctggaccgggtcaatgccgacggcttcaccgtcgcgtccaccctgggccggcacaccaacgacaagatggtgtccttctacgtccgcgcgcgcccggcgactgggacatcgaattcggcaccgacgggatgcgggtcgacgaaacctattacaccgcagaggaaatcaccgccgacagctactggggccacgagtggattccggaaccacccgcggcgatgcgcatgtgaataccgacgtcacaccgatacccgcgtcgtcgatcacctcctgggaccacgaggccgacgtcgtcatcgccggctacggcgtggccggtgcggccgcggcggtggaagcggcccgcgccggggccgacgtcctggtgctggagcgcaccggatcctggggcggcgcggcggcgatggccggcggattcatctacctgggcggcggcacgcccatccagaaggcttgtggtttcaccgattccgtcgacaacatggcggcgttcctcaacgttgcgatgggcccgggtgccgacgccgaccggatcgccgactactgcgcgggcagcctcgcccacttcgagtggctggtcggctgcggagtgccgttcaaggcggagttcttcggcgagcccggctgggagccgatgggcgatcaggggttgatgtacagcggcggggagaactcgtatccgttcaacaccatcgcctcccccgctccgcgcgggcacgtcccgcagatgcagaacaagaagcagggcgaagccagcgccggctacatgctgatgaagccgctcgtcgagaccgccaccgccgccggcgcccgcgcgctctacgacgtgcgggtgcagcggctgatcaccgagtccgacggccgggtcgtcggcatgcgcgcgcgaaagtacggcaccgagatgaacatccgggcgcgtaccggcgtggtgctggcgaccggcagcttcgcctacaacgactccatggtggcccgctacgcgccgcgcatcgccggacgcccggccgcctcgatcgagcagcacgacgggcaggcgatccggatggcccaggcgctgggcgccgacctcgcgcacatggacgccaccgaggtggcgatcttcatcgatccccagcagttggtgcgcggcatcctggtcaacggccgcggccagcgctacgtcgccgaggacacctatccgggccggatcgggcaactcaccctctaccagcaggacaacaccgcctacctgatcatcgacggcgacgcccaggacgaggcgatggcctcgtggtcgcccaagctgatgctgcgcccggcgacctgggtggccgacacggtggccgacctggaacgcgacatggccctgccgcccggttcgctgcaggacaccgtggccgcctacaacgcgggcgccacccgcggcgaggatccgctgctgcacaagaagcccgagtggatcaggccgatcggctcccccgtcggcgcggtcgacctgcgggaaagcaccggcggcttcaccctgggcgggctggccaccacgctggacgccgaggtgctgcacgtcagcgggcagcccatcccgggcctcttcgcggccggccggtgcaccgccgggctggccgcctggggctacgccagcggcatctcgctcggcgacggcagcttctacggccgccgcgccggcgcctcggccgccggtcgtcgcttgccgcgcgtgtaacgccacggcggagaaatcaccccgaaacccgccgtggcgttacacgcgcgagtgtcgccccggggcgtgtcctgtgtgacaacgaccacagcggtgtggtaggaagatattcctaataggaatatgccatccaggaggacatatgcccgcgcccgccgaaacccccaccgcggtcatcgaccgcatctcgctggtgctggacgcattcgacgggccgggacgcctgacgctggcccagatcgtgcgccgcaccggcctgccgcgctcgtcggcgcaccggatgctggagcggttggtccagttgcgctggctgcgacgcagcggccgtgactacgaactcggcatgcgcctcgtcgagctgggctcgctcgccgtgcaccaggatcgtctggtgcgcgcagccacccccttgttggtcgaattgcaccgtgccaccgggcttgtcgtgcacctggcggtgctggacggccccgacgtcgtttatctggagaaggtcggtgaccggctgaacagtgtgatcccgagccgggtcgggggccgtcagccggcgcactgtacggccgtcggcaaggcgatcctggcttaccgcgacgaggcgaccgacctcgacctgggggctcgcccgaccaaatactcgatttccagcgccccgcaactggcggccgaactcgccaaggtcagggcgcacggcgtcgctttcgaacgcgaagaatccttgctcgagtttggctgtgtcgcagctccaatcggcggtcccggcgaagctgccgcagccgtgtcggtgtgcggtccgctgcagcgcatggcgctcgaccagcggctggcagcgccggtacggatgaccgcgatgggcgtgtggcgcaacgtggagggaggcccgcaacgggtcgcgccgaccctgcagcgcctgcggccgttgccgccgatgcggccgcagcatccggtgcccaagccgcgccccgccctgcagtacgcgtgagtctcgagccgcagatcgcggcgatcatcgagcaattggacagcgggtttccacccgtccagcagatgagcggcgccgaggcccgagcgctgatccggtccaggctggtgccgccggcccagcccgagcccgtcgccgaggtggccgatcggttggtcgagggtccgggcggccccctccgcatacgcgtataccgacccgaagcggcggccccgctccccgtcgtcgtgtacgcccacggcggtggcttcgtgttctgcgaccttgacagtcacgacggcctgtgccgcaatcttgccaatcttgttcccgccgttgtcgtttcggtcgactaccggttggccccggagaacgcgtggccggcggctgccgaagacgtgtacgcggtgacgtgctgggcccgcgaccacgccgacgcgctcggggccgaccccgcacgactggtcgtgggcggcgacagcgcgggcggcaacctggccgcggtgaccacggtcatgtgtcgcgaccgcggcggcccggcgccagcggcccaactgctgatctatccggtgatcgcggccgatttcgacaccgagtcgtaccgcctcttcggccagggctactacaacccggcgccggcgctgcggtggtactgggattgctacgtgccctcgacccgagaccgcgcgcacccctacgccacaccgctgaacgccgacctacgcggactcccgcccgcggtcgtggtggtcgccggccacgatccgctgcgcgacgaaggattggccttcggcgccgcgctcgaagcggccggcgtgccgaccgtgcaattgcgttatgagggtggcatccacgggttcatgacgatgccgatgctcgacatcgcgcaccgggcgcgcaacgaggcggcggccgccctagccgatctgctgcagtggtaacgcgacggcttcgacggttgaccggaggttcccggtggtcgggagccggccccgctgcgtcccccgggtgtcatacggtcggctcatggccgacggtgcagtcttcgtcatcgaccgggtggtgacccggcccggatgcgcccggcgattcgtcgatacctatctggccgagtacgcccccggcgcgcgcgaacgcggcatgacgctgcgcgacgtcctggtgagcccacccatctggttcgacgcatccgagggccaggtgaacaccgtcaccatcacctggacactgcccaacgggtgggagatgacgtggcaaggccggcccgatccggccgtgggcgaatggtggtcgcggatcggggaattggtggccgagcggtcccggtccttcgccgcgcgcgccgcggacgtcgacgtactctgcgatgtatagcgtcacccggctgatcgatgtcggcgagcaggaccgcgaccggatggctgccgcactgcgtcgggcggcatccgacgccggcgcgctgcactgggtggtggggccgacactgcccggctcccgcaatgggggcgacctcctggtgcacgttcgcttcgcctccaaacgccaatgggattgcacggccccatgtttcgcggccatcctgggcgaccccgccgtcggccgggtgaacggtgcgacctactccggaacgcccgtgcacgccggccaaaaacccggcgccgtgtaccggacgctgctgttggcggtgtcgcccgacaccgccgaggacaccgtcgcccggttcgaggcagacctgcggctgatgccgcgatacgtgcgcaccatcaccggctggcagctgagccgggtggaggaggcgaccggagcttcggcgtggacccatgtgttcgaacagctcttcaccaacgtggacgggttgatgggcccctacctgatgcacccgatccattgggcggtggtggaccgttggttcgacccggagtgtcccgacgtcatcgtgcgcgaccgcgtctgccacagcttctgcatcagcaccgatccggttctgacctagacccccgcgggaagaatgttcggattggcatttgccgggggacgcaacggcggcaacaggttcgcgccgtccaggctgtgcacgggtagctgctgtgaccacggataatgcaggctgaacgcgaccagccctgttcgctccgcggcgggcagatggcacatcgccagcacggtctcggccagatactccaccggttcggtagggaaagactccgggatcagttgcgcggcaccgggtgtccggaccgccgtcgacgggccgacgcagttcacggcgatgctggcgtcgagcaactcggcggccactccctgggtgaaccggtgcagggcggctttcatggccgcgtagaccacgtcgccggaggccttgttgtactcccggtacggcctgaccggggccacgcccgtgaccgatccgatgttgacgatccaccccgccccttgcttgcgcatatgcggcacagcgcatttcgtcaggacgaacgggacgcgaaggtagtgctccacggtgcgatcgaacgtttccaaactcatgtcttcgaccaacgagtagtcggcgaaaccggcgttgttgaccagaatgtcgatgcggcccgtgcggtcgaggaccgcatcgaccaaaccgtcccgctggtcggcgtcttcgaggtcggccgcgatcccgaacgccgaaccaccggcggcttcaatcagttcgatcgtttcgccgatggtgccgggcagcgcggtggccgtaccggcccgcgtcgatagggacgacgagtgcgagcgtgcggtcaccgcgaccgtggcccccgcggcggccaggcgctgcgcgaccgcgcgacctatgccgcggctgctaccggtgaccaacgccgttttgccggacagtaagcggctcatcgcaactcgagatcttcctcgctcggcgcacgatggtcgcgccagaaatcgacgaggcgataggggaacgcggtcacgatccggcctccgcccgagcggtaataggtgtgcgccgagggcgtgtggcaccacacggtgcccgccatgagggcatcgatgtccgcgacgtattcctcgtaggcgcgctgcgtcacctcgacggtggtggcccggcgcagcgccatcaactgcaggcattccatcacgtagtgcaccatcacctcgaccccgaagttgtgcccggccccgtgacccgggctgtagttgggggccgaggagatgaacatgttcgggaacccgggcaccattccgccccggtaggcccgcggggcgtcgccccactcgtcggtcagcttcttgccgtcgcggccccggatgtccacggtggaaaggaaatccagataataaccggtcgcgtagatgatgacgtcgaggtcgatttggcggccgtcggccgtgacgattccggcctggttgacgcgggccggttcgctggcctcgacgtccacgtgctcgcgggccagcgccgcgtaatagccgcccggatcgcggatgatccgtttgccgtagggcgcaaagtcgggggtgaccttgcgggccagctcgctgcccgcgccgaacacgcgatcgatgtaatccagacacatgcgcagcaacacgtcgttggccggcgaaaccgacaggtgctcggccgcccattgcgggtcatgcaggatcaccggatagttgttgtccgccgtcccccaatatgacttgatccgaatccagttggcgtagtagggaagtcgggtgcccaaccagcgctgataggtggagacgtcgtcggatgcccgtcggcgtggtgcgacccagtgcggttggcgttggaagaccgtcaggtgcgcgacctggtccacgcaggcgtcgacgatctggaccgcggtgcacccggctccgatgatcgcgaccctcttaccggtgagatccagctcggggtcccagtgcgcggaatggatcgaaatccccgagaacgtctcgcggccggccagttccggccaccgcggccgattcaggtagccggcggccggaatcaccacgttcgcgtaactgacgtcgcgggttccgtccgggccgaccgaatggatctgccactgccgacgccgctcctgccaccacaacgcttccacctcggtgccgaaccgggtgtgcttgcgcaggtcgtttttgtccgccaccgataccagataggcctgatattccgcaccctgcgggtagtagctcgaccagtcaccgttgatgtcgcgggacagcgagtaatacgccgagggggtgtccaccccgatgccgggatacctggtggtgtaccaggttccgcccacctcgtcgttgcgctcgatgatctgatactcgatgccggcgtccgcgcaggcgagcgcggcggtgatgccggcgatcccggcgccgatgatgaccacccggaatcccgcgggaagctttgcggtgcgcggaagtaccggttgggagggctggaaaccgccctgctcgacgagcagtccgagatactcggggccgacttctccgcccagcgcgacgggcgccacacgagcgaagaggtcgaggtcgtcggcgggtaccgcgtccgctcgccgcggcgtcctcaacgccgtgacgatctcgtcgacgagctgggcggccgtctccgggtcggtgacgcccgcctgctccggcgggtcgggcacatgggtgattttcggtgcgaaccgatcaacgacggccgggtccccggtcagctgggcgagcacggcgacgagcaccccgggatccgcctgccgcaggttggcccgcagttcgccgacgtcgtaggggtccggacccgccgctcccgcgctttcagtcgtgacggccatgccagtgctcatgcctacgagtatcgaagcggtccgccgccttcagcaggcccgtgcctactcagcgggacgcggccgacccacgcgcgcacgggcagctaccgtaatccagaaaaatagtctcgccgcgcaggctgatcaccaactgagccccgacggtgttccactgaccgggcatccgaggtgctagcaactgcacgctcggagttgactgacgggatgagcgacgacatcacgctgcccgaattacaggaattcatcggggccttctggtaccactacgatgaggcgcactacgacgagctggcggccagctacgccgaggatgtgcactacctgacccgaagcgattccggtgcaagccctttcgaggagctcatgtcaccgaaactcagcggtcgcgacgcggtgatggaatggctgtcggagcaccgcaagcagagcccgtacccattgcggcatcacgccaccaacgtgcaccgcatcgggtcggacggcgacatcacccgggcgcggttctacctctttgtcaaccacatcgccaacttcgtgccgttcgcggtgtccagcgccgtcgtcaacgtcggcgttcggcgcggtgcccacggactggagttcagcgagatggacgtaactctcgacaccaccaactcggtgctcctctccgaactgcacgccgaaagcggtgtgggctcataacgatggacgctcgcagcaccttcgcgggtggagtcgcggtgatcaccggcgccgggtccggcctcggcgccggcctggcccgctacgcctgtgggttgggcatgacggtcgtgctggccgacatcgacggcgacgccgtcgcggcgttgcgcgacgagttggccgcgggaggcggcgcggcgcacgacgccgcctgcgacgtccgcgatcccgccgccgtgcaggacctcgccgaccgcgcctatgacatcgggccggtgcggctgctggtgaacaatgcgggcatcgaacagttcggctatttgtgggacacaccggtggtcaactggcagcacgtcatggacgtcaacgtcagcggcgtgttctacggcgtacgcgcgtttctgccgaagatgatggccgccggacagcaggcgtgggtgtggaacatcgcatcggtgggtgcggtggtggcgatgccgttgcaggcgccctacatcgtgagcaagcacgcggtgctggcgctgaccgaatgcctgcacctcgaggtgcaggccaccgggcacgacgatcacgttcacgtccaggccgtgctgccggggccggtgcgctccaacatcttcgagtcggcgggcggcgtcgaccccgatgcagccagcgatgcggccgcggccgaagcccaccgctcggccatgctcggcatcaaggccgcgtccatggatgcgctggaagccgccgagatgatcttcaggcaatcgaccgagggccacttctacctgcacactcatccggacagcgtcggcgcagcgatgcgcgaacgggccaaagtgcttgccgcgcaacaggccccaccactacggaccgagacacggttcgactccgcgccacactgacaagacatgacttctcccccactggatcccgacgcggccgcccgcatcgcctcgttcggcgagaccgctccgatgcggcaacggggtctgcccgcggtgcgcgccgggctggagtccgcaccgcggccggcgaccatgcccgagatggccagcgtcaccgaggcgctcgtgcccagcgccgccggcggcatccccgtcaggatctaccggcccacaacggattccggtgtggcggtgctggtgtatctgcacggcggcggactggtgatgggatccaaccgctcattcgaaccactggcccgcgagctcgcctccgcgtcagcggccacggtcgtcgccgtggactaccggctggccccggagtcaccgccgcccgcccagttcgacgacgcctacgccgccaccgaatgggtatcgcggaaggccggggaattaggcgtcgatgccgatcggctcgcggtcatcggcgacagcgccggcggctcgctggccgcggccgtcgccctggccgcgcgcgatcgccgcggaccgccgatctgcgcgcaggtgctgctgtatcccgggttggaccgcgacatgtccgttgcctcgatcgcggcaatgcccgacgctccgctgctcattcgcgacgacatcgactacatgcacgcgctggtcgacggcgatgccggtcctcccaccgacccctatctggtcccggcgtatgcggccgacctgtcgggtctgccgccggcgatcgtggtcaccgcgggctgcgaccccatccgggactggggcgagcgctacgcggaccgcctgcgtgacgccggcgtccagaccaccgtcacccgatatcccggcatgtaccacggcttcctgatgcgctccgatgccaccgcacgcggccggctggccatcgcggagatcggtgggttgctgcgggccaagttctcccatccgcttcgttttgacgtcccgatcaccggacggcattccaccgcaacgcgataacgctgcgcacaatcgaccgatcgtgaccgcaaaggaggcaggtgatgctcagcgacgagcgccgaatggagctctccgacgtactgcggccggtcgcgccgccccgcgaaatcgacaatgtgtacaccgacgatgcgtgagcgcctattgaatgtggtgcacacgcacggtccgtggcggcttatcatcgcgcagcacttcgcgtcggccgacgaactgatggcgacgatgagcggtgcgtttcccgaggggttcacgccctcgctggacctgtttctcacgccgacattccgcggctacctcgccaactatggcaccgtgctgtacccggaactacacgactgcttctacaacgccgccttccttgaacatgccaagcgctactggaacgccgagtacgccaagccggagatgatgctgttcaacatcaatgggccttgcgccaaccgcgatcccggccatttggattcgccgagctttcgcggcgtgcgccacgagaacgcacccacctggctgtgcagcgtcatgggcaagtcggggttgttctccgactacttgatcaaaatggcccaggtgatcacgtggttctgcctggacaccggaagtggcttcacctactggcccgacggtccgttgaaagccccggcgcgagtgctgccgccgatcaacaaccgcggcgtggtggtgcaaaacgagatgatggttcaccgcggcgaagccaacgggccactggaacaacagattccgtccggtttggcgttcgacaccgtgttcgcgggtgacccgtccgatcgcgaccactggttgctcaagaacggcgaggacgtgatcgcccgccaccacactgacgagttgcgattcctggtccactggtcggccgaggttttctccgactatgacgagctcaagaaaaacatggaaggctccgacgacatcaccatcgaccgcgcgatcgacatgatgctggacgacctccatgccaagggcatcaaactcgacgccccgagcgagccactgcatgacccagaattcatcgctgccctcaacgccgcctatgacgtggggggtccgaccagctatcccgaccaggcgccgctgagcgcgtttcagccggcctgatcaccgagaggcattgcgtcatggaccgtttcgcaggccgccgcgcaatcgtgaccggggccggctccgggatcggtgcggccaccgcagcccgactgctcgacgaaggcgccaccgtcgtggcctacgacatctccgcggaggggttggcgcgcacgagggccgccgccgacgacgccggcaccggcaaacgcctgaccaccgccgtcctggatatctcggtcgaaggggatgtcattgccgccgtcgatggcgcggtagccgacctcggcggccttgaggtgctggtgaatgttgcggccatacagacgtgttcgcacactcaccaaaccacgctggccgactggaacaggacgttggccgtcaatctgaccggcaccttcctgatgacccgccaggcgctgccggcgctgctggactccgggcgcggtgtggtggtgaacttcacctccaccgccgcgtcgttcgcacatccctacatggccgcgtatgccgccagcaagggcggcatcttgagcttcacccattcgctggcgctggagtacgcgaagcaagggctgcgcgcggtcaacatccaacccggcggagtctcgacggcactggccaacagcacgttggacaaaatgcccgacgggtatgacgtcggcctgtgggccaagcaaaccccgctcctgcacggcaaagacagtgaaatactgggcgacccgagcgcggtcgcctcggtgatcgcgatggtggcctccgacgacggcgcgttcatcaccgggacggagattcgcgtcgacggcggcgcacacgcctgacacgactgccgaccgacggatcgtggtgcctgaccgagcgggccatgggcgaccgcgcgtacgtcggagcgctcggcgtctttgagggttgaccggcgctagcgcactagcgcaccacgacgctgctcggcgtccggggcgagccgagcatgtcccgatgggacggtgggcggcggccgccctcgtcggtgatgccgtagcgctgcgcgagttccgccccgatcagcgtctgcccgctgagctccgccagacccgggtcgtcgaacagcgcatcgatcacatagcctgtgaattccggggtttcggcatgctcggcggtcgcggccagcgcggccggatccgcaccgaaagcggcgcgcagcttttcggtcagcaggatgcccatccatatcgacaccgtcgcaactccggtgccccggaaatccaccgccatgtccgcggccatcttgtcgactccggccttctgcgcgccgtacgcgggaccgtgcatgtagcacaccgaccccggcgacgacgtgaacgcaatcagcccgcgtccgcccgcaaccaacagcggcgcggcgtaccaggacgccacataagacgaccgcaatcccacatcgagcacatcggccaagtcgagtggcttctcccagaagggctttgagctgaccaaattgtcggagatcgtcgcggcgttgttgaccagaaggtccagccgcccgctctcccgccgcacacggtcgaacaggtccgacacggccgcgtcgtcgcggtgatcgacgcggacgggcaccacaccggacggggtgtcgccgatggtgcggctcgtcgcgtacacccgccagccgcgatctgccagcgcggccgagatgccgcgtcccgcgccgcggctcgcgccggtcaccacggccacccgcctcacaccactcatgcggtcagactacgtcagccgagggggtcgacgatcgccaattctcctctggcgacggcggcctggatcgactcccgcagcgcggtacatcccaggaacggcccccggtgatggccggccaggcgttcggcgtcgcggcgctcgatgcagcgagccgaagcgtcggcatcccattgcacgctggtttggttccagctgcttttgcgggccatgacccgtgctccgcagtcttggcacatcaccggcgccatgggcatgtcgacgagccgaacatcctcgcacacaggcattttcagcatcgtcaggccctggccgccaagttggcctcgacctctttcatccatgcggcgtagggtcgggtggtgtccagctcgaattcgaagcggtccaccatgtcgggttgcacgtcggcgacgtcgacgtagaactgctgataccagcggcgcagctgatacaccggcccgtcttcctcgaccagcagcgggttgtcgatgcgcgccttgtgccgccagatctcgacgtcctgctcgaagccgagcttgacgaagtcgccgagcgcgatcgcggtctgcatggccaggtcgtcgggcagcgcatccgatttcttgacgatgatgccgtattgcagcacaaaagaattcgcgtcgatcgggtagtgacaattgatcagcaccgtttggtggtcggcgtcctcgtagtgataggtcaggtcgtcgatcatgaacgacggtccccaataggaggccaccgaagtggtgccgagcatcctcgcgccctcaccgccgatatcggggcgcccggcgctgttcatgtattgggtggccacgtggccttcgaagatgttcttgaactgcttgggaagcgacccgtggatgtagaagaagtgcgccatgtccacgacgttgtcgatgatctcgcggcaattgctttgcacgacagtgctataccaatgccagtcggtccattcgtcgctgccggcaccctcgatgcgcgggatcgttacctccggcggcggcggattgccctccgggtcgttccacacgaacaacatgccgtcctgctgcagggtggtccaggcccgggtgcgggccagccggggcgtgcgccggctgtagggcacctgcttgcaccggccgtcgccgccccagcgccaatcgtggaaggggcaggcgatctcgttgcccttcacctcacccctggacaggtcgccgcccatgtgccggcaatagccgtcgagcacgttgatggcgccgtcgccgccgcggaagacgaccagtttctgcccgaaggcgtcgatcgggtgcggcttgccgtcaccgaaatcccggatcaggcccaggcaatgccagccgcgggcaaaccgggtcgggacggcctgggcctcgatgagccggatttcgtcggtgtcatgcatgcgcacgattcaacgcagccggacccgcccgtgggggtgtctgttccactcatcaggacggctattccggtatcacggtggcgcgacataccgttttcgctgtgacgacgcacagcgcgacgattcctgccggacttcccgtggccgacaccgccgtcgacctgctcgtcgtcggctccggcaccggcatggccgcggcgctggccgcccgcgaactggggttgtcggtgctgatcgtggagaaatcgtcgtacgtgggcggctccaccgcccgctccggcggcgcgctgtggctgccggccagcccggtgctggacgaggcgaacgccggcgacaccgcggaacgcgccggcacctacctggattcggtggtcgcgggttcggcgcccccgcagcggtcggcggcgttcgtcgcgcaggtgtccgcgacggtggagatgctgcgccggaccacgccgctgcggctgttctgggcccgcgattactccgactatcacccggaggagccgggcggcagcgcggccgggcgcacctgtgaatgccgccccttcgacacctcgctgctcggcgagtaccgcacccggttggagcccggcctgatggaggtgacggttccgatgccgacgacgggtgccgattaccggtggatgaacctggtggcccggttgccgcgcaagggaattcccgtctacgccaagcgcctggcgcagggcgtgggcggacgcatgctgggccggcgctacgcggcgggcggtcagggtttgatggccgggctgttcaccggagtgctgcgcgccggcatcccgatctggaccggcaccaccctgacgcgcctgacgcgccggggtgagcgggtgagcggggccgtcgtcgagcacggcgggcgcgaggtgacgatcagcgcgcgccgcggcgtagtgctggccaccggcggcttcgaccatcggatggagatgcggtggaagtttcagtcggaatcgttgggcgcggacctgagtctgggcgccgccgccaacaccggcgacgggatccgcgccggccaggagattggcgccgcgatcgacctgatggatcaggcgtggtggttccccgcggtggcgccgctgcccggtaaggcgcccgcggtgatgctcgcggaacgctcgctgccgggctgcctgatcgtggaccagcacgggcgccggttcgtaaacgaggcaaccgattacatgtcgttcgggcagcggctgctcgagttggagcggtccggcagcccggtcgagtcgatgtggatcgtcttcgatcagcagtaccgcaacagttatgtctttggggccgaactgtttccgcggatgcgtatcccgcaggcgtggtatgacgccggcatcgccgtgcgggccgacaacctcgccgagctgggcgcgggcatcggcgtgccggtgccggagttcgtcgagacgatgacccggttcaaccaaaacgccgccgccggagaggatcccgacttcggccgcggccgcagcgcctacgaccgctactacggcgacccgacggtcaagccgaaccccaacctgcggccgttggtcaacggaccgttctacgcggtgcggatggtgctgtcggatctgggcacctgcggcgggctgaagaccgacgagcgcgcgcgggtgctgcgcgaggacggcgggccgatcgccgggctgtacgccatcggcaacaccgccgccaatgcgttcggcacgacgtatccgggcgccggggcgacgatcgcgcaggggctggtgtacggctacatcgccgcccaagaggcggcgcgcccgagcgccgctcaggaggcggcgcgcccgagcgcctcgcagcccgactaaccggcgtcgtcgctgtcctcgtcttcgtcctcgtcttccccgtcgtcgttctccccgcggaggagtttttcggggtggtggaaggtgttggtgcggggttggtttcggtccaggtggggtggtggaatccattcggtttcccctttggcgtttttgtgggtggtccaggcgccgggttgtagcaggcggtggtggggtccgcaggcgaaggtcagatcgttgatgtcggtggtgtggcaggtggcgtagtcggtgcagtgatgcacttcgctgtagtagccggggacggtgcagccgggggcggtgcagccgggggcggtgcagccgggtgcggtgcagccgcggtctttggcgtataacacgatgcgctgtgcgggtgaggccaggcgtttggtgtgatacaggagggccagggctttgccctggtcgaagatggccaggtagtggtgggcgtgccgggatagccggatcacatcggacatgggtagcagggtgccgccgccggtcagacgccgtccggcggcggtttcgaggtcggccagggtggtggtgacgatgatggaggccgggagcccgttgtgttggccgaggtttcctgaggccagcagggcgcgcagcccggccagcagcccatcgtgattgcgctgggccgccgagcgggcatcaccgtcgatggcgtgttgactcggagtgccttccacgcacggactctcatcgagtgagttgcacatgccgggggcggcgagtttggccagcaccgcttccagggtggcgcgcagctcgggggatagccagccgcggagttcggacatgccgtcggcctgttggttgcccagggtgaggctgcggcggcgggcgcggtcctcgtcgcggtagaggccgtcggggttgaggcaatcggccagcgtgcccgccaacgcggcgagctgttcgggacgatactgcccaccctggttggcgaggtcggtttcggcgcgctcccgcgtcgcctggtcgatccagcccggcaactggtggcagaacttacggatcaccgccacctgctcgagacccaacaacccggcccgttgcgcggccgcagtggcggccagcagcggaggcaacggttcgccggtcagcccgacgcgggggcccaaatcagcggcggtgtgcacccgccgggcggcctcggcgcggctgatcagcgtcgcctcggcgatcgcatgcgaaagccggccacccaactccgccgggctggcgtcgcgggccagcgcgttgatcagcggatgctcgaccgccggcagccgccggcgcagccgttcgcagcgggtcagcaacgccaacttctcacgcgtggccaacgcgacgtagtcgcagtcgagcagatcgtccaaggcagcatcgatgacgtcgaacgccgccgacaccgccccccgatcactactcatacctcgcaaactatccgggggcaccgacaaaaaacccggcaatgtgaccacagaaaccaaagtgacacaagggatttcgctatgcgtttttgatatccggaaaggcgagtattactccgcctcgcgcttcgcctggacctgcttctcgacctcacgccagtaacccggcgtgggccggggcttaccgtacccaccctttgcggtgcgctgcaggatggcgtcgacctcgtcgatctccttgatcatctccagcgcgaactcccgctcggcggcgtaatactttgccgcccagcgcaatgcgagcactgaatacgcccacgcgggctccgcctcggctccctcggcgtcctccatggccttgcggtgccgggcctcggcgtaggccacgtgctcctgcagcaattccttgagccgaccgggattactcaggtgcccgaacgtaacccgaagcagcacactgtgtttgagcaccggcgggtcgacgggtgcatggttggtccactgcgtgacagcgtccatgccggccggggtgatcttgtagagccggcggctgcgggtgccctcgtcgcgttcgacgcgcgacgtcaccagcccgagcgcctccagcttcttcagctcggtgtagatctggctgtaggacgggctccagtagtacaggtcgacactccagtcgatccacttcttgaggtcgtagcccgagacctcctcctcgtaggacatcatgcccagcagcgcccagctggtggcggccagcgccggcttctggctggcagggtccgtttcggaggccatgtcgccaggttaacaacaccgcccctagattgggggtcatggaccgctggctgggacgcccgtgaaattcgcctttcccgttccgcacctgatgcgcctcaaggcgattgcgcagccctgggaagcggccgtcaccgggcccgaacagcggcgcatgatgcaatgcgccgaccggtggggctacgacatgatcgcggtgcccgaacacctcgtcatccccgtcgaccaggtcgagctgtccgggtcgcattatctgcactcgaccaccgcgcaggcgttcatcgccggggccaccgagcgggtggccatcaactcctgcgtcaccatcctgccgctgcagcatcccatcgtgctggccaaagcgctggccaccgcggactggatgagcggcggccggatgatggtcaccttcggcgtgggatggctggcccgcgaattcgagctgctcgacgtgccgttcggggaacgcggccgcatcgccgacgaatatctggccgccatcgtcgagctgtggaccaccgacacaccccgcttcgacggccgctacgtgtcgttcgccgacatcgccttcgaaccgaaacccgttcaaaaaccccaccttccggtctggatcggcggtgacgccgacgccgcgctgcgccgggcggccaggttcggctccgggtggtggccgtttctgacaccacccgagcagatcgcggaaaaactcgactacatcaagtcccaaccctgttacgacgggcggcctttcgaggtgatgcacgggctgggcaccaaccgggtcggcgagggacacgtcgcccgccgcgacgtgagggaccggccgggcatgagcgcgggccagatcgtcgaccggctgggctggctggccgagcagggcgtgacggtgaccgcggtgcccgtgcccgccgtcggcggcgcggacgaatacctcgattacgcgcagtgggtcatcgaagagatcaagccccagctggcgtaggtcagcggatctgcagtccgcgccggcgcacccaggacacggccgcgaggctgccggcgatccagacgctgacggcgatggccaaatggaccacgctcttggtgtcgcgcccgaacaccggccagatcagcgcgggcagctgttgccacaacacccggtgctccacaccgttcatcgggtcggccacgtaatacagcgcatacggcagcgccagggccagcagccagctgcgggtacggcgcagatcggcgcgctggcgccagcgccggatcagcggctcgacgctgaccgggtgcagcaccgagatcaggttgcccacgcccagccaggacaggatcggcaccgcgacggtgggcaccgtaatggcaagccgcgcaggcgtttccagccacagcgtcaacgccatcgcggccgccagggtgggcagcccgacgatcgtgagcagggccaggttcttgaccagcaggatgcgcccgaacggcaccccgtcggccaacccgcgcaggatgcggtagtgatcggcgcccaggaagttggtggtggtggtgacatcggcgagcacccacgacgagaagtaggtgcccaccaggatcacccagtcgtgatggcggcccagagtcagcggctgcaccagcagccaggcggcggcggcgatcacgttggccaccacacccatcagccaggtgcgcggcggggtgaacgcccagcggatctcggcgcggaccgcgggaaggagatccttctcgaagtccttggcggcgcgccgcgccgcggcgggacggggagccgaggcgcgcaccgcggcgcgcagcagggcgcccacccggggaggtgccggcgccgcggccggcggacgaacggatcggcgcgaaacgatcaactggcgtgactccccccctcctcggatcggtcaacgacggccagctacgcagggcaggataaccgcatgaaccgcaagcgtgtcgtcgtcgccggcctcggggacgtcggcgtcctggcggcgatccggttgtcccggaacgccgacgtcgtcgggatctccgccaaacccgccctggtgagcggccaggaactcggggtccggctgtcccgcccgcacgactgggcccgcgattactggattccgttcgaccggttccggcgcctggacggcgtccgcacggtgcaggcgacgctcaccggggtggacctggccgcccgcaccgtattcgggcgcggcgacgacggcgcacccgtcgccgagccgtacgacgcgctggtcatctgcaccggggtcagcaacggcttctggcgacgccccaccctgcagtcggccgccgagatcggcgcggacctgcgcgatgcgcacgagcggctggccgccgccgggtcggtgatcgtggtgggcggcggcgcggccgcggtcagcagcgccctgaacatggcgaggacctggccggacaagcggatcgacctgtacttcccgggcgagaccgccctgcgcgggcatcatccccgcgcctggcggcggctgcatgcccggctgacccggctgggggtcggcgtccacccggggcatcgcgccgtgctacccgacggcttcgccggcgacgagctcaccagccggcccgtgcagtggagcaccgggcaaccgccggccgcggccgacgccgtgctgtgggcgatcgggagggtgcggcccaataccgggtggctgcccgccgagctgctcgacgagcgcggcttcgtccgggtcaccccgcagttgcgggtgcccggccatcccggcgtgttcgcggtcggcgacgtcgcggccaccgatccgctgcgcagctcggcgcgcaaccgcggcgacgcgctggtggcgcgcaacgtcgtcgccgagttcaccggccggccgctgcgcggcttccgggcgccgaggcggcgctggggttcgctggtggggatccagcccgacgggctggaagtcttcttgcccagcggtcataccgtgcgcttcccctcctggtcggtgcaacgcgtggtaatgcccctgatcgtgcggtggggcatgtacggcggggtgcgccgcaacgacccgctggggcgggaaacggccactcccccaacgctatgacgttggtacacaaagagtttcgccgatcagacgccgttgagcagcagcatcagcccgtaatccatgtggatctgttgatggcagtgcagcagcgacaggcccggttgatcggccacgaagtcgatctccatgctctggtagccgccgagcatcgcgacgtccttgcgcacgcccgcggtgggcgtcccggcgaaccgggtgatttcgaaggtgtgccgatgcaggtgcatcgggtgcaggtcgtcgctggcgttgcgcaaccgcagccggtaacgcctgccgcgttcgacgtccagcacgggttggttgctgtccatcgcgaacggtgtgccgttgaccgtccagacgttgaaaccgttgtcggcggcgttgcgcttttcgatcagcaggtcgatggtgtgatcgtgcggcgcgaccggcgccgggtgcgggccggcgaacagccggtaatcccaggtgaacggcggcgggggcacccattgcggttccccggcgcggccggcgtattcaacgaccacgcccagcccgtgctcgcggtcgtcgtcggacaggtcgcccagcacccacacgcccgggttggtcatgctgaccagcgccgagacgcgttcccccgcgccgagccacagcaccggcaccggcgcccggttgggcaccgggttgccgtccagcgcgacgacggtgaaggcgtgaccgggcagggccaaactgcgggtttcggtggcgctggcgttgaggacgtgcagcagcaccagctggccggtgcgcacccggatgggatcgccgtggcccagcatgcgtccattgatcgcgaaggcccggtagccgacctcgtagccgggttgctcgccgcggccgcgcgaggccgccatcgacgactcgccccgctccctcagatccggctcctgcgcgccggcgaggaagtcgacggccatgtcgccgccccggctcaacgacggctcgaattccttgagcgtcaagaagatttcgtggtcgaaggcaccggcgtcatcgtccttggacgcgatgtgcaccggcccgaccaatccgctgtactggccgcgggacagatcggcgcgcggcaccacatgggtgtgatagaagcggaagccggccgggccgggaacgaacgaaatcctgcgcatgccgtgcgcgggcacgtacggcgtgccctcctcggcggcgccgtccacgtcggcaccgatgtgctggccgtgccaatgcagttgctcgggggcgtcggtgtcgttgtacacgtccacccaggtgcgccggccctgcatgaagcgcagcagcgggccgggaaactggccgttgtaggtgagggtggacaccacccgcccgggcgccaattcgactgtccccgtggcaatccggagcgtgtaatcggccttaccgtgcggcggcccggcgcatgcggccagcgccgcgatgccaccccacttgcagaagtcgcgccgggtgaccgccaccatcaccgcccggggccgccgccggccagcggcaacacgtggctcgattcgcttggggcagcacgaaattgccgggcgacgccgcccagtgcggcggatggcagcggcgcaacggcggctcggctggctgtcgccatgctgtcaaacgatacgtcacacgggccggccgcggcgcggtgcgactgccgggcgctgcggatggttccgcgacgggccgacggggaagactgagcaaatggccgatccccgaaccgacccgttcgaaaagctggtggcgctgctgaactacccgatgttcgtcgtcaccacccagtccgacggcaccccggccggctgcctggtggggttcgccagccaggccagcatccacccgccccggttcctggtcggcctgtcgcggcgcaaccacaccttccgcaccgcgcgcgacgccacccacctggccgtgcacgtgttcgaccacgaccacctggacgtggcggagctgttcggcagccagaccagcgacaaggtccacaagttcgaccgctgttcctggcatcccggcccgcaccggctgcccatcctcgacgacgccgccgcatggttcgccggcgagatcctggatcgtttctcgctgggcgatcacgtcgggcacctgctcgcccccgtcgacgggagcccgccgcggcagctggaaagctgggtgtccttcggcgacctgcgccacctggaaccgggacacgaggcgtaagggtgaactcgccgccccggatcagcgccgtgcccggcatcatcgagctcgcgcccttctatgccgatcccccggatggggtgcgcgccaacatgatcttcagcgccgacggcgccgccgcgttcggcggccgcgccggcccgctgtcctgccgcaccgatcaacggctgctgcgcatcctgcgcgggctggccgacgtcgtgctggtcggcgccggcaccgcccgggccgagaactacggcccggtgcggctgaccgacgcggcgcgggcccgccggctgcacgaagggcgcgccgcgccgcccccgatcgccgtggtgagccgcagcggcgagctgcccgcccggctgttcagcgaccccgagcagccgcccatcctggtgacctgtgcacgcaccgcggcccggcccgacctcgacgcacagcacgtgctggtggccggcgaggagacggtggatgtggcccgcgccgtcgcgatgctgcgcgaggccggcatgcatcgcatcctgtgcgagggtggccccaccctgctcgacgagctggtggaggccgacgcgctcaccgaattgtgcgtgacgctggcccccaagctggccgccagccagccgttgggctaccgggtgcacccggcgcggctgaccgccccggtcggcctgcatctggcgcacgcactggtttgcgacgactatctgttcctgcggtaccgccgctgagccgccgcgctcggcatgcagccggccacgcctgttcctatgatgaaaatgcccggctcgaaacgtgatcgaatcgcgtcccgcgacatcacctttcagttgattcagttgaccgctgcccagcgcccacgcaacccgtgcccacagaaaaggatcgccggccaggtgagcagttcagaccacgaccgcgattaccgcaacctggcggtgaaccggctgcgccccagcgaaatccaatgggcgctcaaccacgacgccgtgcacggcatcgcgtatgcgttcaagaatcccgtcgccgtcgccgaggccaccgaggatcccggtgacgaccgcaagacctacctgatccgggtcaagcgcgacgacctggccaacgcgctggacaagatcaacgagtggattctggacaatcccggcccgtccgggatgcaggcctacggattggtgcgggcgctttcccgggaagggctcaccgaccgcgccatcggcgacgacgacccgagttgagcgccccaccgaattagctggcgttcgctattcgccgtgccccgcggtcgccgagaccttagccttatgcctgcacgccactgcccgggcgccggcagccggtttgcggcgcacggctggcggacgaggagtcgccgatggatgacacgagcgcggattcgcgggagggctcgcaattcgggccgtatcgcctgtggcggtgaactatcaggaccccagctggctgaccaaactcaccggctgatcagtcgacgggcgctgaatccccttggggctcagtgtcttcggcgtcgtccaccgtcaacggcagggccaggtcctccagcgggcgttgctcggcggcgatgccgagccacagctcgaccagcccggccgccgccatcaccaccgccccgatcaaaaacgaccacaccacatggtcgcgctggcccgagtcgatcagctgaccgaacagcagcgggccggtgataccgccgatcgccgtgcccatcgcgtagaagaacgcgatagccagcgcccgggtctccatcgggaagatctcgccgaccgtcaggtacgccgcgctggcgcccgccgaggccaggaagaacgccacgatcagcacgccgatgaaggcccacaccccgccggcctgggtgaggaacaccagcgccagcgccaccacgacgacggcggaaccgatgtaggtcagcgtgatcatctgtttgcggcccaccgtgtcgaacaggtgccccagcagcagcggcccggcgaagttgctcaacgcccacagcacgaagaacaccggcaccatgccggagggcaccgcgtagaactggctgagcagggtgccgaggttgaacgtgacgccgttgtagaggaacgcctgcccgatgaacaacgccaggccgagcaccgcgcgccgcgggtagagcttgaaggccaccgcggcgatctcccggaacgagatcgcggtgcgctgacggatgcgcagcgccttgccctgcggctcgggcaggggtcggccggtctgctgctggaccgcctcctcgatctcgccgacgatgtgctcggcttcctcctcgcggccgtggatgaacagccagcgcgggctttccgggacgttgcgtcggaccagcagcacgaagatgccgaggatggcgccgatgccgaaggccaggcgccagccgaggtcggccgcgaagttcgaggtgtccagcaggatcagggcgccgccggcgccggccgccgaacccagccaataggttccgttgatcaccaggtcgacgcggccgcgcacccgcgccgggatcagctcgtcgatggccgagttgatggcggcgtattcaccgccgatgccggcgccggtgaagaaccgggtcaggaagaaataccagggggcgaacgcgaacgcggtcgccacggtggcgatcaggtagagggccagggtgaggatgaacaggttccgccgcccgaaccggtcggtcaggtgaccgaagaacagcgcaccggaacacgctccggcgatgtagatcgcggccgccatgccgatctgtgccgggttgagcgcgatgccgctgcccggctccatcagccgcgccgagacgttgcccaccatggtgacctcgagcccgtcgagcacccacaccccgcccaggccgatcaccacccgccagtggaaccgcgaccacggcagccggtccagccgcgccggcacgtgtgtggtgatggtgttggtctgcgcgccggcgctcatgcgtcagccccgggcaaagcgggattcctcgggggtccaggcctgcggctggccggggtgaccggggaacaggaagtcgatgaaggccgcggcggtgggctgcggttcgtggttggccagcccgggccgctcgttggcttcgatgaatgcgtagtcggcgccggtcacgtccggcacgagcaggtcgatgccggtcaccgggatgccgatcgcttcggccgcggtcaccgcgacccggcacagttcgctgttgacctgcgcggtgacgtcgtggatggtgccgccctgatgcaggttggcggtgcggcgcacccgcagccgggtgccctggggcagcacgtcgtcgagcttccagccggcttcggcgacggtggcctcggtgagttcgtcgagcgggatgcgcgattcgccgccggtggccgccgagcggcgccggctctcggcggcgatcaggtcccgcacgctgtgctcgccggtgccgatgacctccggcggcagccgcagcgcggcggcgacgacacggccgtcgatcaccaccagccgaaggtcgtcgccgggcacccgctgctcgatcagcacgtccgggtattgcgcccgggcccgggccagggcggcggacaggtcgtcgggcccgttctcggcggtgaccccgaccgtgatgcccttgccctgctcgccgcgggtgggtttgacgacgacctcgccgacctccttgaggaacgcgaagtcgccctcgtcgaaggtggccagccgggcgcgcggcacggtgatgcccgcctcagagaccaggcggcgggtcaaccgcttgtcgtcgcaccggcacatggccaccgccgaggtgtactcggacagcgattcgcgggtgatgacgctgcggccgccgtgcgtcagccgcatctcgccggtctcggcgtcgagcacctcgacccagatcccgcggcgcagcgcctcgtcggcgatgatccgggcgtagggattgaggtcgtcgaccgtctccggcggcgggctgaacagcggctcgttgatcgcgttcttgcgcttgatggccagcaccggcacgcggcggaagcccagcttctcgtacaggctgatggcggcggcattgtcgtgcgccaccgacagatccatgtaggcgcagccggcactgcggaagtgctcggccagcgcccgggtcagggcgccgcccaccccgggcagcccggcggccgggtcgacggccagcgtccacaggctcgacccgtgctcggggtcgttgaacagcaactcgtggtcgacgccggtgacggtgccgaccacggcgccgtcctcgtcgcgcaccgcgaggagatatttcaccgcgggcacgtgctgatggttctcccagatcacgtccaccccggccgggaccatgccgcagcgcacgtacacccggttcatcgcgtcggcgtcgatcgggtcgttgagcgtgcggaccgtgacgcccagcggtgtgggcgccaggctcttctccttaccagtgaaccgcagccggtaggtgtggctggggtcgatgaagagctcggtgggcgcctcggcgaccacgacatgggattcgcgggcgtagatgcagatgtcgcgccggccgggcccctcccgccgcagcgcctcgaccagctcctgggaattggcgaaggtttgcccgaaaatcagtcggccccaacccaattcgagctcgacgtccttggccatcgcgtccaccatctcgggcggcgacgcgtcatgcagcccgagggtgatcgcctcggaagggtgatcctctgccggatcggtcatggtcatgcaaccgggcccgtcacaccgtgccgctgcagccacagctcgagcagggcgatctgccacagctcgttgccgcgcagcggggtcagcttgccgttggggttggccagcagcgcgtcgaccgcgtcggtgttgaacagaccgcgttccttggcggtcggcgcgtacagcgcgtcgcggtccatgtccaggtaggggccttccaggtgggtcagcgccgggaccgggaagtagcccttgggccggtcgatcacctcggacggaatgacccgtcgcgcagcctgtttgagcacgcccttgccttcgtgggcgatcttgtactccggcgggcaggtggcggccagctcgaccagctcgtggtcgaggaagggcacccggccctccagcccccaggccatcgtcatgttgtcgacccgcttcaccgggtcgtcgatcagcatcaccgtggtgtcgagccgcaacgcgcggtcgatgccggtctcggcgccggcctgggcgaagtgttcggtgacgaaccgcaggctggggtcgcccggggccaggatgccgggtccgaccagctgcgcgacgccggcggtgtcccggtcgaagaaggcccgccggtactgggcgacggccccgtccagggtggcggcggccggctcgcccatcggcgggtaccagtggtagccggcgaacacctcgtcggcgccctgcccggactgcaccaccttgacgtgccgggccacttcctggctgagcaggtagaaggcgacgcagtcgtggctgaccatcggttcgctcatcgcgccgatggcgccgtccagcgcgggcagcatccggtcggagtcgatgcggatctggtggtggttggtctcgaagcgctgggccacgatgtcggagtactggaactcgtcgcccttcaccccgcccgccgactcgaagccgatggagaaggtggacagcccgtgctggccggcttcggcgagcagacccacgatcaggctggagtcgacaccaccggacagcaggcagcccaccgggacgtcggccaccagccggcgcttgacggccagccgcagggtggacagcacggcgtcctcccagtcgcgttcggaccagtcggcgcggtcggcgtgccgggtgaaatcgggcgcccagtaggtggtgacggtgcgtttgccgtcgggctcgatggcgaccagcgaggcgggcggcaccttgcggaccccgcgcaggatggtggccggggcgggcaccaccgagtggaagctcatgtagtggtgcagggcgaccgggtcgatgcgggtgtccacgccgccgccggccagcagcgcgggcagcgtcgaggcgaaccggacccggtgactgtcctcggtcaggtagaggggtttgatgccgaggcggtcgcggccgagcagcacccgaccgctgtcgcgttcgacgatggcgaaggcgaacatgccgaacagatggctgacgaagtcgtcgccccaccggtggtaggccttgatcaggacctcggtgtcgctgtgcgagaagaaccggtagccgtagccggacagctcgctgcgcagttccttgtagttgtagatgcagccgttccaggcgatggataggcccagctcggagtcgaccatcggctgggcgccggcttcggtcaggtcgatgatcttgaggcgacgatgcccgagcgcgacgcggccctgcgaccaggcgccgccggcgtcggggccgcgtggtgtcagcacggcggccatcgccgagaccgcggctacatcgggcgcccgcccgtcgagtcgtacctccccggtgactccgcacacctcttcgaccctaccgttgcccgattcccagcgcgcgtgacctccgccaaaagcgctgcaacggcccagctacggccgcgatccgtgcgtggtgatcaccgcgatcgacgccggtgtgaaatgaatcgcaccgtcgcgacgggccggcgaaatcgctcatcaccggacgggcggctcgtcgtcgccggggtccgccccgaatcgttgcggtggggtcagttcccggcgacgttgcgcgcccagcagttgcccgaggcgctgcccgtacgaatccaccacatcggcattgaggatctcgtcatgcgtgcagtcgatctcgtggatgacgatgtcgccggcaacgtatggacgccaattctcggcgaggaacgcactgcgatcctcgtgatcacgcaccgcggagaagatggtcacatcgccgaggaaaacaccgggctcgtgaatcttgctgcgctcgatattgtttcgggcattcccgaaaagcacatcgaaaaggcgtttgtgtcgagacatgccttcggctccggcttcacggacgagttgattgaactgccgatgcgcatgcggttggtcgtgatcggcggcggccaggtgcgaccgcagggcttcttccatcatgtgctgctcggccagggcagcgtcgggtgcggtgacgctgccgtcgagaccgggttgagcgtcgaggaggacaaggcgtgcgattgcgcacccgcgccgctgcagctcgatcgcgagttcgtgggcgacgacgccgccgaacgaccagccgacgagatggtaggggccatcgggataggtttcctggattctgtcggcgtagctttgcgccatctcgcgaatcgaccgcggcgcggcgtgctgcggttcggcttgttgaatcccgatgatcgggcaatccagatgattgccgagcacctgatatgaccaactgagcccgccggcggcatggatgcagaacagcggtgcgccggtcccctctttcagggtctggacgggcacgatctcttcggcttgtccgccgcgagcggtatccgtctgcgcccgccagctcaggcttgcgacggtgggcgcctcgaacaaggtgcggaccgcgagctcgacgcccaggctggcgttgatcgccgtgatcacccgcatcgccgagatgctgtcgccgccgaggtcgaagaaggagtcgtcgacgccgacccgttcgacaccgagcacatgggcgtagatgccggccacggtctcctcgacggcgttggacggcgcccggtagcggctgcccgtgtattcgggtgtgggtagggcgcgggtgtcgagttttccgttgggcgtcaacgggattgcgtccagcgccaccaccgcggccggcaccatgtacaccggcagccgttgggccaacgcggtgcgcacctcggccgggtcggcggtaccggtgatgtagccgaccagccgcttgccgccaggccggtcctcacgggcgatcaccaccgcctgctcgacatcgtccagcccggccagcgccgcctgcacctcaccgagctcgatccgatacccgcgaaccttgacctgctcgtcggcgcgaccccgatagtccaactgcccatcggaacgccaacacaccagatccccggtgcgatacatccgcgcaccgggcgccccgaacggacacgccacaaaccacgaggcggtcagcccgccgcgccgccagtagccgcaggccaccccggcgccgccgacatagagctcacccaccacacccggcggcaccggccgcagcgattcgtcgagcacgaacaggccggcgcccggcaccgggaagccgatcggcaccccggccggtgacccgggctgcagcggcgcgctgatcgcggtgtagacggtggcctcggtggggccgtaggcgttgatcatcgtccggcccggggcccagcggtcgaccagctcggccgggcaggcctcgccggcgaccaccagggtgaggtcctcgaggccctcgggtgagagggtgccggccgccgacggggtctggctgagcacgctgacctgctcgtcgagcagcagggcgtggaagtcgtccggcgagcgcaccaccgagtcggggatcaccaccagccggccgccgtgcagcagggcgccgaagatctcccacaccgacacgtcgaaggccagcgaatgccactgcgaccacacgccctcgcgcggcagcccggaatcggcggtgagcagctgcgtcacgttgcggtggctcaccgcaacgcctttgggcacgccggtggtgcccgaggtgtagatcaggtaggcgatgtcgtccgcacccggcggcggcagcgcgctcgacggcgcggcctcgatcgcggggtcgtgcacgtcgatgaccggcacgtcgtgctggccgtgcagccgcggcgccagctcggcggtgctgatcgcgaccatcggcgcggcgtcggccagcatgaacccgatccgctcgcccggcagcgccgggtcgatcggcaggtaggccgcccccgacttgagcacccccaggatcgcgacgatcgcctcggccgaccgggaaaacagcagtgccacggtgtgtcccgggccggccccccgcacgcgcagcaggtgggccacccggttggcggcctcgtccagctcccggtaggtcatccggcggccgccgcagaccagcgcgacggcgtccggggtgcgggcggcctgttcggcgaaaagcgttgggagggaatcgaaccggggcggaggtccggtcagcgccgcccggttgcccagggtgtcgaggcgggcgtgctcgccggcgtcgagcaggtccaccgaccacacggattgtgtcgggtcgtcggtcatcgcctccagcacccggcgcaaccgcccgatcagcgtctggatgctgtccgggtcgaacacgtcggtgcggaattccaccgtgccgccgatcccgcccggttcgccgctctcgcaccagcgttcgccgacggagaaggtcaggtccatccgcgcggtgtgggtgtccaccggtatcggcgtgatctccacatcgccgagggacagccccgcggccgggccggtgtcctgcccggcgaagttctgccaggccagcatcacctgcaccagcgggtgatgggtgaggctgcgggtcgggttgagccgctccaccagcacctcgaacggcacatcctggtgctcgaaggcctccaggctgcgggtgcggacccgagccagcagctcggtgaagctgggatcgccggccgcgtccacccgcagcaccagggtgttcacgaagaacccgaccaggtcgtccagcgccgggtcgcgccgccccgcgatcgggaagcccaccgccacgtcgggattggcgccgagcttggccagcagcacggtcagggcggtctggatcaccatgaagctggtggcgttgtgccggtgggccacgtcgccgattcgctgctgcagctcggccggccagtcgatttccacagtggcgccgcgctgatcggccaccagcggatagggccggtcggtgggcagcgccagccgctcgggcatgccggccagcgcgtcctgccagtaggccagctgggcggcgatgcggctgccactgtcggccagctcgccgaactgggcgcgctgccacagcgtgtagtcgacgtactgcaccggcagcggcgtccagtcggggccgcgcccgtcgcaccggcgggcataggccgcaccgagatcacgcaccagcggggtgatggacatgccgtcggcggcgatgtggtgcaccacggccaccagcacgtgccggtcgtcgcggagacggaaaagctctgcgcgcagcgggatttgggcggcaaggtcgaaggtgtagcgggcggtggcgccgatcgcctcgtccagttggtctgccgaccagccgctggcgtcgacgacctcccacccgaagtcggcccgctcggcgggcagcaccacctgctggggtcgcccctcgggggcggcgaacagggtgcgcaggctctcgtgccgggccaccacgtcgcccagcgccgcgcccagcgcctcggtgtccagcgggccgtccagccgcagcgcggccgccatgttgtaaaccggtgaggggccctgcaattgatccaggaaccacagccggttctgcgcgaacgacaacggcaccaccgtgggccgctcaccggccgtcaacggctcgagtccgctgccgccctccccgatccggggcgctagcgcggcgaccgtgggcgcctcgaacacggtgcgcaccggcaggtcggcgttcagggcggcgttgacggccgcgatcaggcgcatcgccgagatgctgtcgccgcccaggtcgaagaaggagtcgtcgaccccgacccgctgcacgcccagcacctcggcgtagatgccggccaggatctcctcggtcggtgattcgggggcgcggtactcgccggcggcgtagtcgggtgcgggcagggcgcgggcgtcgagtttgccgttgggggtcaacgggattgcgtcgagccccagcacggcggcggggaccatgtaggcgggcagccgctcgcccaggcgcgcgcgggcctcggccgggtcggcggtgccggtgatgtagccgaccagccgcttgtccccgggattgtcctcgcgggcgacgacgacggcctgctccaccccgtccagcgccgacagcgccgcctggatctcgcccagctcgatgcggtagccgcggaccttgacctgctcgtcggcccggcccaggtagtccagctgcccgtcggcgcgccagcgcaccaggtccccggtgcgatacatccgcgcacccggcgccccgaacgggcacgccacgaagcgggccgcggtcagggacggtcgcccgagataccctgcggccacaccggatccggcgacgtagagttcgcccaccacgccgggcggcaccggccgcagcgattcgtcgagcacgaacagcgccgccccatcgaccggcgacccgatcggcggtatgccggatcccgcggtcagcggggcgctgatgctcacgcacatgctggtttcggtcgggccgtagccgttgaccatcacccgtccgggcgcccattggtccaccacctcgggcgggcaggcctcgccggccagcaccagcgacaccgactccaacccctgcggggagagcatcgccaccgcggacggggtttgggtcagcacggtgacgtgccgggcgatcagggcgtcgtgcaggtcgtgcggtgagcgggccaccgcctcgggcatcaccaccacgcgtccgccgcgcagcagcgcgccgaagatctcccacaccgacacgtcgaaggccagcgagtgacattgcgaccacacccccggcgacggcaggccggcgtccagcgaccccagcagctgggtcacgttgtggtgagtgaccgcaacgcctttgggcgcaccggtggtgccggaggtgtagatcaggtacgcgatgccgtccgggtcgggcagcggcagcgcggtgttcggcagggtatcgatgcccggatcgtcgacgtcgacgacggtcacggggcggccggcgagccgctgcgccagctcggcggtggtgacggcggcgatcggttcggcgtcgccgagcatgaactcgacgcgggtctgcggggccgacgggtcgatgggcaggtaggccgcccccgtcttgagcaccgcgaggatggcggcgaccgcctcggcggatcgcgaaaacagcagtgccacagtctgtcccgggccggcgccggccgcggccaggcgatgcgccagccggttcgacgcctcgtcgagctgccggtaggtcaccgacaggtcgtcgcagaccagcgccaccgtctccggcacccgggccacctgggtggcgaacagttcgggcaccgacacccgcccgctcgccggccgggtcaaaatcgccgtgttgccaacctcttccaggtaagcgcgctcggcatcgtcgagcagatccaccgcggacagcggccggcccggatcgcccgtcatcgcctccagcacccgccgcagccgttcgatcagcgtctcgatggtggccgcgtcgaacacgtcggtgcggaattccacccgcccgccgatgccggcgaattcgccgtcggggttccagcgttcggccagcgagaacaccaggtccatccgggcggactggtcgtgcaccggcaccgacgtcacgtcgaggtcacccaatgccaaagcggccgcggggtcgtcgtgcccggcgaagttctgccaggccagcatcacctgcaccagcgggtgatgcgtcaggctgcgggtcgggttgagccgctccaccagcacctcgaacggaacgtcctgatgctcgaaggcggccaggctgcgggcctgaaccagggccagcagctcggcgaagctggggtcgccggtcaggtcgatccgcagcaccagcgtgttgacgaagaagccgaccagctggtcgagcgccgggtcgcgccgcccggcgatcgggaagcccaccgccacatcggaactcgcgccgatcttggacagcagcaccgccagggcggcctgcaccaccatgaagctggtggcgttgtgttcacgcgcgatccggcgcacctgctgctgcagctcggcgggccagtcgaccgccacgctgtcgccgcgctggtcggccgccgccgggtagggccggtcggtgggcagcgccagccgctcgggcatgccggccagcgcgtcctcccagtaggccagctgggtgccgatgcggctgtcggggtcgttgagatcaccgaactgggcgcgctgccacagcgtgtaatcgcagtactgcaccggcaagtcggcccatcccggggcatgcccggcgcaccggctggcgtacgcctgactcaggtcgacgcccagcggcgtcagcgacatgccgtcggcggcgatgtggtggacgacgatcaccagtacgtgctcgtcctcggataccgcgaaaagctttgcgcggattggtatttcggcggccaggtcgaaggtgtggcgggtgacgtcctggacggcgtcatccagccggtcggccggccaatcggtggcatcgatgacgtcccaaccgaattcggcgcgctcggcgggtaccaccagctggcggggcgtcccctggtgcgacgggaacacggtgcgcaggctctcgtgccgggccaccacgtcgcccagcgccgcacccagcgccccggcgtcgagcctgccccgcagccgcagcgccgcggccatgttgtacagcggtgaggggccctgggattggtcgatgaaccacaaccggttctgcgcgaaggacagcgggaccacgtccggccgcccggcggccaccagcggcgccagcccgccggcgctctgcgcgatgcgcggcgccagctgggcgatggtgggcgcctcgaagacggtgcgcaccggcaggtcggtgtccagcgcggagttgatcgcggtgatcagccgcatcgtggtcagcgagtcgccgccaaggtcgaagaacgagtcgtcgacgccgacccgctgcacgccgagcacctcggcgtagatgccggccaggatctcctcggtcggtgattcgggggcgcggtacccgccggtgtgccagtagtcgggcgcgggaagggcgcgggtgtcgagcttgccgttgacggtcatcggcagcgaatccagcaccaccaccgcggccgggaccatgtaggcgggcagccgttcggccagcgcggcgcgcgccttggccggggccaccgatccggtgacgtagccgaccaggcgcttgtccccggggttgtcctcgcgggcgacgacgacggcctgctccaccccgtccagcgccgacagcgccgcctggatctcgcccagctcgatgcggtagccgcggaccttgacctgctcgtcggcccggcccaggtagcgcagttgcccgtccgggccccagcacaccaggtcgccggtgcgatacatccgggttccgggttcgccgaacgggcaggccaggaagcgcgcggcggtcaatcccggtcggcgccaatagccgacgccgacgccgtcgccggccaggtacagctcgccgaccaccccgggcggcaccgggcgcagccaatcgtcgagcacgaagaacgccgcccgggtcaccggggcgccgatcggcgggaagcccgacccggccgtcagtggtgcgctcttgcaggcccacatggtggtttcggtggggccgtagacgttgaccatggtgcggcccggcgcccagcggtccaccagctcgggcgggcagggttcggcgccgatcaccagcgcggtgccgtccagcccgtcggtccgcagcagtccgacggccgacggggtttgggtcaggacggtgacgtgttcgcgaacgagcaggtcgtggaactcgttcggggagcgcgacaccgtttcgggcaccaccaccaggcggccgccgtgcagcagcgcgccccagatctcccacaccgagaagtcgaaggcgtaggaatggaactgggtccacacctgccgcggcgacaactcgatgccgatccgcaggtcgtcgaagagctgggcgacgttgtattgcgtcaccgcaacgcctttgggcacaccggtggtgccggaggtgtagatgatgtgggcgacgtcgtcggggtcgggcaccggtggcgccgtcgcgggctgggtggcgacggcggggtcggcgacgtcgatgacggtgaggtcgaaaccgtgcagccgctcagccagcgcggcggtggtgaccgcgacgatcggggcggcgtcggtgagcatgaactcgacgcgggccgccggcagcgcagggtcgatcggcagataggccgcccccgacttgagcgcggccaggatggccacgatcgcctcggccgaccgggggaacagcagcgccacccgctcacccgggccggcgccgtggtgaatcatgaagtgcgccaagcggttagccgcttcgtcgagttcgcggtaggtcatggaccggccgtcgcaggtcagcgcgaccgcgtcgggggtgcgcgccgcctgcgcggcgaaccgggcaggcaccgacaccggggtggccggccgggccagcaccgcggtgttgccccacttttcgagccgggcgtgctcgttggcgtcgagcaggtcgaccgccgacaggcggcgctgcggatcggccgtgaccgccgtcagcaaccgctgcaaccgctcgatcaggccctcgacggttctgccgtcgaacacgtcggtgcgatattcggcggtcaccgcgatgccggcgcgctggcccgactcggtgaagcgttcggccagcgagaaggtcaggtccatgcgggcggtgttggtgtgcaacggcatcggggtgacctgcaggtcgcccagggccagcccggcggccggggcggtgacctcgccggggaagttctcccagccgagcagcacctgcaccagcgggtggtgggacatgctccgggtcgggttgagccgctccaccagcaactcgaacggcacgtcctggtgctcgaacgcggccaggctgcgccggcgcacctgggccagcagctcggcgaaggtcgggtcgccgcccagttcgttgaggtcgacccgcagcaccagcgtgttgacgaagaaaccgatcagctcgtcgagcacgggttcggggcggcccgcgatcggaaagcccacggccacatcggaactggcgctgaccttggcgagcagggcggcgaacgcggcctggaccaccatgaagctggtcgcgtcgtgctcgcgggccacccggcgaagctgttgctgcagttcggccggccagtccaccgccagccgcgcgccgcggtggtcggccaccgccgggtagggccgatcggtgggcagctgcagccgttccggcagcccggccagcgcgtcggtccagaagtccagctgggcggcgatccggctgcccggatcgtcgacgtcgcccagatgcgcgcgctgccacagcgtgtagtcggcgtactgcaccggcaacggcgcccagtcggggtctcggccggcgcaccggctcgcataggcgaccccgaggtcccgggcgaacggggtgatcgaccagccgtccgcggcgatgtggtgcaccgcgacgaccagcacgtgctcgtcgtcgccgcgggcgaaaagctcggtgtgcagcggactttcggccgacaggtcgaaggtgtagcgggccgcggccgacatcgcctcgcgcagccggtcttccggccagccgcgggcgtcgacgacgtcgcaggcgaagccgatccgatcggcaggaatgaccacctgctgcggggttccgtcggcggtcgcgaagaccgtgcgcaggctttcgtgccgggccaccacgtcggccagcgccgcgcgcagcgcgtcggcgtccagccgcccggacagccgcaacgccacagtgatgttgtacatcggtgacgggccctggaactggtcgatgaaccacagccgggtttgggcgaacgacagcgggatcaccgccgggcgctcccccgccaccagcggctcgggccggtcggcctcgctgccgacgcgcagcgccaactcggcggcggtgggcgcctcgaaaacggtccgcaccccgaggtcggtgttcaggctggcgttgacggcggcgatcagccgcatcgccgacagggaatccccgccgagatcgaagaacgagtcgtcgacgccgacccgctccagcccgagcacctggccgtagatgccgaccaagatctcctcgacggcggtggacggggcgcggtagcggtcggcgtcctggtagtccggcgccggcagggccttgcggtcgagcttgcccgaggtggtcatcgggaattcgtcgagcgccacgatgtgcgtcggcaccatgtattcgggcagccaggcgttcagccgctcccgcacctgggcgatcttggtgttggcgcgcgggtcgttggcgtgccgggtgcgctgtcgggccccggcgggcggcaggtagagatcggtcagcggctcggcggcctggtcgccgtcctgcacgaaaaccgcgctaagagtgccgggttgggcgccccaggtgacggcgacgcggtaaccggtggcctcaccgacgcgatgcagttcctcggcgacggcggcggcggtgtcggatccggccgcggcgagcgcgtcggcgacgggtaacccggcggccagcgcggcttcgacccggacgtcgtcgatcaccccggcctgcggaatgtcggtgacgcggacgacggcggggcgccgcgccgccagttggtcgcgcagtccggcgcagtcggtgcagtcggtccacgaccaggtgggcgcggcggccaccgaccgcaccggcgcgggcgccttgtggatgacgacgtcgtagcggtagcggttcagctcgttgtcggacagtccgcgcttgagctggatgtcgagtccggccgccgcggggcgagagtcggcccagttggtgaaaaactcaggcgccaaaagcaattcggtttcaccgagcatggcgtggcggacacgctggcggatctcggccgcatcggcgccgccgccgcgggccaaggcgatgccggtttggaaggcgccctgcagggcgtggttgcggacgtcgccgatgaacagcgacccgccgggggccagcagctccagggcgttgtcgatgacgtcggccagatacccggcgttggggaagtactggacgaccgagttgatgacgatggtgtcgaagtggcccggcggcagcccgtcggtgacgtgggcgggctgggtcagcagctcgacccggtcacgccagggcagctgcagctgttccatcgatcgggccaggttgtcgatcgccaccgcggagaagtcggtggcgacatagcggtcgcaccgcggggcgatctgcgacaacagcagccccgagcccgcgccgatctccagcacccgccgcggccgcagcgacatgatgcgatcgactgtggcggaacgccattcggccatttcctgcagcgggatcggctcgccggtgtagctgctgttccagccgcggaagtcctcgccgaacgtcgcggcgaggtcggcgccgtacaggtcgtcgtagaggtgccgccactgcgcgacgtcgtcggcgtcgtcggtgtcgtggcggacgtccgcgtcgctcggcccgtgatcgagtgtcacgtaggcgaccagttgggagccggcggcgctgtcctgcacggtgacggccgcctgggtgacctgcgggcaggccagcagggtgttctcgatttcgcccaactcgatgcgttgcccgcgcagtttgatctggttgtcggcgcggccgaggtagtccagcgtcccctcgggcgtccagcgcaccaggtcgccggtgcggtacatgcgctcacccgggccgccaaaggggttggccacgaaccgttccgcggtcaggtccacccggccgagatagccgtggcccagcgccggcccgctcagatacagctcgcccaccacgccgaccgggacgggcttcagccagccgtccagcacccgggcgcacacgccggggatcggggcgccgatgcgcaccgggtggcccgccgtcagccgcgcgcaggtgacccagatggtggtctcgctggggccgtagccgttgaacatctgccggcccggcgcccagccgtcgaccagctcaggcaggcaggcctccccgacggcgaccagggtgtgcagcccgtcgagccggccacggtccagcgtcgagatcacggtgggggtcaggatggccgtgccgacccgctggttgtgcagcaacgcggtcagcgcctcaccggcgtacacctgcggcggcgccacgatcagcgccgccccggatcccgcggccagcaacaattccccgacggatgcgtcgaaggtcggggaggcgaccatcagcacccgcgcgtccgcgcccaggccgaacagctcgcgctgggccgcggcccagcccagcaggccggtgtggctgaccgcgacgcccttggggacaccggtggaacccgacgtgaagatcagatacgcggtgtcgtcggcgcgcagcggggagcgccggtcggcgtcggtgatcggctcggtggagtggccggacaggtcgagaccgtcgatccgcaggatcggccgcggccccgcgccggcgacttcgtcggtgccgcaggtcaatacgcacaccgcgttcaccgtgtccagcaccgaggcgatccgctcgaccggatggtccagattcaccggcgcgtacacgccgccgaccttggtcaccgcccaccaggcgaccaccagctcggcgcaccgctcgatcgccaccccggccgcgtgctcggggcccacaccgtgctggatcagcttgcgcgccaggcgtgttgaccagtcgtcgagttcgcggtaggacagctcccgtgccccgtcgacgatcgccggcgcgtccgggtcggcggccaccgccgcggccagcagctgcggggccaccccgatcggtgcgctcaccccggcgccggacatcgtcgacagcaccagctcccgctcgccgcgatccagcaggtcgagcgacgacagccgtcggtccggatcggtgctcatcgcgaccagcacccgctgcagtcgctgcaccagggattcgatgctcgccgtgtcgaacacgtcggtgtcgaactcgatgtgcaggccgagttcggggccgggcagggcttccaccgtcagcgggtagtggttgtactcgcggttggtgaactcggcgatggccagcccgtccgcgcccaacgtcatgccgctgtcgatcgggtagttctcgtagacgaacagcgtgtcgaagagttggtcgtgcccggtgacgcggtgaatctcgttgagcgccaggtgctggtgctcgagcgtgtcgttgtggctgttctgcagctgcgccagcagctgcgcggtggtggtggtcgcggtgatctcggcgcgcaccggcaccgtgttgatcagcaggcccaccatctgttcggcgtcgtcgacctcgagctggccgacccgcgagcgcggggtaccgaagacgacgtcgtgccggccggtcagcgaggtcagcaccaccgcccaggccgcctgcagcacggtgctcagcgtggtgtggcaggagcgtgccagctcgcccagcgcccgggtggtttgctcagggacacaagacttttcgaagccgcggcggccctgccccaaccggccctccggggcgaccagggtgggcgtgtcgaaaccggacagcacctcgccccaggcccggcgggcggcgtcgaggtcgcgctcggccagccaggtgaggaaggcccggtaggagccggcggcgggcagccgctgcccgtagtagccggcgaagatctcgcgcagcaggatcggcagcgaccagccgtcgagcaggatgtggtggctggtcagcacgaaccggtgccggtcgcctccggtgcgcaccagcgcggtgcggaataccggctggccggccagatcggccaccgcggcgcgttcggcggcgcacagctgctcgatcaggtcgtcggcatcggccgcgcccgtaccgtcgagctcgacgtagcgccactcgacggcggggtcggcggggatgatctgcaccggttcgtcgtactggtcgcagaacagggccgccaggtggggatgccggtggacgacggtgcgcaccgcctcgcgcagccggtcggcgtcgagggggccggtgagggtgaaatccaattgcaccgcgtacatgtcgtccatgccgtcgttgccctgcgcggtgctggagtggaagagcagtccctgctgcagcggggtcagcggcaggatgtcggcgatgcggtgccggctttgcagctcgtcgatctgctgctgggtcagccgggccggggcgatgtccgacggggtgagaccgccgccgccgccggagcgcacgtgcgcgcagacaccggccagcgcctcgaaccacagccggctcacccgggtgatctgctccgcgccgagaaccgaaggcgcccaagtccattcggcgtgcaggtgcgggccggcgccggtgtcgatggtgccggcgttgagctcgacggcgtgcatcagcggcatgggcaccgccgcggcggcgccgagcagcgacatgtcctggctgatccgccacccgtcggccgccgaatcagacgcggcgccttggcgtcccaggtagttgaacgcgatcggcgggtcggccccggccaggtcgacgtcggtgttgaggtaacgcagcagcccgtaggtcagcggttccggcagggtgcgcagctgctccttggcccgtttgaggacggggcccagcgccgggtcgccggcggccacctgcggccagcgcaacccggcgacgtccagcgacaccgggtatttggcggtgaaccagccgacggtgcgggacaggtcgatatccgcgccgagttcctcgtggcggccgtggccctccacgtcgatgccgatcggagcgccgggctcgcccaggaattccgtccaagccaggccgaacgcgatcagcaggatgtcgtggatgccggcgtggaacgccgccggcacctcaccgagcagcatcgcggtcgtctcggcgtccagctccaccgacaggcgaccggcgctggcgtaggtgtccacgtcgggtcgcggtgccggcagcgcggccggtgtggaggtgaccgtcttccagcggtcgagctggccgactacctcggggtcgcgtgcgtgctcgtcgagcagtcgggcccaccgggcgaacgacgtgcccgccggcgccagctccaccggctggccggcgcggtgcagggcccaggcaatgttgaggtcctccaacaggatccaccacgacaccgcgtccacggccaggtggtggatgatcaccgccagctggccggtggcctccacccacaacgcggcgagcatcgtcccggcggccgggttcagccgcgcccgggccgccagcagcgcctcgtcggacagcgcgtccaccgaccgcaggcagtcgcgggcttgcaccgacccggcctcgggcacctcgaacgaccagccgtcggcgccgtcgtcggtgacccgcaaccgcagcatggcgtgccgatctaccaacgcctgcaacacgattgcgacctcggtctcggtcacacccgcgggcgcttgcaccaggacggtctggttgaactggtcagtggccccgccggcccgttcggcggcctgcagccaccgcatgatcggggtgggcggcacggggccgacgccctcgtcggccacctcggccgcccggtcgccggagccgaccacccgggccagccgggcgacggtctgctcgacgaaaacgtctcgcggccggcaagtcagcccggcggcacgggcgcgggccaccacctgcagcgccgagatgctgtcgccgccgaggtcgaagaaggagtcgtcgacgccgacccgttcgacaccgagcacatgggcgtagatgccggccacggtctcctcgacggcgttggacggcgcccggtagcggctgcccgtgtattcgggtgtgggtagggcgcgggtgtcgagttttccgttgggcgtcaacgggattgcgtccagcgccaccaccgcggccggcaccatgtacaccggcagccgttgggccaacgcggtgcgcacctcggccgggtcggcggtaccggtgatgtagccgaccagccgcttgccgccaggccggtcctcacgggcgatcaccaccgcctggtccacatcgtccaatgccgccagcgccgcctgcacctcaccgagctcgatccgatacccgcgaaccttgacctgctcgtcggcgcgaccccgatagtccaactgcccatcggaacgccaacacaccagatccccggtgcgatacatccgcgcaccgggcgccccgaacggacacgccacaaaccacgaggcggtcagcccgccgcgccgccagtagccgcaggccaccccggcgccgccgacatacaactcgccgaccacccccggcggcaccggccgcaaccacgcgtccagcacaaacaaccccgcaccatccaccggcacaccgatcggcggtgaccccatacccggggccagcggcgcgctaatggccacgcacatcgtcgtctcggtggggccgtaggcgttgaccatcacccgccccggcgaccaacgatccaccacctcagccgggcaggcctcccccaccaccaccaacgacaccgactccaacccctgcggcgagagcatcgccaccgccgacggcgtctgcgtcaacaccgagacctgctcattgaccagcacgtcgtgcagctcttcgggcgcgcgggtgacgtcttcgggcaccaccaccaggcgcccgccccgcagcagcgcgccgaagatctcccacaccgacacatcgaacgcatacgagtggcactgcgaccagaccccggccggcggcaagcccgcgtccagcgaccccaacaactgcgtcacgttgcggtgcgtgaccgcaacacctttgggcacacccgtggtacccgacgtgtagatgacataggcgacaccgtcggccgcgggcaccggcaacgcggtggcgggccggtcctggatacggggatcgttgacgtcgatcaccgtcatgccgtggccctcgagccggccggccagctccgcggtgctcagcgccgcaacgggtttggcgtcggcgagcatgaacccgatccgagtctccggcgcggccgggtcgatcggcagataggccgccccggtcttgagcaccgccagaatcgacgcaaccgcctcggcggaccgcgaaaacagcagcgccacagactgtcccgggcccgcgcccaggccggccagcaaatgcgccaacctgttcgacgcctcatccagctgccggtacgtcagcgaacggccttcgcacaccagcgccacgtcctgcggcgcccgggccacttgtgtcgcgaagagctccggcaccgacaccgccgggcccggcgtccgggtcaggaccgccgtgttgccgagcgcttccagctgcgcgtgctcggggtcgcgcagcacatccaacgacgacagcagccgggccgggtcggcggccatggccgccaggatgcgttgcaatcgctccgccaggtccgtcgcgtcgaagttcgccaacggctgcccggtgccgaccgtgctcaggaattgctggtcaccgaatcccaggaagaacagcccgaagtgccccaccgggccgaagctggtgtacgtcgcggtggccggcacgtcggccaggctgagggtgagacgcgccgggacgaagttgacgacgacccggttcggcgcctgcctcggcccgctgaagtcgccttccccgtccagcgtgcgggtggggaattgctgatgccgcaacgcttctcgcgagcgctgatcgacatgccgacagaagtcggcgaacgtggcggccgccggggcgtgcagcaccagcggcaccaccccggccagcatgccgggatgcgtcttcgacttgggatcgacccgccggctgaccgggaagtcgagcaccacctcgtcggagccgtcggcgcaccatccgcgcaccaacaacgcacaggcggcggtgagcaccgatgaccgacggatgcccaacgccttggacaactccttgacgctgccgatcaccgactcgtccaactgcaccggcggggagggcgaatacgggtctcgcccgtcgtcggccggccgcggcggatggccggccgtgccgtcgccgggacggtgcgcaagccaataatccttgtcctcaaggaatttcgcggatgcctcgtattccagctcgccgccgaccaggtcctgcagcgaaccgaagaaggcgggcggaatcggtttgccggacgccagcgccgtgtagaccgccgcgatccgccgacccaccagcgcgatgcccatcccgtcgatggcgatgtgatggcaggtggtgaaccagtagtactcggcggaaccggttcggaacaaagcgaatttgatcatcggaccggtcagcggcatcggggtgcgctggatcgacgccgtcatctcgcggacttcccgctccggatcggacgagccgctcaggtcgtagaaggtcaggtcgacgtcggagtattcgaccgccttctggaagacctggccgtcggcctcgaagaagctggcgcgcaggctctcggcctcgccgaccacgtgtcgcatggtctggtgcagcagcgcggggtcgatggcgccgtcgatgcgcaccagcacgcccagctgccatgccacatccaagtggccggtctgctccgccagccagatgtccagctggcctcgcgtcaccggatatgcccggtcaccgcgtttcactaattgacccccagagctcgactccgcaacccttcataccgacagccgtcggcacatcataaaccggcgctcagcgtgtcgcgcagacttttcgcccggatatcgggccagctctcttcgatgtactgcaggcatgcggtgcggtcggcttccccgaaaactacccgccaacccgggggaatgtcggcaaacgttggccaaagactgtgttgttcttcgttattgaccaggacgaaaaatcggccgccgtcgtcgtcgaacggattgagctgcatggtgatggacctcccttttcaccgagacctgattccagatttaccaccgtcgcaccgcctgcggcatgaacgcccttgcggcgcatacggattcagcccgtcgggccgggccggcacgtcaaccagcccaccggctggacaccggcgaaggtgagcttggtcgccaggatccggcaccgtgacgcggcggcgccgattccggccctgcgtcgacacccgccgttcgccgggcggtgcatccccgttgaactggcattacgactgtcgacgccgcgatcctcggtcagcggatacccaaccgatgctgtgcaaaacatatgaattccgttcctacataaccgatccgcggcgattctactgttcgactcgtgtgcggcactgagcaaaacgcctttttgcccggccgcttccgccgccaccggcttttgcggccgggtcgccggcggtcgccgacgcggtttgcccgcgcccagatgcgccacctcgccggccgcggcggcggggtttgcccgccggcgcccgtctcagccggtcatcggcccgacacgctgcggggccggcgaattggcgaccgcgcctgcggcatgaacgcgaccttaacagccctttaagccggcgccctccggtgggcgccgcatgccgcccgacgcgccgaatccctgccgcaccatgggaaaacgtacggatgttgctgtgtcgcccgcgagatcgtcgttgcccggcgccggcgcgcctggtcggtcgtagctgacggggccgtgggcgcagcgggagcccgcctggacccgccgatgtccgccgtggccgcccgccccggggaatcacaccgattgtttgtgattgatctcacggacctcggactcatcgggcgttcgccggccggtcaccggcgcgcgtggtccaaccgcttcacggcgccgccgtgaccgactgggtcgtcggccccggatccggcgcctcacctgcccgggcgccgatcggaggcggtgcctgaaaccgttgcacgcgagcacaattcgtcgttcacaggggacgcataggttcgctttgctcgaccatcaccgcggcaccccggcacgcgaaggcaggcgtttagagcccgacacccgcgggtagagctgcgcccatgtgggggtcggtgctgggcttggggatgctggctgcgctcaatccggttcgtctgggtctggctctgctgatgatttcgcggccgcggcccgggtcgagcctgctggcgtattggatcggcgggctgaccgtgtgcgtgcccgagctgctaatcccggtgctgctgctgaacttcacgccgatgttcggccatccctcgcacgcgtccccgtccacgggcttggccctggggaagattcagatcggcctcggcgtggtggggctgtcgatcgccgcggtgctgaccgtgcgcttcgcggcccgccagcgcgccgccgcgccaccgcccgacgaccggacctcggaactgtcagcggccccgggcgccaccatcgcgatgccgcggctgctgacccgggcgcaggacgtttcccccgacgaccggtcggtgctgcggcggctgctcgggcggatgcacagcgcgtgggagagcggggcgtcgtgggtggcctgggtgatcggcgtcatctccgtgcccgtcgacggtgtgctgttcatcgtcgcgatcatcgcggcctcgggagcctccgtcacggcgcaggtcagcgcgtcggtggcgttcgtcgtgctgatgtacgccgtggtggaggtcatcctggtcgggtacctggccacaccggggaagacgcagtcgctgctgctggtgctgcacgactgggtgcgcacctaccaccggcagatcctggtcgcgctgttcaccgtggtcggggtgtcccagctggcccaggggctgcacctggtctgagtgttcggaagcccttcgtggccggatcgccccgaacagaacccgaataccattgaggcggtctactacgaaacgtagtattcgaggtggttccccggtgcacaaggaggtgcagtgtgaggtggagtgtcgcccaggtcgggctgctggtcatctgcgtggtccacgtgatccaggccgttgtcggtctggtcatgaatcccagtttcgccaccgggccgaacgccccgaccgtccagctgctcgggatggactacaacggctggcacgcggtcgccggtctggcgctgttcgctcccggcctggtgttcgccgcccgcaagtcctggtcggtgctctatctgctgctggccgcgatagccggtgcgttgccgggcatttgggcgttcttctcccaccaggtcgcgttcctgttcacctttcccaacaacatcaccgacgcggtcgtgcacttggtgaccgccgcggtgatggtggcggtggcggccgttcaggtccggatggacggtgggctgagaaactccctggccgacctgcgcagagcgcggtagccgtcggccgggtggccgggacgtcggcgtcacgatgaaaatggacggatgccttccgaacctgcgccgccccctcccaaatcggcgcccggctggtaccccgatcccgcggtcggtcatgggctgaaacgctacttcgacggcaccagctggacgggcgagtgggcgttcttcaccgagcaacgcaagaacggcacctccggcaaggcggccctggccctggcggccctgggcgtcgtcgtcctgctgctgatcttcgccaagagctgggccttcgacccggagaaggccgcccgcgccaccgcgacttcggccgcgacgggatccaccgagccggcacccccgacgccggccggtcccaagaagccggacggcgtcaccttcaccaccgccgcggcccccgacggcgacgtggtggacgcccggttcgccatccgcgacaactacagcgaagagatgatcagggacggtgcgcgctcggacaccattcagattctcaagtacgcgcacgcgacctacccgaacgcgtccgcggtgaatgtgcagggcaccttcccgatgaccgatccgtacggcaacacctcgacgcaggtcgccatcgacctgacgtattcgcgggccacgttgaacaagatcaacttcgatggggtgcgggcgaacaccatctgggagattcgcgattccgggactgtgctcccggcctttcagccgtagccggttggtcgggctgacaggatttgaacctgcgaccacttgacccccagtcaagtgcgctaccaaactgcgccacagcccgcgcgccggcggttgcaccggcagcaagtcgaaagcctaccgtaaaggattggcttgccgggcaagcgacctcccgtcagtcaccagtgaaggacgccggcatgcccaggcaccgccgggaactacgagacgacccgcagacacgccagcaccggcgctagcggatttcgaacagcgcgatacctccagacacagcccacgccactcagcgccgccgggccccgcgcttctcccgcacccgcacgttgatccggatcggcgtcccctcgaacccgaacgcctcgcgcaggcgccgctccaggaaacgccggtatccggcctcgagaaagccggtggtgaacagcacgaaagtcggcggccgggcggcggcctgggtggcgaacaggatgcgcggctgcttaccgccccgcaccggcggcggggtggccgccaccacctccttcagccaggagttcagcgggccggtggcgatccgggtgtcccacgacgccagggcggtctccatcgccggcaccagcttggccaccgcgcggccggtcttggcggagatgttgacccgctgcgcccagcgcagctgcaccagctcgcggtcgatctcgcgctccagcagctcgcggcggtcctcgtcgaccagatcccatttgttgaacgccaacaccagggcccggccggcttcgatcaccatggacagcacccgctggtcctgctcggtgagcggggccgacgcgtcgatcagcacgatcaccacctcggccgcgtcgatggccgagtgcgtgcgcaccgacgcatagaactcgtggccgctggcctgccccaccttgcgccgcagacccgcggtgtcgacgaaccgccacacccgatcgcccagctcgatcagcgagtccaccgggtccaccgtcgtcccggccacatcgtgcaccaccgagcgctgatcgccggccagcttgttcaacagcgagctcttgcccacgttcggcttgcccaccagcgccacccgccgcggcccgccgggcctgggcgccacctcggagacctcgggcagcgcggccagcacctcgtcgagcaggtcggccaccccgcggccgtgcatcgcgctgatcgggtgcggctcgccgaggcccagcgaccacagcatcgccgcgtcggcctcggccttgtcgctgtcaaccttgttggcggccaagaagaccggcttcccggaccgcagcaggatccgggcggcggcctcgtcggcggtggtggcgccgacgagcgcgtcgaccaccaggatcaccgcgtcggcggtgcgcatggccaccgacgcctgttcggcgaccagctgctgcagccccttggcgtcgggctcccatcccccggtgtcctgcacgacgaatcggcgcccggtccacagcgcgtcgtaggacacccggtcgcgggtgacaccagggacgtcctgcaccaccgcctcccggcggcccaggatccggttcaccagcgtcgacttgccgacgttgggccgccccaccaccgccaccaccggcgcggggggcgcgtgcgccgcctcgtcgagctcgaattcgaccgcttcccagtcgctttcgtcgctccatgttccgtcgtgagtcaccgcgccacttcgcttcgctgtctgaccaggtcccgcaggtggtcgatcacctgcgcctcggtcatgtcactggtgtcgaccaccaccgcgtcgggagccgcccgcaacggcgacacccgccgggtggaatccaggtggtcgcgccggcggacgtcggcgagcaccgcctcgtagtcgtcggccagccccgccgccacgttctggtcgttgcgccgccgggcccgggtctcggccgaggcggtcaggaagatcttcaccggcgcgtcgggcaggaccacggtgccgatgtctcggccctcgacgacgatactgcctgggccggaagccatttcacgctgcaagccgaccaggcgggtgcgcacggcgggaaccgacgacaccgcggacaccgccgcggtgaccttgtcgccccggatctcggtggaaacgtcttctccgccaaggaaataacggtcaccgtcggggtgatagtccaccgacatccgcaccgcctgcgcggcgcgcccgacggcttcggcgtcggccgggtcgatgccggcgcgcaacaccgccagcgtcaccatccggtacattcccccggtgtccagatagcgcgcacccagcgcgcgcgccaatccctttgagacggaggactttccggtcccagcggggccatcgatggccaccacgacgtcggagctcacagcccgaccgcctggtagagccggcccacctcgtcgcgtcccagcgcacgaatgctgcccggccgctgcttgcccagggaaatcggcccgatgtcggtgcgcaccaacgactcgaccgggaagcccgcggcggccagcagccggcgcacaatgcgattccgcccctcgtgcaacgtcacccgcaccagcgtcttgcccgggatggggtccaccaccgcgaactcgtcgacgcgcgccatcccgtcgtccagctcgatgcccgcgcgcagcgtcttgcccagcccgcgcggtatcgatccggtgaccgtcgccagatacgtcttgggcacctcgtgggagggatgcatcaaccggtgcgcgagttcgccgtcgttggtcagcaggatcagcccttcggtctcggcgtccaaccgcccgacgtgaaacaggttcttgttgccgcgaactcgacgttcgatcaggtcgccgatgcacggccggccgcggtcgtccgacatcgtcgagtgcaccccgcgcggcttgttcagcgccagatagacctgcgactcatcgaggaccacccgggccccgtcgacccggatcaccgcggcatccgggtcgacgcgggtgcccagctcggtcaccacctgcccgtccacctcgacgcggccgtcgacgatcaacttctcggcggcccgccgcgacgcgattccggcctgcgacaacaccttttgcagccggatgccctgagcttcgaccatcaatcctggtccacgtcgaacgtcagcgccgcatcggaggcctgaccgccggagagtttgacgaaacgtggctcgctgtccagggattcgctcaagtcctcgatcgtgtcgacgtcgggaagcagcggcgcgatgtcgggcaggtcggccaacgacgtcagccccagccgctccaggaacaggtcggtggtggcgaacgtggtcgcgccggtgtcctcgtcgaccccggcctcggtgatcaggccgcgggccagcagcgtgcgcatcacggcgtccacgttcaccccgcgaaccgcgctcacccgcgcccgggccaccggctggcggtaggcgacgacggccagcgtctccagcgcggcccgggtcagcttggaccgcgccccgtccagcagcagcttctccacatagggcgcgaaccgggcccgggtgtacatccgccagccctcgctggttttgcgcaggtcgatgccgctgtcgcgggcggtgagctcgtcggccatctcctgcagcttggtggcgatccggtacaccggctgctgggtcgcggcggccagcgcctccgcggtgaccggggtgtccaccaccagcagcagcgcctccagcaccgacccgagttccccggactccatgggcgcggcctcggcgatctccgggatgcctgcctcgagctcggagtcgagatcgacgtccggcgcgttctcgctcacaattcgtcccgcacttctaccaaggtttcaccgaccggacgttccccggtccacgagatttggagcacgccaagcggctctgactgctcgaatgctaccgcccgggaccgatacagttcgagcagcgccaggaaccggcccaccacctccattgatccctcgcagtcggcgaccagctcggagaacgtcgcccactgcccgctgccccgcgcttccaggatggccagcaacttgcgcgcctgctcggggaccgagaccttcacctcgtgcaggtgccccaccgacaccgtcggaacgggccgcgggctgaacgcgaccgccgcgatctgggcgaaccgttcggcgtcgacgcccagcatcacctcgggcagcagctgggtgaaccggtcctccagcgacaccgcgcgcggatagctgcgcagggcgctggcctccagctcggcgaacatctcggcgacgtgcttgaacgcccggtactgcagcagccgggcgaacagcaggtcgcgcacctccagcagggcgaggtcttcgtcgtcgtcgacctgtccggccggcagcagccgggcggccttcaggtcgagcagggtggcggcgacgaccaggaacgcggtggtctcctccagctccagcttggggccgatctcgcgggtgtaggcgatgaagtcgtcggtgacctggtgcagcgccacctcggtcacgtccagccggtgggcgaagatcagctgcagcagcaggtcgaacggcccctcgaaattggtcaggcggacctgaaaaccggtctggggttgcgcctcaccgtttgcggtcgcgttcacgcgccgaatcggtcgatgaactcgcgggccagcgcgcggtaagcgatggccccggtggagcgcggggcccaggtggtgatgggctcgcctgccacgctggtctccgggaaccggacggtgcgggtgatgacggtgtcgaagaccaggtcgccgaagcgttcgacgacgcgggccatcacctcgcgcgcgttgacggtccgcgggtcgtaccgggtgagcaggatcccgctgatttccagcttcgggttgagccggtcgcgcaccttgtccacggtgtcggtgagcaacgccaggccgcgcagcgagaagtactcgcactcggtggggatcaccacaccgtcggagcaggccagcccgttcacggtgagcaggcccagcgacggctggcagtcgatcagcacgtagtcgtagcggtccagcaccgggtgcagcgcccggcccagcgtctgctcgcggccgacctcgttgaccagctggatctcggccgccgacaggtcgatgttgctgggcaccaggtccatgtgcttgacccgggtctgcagcagcacgtcgtcgatcgacacgcgcggcccgaccagcacgttgtggatggtcttctccagctcgtagtgcggcacacccaggcccgccgacagcgcgccctgcgggtccatgtccaccagcagcacccggcgaccgtactcggcgagcgccgcacccaggttgatggtggacgtggtcttcccgacgccgcccttctggttgcacatggcgacgactttggccgggccgtgcgaggtgcgcggctgtggctccgggatcgcccgcggcggccgcccggtcaggccgagctcgacgccgttgtccggccgctcggtcatggcgggggtgttcgggaggtgaacatcgtcggaaagtctaacgggttcgtcgcgcgaaacccggcgacccgcaggcaatcaaccagccaatatgggcggaaatcggtggtaggacgcacattccgacagcctattcactttcgccacaccagcaccagttcgggggtggggacgccgggcgaaaaaccgccgtcgcgggacccggcacggtcgccgacgcgcctatggtggcggctatggacctcaagcgacggatacccctgctgcggtggtcggtctggcgcatggcggccggggtgcagaacatcaccaccaccggccagatcggtgacggacgggaagcggccgccgtcgagtacgtgctgcgcaacgcgcgggccggcgacatcgacgacgtgctggccaccatcgacaggttcgcctaccagaaatcgatgctgatcaatgtcggcgacgagaaggggctgatcctcgacgccgcggtgcgccgcgccgacccggacgtggcgctggagctgggcacctactgcggctacggcgcgttgcggatcgcccgggccgccccgggcgcccgggtgttctcggtcgaactggccgacgccaacgccgccaacgcccgccggatctgggcgcacgccggcgtcgccgaccgggtgacctgcgtggtgggcaccatcggcgacggcgggcgcaccctggacgtcctggccaacgagcacggattcgctgccggcacactggatttcgtgtttctcgatcacgacaaggacgcctacctggccgacctgaagagcatcatggaccggggctggctgcatccgggctcgatcgtcgtcgccgacaacatccgctggccgggctcgccgaagtaccgcgagtacatgcatgtccagcagggcaagcggttcgacaccgtcgagcacaagacgcatgccgagtaccagaccatgctctccgacctgatgctggagtccgaatacctgggctgagaggcggcgcgcggcggcgagatggtcagcgcgcccgcgggtgcgcctcggcccacacctcgcgcagcgcgtgcacggtgaccatggtgtagatctgcgtcgtcgtgaccgaggcgtggccgagcaactcctgcaccacccgcacgtcggcgccgccctcgagcaggtgggtggcgaacgaatgccgcagcatgtgcggcgacacccccgaggtgatcccggcgcgctcggccgcgtcctgcagcacctgccaggcgctttgccgcgacagccggccgccgcgcacgttgaggaagatggctggcgtgccgcgcccgcggcgcgccagctcccagcggccgcgcaccagataggcatccagcgcggccacggcgggacgcccgatgggcaccaaccgctgcttgccgcccttgccgcgcagcagcaccgaccgggcctgggtgtcgacgtcgtcgacgtcgaggccgacggcctcggagatgcgcgcgccggtggagtacagcagttccagcaacgcccggttccgcagggtcagcgggccgtcggcggggctctcgccgcccgccgcctccagcagcgccagcacctggtcgatggtcaggctcttgggcagccggcggcccggcgtcggcgggcgcacggcgcgggcgacgtcgagttcggccaacccctcggccgccaggaaccggtgcaagccgcgcaccgcgatcagggcgcgggccgccgacaccgccgacagcgcggcggcgccggtgtcgggatcgccgcggcgcagcgccaccaggaactcgctcacgtcgtcctcgcccaccttggccaggtccgaaatcccgcggtccgacaggtgtttggtgtagcggcgcaggtcgcgccgatacgagctgagcgtgttcgccgcgacgccccgctcgatcgtgaggtggtcgaggtagccctgcagttgggtctccaacgccaccgtcgtcatcgcccggccttccgcgcgggaaacgccgtgggccggtcctgccacgggctgtccaccggacgcggtcgctcaaatcccgtcgtgacggcgtgggcggccaaaatccctgccacggcaatggcattgacgatttcaccgctgagcaccttgcgggcggcgtcggccagcggataccactccagggtcatgtcggcttcttcgtcgtgcgcctcgggtcggtcgacccgggtcaggccggtggccagatacacccgcaccgactcgtcgctgaagcccggcgtggagttcagatcgacgagcaccgcccaggtctcggccttcagccccgcctcttccatcagctcgcgcgccgcggtcagatgcgcggcctcgccgtggacgtcgagcagcccggcgggcagctcccacagccgccggccgaacgcgtgccggtattggtagaccatcgggatgttgccgtcgtcgtccattgcgaccacggcgaccgcgccgaaatgttcgacgatctcccgggtgacgaccttgccgcccggcatccggacctggtcgcggcgtagcgcgaaaatctttccggtgtacagcgtttcggatgacgccgtctcgaagacgtgttcagccacgggccgcgggctcaggtatgggccgcgcagcgctgtcccgatgctggatgccgttggaggactgctcggggatttccaccggaagcagttctcccgctttgtaatccatggccgccccgacgaatgcgacgaacaacgggtgcggacgggtgggccggctcttcagctccgggtgggcctgggtgcccacgatgaacgggtgcacgtcgggcgggtattcgacgaactccaccagatggccgtcgggcgatgttccggagaacctcaggccgctttcggcgatcttgtcgcggtaggcgttgttgacctcgtagcggtgccggtgccgctccgacacctgcgtcgtcccgtaggcccgggccacgatcgaatcctcttccagcacagcgggataggcgcccagtcgcatggtgccgcccaggtcggccgcgccggcgacgatgtccacctggtcggccatcgtggagatgacgggatccggtgtgtccgggtcgaattcggccgagttggcgccggccaggccggccgcgcgggcggcctcgatcacaatgcattgcaggcccaggcacagccccagcaccggcagcccgcgggtgcgggcgtagtggatggccccgatcttgccctcgatgccgcggatgccgaacccgccggggatcagcacgccgtgcacctcccccagcgccgccgcggcaccggacgcgctctcgcagtcgtcggaggccacccacaccatctcgaccttggcgtggtggaagaacccgccggcacgcaatgcctcggtgaccgacaggtaggcgtcggaaagctcaacgtacttgcccaccaaggcgattcgcaccgtctcgtgcggttcgtgcacccggcgcagcaggtcgtcccattcggtccagtcgacatcgcggaacggcaggttgagccggcgcaccacgtaggcgtcgagctcctcgcggtgcagcaccttgggaatgtcgtagatggacggcgcgtccggggtggagatgacgccgtcgatgtccacgtcgcacatcagcgcgatcttgttcttcagcgcctcgggcacgtcgcggtcgcagcgcaggatcagcgcgtcgggggtgataccgatgctgcgcagcgcggcgaccgagtgctgggtgggtttggtcttgagctcaccggacggtgccaggtagggcaccagcgacacgtgcaggaagaagacgttttcccggcccaggtcgtggcgcacctgccgggccgcctccaggaagggctgcgactcgatgtcgccgacggtgccgccgatttcggtgatgacgacgtcggggcggttgccctgcgcgtccggctgggccatcgccaggatgcggcccttgatctcgtcggtgatgtgcgggatcacctggacggtgtcgcccaggtattcaccgcgccgttccttggcgatgacggtcgaatacacctgtcccgtagtgacattcgccgaaccggacagatcgcgatccaggaaccgctcgtaatggccgacgtcgaggtcggtttcggcgccgtcctcggtgacgaagacctcgccgtgctggaacgggttcatggtgccggggtcgacgttgaggtacggatcgagcttttgcatcgtcacgtacaacccgcgcgccgtcagtagctgaccgaggctgctggcggtcaatcccttgcccaacgaggatgcgacgcccccgctgacgaagaggtgcttggtggcggtttgcgggtgctttcgcacaggcgacctccgtgaagacgggcagggcgtcaaaattgttctagcgaatcactagctgggcctgccgacccacggaaacccaccctaacatccacggcgccacgccgcggggaacacgcccgctactgagcgaccgtgatcgacgtggcgccgtgaccggtgccgtactgcccggggtggccgccgttcatcaggtcgtgcaagccgaggacggcggtgatgcggcccggcgcggcgtcgacgttgtcgacggtgctgaccgcggagttcatcccggagtcggcgcgggtcacggcgacggcggcgcttccggtcgccgatccgtcgcgcccggccagcaacgtggccgagccgtgcggggccagcgcggccgagaaccgggccacgctgacgccctggttgccggcgtcctggggtagcgcgccgccggtgacgaccagcgcggcgttggccgcgcccaggtggtcgccgccctggtaggtgatgaagccggtgtcgcgcagcgccgcgagcacggtgttgcgctgggtctcggagacctccggcggcggcgggccggccggggtggcgttggtcaacaaggcgattcccatcaggtcgcccgcctgcgagccctggtcgacgagcttggtgctcagctgctggccggcgggcagcaccgacgagttgaccaccgtctgcagcttctccgcggaattggcctcgacgaattcctgggtcagcgccaccgtcgtggtcaccgtcccgccggcctgggcgatgaacttcgacaccccggccacgtcgtcgtccttggcgtccggggtgcgaaacaccaccaccgacttgccgcccagcgcgtcgtgcagcatccgaccggccagttgggtgtcgaaattgtttgccgcgctgagcttttcgttcagcacattcttctggtcgttgagcccgttgatctgggtgtgcaggtcgcgcttctcgtcacgcaggctggacagcaaggtgtcggacaggaagccggagcccagcaccactcccacggccagcgccaggaagacggcggccagcgacagggcgtgttggcgtagcgagatcatctaggtgacccacttctgcaccatcagcgagaagtggttccagtagtcggtgatccagtgcagcaccacaccgtcggtgcgcgacacccatagcgcgacgatgacggcgatcagcatggtcagcgccagcagcgcgatggcgcccgccgagatgtggttgcggtacagggtggcgacggccttggcgtccaccaccttctcccccacccgcagccgggtcaggaaggtggacgggttgctgtgcgcgcgggtgcggtcgaagaacgtctcgatgttggcggtgtggcccgccgtcaccagcagggcggcgccgtggtgatcggccagcagcagggccaggtcgatggccgagccggcggccgggaacgtcatcgcccccacgcccaggtcctggatgcgttccagcccgggggcgtgcccgtcggcgtcggcgggcagcaccacctgggcgccgcacttgagcgcgtcggcgctgatctggtcgggatcgccgacgatgatctgcggccgataccccgccttgcgcaacacatccgcgccggtgccgaccccgatcagcgccggctggtactccttgatgaacggcttgagcgacttgaggtcctcttcggcgctgggctcgtcggcgacgatcaccacgtgcctgcggcgcaggtcgacgtcgatgtcggggatgccgatgccgtcgatcagcagcgggctctcgctcttgatgaactcgatggtgttgccggcgaacgcctcgaggtgggcggccagcccgctcttggcctcgcgcatcaggtcggcgatgtcgtgctcggtgcgttcggtgccgcgcaccagccggcggtcgccggcgtacaccccgccgtcgtacaggcggatcttggcgccgtctttgaccttcttgaagatgtccggcccggcctcgtcgatcagcgtcaccccgttgttgaccagcacctccggccccaggttggggtagcggcccgagaccgacggggaggcgttgaccacggcggcgatgtcggcttccaccagggcgtcggcggtgatgcggtccaggtccaggacgtcgagcacgacgatgtcgccggggcagacccggcgcagcagtcggtcgatgttccggtcgacgcgggcggtgccgacgattccgggccggtcggtgtttcgggaaagcaggcctgacatcttcatgggggcgattctgtcggtgaagcgtcggcgaggtcgggaggcgcgccgtaacatcagcctcataagttatctagagtcccattcgtcacaggtaggtgccgaaccggtcacgaacgtcgactcgatgcgggacatggggcccaaggacgtcaacaagtcgacgctcgccggggaaaggtgccggaaaggtgccggggaggtgccggggaggtgccggggaggcgcaccgtttagatctcgtccttctgggcggcgtcgagcagctcgcgggcgtgcgcgcggccgctgtcggactcgccgagcccggccagcatccgcgccagctcggccacccgctcgtcgccggtgacccggcgcaccacgctggtcccgcgcggcccggcgccgtgcaccaccaggtgcacgtcggcgtaggccgcgacctgcggcagatgcgtgacgacgatgacctggtgggtgcgggccagccgggccagccgccgcccgatctggaccgccgcccgaccgcccacgccggcgtccacctcgtcgaacaccatggtggtgccgacggtctccttgcgggaggcggccagcaccacttcgagcgccagcatcacccgggacagctcgccgccggaggcgctcttggccagcggcagccgatccatcccgcggtgtgcggcgaagccgaactcgacctggtcgatgccgtcggcgccggcccgcacccgctcgcccgacggcagcgtcagcaccgccgcatcgtcggagccggagccggcgggcacgacgtcggtgctcacgtcgatgctgaactgcgcgtcggccatcgccagcccggacagctcggcggtgacctccttggccagccgcttggcggccttgcgccggatggtgctgagatccgctgcggccccggccaattcgcggccgagctcctcgacgcgggcggccagcgcgctcagaccctcctcggagacgtcgagttgggcgagtcgctcccgcgactcccgcgcccaggccagcacgccgtcgatgtcggcggcgtacttgcgggtgaggccgcgcagctcggactgccgggccagcttggcttccagcgcactggcgtcgaccggtagttcctccaggaaaccggccagctcgccggcggcgtcgaccaccacggtcaacacctcgccgatctggccggccaacgccagcagcttgggatcgtcggtggattccagtgcggcccttgcctttccgagcgtgtcgacggcggacagaccggagccgtcggcgtcgtcggcggacagcgccgcgcgggccgcggcggcggcctcgcgcagggtgtccagttccgagagccgcatgatctcggcgaccagggcgtcgtcctcgccgggttgcgggtcgacggcgtcgatctcgcccagcgcgaaggtcagccggtcggcctccagcgcgagttcgcgcatccggttgcggcggtcggcgaggtcgcgtcgcgccgacagccaggcgtcgcgcagcttggtgtagcgctccagcgcgggcccggccttggcgaaccggtccagcgcgccgcactgctcctcgggccgcatcagtcgcagctggtcgttctgcccgtgcagggtcagcagttctgcggtgaagtcgcccagcgatttggcgggcacgctgcgcccgcccaggtaggcgcgcgacggcccgtcgcggttgaccgagcgcagcgcgatcacgctgccgtcctcgtcgcgttccgccccggaggcgtccagcatctcgtccagcctgaccaccagggtttcgtcgagatccgttgtggtgaaacggccttcgacgatcgcccggtcggcgccggagcgcacccgggtggcgtcggcgcgggccccgccgagcaggtgcaggccggtgaccaccatggtcttgccggtgccggtctcgccggtcagcacggtcaggccgcggtcgaactccccgaccgcggcgctgatcgcccccagtgactcgatgcggatttcggtcagcatggcagtcgcaatcccgttcgcgccgtcagttgccgcgccacccggtcaccggaagccggaacttgcgcaccagccggtcggtgaacggggcgctgtccagccgggcccacttcaccgcggtgtcacaccgtttgacctcgatccggctgccggccggtatcagcatctcgcggcgaccgtcgcagaacaccagggcgtcgtggccgtcggcctcgatctcgatcgcgatggtggcggccggactggtgaccatgggccggccgaacagcgcgtgagcgttgttgggcaccaccaggattgcctccaggtcgggccagagcaccgggccgcccgcggagaacgcgtacgcggtggatccggtgggcgtcgacaccagcacgccgtcgcagccgaaggccgacaccggccggccgtcgatctcgaccaccaccccgagcaccccgagccgcgggcctttttccaggctgacttcgttgagcgcccagccgtggtcggacaccgtgccctgatggcgcaccacgacgtcgagcgtcatccggttctccacccgatagtcgcgcgccacaacgtgttccagcaccttatcgatcgcctcggcttcggcctcggccaagaaaccgatccggccgaggttgacgccgagcaccgggatgtcggcgttgcgcgccaattccgcggcccgcagaaacgtgccgtcgccgccgaggaccagcaccagctcgcagccgcgggcggccagcgggtcggcgtcgaccacctcgatctcgacgcccatggcccgcatgtcgtcgggcgccaggtgcagcggcccccggtcgaccgcctcggcggacagcacccgcagcgcaatcccgttgtcgcccagcaccttctgtactcggcgtgccgtctcggttgcttcttcgcggccggtgtggaccaccatcaggacggtgcgctcggcgggggtcactgcggtccgctttccaccgcgcgccgcaccgcgcggcacagcgcgtcgccggccagcgggcggtcggtgcgggcgcgcagccgcaggaagtattcgacgtttcccgacggtccgggcagcgggctggcggtgacgtcgacggggtgccagcccagctcgtcggcgcgccgggcgaccgacagcacggcctgcgcgcgcaattcggggtcgttcaccacacccccgggcccaacctggcccttccccacctcaaactgcggcttcaccatgggaacgatatccgcgtgcggcgcggcgcagccagccagcgccggcaacaccgtgcacagcgagatgaacgacaggtccgccaccaccaggtcggccggcccgccgatcgcctccggtgtcaggtcgcgcacgttggtccgttccaccacgaccacccgcgcatcgctgcgcagcgaccaggccagctggccgtagcccacgtccaccgcgaccacctcggccgccccgcggtccagcagcacctcggtgaacccacccgtcgacgcgccggcgtccaggcagcggcggcccgccaccgcgatctcgaaggcgtccagggcgcccagcagtttgtgcgccccgcgggacacccagccgcgttcgccgtccgcggcgacggtcagggcggcggtgacggcgacggcggtgcccggtttgcgggccggcatcccgtcgatgctcaccttgccggcgccgatcagctccgcggcctgctggcgcgaccgggccaggccgcgccggaccagctcggcgtcaacgcgggcgcgtcgagacatccgcgcactcagcccttctccgccgactccagcgcggccagcagcacgtcgtgcgcctcggagagccggcgtgcgatctcttcgagttcgtcgagcgagggggccttgtcggggtcttcggtgtccccgggctggggcagccgggccagcaaggcgtcgatttcagcgcgaatctgatcgggatcgatactcatcgcgttaccacgctagtcacccgctagtcggtgcgcaccaaagaccagcgcgccagcgcggcgcgggcccggtcgtcgccggcccggatgggcagcgtaccggcgtccggcgagccccagaccgcgctggcgaccgcgcggaccaccgacagcccgtcgcccgacccgtcgtcgcgtccgtcgccgctgaccgtgatggccgtgtcgccgacgtcgacccgccagcccggctgcggcgccaccgccagcgccgcggcgtcctggtgcagggcgcgcaggtcgtggccgatgtaggtggggcgccgggcgggcttggcgtacaccgcgtctcgcgccgagttgaccccggtgagcaccagcaggctgggcagcccggcggcgttggcgccctcgatgtcggtgtcgaggcggtcgccgatcaccagcggcgcgcggaagtcgccgcgggccgccgcgtcgcgcagcagcgccggcgccggtttgcccgcgacctgcggggtggcgccggtggccgcggccactgcggccaccagggatccgttgccgggcagcagtccccgctcggtgggcagggtgaggtcgatgttggcggccacccacaccgcgccggcccggatggccagcgccgcctcggcgaggtccggccaaccgatggtcatggacaggccctgcacgacggcgacggggccgtcgtcgtatcggcgcaccgggcgcagcccgacggccgcgatctcgccggccagtgcctcggtgcccacgatcagcaccggcgcgccggccggcagctggccggccagcaggtgggcggcgctctgggcgctggtggccacgtcgtcggcggtggcggtgaagccgagctcggtcaggtgcgcggcgacctcggcggcgctgcgggatgcgttgttggtgacgaacaacgcgcgcccgggcagcctcgccaacgcctgcaccgcgccctcggtgggcgaacgcccgcgaaacgccgtcccgtccaggtcgatcagcaggcaatcatgttgctgcgcaagggttttcacgccggacacgtcaggcgagttcactgacccggtcttcggcgtcggtgacgccgtcgaggtcggcggccgcggcgtgcaggaaccattgcagcgcctcgtcgttgcggccgagcgccagcagcgtgtcggcgtaggcgtagaacagccgcgccgccgtggagccggtgcgggtcgaatccagttgcggcgtggacaaaatggtcagcgcctgctccagctggccgaggtcggcgcgggccccggcggcgacgatgcgcaactcgtcggcgtcgtcgccggacagctcggcggcctccggcccgcgggccagctcgatcgcgcgctccggacggccgagtccgcgttcgcaatcggcgatcagggccagcagcgcggacttgctgcccatccggcgggcggcgcgcaactccgccagcgcctgggcccaatcgccgcagtggtaggcggcgatgccgaccgcctcgcggatggcggcgatccgcgacgaccgggcccgcgcggcccgggcgtggcgcaacgccgcctccgggtcctcgtccagcagctcgcccgcggcgaccaggtgccgcgccaccgcgtcggcggtggcgcggtccagggtgctcagctcgcggcggatgtcgggggccagctgcttggcctccacccccggcggtatcggcggcccgtcggccgccgcgcggtcgggcggggcaccccgacgcgccggggtctgcggctgggcggggcgggcacgacccgggccggaccacgacgccggtcgggtccgccgttcgccgcgatgcgggtgcctgtcgtcgaccacgctgccgagaatacgggccgccccgcgctcaggatgccagccggttaccgagcagcggcgcgatcaccgccgggcagtaggtcgcgatcgccacgatggtgaacctgcccgcggtctcgtacgacattccggcgcgctgcgccatgtcggcggtgaccgcgtcgaacgagccgccgggctcaaaaagcatcgggcacaccgactgtcccatcgccatggtgctggtcggttgggtgtaggcgatcccggcgttggtcagcgccgacaggaacgcgttgcccagcatgtcggcgcggatcggcgccgacagcgtcccggccagcgccgccagcccggcgagcacccccacgatcagtccggtcaaccgcacccgcctcgcgaaaatcaccgtgaccacagtgctcggccacggtcacgtcgacgacacggtgaggtaaagattgtgcacacgtacgcgttttgcgcggccgtcgggccggcggtggtctacagcttttccaccccggcgatggtgcgcttgccgcggcgcagcaccagccatttgccgtgcaggaagtcggacggttgcggcgcccagtcctcgcggtcgatgcgcacgttgttgaccgagacgccgccctcgccgagggtgcgccgggcggccttgcggctctcggacaggccgctggccaccaacaggtcgacgatcccgtcgggcgcaccgggtttgagctcggcgaccgacgtctcgcgcagcgccgccgccagcgtggctgcgtcgaggcgctccagctctccctgcccgaacagcgcccggctggcgtgcttgaccgcttcggtggccgcctcgccgtgcaccagcacggtcagctcgcgggccagccgccgctgcgcggcgcgctgctgggggcgctcggcggtggcccgctccagctcgcccagctcgtcggcgctcaggaaggtgaaccagcgcaggtagcggatcacgtcggcgtcggcggtgttgaagaagtactggtaccacgcgtacggcgtggtcagcgcggggtcaagccacaggctgccgccgccggtggacttgccgaacttggtgccgtcggcggcggtcaccagcggcaccgtcagcgcgtgcaccgtcgcgcccagcttctgacggaccagccgcaccccggcgatgatgttgccccactggtcggacccgccgatctgcagcacgcacccgtagcgccggtgcaactcgacgtagtcgttggcctgcaacagcatgtagctgaactcggtgtaggagatgccgtcgccctccagccgccgccggacggtgtcgcggtccagcatgacgttgaccgagaaatgcttgccgaggtcgcgcaggaactcgatcgccgacagttggcgggtccagtccaggttgttgacgacgacggcgccggtgtccgattcgtcgaagtcgacgaaccgctccagctggccgcggatccgctcggtccactcggcgacggtgtcggcctcgttgagggtgcgctcgccgacgtcgcgcgggtcgccgatcatgccggtggcgccgcctgccagcacgatcgggcggtggccggcgcgctggaaccggcgcagcgccagcagcggcaccaggtgtccggcgtgcaggctcggcgcggtggggtcgaagccggcgtacacggtcatcggccgggcttcggcggccagcgcgtcgaggtcggtggactgcgcgatcaggccgcgccagcccagctcgtcgaggatcccggaagacatcgccgccgactttagtcgctggtcccgggggcgggcgcccgcggacttcgccggtaggccgacacctccgggcgcccgggcagccacagccgccacggccggtcggcggcctggctgaccccgacccgcggcccgcacaccgcggtcagcggctcgtgcagccgcagggtcaccggcgagtccgggtcgaaaaggtcgattccgttgtccgccatggtgattcccatggcggcgcacaggttgcccgggccgcgggccagcgccgcggtgtgcaccaactcgccgcggcggccgcgcgcgacgtcggtgccgtcctcgagggcggcggcccgcagcagcacggcggcggcggtcccgtcgggcccgcaggacacgttggcgcagacgtggatgccgtggctgcggtaggtgtagagccgcccgggcgggccgaacatgacgaagttgcgggcccgcagccccttgtaggagtgcgccgcggcgtcgggccagggcccgtcggggactcccccgtacgcctcgacctcgacgatgaccccgctcacgccccgtccggtcagggtggcgcccagcagccggcgggcagcctcgaccgggtcgaccagcagctgctcggcagcgtcgcgcaaccgtcgtcccgcctcgaccacgtcagatccctttcagcaacccaacgaacctaccggcagcccgaacatggcaatatcccggtgtcccgggaccccaaggagcccacatgcacggaatcgatccggccgccacggcctggctgctggccagcaccgcgctggtgttgctgatgacccccggcctggcgatcttctacggcggcatggtccgcaccaccggcgtgctcaacatgatcatgatgagcttcatctccatccccctggtgaccgtggcctggttgctggtcggctacacgatggcgttctcccaggacgggatgagcgggctggtgggcaatctgcggcatttcgggatgctcggcatcactcccgacaccacccacggcgcggtccccgaattgctgtacgccactttccaattgacgttcgcgatcatcaccgcggcgctggtcagcggcgcgatcgccgaccgcgccaagttcgccgcctggatggttttcgtcccggtgtggacggttgcggtgtattcggttgtggcgcaatgggtctgggggccgggcggctggctggcccggctgggcgtgctggactatgcgggtgggctggtggtcgagatcgtctccggcagctccgcgctggccctggcgctggtgctcgggccgcggatcggcttcaagaaggacgccatgcggccgcacaatctgccgctgctgttcgtcggcgtcgggctgctgtggttcggctggttcgggttcaacgccggatcggcgttggcggccaacggaaccgccgcggccatcttcctcaacaccctggtggccggctgcctgggcatgctgggctggctgtcggtcgagcagatccgcgacgggcggcccaccacgttcggcgccgcctcgggcgtggtcgccggcctggtcgccatcaccccgtcctgcggcaccgtcaacacgctgggggcgacggtggtcgggctggcggccggcgtcgtgtgctcgttcgcggcgggcgcgaaactgcgcttcaactatgacgattcgctcgacgtggtcggtgtgcacttcgtcggcggggtggtcggggtgtcgctgatcgggctgttcgccaccgcggtcatgacggcgggcccgcaggggctgttctacggcggcggcgtggcccagctgggcaagcaggcgctggcgatcgcggtggtggcgctctacgcgttcaccgtgtcgttcctgctggccaaggtcatcgaccgggtgatgggcttccgggtcagcgccgaggacgagaccaccggcgtcgacctgacccagcacgccgagaccgcctacgccgagggcgtgcacggtcatctgccgcagcgccgcccgggccccggcgaccggttgaagtagccccgcgcgacggtcgtcggcgcccgcataaccccgtccgcagtaacacctttcgcggggcctggaccaaagtccttgacaacgccgatgcgcgggacgaatattcatcacatgatgagttcatccggtgatgaattaatcggcggggccgaaccggcggtgcgcatcgagcacctgcgggtggtccgcggcaaacgcccggccctgcacgacttctccgtgcagatcgccaagggcagcatcaccgggctgctcgggccgtccggttgcggcaagaccaccctgatccgctgcatcgtgggcacccagatcctcaccaagggccgcgtcacggtgctcggaaaacccgccggcagcgccgagctgcgccaccgggtcggctacctgccgcaggacccgaccatctacaacgacctgcgggtggtggacaacgtccgctacttcgcggcgctgtacgggttcgacggccaggccgccgacgccgccatcgaccgggtggggctgaccgatcatcgaattgccttgtgcggcaacctgtccggtggtcagcgcacccgggtgtcactggcctgcgcgctggtgtgccggcccgacctgctggtgctggacgaacccaccgtgggcctggatccggtgctgcgcgccgacctgtgggatcagttcgccgcgctggcccgcggcgggaccacgctgctggtgtccagccatgtgatggacgaggccgaccactgcggcgacctgctgctgatgcgggaagggcggctggtcgcccacaccaccccgaaccgactgcgagaggacaccggatgcacgtcactggaggacgcgtttctgtccatcatcaagcgcagcaccatgcgcgaagccggctgacgctgcgcggatacaccgcgaccacgacgcggatcctgcgccagctggccggcgatcaccgcagcgtggcgatgatcctgctggtgcccgtgctggtgatcaccctgatgtttttcatgttcgagaacgccccgcaccgcccgggcgggccgaccccgttcaacaacgcctgcctggtgctgctggggctgttcccgctgttcgtgatgttcatcatcacggcgatcaccatgcagcgggaacgggcgtcgggaacgctggagcggatcctgaccaccccgttgcgccggctcgacctgctcatcgcctacggcaccgcgttctccatagccgctgcggcgcaagcgatcctggcgtgcaccgtgtcgttctggttgctgggcttcgacaccgcgggcagcccggtgtgggtgttcgtgatcgcgatcgtcaacgcggtgctgggtgtggggttggggctgttgtgtagcgccttcgcccgcaccgagtttcaggccgtgcagttcattccgctggtgatggtgccgcagctgctgctggccggcatcatcgtgccgcgggcgctgatgccacactggctgcaatggatcagcaatgtgttgccggccagctacgcgctggaggccctgcaacaggtggggacgcacccggagttgaccttcatcgcggtgcgggacatcgtcgtggtgctgggcttcgccctggcggcgctgtgcctggccgcggcgacactgcggcgacggacgccctagcgtgacggacggccccgcgtgacgaccaccggcacgccgcgacgccgccgcggccggccggccgggtcctccggcagccgggagcggatcctggccagtgcccgggagttgttcgcccgcaacggtattcgaaacacctcgatccgtgcggtggccgcggcggccggggtggactcggcgctggtgcaccactacttcggcaccaaggagaagctgttcgccgcggccgtgcagatccccatcgacccgatgcaggtgatcggcccgctgcgggaggttccggtcgacgacctcggctacgccctgccgtcgatgttgttgccgctgtgggattccgaggtcggcgcggcgttcatcgccacgctgcgctcgattctggccggcgaggagatcagcctgttccgcaccttcatccaggacgtgatcggcgtcgaagtcggcccccgcgtggacaacccggcgggcagcggggtgatccgcatccagttcgtggcctcgcagctggtgggtgtggtgatggcgcgctacatcctggaactggagccgttcgcgtcgctgccgcccgagcagatcgcggcgaccatcgcgccgaacctgcagcgctacctcaccggggatctgccggacggacttgcgccatgagccgggcgtgctcctcgtcgtcgacgtcgcgggcctcgtccatgagcaacaccgggatgccgtcctcgatgcggtaggcgcgccgcagccgcgggttgtacagcagctcctggcccaccagcacgagcggcccccgatcggccgggcacaccaggatgttcagcagcgcctcgtcgatcatgaccggccgccgctcagctcggcgcgcgcggcgggcgtcagccggcggtactgcccggattcggcgtcgaaataccagacctggcgtcccgccttcgggatcccggcggcccgcagcgcgctgacggtgggacggtacgtcgcgctgaggttcatttccggcaccacgcacacgatgtcggggcccagaccgatcgggatcttggcgcaggcctcggtcaggtcggccgcggtgatggaggcgcccggcagcagcgtcaccgccgacaccgccacctcgtgcccgcccaccggcacgttgtaggtcaccgccaggtcgacgccgttgatgcacccgagcgcgtcggtgaccggctcggcgtagaccacgccgcgcggggtgtgcaccaccgacccgcgccgaccggccagccagtagtcgccgtcgtcgtcgcggtagaacaggtactcggtcgatatccaggtgtcgccggcggcgaacacgccgcgtttgaccgaggcgctggggtcgatcgggccgttggaggcggccagcagcacccccacctggtggggttcggcgatctgcacgaagccccggtcgttctccaggatcaggtcgtgttcggtgtcgtaggcgcccagctcgatgcgcccggcgccgggcagcggccggcccttgctgcccaccttggcaccggagacgttggccagcaccgcctgcccgtcggtggtggcgaagaactcgacgacgtgggccggcgcgaacgcctcgaccacgcgcccccacagcccggtcggcatgccggagccgatgaacagccgcaccgggtggttgccgtgcaacacgaacgcgggatcgtcgacgatctcgcggagcatggcccaggtgtaggacaccacggtgacgccgtactggcgcacctcctgcacgaagcggtcccggtccaggccgcgcgacagcgcgatgcgggtgccgccgaccaccgcgccgcccaggctgaccagcagcgccgactcgtggtgcagcggcgtcaggcagtacacggtgtcgcggcggtccagcgcggccgtcgacgcggtgccgaacgccgacaccgcccagcggtagttggtgatctgcttggccaccagctcgccgccagcggcgctgaacgcgatgaacgccagatcccgggccagccccgggttgggccggtaccagccgggcagctcgaccgcgtccgggtcgatcttctccatgtcgatgacgtacggctgctcggcggagtcctcgggcaggtgcaggtcccgcgcctcgccgccgccgagcaccagcacctgccgcagcagctgccggtccgaggccagcaccgactcgaggttggtggggtcggtcaggatctcggtggcgcccccgagccggaccgaggcggccaggtcggcgtcgggccgcatcaccaccgcgatggcgccgagccgggacagcgcggcgatggccaccagcgcgctgggccgcgtctccatcagcacaccgacccggtcgccctggcgcacccccacctcgatcaggccacgcacgacgttgttgatgcgccggttgacggcctcgtaggtgtgcacccgcccgtcgaacagcaggaattcgccctgcggggcgtcgtgggcctgctcctcgatgatgcggcccagcgagatccgggtgtggtcgttgatctggcccaaccggaccagccggggcagggtgcgggcggtctcgacggccagggtgcgcaccgacttgttggcggtgacgaccgcgttggccgcgccgcgcaccagcccgatcgccgcctcggaggcctcccccagctcgtgcgcgatccgcgagctcagggccaccccgctgtcggtgtgctcggccggctggtccgccatcgggtcgatgccggtgggtttgtcaccgccggtggacagccatttcacccacgcggccacggtcggccagctgtgctgggccgccttggagccgaccaccaggccgaagtggccggtgcggatggtgcattcgtagacctcggcgtcgggagccgcgcgccgaatgccgcgcaccgaggcgggctgcccgatgtcgtcgacctcgccgacgaaggccagcaccggacaggtgatgtcggtgagggtgaccatctggccgttgacggcgaacccgccggtcatcatccggttgtgggcgatgaactgcttgagcagctcggagatcgcggggccggaccaggcgatccatccctcgcgctcgaggaaccggcgctgctgctcgcgcggcagcagcgcctcccggtcgtgcagttggcgcaggaagtccacccgcgccttggcggttttgagcgggtcgagcatctgaaagccggtgcgcgccatccagctggggatggccagccggctgaacacgtggtcggccatgaagttggccgcgggcgcggcgaagttggccgggatgcccatcggcagggcggccagggtgtccaccggcgaaccgaacgtgacgatgctggccagactcttcgaccgccggtaggcggccacctggtagcaccacatgccgccctgcgagtagccgaccaggtggatgtcggcgccggtgacgtccttgacggtgtcgatggcctggctgagcgcgacgatgtggtcggtgagggtgcggcgcatcccgccctccaccttgtccggttcgccgaagtcgatcacccagggatcgagcccgtgcgcgtgcaggatccccaccgccccctcgtcgcgggtgacgtcccacatgtcggccgacatcatcatcgggtgcaccatcagcaccggcgggccgaccggcggctggccgggccggctgtccggcgggaagtagcgccgaagcttgtacatccgcacgctctcgacgatctgcgacggcgacgcgaccgtgccggtttccaatcccccagtcgcaagacctccagcccgttctgcgccgtggcgatcagccgcccgaccggtcgcgtgaccatcgacaaattgagatccaccgccgctccctgagtcttgacagcttgcacatcatggcacatcgggccagctagaagggcggtggtcggcccgcatcggcgacccgggcgaatcgccttccggcggcgcggtcggcgaccgtgcggtgctgcgcggaaagctcatcgtggtgccggcgcggtggttcgccgtccggcaaccggcactcagccgtggaagccgggatcctggcccccggggttggggcaccacatcaggccgcactggacgttgcccggattgtcgcccggcgggttgtcgccgtcccacgcgttcgagctctgcagcgtctgctgaccgttgagcgcgatgcgcgggacgttgccccagccgtcggggacgacgtaccaggtgtggcacacgtttatgtcccagacgtagttcaggtgaccgcgcgaggagttcgggccgctcggccactccatggactgccccgggcaccaggtgaacgggcccttggtggcgtgcgcggccccggcgcccagtcccagcccggcggcggcgacgccaccggacagcagcgccccggcgatcatcgcgttgacgatccgaaaccttgacatggccccacgccctttcccggacgggattaccggtgccgaccagtattcgccggcaccgcatcccccgcatggctaatcggctaactcgaatcagtacagacgggccgggccgctaccgatcccaacgacaaccgatgacacgggtcgccggcgggccccgtttgcacccccggggacgcgggtacacagccgacgcgcttcggtcacgacgcgtcgtcgagaccacctcggttgaaactcacagctgggcgctcaccagttctctgggcggcttccgcggccgttaccgacggtgccggggccggaggctgcgtgcggtccattccggcggaggcgaggcggcgtcatgacgacaccggtttttcccggccaccatccccacggcatcacccacgcggccgcgcggtcatcgcggcacaccggcgggtgaccggccggcatcacgcgagcgagaaagggagacacatgttgttgctgggcaacggcggacggcgcagggccgccggcggcgacggcctcggcgaggtacagcagctggccgagcgggcgctctacgacgtcgcgcacggccggttcgaacgctcgctgtccgggctgaccgcgatggcggcgctggtcacgacggccgagatctacttcgagcactacaaggccagcttcggcaacaaatggatgtggagcccgatcgtggtgaccccgccggtcgtggtggccgggatcggcggggtgttctcccggcgctgggccaaggtctggctgcccatcaccgccgccgtctacaccgccaacggcctgatgggcgaatacctgcacgcccgcggggtggcgcgcaagccgggcggatggaagcacgcgtcctacaacgtgccgatgggcccgcccatcgccgcccccgggttgatgtgcatggtcggcgggatggggctgctggcctcgatcctgcgccgcgaacggttccggcgataggcagccgatggccgacacctctcgccccgaccacctgcccaacctgcgtgacgacggcaagccaccgcacccgtcctggctgccccggcaacgccgcggcaccacaccgcagatgatcgggcgctaccccgatttcgacgtgctcgagaccgcgggccactgggacgaggccacccgcaacgtggtgctggcccggctggaaccgccggggccgctgcggtttttcggccccgaggaggagccgtgcctgcgcgcgttctgcgacacggtgctggcccaggacgtcgagccgcgggtgccggtcgccgagtcggtcgacgccaagctcgccgacggccgcctcgacggctaccagtacgccgacatgcccgacgaccgcgacacctggcggctggtgctgcgcgggctggacgagaccgcgtcgcgccgatacggcgccggctcgttcgccgccgccgagccgcagacccgggaggcgatcatcgaggaattctcccggggcgagctgcacggcggcagctgggacagcctgaacgtcaagcgcgcatggtcggtgtgcatgcgaatgacgttgtccggcttctattctcacccgtgggcgtggaacgagatcggtttcggcggcccggcctacccgcgcgggttcatgcgcctcggcggtgccaccgggccggcggccgcgcgggagccgtacgagacccgcggcgccaccgacgaagacccggtgcaggtcgtgcagaacggcgagctgtgatgggcgacttctggcgcggcctgctcaagggggccgtcggaccccgggacaacgactcccgcttcctgctcgacgtgcattcgcgcgacctgcccggcgaacggaccatgcgccgctacgccgacgacgacgaggtcgacctggtcgtggtcggcgccggcgccggcggctcggtgctggcgcagcggctggcccgcgccggctggcgggtggtggtcctggaggccggcccgttctggcaccccgacgaggactgggtgtccgacgaggccggctcccatccgctgtactggacccagaagcgcatcatcggcggcgccgacccgatcgagttgggcaagaacaactccgggcgtggggtgggcggctccatgatccactacgccggctacaccccgcggttccatcccagcgacttcgccacctacaccctggaccgggtgggggccgactggccgatccggtacgaggacctgcgccgccactacgagcaggtcgagctggagctgccggtggccgggcagaactggccgtggggcgatccgcatcgctattcctttgccccccaccctatttcgggtgcagccgccaaactgtgggagggcgcgctcaagctcggcatcgagatgcgggtggggccggtgggcatcgtcaacggcaccttcggcaatcgcccgcactgcatctatcgcggctactgcctgcagggctgcaaggtcaacgccaaggccagcccgtacgtcacgcacctgcccgacgcgctggcgcacgacgtggagatccgcgccaactgcatggccgcccgcgtcgaactcgacggcagcggcgccgcccgcggcgtggtctactacgacgaggcgggcggcaccgaacggctgcagcgcgccaaagtggttgccatcgcggggtattcgatcgaaacgccccgcctgctgttgaactcggtcagcgaccgcttcccgaacggcttgggcaacaacgacgaccaggtcggccgttatgtgatggtgcagggcgccacccagtcggcgggccggtggtcggaggaggttcggatgtacaaggcgcctccgccggaggtgacctccgagcagttctacgagaccgactcctcgcgtgggttcgcccgcggcttctccatccagacggtgtcgccgatgccgatcggctgggccgaacacgtgctggccgacgggcactggggccgggcgttgcgggagtacatgcgcgactacaaccactgggcgaccatcggcgtgctcaacgagctgttgccccagccggacaaccgggtgacgctggcggacgagaaggacccctacggcatcccggtggcccggttcgactacacgctgtgcgacaacgacaaggccaacatggcctactccaccaacgtgatcggcgacatcctgcgcgccgccgacgcccaggatgtgctcaccatcgagcggttcgcccacctgatcggcggcgcccggatgggtacccggccggacaactcggtggtcgactccgatcaccgggtgtggggcgtgccgaacctgcttgtggccgacgggtcggtgtgcccgacccagggctcggccaatcccgcgctgaccatcatggcgttggcctcccggctggccgagcggttggccgccggcaagatcgacaccgccgccggacggaggtcgaaggcggcggcccgtggctgagcagaccgtcgatgccgggaccgtcttcgcgccccgggtgctgcgcgagtacgcgctgctcgccgacggcgaacggggcgcgctgatcggcccgcagggcgacgtggcgtggatgtgcgccccgcgctgggaatccgacgccgtgttctccaatctcgttgggggcggcggggtttacgcgatcaccccgaccgacgtgcggcacgtgtggggcggctactacgagccgggcacgctgatttggcgcaaccgctggatcacccgcgacggcatcgtggaatgccgtgaggcgctggcctttccgggcagcccggagcgggtggtgctgctgcggcgcctggtggcctgccgcggcacggtgcgggtacgggtgctgctggccccggctgccgagttcggaaagcacggccccgggcggccccggctcgacgacgacggggtgtggagcggacggtccggccggttgcgctggcgctggctggccggctgcgacgcccgcccggtcgattcggccggccacggcgccggcgaactgctcggctgcgagatcaccctcgacgagggcggccggcacgacctggttctggagctgtccgaacgcaccctgcccgagcgactccccgaccccggcctggcctgggacgccaccgcggccgcctggcagcgcagcgtgcccgcgctgaactgcaccatcgcgccccgggacggccggcacgcgtatgcggtgctgcgcgggctgaccagcagcagcggcggcatggtcgccgcggcgaccctcggcctgcccgaacgcgcgcacaccaaccagaactacgactaccgttacgcctggatccgcgaccaggtgtacgccggcatggccgccgccgcggtcggcaccaccgaattgctggaccgggcagtgggattcatcggcgcccggctgctcgaggacggcgccgacctcaaacccgcctacaccgtcaccggcggcgccgtgcccggcgaagagaccctcgacctgcccggctaccccggcggcaccgacaaggtcggcaactgggtcaaccagcagttccagctcgacgtgttcggcgaggcgctgcagctgctggcggtggccggggccgccgaccggctcgacgccgagggctggcgcgccgcccaggccgccatccgggccatcgaaaagcgctggcgcgaaccggattacggggtctgggagatccaggacgagcggtggacgcagtcccggctggcctgcgtggccgggctgcgcgccgtcgcaaagcttgccggcgccggcccggagctgaccgcgtgcgcgtcgctggccgacgcgatcctggccgacaccgcatcggaaagcctgcacccgcacggctattggcagcgcagcccgcggctgcccggcgtcgacgcctcgctgctgttgccgccggtgcgcggcgcggtgcccgccgacgacccgcgcacccgggccaccctggacgccgtgcgccgcgacctcaccgacgacgggttcgtctaccgcttccggcacgacgagcgcgacctgggcgaggcggagggcgcgttcctcctctgcgggttcatgatggcgttggccgaacatcaactgggccatacccattgcgcgatgcgctggttcgaacgcaaccgggcggcgtgcgggccgccggggctgttctgcgaggaatacgacgtgcggcaacgccagttgcgcggcaacctgccgcaggcgttcgcgcacgcgctgatgctggaatgtaccgccaccctcgccgaggacgccgtccaccatgactgacaccggaccgcagcgaaaggcagttctgcgatgacacagtccacccaaacggtggtgatcaccggggccagcgccgggatcgggcgggccaccgcgaaggagttcggccggcgcggcgcgaacgtcgccctgctggcccgcggcgccgccgggctgcagggcgcggcccgcgacgtggaggccggcggcggcaaggcgctggccctgccgaccgatgttgccgaccacgcggccgtcgtcgccgccgccgacgagaccgaggccgccttcggccccatcgacgtgtgggtcaacgtcgccttcacctcggtgttcgccccgttcagcgagatcagcgccgaggagttcaagcgggtgaccgaggtgacctacctcggttatgtgcacggcaccatggcggcgctggccaagatgcggccccgcgaccgcggcaccatcgtgcaggtcggctccgcgctcagccagcggtcgatcccgctgcagtcggcctactgcggcgccaaacacgccgtcaacggattcaccgaatcggtgcgctgcgaactgctgcacgagggctcgcgggtgcggatcaccctggtgcagatgcccgccgtcaacaccccgcagttctcctgggtgctgtcccggctgccccgtcatccgcaaccggtgccgccgatctaccagcccgaggtcgccgcccgcggcgtgctgtacgccgccgatcatccagggcgcaaacagtattgggtcggggattccaccatggtgacgctgctcgcgcagaagttcgcggcaccgttgctggaccgctacctgggccgcaccgggtacgactcgcagcagaccgagcagcccgtcggcggcgaccggccgcacaacctctggcagccgctggatcaggagccgggcagcgatcacggcgcccacggcgaattcgacgacacgtcgcacgcccacagcccgcagctgtgggcctcccaacatccggtaatcagcggcaccggcgcgctcggcgccgccgggctgggcacctggctggcggcgcgggcccgccggtggacgcgatgacgcccgacccggccatcgacgaggtgaccgcgcgggtttaccaaatccccaccgacgcaccggaagccgacggcaccctgtcctggtcgtcgaccacgctggtgctggccgaggtggccgccggcgggcggcgcggcatcggctacacctacggcgacggcgcgtgcgcacagctgatcaccggggcgctcgccggctcggtcaccggacacagcgcgctggacgtcgcggcgcgctggcaggcgatggtccgcgcgatgcgcaacaacgggcgccccggcctggtctcctgcgcgatctccgcggtggacaccgcgctgtgggacctcaagggaaagctgttgggcctgccggtgtgccggctgctcggcatggcgcacgactcggtgccgatctacggcagcggcggtttcaccagctacgacgacaacgccacccgcgcccagctggaacgctgggtgcacgagtggcggatcccgcgcgtcaagatcaagatcggcgagtcctgggggtcgcacgagcgccgcgatctcgatcgaattgccctggcccgcaccgtgatcgggcccgacaccgaactgtatgtggacgccaacggcggctaccggcgcaagcaggcgatccggatggcccacgccatggccgggcacgacgtcacctggttcgaggagccggtctcctccgacgacctggccgggctgcgggaggtgcgcgaccaggtgagcgccgacgtcaccgccggcgagtacgggtacgacctggcctactttcaccggatgctcgccgccgacgcggtcgactgcctgcagatcgacgtcacccggtgcggcggcatcaccgactggctgcgggcggcggccgtggcggccgcccacaacgtcgacgtctccggtcactgcgcgcccaacctgcacgcccacgtcgccaccgccgtcgccaacctgcggcacctggagtacttccacgaccaccaccgcatcgagcagatgttcttcgacggcgcgctgtcgccgcagggcggcgtgctgcggcccgatcaacagcggcccggattcgggctggagttcaaacagcgcgacgccgaccggtaccggatgcgctgactggcttcgtcacgacctgtgggcccacgcatttcgtgaattcgagtgcggggccgacaattgagggcatcgacgccgcgttcgcgggaataccaatcctgctactggcgcatgtgtgaggcgccgccgatgtaccacacctgcccgttgatccattcggcctcatcggagagaaggaaggcagtgatcgcggcgatgtcgcgcggttctccgaggcgggtgaccttggcggcctgcaggaacatctgctgcaactgaatgtcgttctgctgcttctgggtttcgcccatgaccaggccgggcatgacgccgttgcaccggaccccttgcgcgccccagttgttcgcgatgtggcgggtgagttggttgacggcggctttggcggcgttgtaggcgacgtgcatcgggtcggtgcctagcgagcctcccgaggacgtgtttacgatgcttccgctgccttgctggaggagatgcgccaagacggcgcgactggtgcgcacgtaacccaggaggttgacgtcgagcgtgcggcgccagacatcgaaatcggtgtccaacagcgtggtgtcgcggccgaggttctcggcggatagatctgagccgacgttgtggaggccgtggagggcgccgaactcgccaatggtcttctgcacgaggttccgaacggatgcttcgtcggcaaggtcgaattccaccgcgatcgcgcgcccgccggattgcgtgatccgcccgacggtcgcgttggcgccttcgatgttgatgtcaccgacggtgacggctgctccctcgctggcgaggcgttcggcggttgcggctccgattccggtcgatccgcccgcaacgatgaacgtcttgccctgtaatccgcgcacgggcccatcctctcgctagcagtaggcgacacccaggtcgaccgagataccggatgcggtaacgaatctcgattgatccgatgcgagccaggccaccgcgtcggcgatgtcttcgggttgcgcaatgccgtcgggcagcagcggcttgtgcaggccttccaaatggggatacgtcgcggccgccgactcgagcgcgtcgcgcatacgtccggttcccatgggtgtgtcgacagctccggggtgaaggctgttaacgcggatgttgtagcggcccagctcggcggcgaaggcccgggccatgccggtgatggcgtgcttgctcgccgtgtaatgcaccatgaacgcttgcattttcacacctgcagcggaaccgatcaggatgatcgacccgccccgtcgccctgcgatgatgtggtgagcgcctgccatgacggtgttccacgtgccgatcacgttggtgtcgatggtgtcgcggaacgcctggcccgtgatttggtcccatggtgccgggcaacaaattcccgcgttggcgacgatgatgtcgaggcggccgagctcggcgaccgcgtggccgacggccgcgctcagcttttcggcgtcgcgcacatcgatcgccgcggtgatcgcgcgccggccgttggcttcaacgagccgcgcggtctcggcgagatcatcgcgagtcggcgactcatatgggacgctttccggtagccgcccggcgatgtcgaccgcgattatgtcggcgccgccggcgctcagccgcaccgcgtgggcacgtccctgcccgcgcgcggctccggtgatgagagctactttgttgtccgccaaggcagttcagtcccgatgaatcttgtcgagcgggttggagcgttcgagcatgccgtaggtctcctcgccgtcccagcggtagcgcacaccggcttgctgcagtgcggggaaactgggcatctccttcttcatggcatgtacggagtaggagtcgtcgtcgtgatggatgtcgtgggtggagaacaccgtctctccctcgacggcgacgacgccgtggccggtttccaataccagtgacacgtcttcgcccagggcctgcaaccgcgtcagccacggcgcctgcaccacgcgcgccgggatcagcggcccgtcgccggtaaagacgtagccctcgttgaacgtgggctggccgtcgagtcgcggtggataggcgatgtagccgaacgcttttccgctcgggaacaccgccgactgccaggcgtggccccaaaagccggccagcttgcgcaccccttggcggcggatccgcagaccactgccgctgaaccgccgctcgctgccgtcgaccgtcaccgacccggccgcccgaaagagttgttcatagcgggggccgcccatcaggttgccctcgatggatgacttcagttgttggcctgcatcgttgcgtaaggcgccctgaacccagggcggcaccgccatcgcggcctcaacctcaaaagcgacgtcgaccaacgggccgtccttgcgcccgctgaccagatcggccgacgacgtctgcacggccttgccctcgtaggtcatcgtccatgtgtgaaatggttcgacgcagcggaacgccaatccccctgcccccaacaccgtcggccggccgtccggtcccgccgcgggcagggacggaccgttggctctcaggcggtacacccgaccgtcggggtaagcgacgttgacttggatgtcgtgggcatcccaattggctgcgacggcttcgattccgatcctcggcaggccgatctcgccgcgatcgtcgacgacccagaagctcaccgagtctcgcatctccgggttctctggacgctcagcgaacacgagttcgcgcgatgggtcgatgccaccagtgaggtcaatagccatggctctcctagatgtcggcgtgtgcggtccagtcggcggcggccgtgatgtagtcggcgaacagcggccgtatcgaatccaggtcgatcccgaactgaacagggtcagcatggctgctgggttcgcgctcggttgccgcctgcgcccaccagctgttcattcggccctcgaattcgtcgctgacctgttcgccaagccagcgatacaatcccgtcacctcgccgatcgggtcggcctgcatcgcgcgaaagtcgatgtcatagaaccggttatcgttgcccgctgcccggaactgcagcgtgcgggccatgcccaacgaccaatgctcgacgttgagccgcccgatataggggcggtcgatgtcgtcggtgaactggccgatgatgtcggcgtagaggtcggcgactgacaggatgacgtccgtcggatcacggtgcgtcatcacgaatttggcgtctgggaagaccgcggccaggcggtcaagccagagcacgtgcgaggggcatttcagcctccacggccgcgtcggctcaccccaggccagcagcttgagcacccgacgctcgtacgcgagcgccgaggtgaggtcggcgtcggccaccagccacgccgaataggtgggaacttgggccagcgactggaacaggtgggaggcgaaactcagagccatcagttcgtgacattccatcggcccgttggcgtccgtgggcactgagcaaggtatgcggtgatccgcggatagatgaaggcctcacctttggcgttgagccgggcctcatcgcgcagcgacgtcaacagtatctcgaggccttctcgaaaggaatcatccccgaaatcgtcgagaccggtctgggcaaccgcggtttgcaggagatcgttgactgccggcattggatcagcccatccactgtccgccggcgacatcgatggtctggccgcacagataatcggcggcctcggtagcaaggaaggcaaccatattcgcggcttcctccggaagcgaggcccggccgagttgcacctgctgcgtgatcgcctcgatgatcgcggcgcggcccgcgcgctcctggtcgtcctgcggatccaaaacatattgcttgagttggggattgagcatgatgccgggcgccacgccaagcacgttcactccgcgcagagccacctcatgggcgaggttgcgggtgaacccgatcacgccggccttacacgcgttgtacacaacaaggccccgctgctggatacggccaccgaccgagccgatattgatgatcttccccgacccctgaggaagcaggaactgcagtgcggcgtgtgcgccgtacatcatcatcgacaggctgccgagcacggtgaagtcgatctgctccttggtctgagtctcgaacagccctccggcgaccatcacggggttgttgaccatgatgtcgagaccacccagctgccagtgcgcctcgcgcacggcattatgcacttgatcccagtccgacatgtcggcgctgatcgcgaccgtcttgaccccccagcgttcctcgacttcgcgaccacgacgttgcactttttccagcgtgcggccaatcagcgcgatgtcggcacccagcccgcccagccgattggcgatcgcctgacccaggccgtctcccccggcgccagtgacaacagccttcttgccggacagatccatcaactcggtgacccgcttatcgacaatgtgctccggcagccggtcaaaccccagcacttctgcccagtcctgcttttcatcctggattgtcacgacggctcccttcaccgcaggcgatacacacgacatatcagcgcgttatcgcatcagaacgtgctcgctcggttgcgacgttagagccggggacgaccgatgaggtaataccaattacggaacgcagtcataccgattcttgatgcctggtatatctgtgcagcagtggacactcatcggctgaagtacttcctgcgcatcgcagaacagggctcgatcaccggcgcggccgcctcgctcggcatcgcgcagccggcgctgagccgccagatccgcctgctcgaagaggacctcggtgtcgcgctcttccgccgaacccgccgcggggtgcaactgaccgaggagggggaacggctacgagcatcgaccgctgcaccgctgcgccaactcgagctggccatgcaatacgccggatcaccgatagccaggctcgcgcgcggcgtccgcctgggcatactcgacacaacggtcgacgtcttcgctgcacacctgctgtccagcttggccgccgcttttccgaaggtgactttctccgtggagaccggaagcaccgaccagctcgtcgaagcgatgttgaagggcgccgtcgacgtcgctgtgatcaacccagtgccggacgaccgaatcttctaccgcgatctactcaccgaagacctcgtggtcgtcggcgcagcgacctcggacctcgattccggtcagatgatgcccttcaccgaactcgtagagctaccactggtggtccctcgatcacacaccggtatcgggaacgtgatcgaaaatgccgcgctgcgaaggaaagtcaagatcagctggcgaatagccacagattccctagcgctgaccaaacggctcgttgcggccggcctcgtctacggagttctcccgctttccgcctgcctcaacgaaattgactccaaccaattgcgatacaccccgttgaccgagccaccccttactcacagggtcggtgtcgcggccacatccaacctagagctcccacgagaagtcaccgcaaaagtcggcaacatcctgcgcgaagagaccgcacacctcatcaaaactggacggtggccagctcgactcctatcaccacaaccatgggatcccgcagtcacatgaacggttgacgggacgcaccttgacaccgcgagtgtgcgagcaacaacttcgaccaacgcgtgcttcaggttggccggcaacctcgatcacacactgagcgctccccagcacgagcaggtatggaagcgcgccaaacggggaatcgatatgtcaacttctcccagcgggttgcatggaagggatcgggcggccatgacagtgaactccaacgacgaaaccgtcccgtgtgcggagccgctcggctcggacgtcgtcgagggcgacggcgacctcagcgcggtcgagcgggtgctgggcctgggtgagccgcagcgcgtcggcaggttccggttcttcctggacggccaccgctgggagtggtcggacgcggtggcgcgcatgcacggctaccggcccgggcaggtgcagcccagcacggagctgctgctgcagcacaagcaccccgacgaccgcgagcgggtggcggccgtgctggaccaggtgatgcggggcaagccgttcagcagccggcaccgcatcatcgacaccgccgggcgcacccactgggtcgtcgtcgcgggcgatcggatgctcgacgactccggcgcgctggccggcacctccggcttctacgtcgacgtcacagactcgctgcactccgacatcaccaacgtgctgtcggcggtggccgactcccgggcccgcatcgagcaggccaaggggggtgctgatggccgcctatggcatctccgccgagcgggcgttcgacatcctggtgtggcgctcgcaggaaaccaacctcaagctgcgcgacgtcgccggccggtttctggacgcggtggccagcaaggcgtccccgggaatgcagcgccaggtcgaccacgccctgctgaccctggaatgaccgcgcagggtcggattgcgcgactcctcctccggccgtcaccggccggcatcgtcgccgcgcagggccggattgcgcgactcctcctccggccgtcaccggccggcatcgtcgccgcgctagggtcgggccggtggcgcacctactgggagctgaggccgtacacctggaatacccgacacaggtggtcttcgagtcgatcacgctcggggtcaacgacggcgcccgcatcggcatcgtcgggcgcaacggcgacggcaaatccagcctgctgcggctgctgaccggcgaacaacaacccgacaccggccgggtcacccggcgcagcgggctgcgggtcggcgcgctcagccaggccgacacgttggacccggaccacagcgtgggctggacactggtcggcgacgcggccgaacaccagtgggccggcgacccgcgggtgcgcgacgtggtggccggcttggtctccgacattgattggcgggcaagcgtttccacactgtcgggtggtcagcgccgccgggtgcagcttgcccggttgctgatcggcgagtgggacgtcatcgcgctcgacgagccgaccaaccacctggacatcgagggcatcacctggctggccgggcatctgcggcagcggtgggcccgcaacaccggcgggctgctgctggtcacccacgaccgctggttcctcgacgaggtcgccaccaccacctgggaggtgcacgacgggatcgtcgaaccgttcgacggcggctacgcggcctacgtcctgcaacgcgtcgagcgcgaccagatggccgcggccgccgaggccaagcggcagaacctgatgcgcaaggagctggcctggttgcgccgcggcgcgccggcgcgcacctccaagcccaagttccggatcgaggcggccaaccagctgatcgccgacgtcccgccgctgcgcaacagcgtcgagctggccaagctggccaccgcccggctcggcaaggacgtggtggacctgctcgacgtgtcggtctcctttgacgggcgcccggtgctgcgcgacgtcgaatggcggatcgcccccggcgagcgcaccggcatcgtcggggccaacggcgccggcaagtcgaccctgctgggcttgatcgacggcaccgtgcggcccgacagcgggcgggtcaagcgcggcaagaccgtccagctcggcgtgctcgaccagcggggagcggagctggccgcgatcgccgacgaccggatcagcgacgtgctgggccggctgcgcgccggctatcgggtggacggccgtgaggtgacgccggcccaactgctggagcggctcggtttcggccggggccagctcgcggcgcgggtcggcgacctgtctggcggccagcggcggcggctgcagctgatgctgacgctgctgtccgagcccaacgtgttgctgctggacgagccgaccaacgacgtcgacaccgacacgctcgccgccatggaggatctgctcgactcctggccgggcacgctgatcgtcgtctcgcacgaccgctacctgctggagcgggtcaccgatcagcagtacgcggtgctcgatggccggttgcggcatctgcccggcggcgtcggcgagtatctgcggctggccgcccagcggcgcgacgcggcaccgcccgccgggccgacttccgttgcgccgcaagcgatgtcgggcgcacagcggcgcgccgcggagaaggagctggccgcggccgaccgccggctggcgcggctggccgaacaaatcaaggacaagcacgaggagctcgccgggcacgaccagtccgatcacgtcggcatcacccggctcacccgggagctgcgcgcgctggaggacgaggtcgccgcggccgagagccgctggctggaactgtcggagctgctcgaatgagacccgtgcgctaccggcccggtgaggcattgctcgcgctgtaccggcgccggggcccggtgatcgacgccggggcgggccggcacggctacaccctgctgctcggggccgaggcaaacaagtttgtgttcgccaacgccgacgccttcagctggcgggcgacgttcgagaacttggccctggtcgacgggcccaccgcgctgatcgtcagcgacggcgacgaccaccggcgccgccgcagcgtggtagcccccgggctgcggcaccggcagatccaggactatgtgaccaccatggtgtcgtgcatcgaccgggtcatcgacggctggcggcccgggcagcggctggacgtctaccagcactgccgcgcggcggtgcggcgcagcaccgccgaaagtctgttcggcccgcgcttggccgtgcactccgacgccctcggcgaacacctgcagccgctgctcgacctgacccaccagccgccgcaactggtgggcctgcagcggcggatcaacgccccggcgtggcggcgggcgatggccgcgcgacagcggatcaacaaccttgtcgacaccctgatcgccgacgcccgcgctgcgcccaacccgaacgaccacatgttgaccatgttgatcgacggccgcggcgacgagggttatacgttgagcgacaacgagatccgcgatgccatcgtgtcgctcgtcacggccggctacgagaccaccagcggcgcgctggcctgggcggtctacctgctgctgtcgcagcccggcgcgtgggccacggcggccggcgaggtgcggcgggtactcgccggactgccgccggccgcggccgacctgagcgggttgacctacctgaacggcgtcgttcacgaaaccctgcggctgtacccgccaggggtgatctccgcgcgccgggtgatgcgcgatctgcgcttcaagggcaggcggatccgatcggggcggctgttgatcttcagcccgtacgtcacccaccggcttcacgaaatatggcccgagccaaggcgattcgcacccgaacggtggaaccccgatgctcccgggtatcgccgggcggcgccgcacgagttcatcccgttcagtgcggggctgcaccgctgcgtgggggccgcgatggccaccaccgagatgacggtgatgctcgcgcggctgctggcccgcacccggctgcggttacccgctcagcgcctgcgcgcggccaatgtcgccgcgctgcggcccacgccgggcctcacggtcgaggtgatcgactcagtgccagcgcagtagcaccagctcggaaccgaagccgggacccacggccagcatcagcgccggggtgccggccgggggcggcttggcgatggtgtcgcgcaggatgtgcagcaccgacgccgaggacaggttggcgacctcgccgagcgaacgccaggtcagttcgtgcgcctccgcgggcaggtcgagcgtcgcggcgatcgccgtgatgaccttggggccggccgggtgggtgatccacgcgccgacgacgccggtggtcaggccgtgggcggcgaggaagccggtcacgtcgtcggccaggtgcttctcgacgacggccggtagttccggggacatcaccagctgcattccggccgagccgatgttccaacccatgatgtgcagcgtttcgggatagagccggctgcgcgagtccaggatgtcggggccggtggcgccgagccgctcggcgcgccggtcccccacggcgaccaccgcggcggcgccgtccccgaacatcgccgtcccgaccagtcccgacaccgtcggcttgaccgtcgggaaggtgagcgaacacagctcgaccgacaccagggcggcgacgccgtcgggagcgccacgcaggtaatcgtgcaaccggcccacccccgcggccccggccgcgcagcccagcccgaacagcggcactcggcgcacgtcggggcgcaggcccagccgtccggcgatccgggcgtccagcgacggcaccgccaccccggtgaccgtggtggtggcgatcgtgtcgatgtcctgcggccgcaggcccgcctcgtcgagggcgccgagtaatgcgtcgcagccgatttggacggccttgtcgatgaagatctcgttgacctcgccgaaatcggtcagcgagtggtactgctgcagcggcagcacgaagtggcggctgttgaccttggcggcggcgtgcaggcgccggacgacctcttcgtgttcccgcagcgcggggaacttcacgatctcgtcggtgatttcgcgttggctgtaacgatgcggcggcacggcgccgaacacacccgcgatgacgctcatgctttactctcttgattgccaaccgacttgaatacgattcccgctaaaccccgaagtttatgcgttcggatggggtcgcgcaaaagttcgatgtattgaacacatgtgttattgtgccgattttcggtgcgtgtaatcgggttggccagcggggatttcgtcattcggcctcgtcgtcatccgccgagttcagcgccatcgcgatcagcgcgtcggggcttaacgagtcgatatccgcgtcgctgattttcgggtcggtggtcgcggtttccgggatgccggcgagcaataggagtttgtcgagcaatccggtccgccgcagctcgcgcagcggaattctgcgcagcgccgaccagattctctcgtcgtcggattccgggtcctcgtcgtgcagcagttgccggcgaagatgatcggccagcgcggtcggcgtcgggtagtcgaagatcagggtgcgcgacaacgccgtcccggtatgcgtggtgaggcggttgcgcaattcgaccccgatcagtgagtcgaacccgagatcggcgaaggcgcggtgggggtcgatggcgtcaccgtcggggtgcccgagcaccgcggccgcgtgctcgcagaccaattcgcgcagcacccgttgctgttcgtcgcggggcagtgcgtgcaggcggtgcgccagctcgggggcacgcgtgccgccccccaccggtgccgctcccgccggggcgccggccaacgatgcgccgcccagccaaaagcgttcgcgcgcaaaggcatacgtcggcagctcgacgcgacgggcgggcaggccggcgaacacgcccgcccagtcgaggcggtggccgcgggtgaacaggtgcccggccgcgtgcagcgccgattcggtctcggggcggtccttgggcagggtggcgatcgcggtggcaccctcggtgctcagcgattggtccaccgcggccgtcagcgccgcgccggggcccagttccaggaaggttccggcgccggcctgctcggcggcgcgcacccccgcgaggaattgcaccggcgcgcgcacgtgctcgacccagtactgtggcgtgccgtagccggggccggcgagttgtccggtcaggttggacaccaaagggattcgcgggggccgcggctcgataccggccgccgcggcggcaaagccgcccagcatcggctccatcagggccgagtgaaacgcatgcgagaccgccaaccggtgcacccgcgcgccggagccggccaaccgctccgccaccgccgccacggcttcctgctcacccgagagcaccaccgcgtcggggccgttgaccgccgcgatgctcaccccaccacccaccagcggcgccacctgcgcctcccccgcggtcaccgccaccatcacaccgccggccggcagcgccgccatcaacgcaccccgggccgccaccaaccgcgccgcatccggcagcgacaacacccccgccacacacgccgcggcgatctcacccaccgaatgccccatcaccacatccggtgtcacacccaaggattcccacaacgccgccaacgccacctcgaacacgaacaacgccggctgggcaaactccgtgctctgcaacaactccggatcggcgccccacatcacctcacgcaccggcagccgggaatgctcgtccaccaccgcgacagcctcatccaacgcccgcgcgaacaccacgaacctctcgtacagctgccggcccatccccaacgtctgcgagccctgaccgggaaacaccaacaccgtcttgcccgtcgcccgggcccgccccaccaccgtggccgcatccggccgccccgacgccagacccgccaaacccgttgccaacgcgccacgctcgcatcccaccaccaccgcgcgatgctcgaacaccgcccgggtgctgaccaacgaccaccccacgtccagtggactcgcctgcgcgtcggcggtcacatggtccagcaaccggcgggcctgcccggccaacgcctcggccgaacgggccgaaaccacccacggcacaacagcatcgggcatagcagacgatgcgggtgcggcctcggtctcggcggccgcgggggcctgctcgacgatcacatgcgcgttggtgccgctgatcccgaacgacgacaccccggcgcggcgcggcccgccgtgctccggccagggccgcgggtcggtcagcagcgacaccgccccggccgaccaatccacatgcggcgacgggacgtccacgtgcagcgtcttgggcatcaccccgtgccggatcgcctgcaccatcttgatcaccccggccaccccggccgccgccgaggtgtgaccgatgttggatttgatcgagcccagccacagcggccggtccgccgggcggtcctggccgtaggtcgccaaaagcgcttgggcctcaatgggatcgccgagcaccgtgccggtgccgtggccctcgaccacgtccacgtccacggccgacaggcctgcgttggccagcgccgcccggatcacccgctgctgcgaaggcccgttgggggcggtcaggccgttggacgcgccgtcctggttgaccgcgctgccccgcagcaccgcccacaccgggtgtcccagccgacgggcgtcgcccaaccgctccagcaccagcacaccggcgccttccgaccacgaagtgccgtcggccgcaccggcatacaccttgcagcggccgtcgggcgccagcgcccgctgccggctgaactcgacgaacgccgcgggcgtggccatcacggtgacaccgccggccagcgccaggtcgcactcgccggaccgcagcgactgcgcggccaggtgcatggcaaccagcgacgacgagcacgcggtgtccaccgacaccgccggcccctccaggcccagaacgtaggacacccggcccgaggtcacgctcaacgtcgagccggtgaggccgtagccctccagctcgcccttcacctcgccgccgtagccggcgtggatgacgccggcgaaaaccccggtcgccgtgccgcgcaacgccgagggatcaatgccggcccgctccaaggcttcccagcagatctccagcatgatccgttgctggggatccatggccagcgcctcgctgggtccgatgccgaagaacccggcgtcgaagtcgcccgcgtgctgcagaaaactgccctgccgggtgtacatcttgcccttggcgtccggatcggggtcgtacaacccctcgacatcccagccgcggtcgaccggaaagtccgacaccgtgtcgcggccctcgatcacgaggtcccacaacgcttctggcgagtccaccccgccggcgtagcggcacgccatgcccaccaccgccaccggttcggacagccggccttccagctccgcgacccgccgccgggtccgcctgagatcggccgtgaggcgcttcaggtagtcgaggtgctgctcggtgcccggcatcggcgctccttgcggggtgtcagcggccgagttcttcatcgaggatcgcaaagagttggctctcggtggcggcttccagatcttcgtcgagcggtgcggaatcgggcccgtcaccggccggaagcgcgcctagcaggccgtggatgcgggtccgcagcaccgccttgtcgtcggaattccagtgggccgcgcccagcagcgcctgcagctcgcgggtgatgtcgttgaagcgacccatcaggtcgggctggtcgtcgccgccggagccggccagccgggagtcgaggtgctcggccagcaccaccggcgtcggatagtcgaagatcagtgttggcgaaagggtaagcccggtagcgtttttcagcctgttgcgcagttcgaccgcggtcagcgagtcgaacccgaggtcctggaacgcccggccggcgttgatgtccgccgggttgggcaccccgagcaccatcgccgcgttgccgcacaccaggtcgaccagctcgcgccggcgcgcctcgggactgaggccgtgcagccgcgcggcaagcccgctcatcgacgcggtgacgtccgcgtcgtcgatgacgcggcgggtggggccggcggccagctcgcgcaacagcgggggcagcgcggcgatgttctccgacagcgcggcacggtccagccgggccgccaccagcaccggcgtctcgaccagcatggcggcgtcgaacgccgccagcgcctgttcggtggacaacggcgccagcccgatccggctcatccgggccttgtcccgatcgccgaggtgggcggtcatcgccgaggcctgttcccacagcccccacgccagcgacaggccggcgagcccgtcagcgcgccggtgggcaaccagcccgtccaggaagctgttggccgccgcgtagttggcctgaccgggcgtgcccacgatcccggccatcgacgaaaacaccacgaacgccgacaaatccagatccttggtcagctcgtgcaggttccaggcgccgtccaccttggcccgcagcaccgcatccacccggtccgggatcagcgaggacagcagcccgtcgtcgaggatcccggcggcgtgcacgatcccgcgcagcggatagcccgcgggtagcccggccagcatggtggccaccgcgtcgcgatcggcgacgtcacaggccagcaccgacgccgacgcgcccgcccgctgcagctcgtccaccaactcggcggccccggcggcctgcgcgccggtgcggctgaccagcaccacatggcccacccggtagcggtcgacgagatggcgggccagcgccgaaccggccatcccggtgccgccggtgatcagcacggtggactgcgccagcccgcccccgcacccgctgagcacctcgccgagcccggacggcacggtcagcaccaccttgccgatgtggcgggcctggctgacataccggtaggccgccgacgcgcagcgcacgtcgaatgtcttgagcggcaacggtgtcagcacaccctcttgcagcagtcccacgatttcggccagcatcgccgcggtgcggtcggggccggcctccatcagatcgaacgcccgatagcgcgccccgcggtaccgctgcgcgacgacgtccgggtcacgcacgtcggtcttgcccatctcgatgaaccgcccgccgggggccagcagccgcagcgacgcgtcggtgaactcgccggccagcgagttgagcacgacgtcgaccccggccccgccggtggccgcgaggaacttctgctcgaagtccgggctgcgcgaatcgccgatgtggtcgtcgtcgaatcccatcgcgcgcaaggtgtcccacttgccgcggctggcggtggcgaacacctcggcgccgtagtggcgggccagttgcaccgcggccatgcccactccgccggtggcggtgtgcaccagcacccgctcgccgggccgcagcccggccagcaccgacaacccgtacagcgccgtcaggaacaccaccggcacgcccgccgccgccaccagcgacagacccggcggcaccgcggtcagcaatcgctgatccaccaccgcttcggacccgaccacccccagcagccccatcaccgggtcgccgacggccaggccggtcaccgcgggccccacctccacgaccacaccggcgccttcggcgcccagccggccgccgccgggatacatgcccagggccaccagcacatcccggaagttgaccccgaccgcggccaccgcgacccgcacctgcccgtccgccaattccgttcgcgggcaccggctgaccaccaggtcccccagcgtgccctcgccgccggcgtccaaccgccacgccccggacggcagcccgagcgtcgcgccggcccgcgccggccgcagccgggccgcatgggccacaccctggcgaaccaccacttgtggctcgccgcaagggattaccgccctggcgtccagggatccgtcggagtcgatcagcaccaggcggcccggatgctcggcctgcgccgaccgcacgaggccccacaccgccgcgccggccaggtccgaaacgtcctccccggccagggccacggccccgtgggtctgcacggccagcaccccgccgccctcaccgtccaaccaggattgcagcaccgccagcgtctcggtgaccgccgcgtgcaccgacttcaccacgtcgccgccgtgttcgcccggctcccacagcgtgacctcgtcaccaagatcgttgccgcccagtgcgatcggcgaccagatcacgtcgagcagccccgagggctgcgcggtgcccatcgccgcgctcagctgccccggtgagaccgggcgcatcgtcaccgaccgcaccgacagcaccggcaggcccgcgccgtcggccaattccaccgacaccgcgccggccccggccggggcgatccggacccgcgcccgcgacgcgcccgaggcgtgcaacgccaccccctgccaggagaacggcaacacggtctggtccttctcgcccgccacaccgagcacatgcagcgcggcatccagcaacaccggatggacgccgaaatcgtcaccggcggcggcgtcgtcgggcagggcgacctcggcgaagatctcgtcgccgcgctgccacatcgcccgcaaaccccggaaggcccggccgtattcgtagccccgctgcgcgagccgggcgtacccgccggtgacgtcgaccgcggtcgccccgatcggcggccagatcgacaggtcgccggccggtgtcaccgtcccggcccgcagcacaccctccgcgtgcagcatccactccgaatcctggtgtacggcagccgaatacaccgacagcgggcggcgtcccgcctcgtcgggcgcgccgaccaccagctgcagccgcacaccaccggacgcgggcagcggcaacggggccgacaacgtcagctcgtcgatcacgccgcagccaacctcgtcgccggcccggatggccaactcgacgaaccccgccccgggaaacaacaccgtgtcgcccaccgcatgatcggccagccacgcctgcgcagacgtcgacagccggccggtcagcaccacacccccggaatcgggccgcggcagcaccgcgccgagcagcccatgctcggcgccgcgcagccccagggcggcgacgtcggaggatcccgtcgacccgccgggcagccaaaagtgttgccgcacaaacccgtacgtcggcaggtcgacgcggcggccgcccagcccgtccagcatcgcgcaccagtccacgaccacgcccgacacgaacgcctggccggccgagagccagaaccggtccggtccgccgtcgtcgcggcccagcgacgggatgacgcagccctgaccgccgtcgggcatggtttcttcgatggcggccgtcagcaccggatgcgggctgcattcgatgaacgcccgatagcccgcttcggcggcgccgcgcaccgcccgctcgaattgcaccgtctgccggatgctgcggaaccagtagtcgccgtccagcgcggcggtgtccatcagctcgccggtgaccgtggagaagaacgccaccgccgacgaccgcggcgcgataccgcgcagcgcctcggcgagcgaatcgcgaatttcctccacctgaaccgaatgcgaggcgtagtcgacgtcgatccggcgggcacggatgtcgtcggccgcgcaccggtccagcagttccgtcagggcatccacctcgccggacaccaccaccgccgaaatcccgttgacggtggcgatattcaatcgctcaccccagggggcgatcagctgctcggcgcgcgagcgtccgcaggccagcgagaccatgccgccgcggcccgacagccgcaccagcagccggctgcgcagcgccaccacccgcgcggcgtcctgcagcgacagcgccccggccacacaggccgccgcgatctcgccctgggagtgaccgatcacggcgtcgggaaccacgcccaccgaacgccacaactcggccagcgacaccatcaccgcccacagcgccggctgcaccacgtccacccggtccagcccgggcgcgcccggtgtcccgcggatgacgtcgatcagcgaccagtcgacgtgctcggcgagcgcccccgcgcaccgatgcatgtgttcggcgaataccgttgagcggtccagcaattgagcgcccatgccgggccattgcgagccctggccggggaacacgaacaccgtcttgcccaccggctgggcccggccggtcaccacgcccgcccccggctgcccgcccgccaggtcggccagccggcgaagcagctgcgcgccgtcggcgccgacgatcaccgcccggtgctcaaaccgcgaccgcgtcgacaccagcgaccagcccacgtccagcacccgcacgccgggatcggccttcacccgcgccagcagccgcgccgcctggttcgtcaacgcctcggccgagcgcgccgagagcacccacggcaccaccacgtcacccccttggggcgcaatggtttccggctcatactgctcgacgatgacgtgcgcgttggtgccgctgatgccgaacgacgagacgcccgcgcggcgcggccgatcccgcgccggccagggccgcgcctcggtgagcagcgacaccgccccggccgaccaatccacctgcggcgtcggctcgtccacgtgcagggtcttgggcatcaccccgtgccgaagcgcctggaccatcttgatcaccccgccggcgccggccgcggccgaggtgtgacccatgttggatttgatcgaccccaaccacagcggttcgtcgaccgggcggtcctggccgtaggtcgccaacagcgcttgggcctcaatgggatcgcccagcatggtgcccgtcccatgcccttccaccaggtccacgtcggccgcgccgagccgggcgttggccagcgccgcccggatcacccgctgctgcgacggcccgttgggggtggccaggccgttggacgcgccgtcctggttgaccgcggagccgcgcagcaccgccagcaccgaatgtcccagtcgccgtgcatcgctcagccgctccagcaccagcaccccgacgccttcggagaagccggtgccgtccgcggcgcccgcgtaggccttgcagcggccgtcggcggccagcgcccgctgccggctgaactcgatgaacatcgccggggtggccatcaccgtcaccccgccggccagcgccaggtcgcattcgccggagcgcagcgactgcgccgccaggtgcagcgccaccaacgacgacgaacacgcggtgtcgacggagaccgccgggccttccaggcccagcgcgtaggccacccgccccgaggccacgctcagcgtcgagccgcgcaggccgtatcgctccaggtttccgggcacccggccctggccgccgtaggagccgtggaatatcccggcgaacaccccggtcgccgatccgcgcagcgtgcgcggggtcaattccggcccgctccaacgcttcccaggacacctcgagcagcagccgctgctgggggtccatcgccagcgcctcactgggtgcgatcccgaagaacgcggcatcgaaatcgcccacgccggtgaggaatccgccgcaccggcagtacgacttgccgaccgcgtcgggatcggcgtcgaacagcccggccaggtcccagccgcggtcggcgggaaactccgagacgacgtcgcggccctcgaccaccatctcccacaacgcctcgggcgaatccacgccgcccgggtagcggcaacccatgcccaccacggccacgggttcggtcgccgcgaccaggtaccggcggttctcgcgcttgagccgctcgttctccttcagcgactggcgcagcgcccggaccagttcctcggtgtcgccgctcatcggaggcggcctcgggtgtcactcacagcgatacttccgcattcgtgcacgggcgagggtcagtgccaacgcaacaacaccagttcggagcagaaacccggccccatcgcgagcatcaggccggggctgtcgctcggcggcggcttggcgagggtgtcgcgcagcacgtgcagcaccgacgccgacgacaggttgccgatctcgccgagtgaccgccaggtcagttccagcgcctccggcggcaggccgagggcggcgttgatggcctcgatcaccttgggcccgcccggatggctgacgaaggcgccgatatcgttggtggtcaggccgtgcgccccgaggaatccggtgacgtcgtcctcgatgtactgctcgacgacggccgcgacgtccttggacagcaccagctcgaatcccgtcgcgcccacgtcgtagcccatggtgcgcagcgaatccggatacaggtggctgcgcgaatccaggacgctggggccggcggcgtcgagctgctcggcgcgccgctcgcccaccgccaccacggccccggcgccgtcggcgaacagggcgctgccgaccagcccggccagcgacggcttgtagccggggtaggtcagcgagcacagctcgaccgagaccagggcggcgacggcgtccggtgcgccgcgcaggtagtcgtgcatgcgggccaccccggcggcgccggccacgcagccgagcccgaacagcggcacccggcgcacgtcgtcgcgcagaccgagccgcgcggcgatccgggcgtccaccgagggcaccgccaggccggtgaccgtggtggtgatcagcacgtcgaggtcttcgggtttcaggccggcctcgtcgagcgcgccggacagcgccgcgcagcccagggtcaccgcgtgttcgatgaagatccggttggccacgccgaagtcggtcagcgtggggtattgctcgagcggcagcaccagatggcggctgccgaccttggcgctggcatgcagctgccgcacgatgtcctcgtagccttcgaattcggggatgctgacgaagaagtcggtgagctcacgctgcggatagcggtgcggcggcagcgcaccgaacacgccggcgatgacgctcattgcacccaccccttgatcacgaccggtcgggctgacaggttcagccgcatcgctcgagcgggaagtctagtccggttgcaatttaccggcaggtaaatcgaggccatctcaggccgggccgccgagccgttcgcgcagccgcgcggcggtggccgccacggtgtcgatctgctcggcgacccgcgccggcgcggtgccgccccgcgcgtcccgggaggacaccgagccctcgatcgtcaaaacctcccgtacttgcggcgtcagggccgggctgatggcggccagttcgtcgtcggtgagctcgtcgagcccgacggcccgctgctcggcggcgcgcaccgcggccccggcggcctcgtgcgcggaccggaacggcacgccctggcgcaccagccattcggcgatgtcggtggccagcgtgtagccggcgggtgccagcgcggccatccgctgcacgtcgaaggtcaggctgccgaccagcccggccatcgcgggcaacaccagctccagctgggccaccgcgtcgaacaccggttccttgtcctcctgcaggtcgcggttgtaggccagcggttgggccttcagcgtggccagcagcccggccaggttgccgatcagccgcccggacttgccgcgggccagctcggcgatgtccgggttcttcttctgcggcatgatcgagctgccggtggaccaggcgtcgtgcagcttgacgtagccgaactccgtcgagctccacaggatgacgtcctcggccagccgggacaggtcgacaccgatcatggcgaagacgaacgcggcctcggcggcgaagtcccgggacgcggtggcgtcgatcgaattgtcggcggcgctggcaaaccccagctccgcggcgatcgcgtccgggtccaggcccagcgacgagccggccagcgcccccgagccgtacggggacaccgcggcgcgcttgtcgaagtcgacgatgcggtcgacgtcgcgcagcagcgggtgggcgtgcgcgagcagatggtgggccagcagcaccggctgcgcggactgcaggtgcgtcttgcccggcatgatggcctcggggtgggcggcggcctgggcgaccagcgcccccaccacgtccagcgccccggccgcgacgcggcgcacggcgtcgcgcagccacatccggaacagggtggccacctggtcgttgcgcgaccggccggcccgcagccgcccacccaggtcgggcccgacgcggtcgatgaggccgcgctccagcgccgcgtgcacgtcctcgtcggtgaccagcggggtgaagctgccgtcggccacgtcttccgccaggctgtccagcccggccaacagcccgtcgcgctgctcctcggacagcagcccggcccggtacaggatcacggtgtgcgcccgggaggcgacgatgtcgtagggggccagcacccagtcgaagtgggtggacttgctcagggcggccagcgcgtcggacgggccgtcggcgaaccgcccgccccacagcgacccctcgcgggtgctcacgcgcgcccctccgcgcgccctcttgcgggaaagctcaccgctggtcccggcgggaggcgatcttcgacgacagcccgtgcacgtagacgaaacccttcgccgccgactggtcgaagctgtcgccctcgtcgtaggtggccaggttgaagtcgtagagcgattcggcgctgcgccggccgttgaccgcaatgtggccgccgtgcaacaccattcggatctcgccggtgacgtgctcctgggtcttgtcgacgaagctttccagcgcagccttcagcggcgaataccacaacccgtcgtacaccagctcggcccagcgctgatcggtgtgccgcttgaaccggcccagctcccgctccagggtgacgtgctcgagctcggtgtgcgcggtgatgagcaccatggcgccgggcgcctcgtagatctcgcggctcttgatgcccaccagccggtcctccacgacgtccaggcgccctacccccttggcgccggcgcgggcgttgagttcctcgatggcgcccagcaccgacaccggcttgccgtcgatggacaccggaaccccgcgctcgaacccgacgatcacctcgtcgggggtgctccagttcagcgtggggtcctcggtgtaggcgtagacgtccttggtgggcgcgttccaaaggtgttccaggaaaccggtttccaccgcgcgaccccacacgttctggtcgatggagaacggcgagcgtttggtcacgttgatcgggatggcgttctcctcggcgaacgcgatcgccttctcccgcgtccacgcgtaatcgcgcaccggggccagcacctcgagatccggtgccagcgaagcgaatccgacctcgaagcggacctggtcgttgcccttgccggtgcagccgtgcgcgacggtgctgccgccgtgctcgcgggccgcggccaccaggtgcttgacgatcagcggccggctgatcgccgacaccagcgggtagcggtccatgtagagggcgttgttgcggatggtgggcaggcaatagccctcggcgaattcgtcgcgggcgtccacaacgacggcctccaccgcgccgcagtccagggcgcgctggcggatgacctccatgtcttcgccgccctggccgaggtcgatcgccaccgctacgacctcacggccggtctccttgccgatccagctgatggccaccgaggtgtccagaccgccggaatacgccaggatgacgcgttctgacatgaaccaatctccttaagttgaaccgctttaggtgagtttttccaatgtgtcggccaactccgcgcccgtcatcggatcgcgggcggcgacgaacacggtgtcgtcgccggcgatggtgccgacgacgtacggtagcgccgcccggtcgatggcgctggccaggtagtcggcggcgcccggcggagtgcgcagcaccgcgaggttcgcgctggcgtcggccgagaccagcagctcgctcagcaaccgggaaagccgtgcggtgccgcccgatacgccgcgcaccgggctgccgtcctcggggaccatgtagacgccgaccccgccgtcggcgccgcgcagtttgaccgcgcccagctcctcgaggtcgcgcgacagggtggcctgggtgacctcgatgccctcgtcggccagcagcgccgccagctcgctctggctgcgcacctgcgccgacgacaggatcgccacgatgcgggcctgccgggcggcccgggtggtttcggtggtgctcttcgagcgggtcatgactgccgctccaaaagccaggtgagcagcgccttttgcgcgtgcaaccggttttcggcctcgtcccagacgacgctggacggcccgtccatcacctcgtcggtgatctcctcgccgcggtgggccggaaggcagtgcagcacaatggcttccggatccgcgagggacaccaggtcggcgttgagctgatacggccaaaacggtgtgcggcggtccaggccgtcgtcctcctgccccatcgacgtccaggtgtcggtgaccaggacgtcgacaccgcgcgcggccgcccgcgcgtcggtggtgagagtgaccgtggcgccggtgctttcggcgcgccgccgcgccgccgccacgaattccggtgcgggggtgaagccgtccggggcggcgatggtgacgtggatgccggccgtgaccccgcccagcatcagcgagtgggccatgttgttggcgccgtcaccgaggtagcacatccgcaggccgctcagcgaccccttgtgctcggcgatggcctgtaggtcggcgagcatctggcagggatggaactcgtcggagagcgcgttgatcaccggcacggtcgcggcgccggccatcgcctcgaggcgctgctgctcgaacgtccgccacacgatggcctcgacgtagcgggacagcacccgggcggtgtcctccagcgtctcgtcgcggcccagctgggtgctgcgggcgtcgacgaccacggcgtgcccgccgagctgggcgatgcccacctcgaacgagaaccgggtgcgggtggagttcttgtcgaagagcaccgcgaccccgcgcgggccctccagcgggcgcgcgctgaacgggtccttcttcagctcggcggccagcgccaacacctcggcctgctcggccggcgacaggtcgtcgtcgcgcaggaaatgccggggggtcatgccgcggccctgtcgagaatgccgggcagcgcggcgatgaagccgtcgatctgggcctcggtgacgatcagcggcggcgccagccggatgacgccgggggcggcggcgttcaccaggaatccggcctcgcgggcggccgcctcggcgtccttggcgtgcggcgcggtcagcaccaccccgcacagcagtccgcgcccgcgcacgtggtcgaccagcggatggccgagtccctcgatgccctggtgcagcgacttgcccagcacctcggcgtgccggaccaggttctccgaagccagcacccgcaacaccgcgagcgccgcggccgcgcacaccgggttgccgccgaaggtgctgccgtgcaggcccggggtcagcaggtcggcggccggaccgacggccaggcaggcgccgatcggcaggccgccgccgagccccttggccagcgtcaccacgtcgggggtgatgccgtcgtgctgatgggcgaaaaacgttccggtgcagcccattccggtctgcacctcgtcgagcaccagcagcgcgccgtgccgtgcggtgatgtcgcgggcggcggccaggtatccctcgggtgggacgacgacgccgctctcccccatgatcggttccaaaaacaccgccgcggtgccgtcgtcgaccgcggcggccagcgcctcggcgtcgccgtagggcacgtgcgtgacgtcgccgggcagcggcgcgaacggcgcctgcttgctgggctgaccggtcagcgcgagcgaacccatggtccggccgtggaaggcctcttgtgccgcaacgagtttggtgcggccggtgagcctcgacagcttgaacgcgacctcgttggcctcggttccggagttgcagaagaacacccgcgccgtgcccgcggattcggtgccgccggattcgtggccggctggttcgtggccggcgcccagcagggccaccagttcctcggccagcgccagactcggctcggtggcatacagattcgaggtgtggcccagcgtcgacagctgcttcgtgacggcctcgatgatcgccgggtggcgatggcccagcacgttgaccgcgatgccgccgagcagatcgaggtaggtgttgccgtcgacgtcggtgaccacggcgccctcgccgctggccagcgcgaccggcggggtgccgtagttgtgcatcatcacggcctcccagcgccgccgcagcgcgtccgtgtttgtcaccatcgccgatcccccttcccgagcgtcacgctggggtggttctcggcgcccaacgccacgctggcgtgacgctcggcggctggcaaggcacccttcgtcacgagctcaccaccttggtgccggtgccctcgtcggtgaaaagctccaccagcacacagtgttcgacccgcccgtcgatgacgtgcgcgctgggcacgcccgcggacaccgcccgcagacacgcctcgaccttggggatcatgcccgcctccagcgtgggtagcagttgggacagtgtggccgtgtcgatctcgctgaccagcgaatcacggttgggccagctggtgtacaggccctcgacatcggtgagcatcagcagcttctcggcgcccagggcttcggccagcgccgccgccgcggtgtcggcgttgatgttgtgcaccaccccttcggcgtccggggccagcgtcgacaccaccggaatgcgccgcgccgcaatcaaatccagcaccgcggcggcgttgacccgctccacgtcgcccaccaggccgatgtcggtggtcacgccgtccacggtgacgctgcgccgcacggcggtgaacagctgggcgtcctcgccggtgatgccgaccgcatacgggccgtgcgcgttgatcaggttgaccagttcgcggccgacctggccgaacagcaccatccgcgccacgtcgagcacttccggtgtggtgacccggaatccgcccttgaagtcgccagggatgcccagccggcgcagcatcgcggtgatctgcggcccgccgccgtgcacgacgacggggtggatgccgcagttgcgcaggaacgccatgtcggcggcgaaggcgcgccgcagggtgtcgtcggtcatcgcgttgccgccgtacttgatcaccacaatcttgccgtgcagctgcttgagccagggcagcgcttcggccagcacctgcgccttgaccgcggtgggcagcgcttcggtcgagggcgtcatgagctgtaggccgaattctcttcgacgtagccgtgcgacaggtcggtggtgcggacggtggcccgcccgtcgccgagccgcaggtcgacggtgatgtcgatgtcgggcccggacaggtccacctcccgcgcgccgggtgtgccgacgccgtcggcgaagaccgcggaaccgttgaacgacaccgtcatccggtcgggatccagcgcgatcggcgcgatgccgacggcggcgaccacccggccccagttggggtcggagccgaacaccgccgtcttgaccaggctgtcgcgggcgatggtccgggcggcgacgacggcgtcgtcgtcactggccgcgccggtgacggtgacgttgacacgtttggtgacgccctcggcgtcggcctgcagctgagcgcacaggtcatcgcagacccgcagcaccgcgtcgtcgaggtcggcctgcgccggcgtgatcccgctggccccggaggccagcagcagcaccgtgtcgttggtcgaacacgcgccgtcgatgtcgagccggtcgaaggtggcggcggtggcgcggcgcagcgcggtgtccagcgccaccgggtcgacggccgcgtcggtggtgagcacgcacagcatggtggccagcgacggtgcgatcatgcccgcgcccttggccatcccgccgacggtccagttgccaggatggtgcagcgcaacctgtttgggcacggtgtcggtggtcatgatggcctgcgcggcgtcgtcgccgccggacaggccgccggccatgtcctgcacgatggtgcgcaccccggcgagcagcttgtccatcggcagccggtcgccgatcagcccggtggagcacaccgcgacctcgatggcgccggtctcggtgccccagtccgacagcgcggcggcgacggcttcggcggtggcgtgggcatcctggaagccgcccggcccggtgcaggcgttggcgccgcccgagttcaggatgacggcgcgcaacgcgccggtggtcagcacctgctggctccacagcaccggggcggccttgaccttgttgcgggtgaacacgccggcggcgccgtagtcgggtccctcgttgaagaccagggccaggtcgcgcttgcccgacgccttgatccccgcggcgatgccggcggcccggaagccggccggcgcggtgacgccctgctcgcgcagcagccgcgccgcgttcaccgtctcggtcacggcgccaccccgatcaccgaaagtccttgtgtctccggccaacccagcgccaggttcatcgactgcacggccgccccggcggttcccttgaccaggttgtcgatcgcggcgatcgccaccagcacgcccgccgcctcgtccaccgccaccgcgatgtgcgccgcgttgctgccgatcaccgccccggtccgcggcagctgtccctcgggcatcaggtagatgaaaggctctgcgtcataagccttttcgtatgcggcccgaagcgccgaaaacggcgcggtggtgcgggcggtgcaggtggccaggatgccgcgcgaggtcgggatcagcaccggggtgaacgacaccgtgacgtcgcgtccggacacggccgccaggccctgggcgatctcgggggtgtgccggtgcgccccggcgatgttgtaggcccgcgccgacccgatgacctccgagcccagtaggtcggtcttggcggcgcgaccggctccggaggtgccgctgacggcgaccacggtgacggcgggctcgatcaggtcctcggccatcgcgggcagcagggccagcagcgccgcggtcgggtagcagcccggcaccgcgatccggcgggcgccgcgcagccgctcgcgcgccccgggcagctccggcagcccgtagggccaactgccggcgtgcggcgagccgtagaaccgctcccaggcggcggcgtcggtcagccggaagtccgcgccgcagtcgacgatcagcgtgtcggcgccgagctggtcggccagcgccgccgaatgtccgtgcggcaacgccagaaacaccacgtcgtggccggccagcacggcggcgtcggtgggctccagcacgcgctgggccaacggcgtcaggtgcgggtgatgctcgccgagtgggctgccggcgctggccgcggcggtcaccgcgccgatcgccagccgcccctgggcgtaagccgggtgcccgagcagcaggcgtaggatctcaccgcccgcatagccgctggcaccggctaccgccaccctcatcacgtcggccatttggacgattctgcatggttatgcagtactttgcaaatccattccatctaggtgcgcagctcggcgccgaccgcctcggcggcccggcgcaccgcggcgtcgcgggccgcggtggcgtcgtcctcggtcagggtccggtccggcgcgcggaaccgcagcgcgaaggtcagcgacttgcggtgctcgccgagctgcggcccggtgaaaacatcgaacaactgcaggtcttccaacaggtccccggcgccctcacagacggcgtcggccaccgcctgggccggtacgtcggcggccaccaccaggctgacgtcctggaacaccgccgggaacggcgagatgcggggggcgggcagcgtcgcgacgaggggtatcgcgtccaggtcgagttccagcgcgcaggtgcccctgggcaggccggcgcgttcgaccaccgccggatgcagctggccggcgtaccccaccggggtgtcgccgacgagcacctcggcgcatcggcccggatgccacggcagctgctgcgcggcgcgcaaccgcacgtccacgccggcggcccgggcgatgacgcgcaccgcctcgaacgcgtcggcggcctcggcgcgacggcccggcccccacgggccgcgttgttcgcgcaggccggtcagcaccgcggcgacgtgctggggttgccgcggcaacgacgcgtccaggaccgcgatctcggcgtcggtgggccggcggtcgaccggaatgaactgcaccgcacgggtttccgctgtcggctgcaccacctgcgccagcgcgtagagggagacgtcgaccaggccgcgagacacgttgcgcaccaaggcttccagcagcgcgggcagcagcgtggtggccagatgcgggcggtcggcctccagcgggttgagcacctgggtggtgccgcgccgcgggtcgtcgtccggcagtccccacacgtcgaacacgcccgccggcaggaacggggtgggcaggatctcgacgtaaccggactgggccagcgaccgcccgatggcgcggcggcggcgctgcgcggcggacaggccgcggccggccggggccgacggcagcaccgatccgatcacctcgaggccctccagccgcagcacctcctcgaccaggtcggccggctgcagcaggtcgggccgccagctgggcgggaccaccgtcaacgtgccgccgtcggcggtgaccgcggcgccgatctgggcgagccgcttggccgcggtgcccggcgggtagatgaccccggcgaggcggtcgggcaggtcggcgggcatctggatggccggcggtgaccagccgtcgcacgccggctcgccgcgccaatcggtcaacgcctccgacaccttgccgccggcgatgccggcgagcagcgcggcgcaccggtccagcgcggccaccgagatcgccggatccaccccacgctcgtagcggcgggcggcttcgctgggcaggtgcaacctgcgctgggtgcgcgacaccgcggccgggtcccacaccgcggcctcgagcagcacgtcggtggaatcggcgcgcacctcggtgctggccgcgcccatcacgccgccgatcgccgcggtcgccgcgtcgtcgacgatcaggacgtcgacgggttcgagcttgcgctcgatgtcgtcgagggtgacgacggtctcgccgggccgggcgaagcgcacgccgagcccgccgctgatccggttgcggtcgtgggcgtgcatggggtggccgagctcgagcatcacgtagttggtcacatcgaccgccggcgaggtggcgcggatgcccgacagcaacagccggcgctgcagccaccacggcgacaccgcggccgggtcgatgccggtgaccgggcgcagcgcgaaccgccgcaccccggtgtcgggctgcaccgtcagcggccaggcctggccgtcgaccggcagcggcttgacatccgcggggtcgacgaattccaggtcgtaggcgcaggcgatctcgcgcgccaggccgcgcaacgacatgcagtagccgcggtcgggggtgatcgccaggtggaagatcacgtcgtcgagtcccagcaccgcggcgccgtcggcgcccggttcggcggtgcccggcggcagcaccaggatcccggaatggtcggcgcccaggccgagttcggccgccgagcagatcattccgtccgaattgcggccgtaggtcttgcgcgcggcgatggcgaacccgcccggcagcgtggtgccgggcaacgccaccaccaccaggtcccctgctacgaaattcgttgcgccgcagacgatttcacggtcaacgtcgtcgccgacgtcgacatggcagaaccggatcggcttcttgaagccggtcagctcttcgatgtcggtgacccggccgacggtcagcgggccgtccaccggccccaactcgatgacctcttcgacctcgtggccgatgcggatcagggtctgttccagttcggcgggggcgacgtcccagtccggcgccccggcggccacgacctcgcgcaaccagctgtacggaacgcgcatcaggcgcccaccccgaacggcagcaagaaccgcacgtcgccctcgaccatgtcacgcatgtccggaatcccgttgcggaactgcagggttcgctccaggcccattccgaatgcgaacccggagtagacgtccgggtcgattccggcggcccgcaacacatttggatgcaccattccgcagccgccccactccacccagccggcgccgcccttcttgccgacgaaccacacgtcgacctcggcggacggttcggtgaacgggaagaagtgcggccggatccgggtccgcgcctgcgggccgaattctgctcgcgcgaacgcatccagcgttccgcgcaggtgcgccatggacaggccgcggtccacggccaggccctcgacctggtggaagaccggggtgtgggtggcatcgagttcgtcggtgcggaaggtgcgcccgatcgagatgacgtagaccggcagctcgcgggcgagcagcgtgcgcacctgcaccggcgaggtgtgggtgcgcaacagctgccgggaaccctccggcgcgatgtaaaaggtgtcctgttcgctgcgcgccgggtggtcggcggggaagttgagcgcgtcgaagttgaactgctcggcttccacctcgggcccctcggccagttcccagcccatcgcgatgaaggtgtcggcgatgtgttcggccaggatcgtgatgggatgccgggcgccgaccggctgccgggtcgacggcagggtgacgtcgatgcgttcggcgaccagcaccgcggcgtcgcgttcggcgcgcaacacgtccaggcgttcgtcgtaggcctgctgggcctgcgcgcgtgcggcgttgacccgcctgcccgcgtcggcgcgctggtccttggggacgccgccgagcgcctggcgtgccagggccagcggcgcccggtcaccgaggtgctcggtcttcaggcgcgccaacgcgtcgaggtcgccggcccgggcgaaggcctgccgcgcggcgccgaccgcctcggccaacgctgtttccgacaggtccacgggttgatcacccacgcggcgacactctccttgctgacgaggctctacgggctgcccgcatcggcgccgcgctgggttcgattcgcccggctcctcctcggtcgctacgcgaaccgcatcgtcgccgggctgggcacgatggtgattccgcgcggcacgggtcgagtgctgatcatagtgatgcgctgcgtgccgccgcggcgacggtcgtcagccggctacggccggctgcgggccggtcagcgggtcgtcgccgtcgagcggggtcaccgccaggccgcggccggtgtacgccttggccgccgcgtaggccacggcggcgcccagcagaccgaacaccggcgtggccgccatggttccccaatggtgggccagcatcaaaaagccgaagcccgaggacgccgccagcatcaggtagcgcgccggcgtccagtggatcggctggcggaaccgcgccgacaccagcacgcccaggatcaccgcgacggtgtgaccggcatcggtgaagtcgccgccgacgatcgccgacgcgatgcccgccgccacccaccagccgacccaggcggcccgccagcgcgccgggatcaccgccgtcatcgcgcccagcaccgccagcgcgccgtagctcatccccacgtcactggcccgggtgatcgacacgggcagccagccgaactcgaccgacgctgccagcgcggcggccaccagcagcgtcgcgccgatgtggccgaccagaaacgccaccaccagccggatggtgcgcaggtgcagctccgccagcgccagcagacaggtcagaaagggcagccagaagtagagcggtccggcgtcgacgaccagcgcgctgcccagcagcgtgcccaggtggccgtgcgacaggttgtgcaggttggtgctggcgcgctgcacgatgacgtcatgcgcctgcgggccgagcatcaagatggcgcagctgatggccagcagcagcgccgcataccccacggtgaattggacccgggccagccgggacacgatgcccccaatcattggcacccattatggctgcggtttcgtctcgtccgtgtcatcggaggctgacaactccttaagagtcttgaggcgatatatcgccaagtcggcgggcatgccggcgggcttgggtccgaaaaccggtttgcgggtgcgtttggcctcgacgcccaacgcgtccaactcgctttgcggtatgtggtccaacgtggaactcgacaccatgattccacccttggtggcccgttccataacccgtgcggcgatgttcacatccacacccagccaatccgaggccagccgctgcgggcggccggtgtggatgccgacccgcatccgcggtgtatagccggccacctcgaccgatctcagcgcctccttggcggccagcacggcccgcacggcgacggtcggatcgccgaacacggccatcagcccgtcgcccatgcgcttgacgatgtgcccgccggcgtccagcagcggtggttcgacggcgcgggccacctggcgcagcagcgccagggcggcgtcgtcgcccgcctgcaacgaccaggtggagaacccgaccaggtcggtgaagaccaacgtcacctccggattggccggacgacgcgagatgccctcggtcagcgcctgccacacctgcagcaccccgaggctgacctcacgcgacaccgcgtcgcggtcccccagcagccggtcggccgcgcgggccgccatcgccggcggtagacagcggatcgccgaagtcggggtcgcccggcagcaaccggcgcgcacgcctgacgagtgccaccgccccggggctgtggtttcggttgtgcagccactgggtggcgttgtgcaccgacagtgcggtgcgtcgcgaagccgactgcgccgccgcggattcctcgggctcgcccggatccagatcgcgacgcgcgagttccacctggccaggttatttgctttcgtcgacgccaggcaacgacggccgcgtcgcatgtgtcgcaactcgcattcgcacggggtcgatcacgggcctcgatcacgggagcggcacaccggcgtggaacccccgataacacttcccggacacggcaccgaaatcgtagacaacacgcgttgtcaaaagttatggtgaccgcaactggcgcaggaggccgcgatgactggcagatcgactacagccgctgatccgctcggaccagattccctgacctggaagtactttggcgatctgcgcaccggaatgatgggcgtgtggatcggcgccatccagaacatgtatcccgaactcggcgccggcgtgcaagagcattcgatcctgctgcgcgagccgctgcaacgggtggcccggtcggtctacccgatcatgggtgtggtctacgacggcgaccgggcgccgcagaccggccggcagatcaccagctaccaccacaccatcaaggggaccgacgcctcggggcgccggtaccacgcgctcaacccggacaccttctactgggcgcacgccacgtttttcatgctcatcatcaaggtggccgagtacttctgcggcggcctgaccgaggccgagaagcggcagctgttcgacgagcacgtgcagtggtaccggatgtacgggatgagcatgcgtccggtgcccaagtcgtgggaggaattccaggagtactgggagcgcaccggccgcgaggtcctcgagatcaaccaggcgacgctggacatcttccggatgcgcatccccaaaccgaagttcgtgttgatcccgaccccgctgtgggaccagctgttccggccgctggtggccggccagcgctggatcgcggccgggttgttcgagcccgcggtgcgcgagaaggccggcatgcactggacgccgggcgacgaggtgctgttgcgcctgttcggcaagatcgtcgaactggccttcctggcggtgcccgacgagatccggctgcacccgcgggcgctggccgcctaccggcgcgaacagggacggctgcccagcgacgcgccgctggtggaggccccgccgttcatggcgccgccgcgggaccggcgcggactgccgatgcactacttcccgccgccgcccaggttgccgttcgacccggccctgcagcccgcgcgggcgctgatggaacgcgccggatcgctggtgcacaccacgttgtcgctggctgggctgcgcgccgggcggggccggccgaaacgaccggtcagggccgcgtgaacagctccagcgcccgcgcgctctggtagaggcagatcgccgcggccgaggccacgttcaggctctccgcgccgccggccatcgggatgcacacccggtgatcggccgccgccgcgactgcgcttggcagaccgtgtgattcggggccgaacagccaggctgtcggcttggccagcagttcacccgcccgatccaggcgcacctcgccgtccacggtggtggccagcagctgcaggccggcctcgcgcaccgcggcgacggcctcgcgcaggtccggcgcggcggccaccgggacggagaagatgctgccggccgatgcgcgcaggcatttgccgttgtacgggtcgacgctgtggccggccagcagcacgccggccgcgcccatggcgtcggccagccgaatcagggtgccggcgttgcccggctcgctgatctggaccgcgaccgcgatgagccgcggcgacccggccagcacgtcgcgcaggccggtggccggcaggtcgcacaccgcgaccagcccggccggggtgacggtgtcggagagcgccttggcggcgcgctcggtgaccagatggaccgggcagtccagcgccgccagcagcggcgcataccgctgctgcgcggcttcggtgacgaagacgtcgcggaccaggccgcggcccgcggccgcctcgaccaggttggagccctcggccaggaaccgggcggcccggcgccggccgacgtggcggtgcagtttggccgccgcggcgaccctgcccgaacgttcggtcagcaccctgcggcgtccccgtcgtcgccgggtcggttaggccgcttctccggagtccgacggggcgttgacgtcctcgggcagcgccgcccgggcgacgtcgaccagcgcggtgaaggcggccgggtcggcgatcgcgatgtcggcgaggttcttgcggtccacttccacgccggcggccttgaggccctggatcagccggttgtaggtgatgtcgttggcgcgcgccgcggcgttgatccgcgagatccacagcttgcggaactcacccttgcgcgcgcgacggtcgcggtaggcgtagttcagcgaatgtagttgctgctctttggctttgcggtagagccgggatcgctggccgcgatagcccttcgaggccttcaggatgctgcgcctcttcttgtgggcgttgaccgcccgcttcacgcgtgccatgggatgttcctactctcgttcaaacgtcattcggtcggaggtgccgtgccagctcgcggacgggtctggccggcgcggggtcagccgttcagcaggctgttgacccgcttggtgtcgttggccgacaccgtggtgcggccttccagccgccgcgtgcgggtggtcggcttgtgttcgagcagatgccggcggttggtcttctgccggacgatcttgccggttccggtgcgccggaaccgctttgaagccccgctgtgggtcttggctttgggcatgtttcctctgttcggtaaggactgtcgtggtcgggcggtgggtcagttcgacgagggttcggcgtccgcggccgcatcggagtccgatgccgcgccgccgggcccctcgggatgccgcgccctggcgcgagtcttcgcgccgcgatgcggtgccagcaccatcgtcatgttgcggccgtcctgcttggcggacgtctcgacgaaaccgtattcggcgacgtcggcgcccagccgctgcagcaatcggtagcccagctcgggccgcgactgctcacgtccgcggaacatgatggtcaccttcaccttcgatcccgcttccaggaagcggatgacgtgaccctttttggtctcgtagtcgtgatcgtcgatcttgggtcgcagcttttgttccttgacgacggtctgctgctgattccggcgggattcgcgcgccttttgcgccgcttcgtatttgaacttgccgtagtccatgatcttgcagaccggtggtctggcgttcggggcgacttcgacaaggtcgagatcggcgtccgcggcgacgcgcagtgcgtcttcgatgcgcactatgcctacctgctctccccctgggccgatcaaccggacttcaggtacgcggatgcgctcgttgacgcgggtctcagtgctgatggggcctcccttgttgggcttctatatgtcctggcgaatatcctgcgtgacgaccggtgaccgggtggtccgggaagcagcggcggagacaccacaccactagcaaaaaggccctgcacaagcagggcccaatgccgaccgatcccggctgagcggtgctcgagccgcccgcggtagccgcggaacaggcattcgcgatgcctgtgaccggaccgccggacctgggagaatccgctcaggatctcgtcggcccgcggtgggagtgggactccacttactgttcccggcttgcgccgggctggtcgcagccgtcagtttagcagtgttgaggaggcttttagcacttcggccgcccgaccgggcccgcgcgggcgtcgatccggccgggaaaacaccgcgaaattcgtgccggccactcttagcgcttcgacaagcttttcacggatagagggcatatcctcgcggtctgtgacactcgcatctcctggttcgaggtctggttcgggtcctcgttcggggccgcggttggggcctcgcaaccggtcgacctcgcggtatcgctgggtgccggcggccgccgggtggaccgtgggtgtgatcgccacggtgtcgctgctgggcagcgtgtccccgctgatccggtacctgatcaaggtcccgcgcgagttcatcaacgactacctgttcaacttccccgacacaagcatcgcctggtcgttcgtgctggccctgctggcggcggcgctgacggcacgcaagcggatcgcctggctgctgttgctgggcaacatgatcctggccgccgccctcaacgtcgccgacatcgccgccggtgacaacaccgccgccgagatcttcggcgagaacctgggtttcgccgtccacatcgtcgcgatcgtcctgctggtgctggcgtatcgggagttctgggccaaggtccgcaagggcgcgctggtcaaggcggccgcggtgctggtcgccggggacgtggtgggcatcctggtgtcctggggcctggtcgagttgttccccggcaccctggcccgccaggaccggctgccctacgtggtcaaccgggtggtcggcttcgcgctagccgacccggaccttttcaccggccgcccgcacgtgttcctcaacgcgatcttcgggttgttcggcgcgctcgcgctgatcatggcgaccatcgtgctctttcaatcccagcgcgcggagaacgcgctgaccggtgaggacgagtcggccatccgcggactgctggagttgtacggcaagaacgactcgctgggctacttcgccacccgccgcgacaaatcggtggtcttcgcccagagcggacgcgccgccatcacctaccgggtcgagatcggggtctgtttggccagcggcgacccgatcggcgatccccgcgcgtggccgcaggcggtcgacgcctggctgggcctgtgccagacctacggctgggcgcccggcgtgatgggcgccagcacgcagggggctcggacctatcgcgaggccggcctcaacgcgctcgagctgggtgacgaggccatcctgcgcacctccgagttcaagctgtccggcccggacatgcgcggcgtccgccaggcggtgacccgggcccgccgggccgggttgacggtgcggatccgccggcaccgcgacatctcccccgaggcgatggccgacaccatcgcccgcgccgacgcctggcgtgacacccagaccgagcgcggcttctccatggcgctgggccggctcggtgacccggccgacggggactgcctgctggtggaggccatcgaccgggacggcagcgtggtcgcgatgctgtcgctggtcccgtggggcaccaccggtgtgtcgctggacttgatgcgccggtcgccgagctcacccaacggcaccatcgagctgatggtcagcgagctggcgttgaacgccgaaagccttggtatcacccgcatttcgctgaacttcgcgatgtttcggtcggcgttcgaacagggcgcccagctgggcgccggcccggtcgcgcggctgtggcgggggttgctgctgttcttctcccggtggtggcagctggagaccctgtaccgctcgaacatgaagtaccaacccgattgggttccgcgctacgcctgctacgaggatgcccggctgatcccccgggtcggcgtcgcgtcggtgatcgccgagggcttcctggtgttgccgttcagccggcgcgacaaggtgcacaccggccatcaccccgccgtgccggcccggctggcgcagtcgggcctgctgcaccacgacggctcggcaccggacgtgagcgggctgcgcccggagcgcaccgacgccgaggaggcgcgctcgcggctgcccgagcaggtccgggtgcgcctggccaagctgaaggtgttgcagcgcaacggtgttgacgcctatccggtgggctgtccgcccagccacaccgtcgcgcaggcgctggacgccgacgaccagcaggacatcaccgtcgccgggcggatcctgcggatccgcgacttcggtggtgtgctgttcgcccagctgcgggactggtcgggggaaatgcaagtgctgctggacaattcgcgtctggagcggggccgcacggccgacttcaccgcggccatcgatctcggcgacctggtcgaggtgtccggtcagatggggttctccaagaaaggcacccggtcgctgatcgtcaccgactggcggatgatcggtaagtgcttgcggccattgccgaataagtggaaggggctcaccgatccggaggcccgggtgcgaacccgctacgtcgacctggcggtcaaccccgagtcgcgggagttgatcgcggcgcgcagcgaggtgctgcgctcggtccggcagaccctgttcgccaagggattcatcgaggtcgagaccccgatcctgcagcagatccacggcggcgccaccgcccggccgttcgtcacgcacatcaacacctacgacatggacctgttcctgcgcatcgcgccggagctgtatctgaagcggctgtgcgtcggcggcgtggagcgcgtcttcgagttgggccgggcgttccgcaacgagggggtcgacttcagccacaacccggagttcaccctgctggaggcctaccaggcgcacgccgactatcgggtgtggatcgacgggtgccgcgagctgatccagaacgccgcccaggccgcgcacggcgagcagaccgtgctgcggcccggcgccgacggccggctgcaaccggtcgacatctccgggatctgggcggtcaagaccgtgcacgacgcggtgtccgaggcactcggcgagcaggtcgaccccggcacgtcgctgtccaccctgcgcaaactgtccgacgcggcgcgcatcccctaccgcgcgcactgggacgccggcgcggtggtgctcgagctctacgagcacctggtcgaggaccggaccgaggagccgacgttctacgtcgacttccccacctcggtgtcgccgctgacccggccgcaccgcagccggcccggggtcgcggagcggtgggacctggtggcctggggtgtcgagctggccaccgcctacagcgagctgaccgatccggtggagcagcgccgccgcctgcaggagcagtcgctgttagctgccggcggggatcccgaggcgatggaactcgacgaggacttcctgcaggcgatggagtacgcgatgccgccgacgggcgggctgggcatgggcgtcgatcgcctcgtcatgctcataacgggccgcagcatccgcgaaaccttgccgtttccgctggccaagccgcactagcggaggccatccgacactcggccaaccgggggcgaacattcggtgaatacgttccagggcggttaacaatagatcacaatgactcacgtgacagactccccgaacggtgcacccgcacagttcctggcgtttagccacacctcgctgatgcatggctgggtgccgatgacggtccaggtgctggccggtgtcgtgctgacgttggcggtcggctggcggtcgcgccgctggcggacggtgtgggtgccggtggccgcgctggccggcgccgccgtggcctacctgacgcactggtatatcgtcgaccgcgggctgtccgacgagcccgccccggcggcgctgtggctctgggtcatgctcaccgggacggcggtggcggtgctggtgctgggctggcggaccgcgcgccgctggcggcgcggcgccgcggtgctggcggttccgctgtgctcgctcagcgcggccctggtgctcaacctgtgggtcggctacttccccacggtgcagtccgcgtggagtcagctgacgtcgggcccgctgcccgaccagaccgaccaagccaccgttaccgccatggccgccagtcgaattcggccgccgcacggcaccgtggtgccggtggcgatcccgtcggacggctcgcacttcaaacaccgcggcgagctggtctacctgccgcccgaatggttcgccaccaccccgcccccggcgttgccgacggtgatgatgatcggcggtcagttcaacaccccggcggactggacccgggcgggcaacgcggtcaagaccatcgacgacttcgcggccgcccaccacggccaggcgccggtgttggtgttcgtggactccggcggcgccttcaacaacgacaccgagtgcgtcaacggggtccgcggcaacgccgccgaccacctgaccaaagatgttgtgccgttcatgatctcggcgttcggggtcagcccgcaccgggcgaactggggcgtcgcgggatggtcgatgggcggcacctgcgcggtggatctgaccgtcatgcacccggagctgttcagcgcgttcgtcgacgtcgccggcgacttcttccccaatgcgggcaacaaggcgcaaaccatcgcccggctgttcggcggaaacgccgacgcctgggcggcattcgatccgaccacggtgatcaaccggcacggaccgtaccgcgacgtggccggctggttcgcgatctcctcggacggcccgcccgcgccccggcgtgacatccagctcagcgacagcggcgccatccggctcgcggcacgcgaggccgcggccaaccccggcaaccagaccgccgccgcctattcgctgtgtgcgctgggccgcgccaacggcatcgactgcgccgtggtgccgcagcccggtcggcacgactggccgttcgcggaccgcgcgttcgcggccgcgctgccctggctggccggggcgctgggcactcccggaattccgcgaaccccgttgcccgccacgtcgtccccggccgtcggcgctccgctggtggtcccggccgagcggtccaacaccggcaagcgttagcgccggtggcgtcggttgcgcgcgtgcggcgtgcggtcttcgcgcggcactgccacccgtgcagcgcgtggtcccgatgggcgagcacgccgctgatcctggtgccgccctggacgcgacgggccaagcacgcggtatggattgcgctgtggctggcggtgaatccgttcatcttcggcgaaccggcccatcaccgcgcctgggccacgcgggcgatgctgggcgaggaactgtggattacccgccggccccgggacgcggcgatggtggtcagcgcggcgacgtcggcggccgcgctggttgcggtgatcgccgcccatcgccatcggctgagacccgcgctggtcgcgaccgccctgcagatggcgctgacgctggtgtactggcagcagatggttcggtatctcgaacgcgagatgcggtaacgcggccgatcgtctgcgagacagggcaatacgcgcgtatcgctgagcgatacgaaggtattgtcaggccgtgggacccacccggctgtttccgtacgatccgccccccgcgcaacgatcggcgaaggagcggatacgcgacgcggcgctgagctgtttcgccattcgcggcgtcgccgccacatcgctgcgcactgtcgccgaagccgcggaggtgtcggtcgggctcgtgcagcaccacttcggcaccaagttggcgctcgtcgccgccgtcgaccagtacgtactggctcaggtcggtgaggcgttggaagcgacggcgttgaccgatgcgccggttgacggcctcgacgatgccggccagcgcctgacctcgttgatggccgaacgccctgacgtgatgtcttatctcgggcgcgcgctcgccgagggcggaactctgggggcggtcatcttcgacgggctgttggccatcagcgcggcccagcgtgacgaattcgtccggcagggcaacacccggcccgatctcgatcccgagtgggcggcactcaacccactgatcttgcgggtcggtgccatcattttgcatccctacatcgagttgcgcctgcgcaaatcgttcttcgccgagccggagctgcgacgctgggacgccgccgtcaccagtctcatccggcacgggctcttcctcgacgcacccgaagcccgggagcgcgggcgcggcgagtgactccccagccgcgtcggaggtacccgccgatcgcacgtttcagaaacggggtcccgcccacgacccaggtgctatacacgagacaccatgcatgagtccgccgtatccgcctatgccgcgcaacttctcgacgccgacaaccccgacgacatgccggagttgcagcggctgcaaggcgatccgaacgtggaattcatcgatcggctcgacacgcagatggccaacctcgccaacctgcgtcccgcaccgcctcccgagcttctcgcggagcccggccgatgggcctactacccatggcgacgcgccgtcgtggcggtgctcggcccccgcgggtaccgtgccgtgcgcctggaccgcaaccgcaacaacatcacttccgcggagcaggaccggctcgctacgctccgggtcggggtggccggcctgagcgtcggccacgtcatcgcgcacaccctggccgcgcagggattgtgcggccggcttcggctcgccgatttcgatcatatggagctgtcgaacctgaatcgggtgcccgccaccgtattcgacctcggcgtcaataaggcgtgcgtggcggcgcgcagggttgccgaactcgacccgtacctgccggtcgaggtcttcgccgccgggctcaccttcgacaccgtcgacgcgttcctggacggcctcgacatcgtgatcgaagagtgtgactcgctcgacatgaaggcggtactgcgcgaaggcgcccgtgcccgccggattccggtgttgatggcgaccagcgatcgcggactagtcgacgtggagcgtttcgaccaggagccgcagcgcccgatcttgcatggcctactcggcgacctcgacatcggcctactcccgggtatgagcagccgcgagaaggtcccccacatcttgcgtcaccttgaagcggaacgactttcgccccgcacggccgcatcattggtcgagatcgaccgcacggtgtcgacctggccccagctcgcgtcggacgtcgtcctcggtgccgcggcgctggcggagggcgtgcgtcggatcggactcggcgaagagctccgctcgggccgcacccgcatcgatatcggctgggcgctcgaccgactcgacgagcctgacatgactcggcacggccccacaccggtggacgacgttcacgaggcgccggaactgcccggaatggccgggaccatcgccagcgccgcgatccgcgccccctccgggggaaacgtccagccctggtttgtccaagccggacccaccagtatcaccatcgacgttgccgcccaacatacttcgacgatggacgtcgggttccgaggcagctccgtcgcggtgggcgcagctctgatgaacgccaggatcgctgcggcggcgcaccaggttctcgggcccttcagcctcagtgaacgggtcaacgggtcgccggtgcgcgccactctgaacctgagtgatggcaccgacccctggctcgcggatctctatcagtcgatgatccggcgcgagacaaatcgccatcacggaagcccgcgagcggtcgacgccgcgaccatcgaggcgctcggcgacgcggcaaaccgcgagtgcgcgcgactgcacctgatcaccggccgtgacgagatcgaacgtgcggcaacgcttctcgccgcatcagaccgcatccgctatctaacgccacacctgcaccgggaaatggtgtccgaacttcgctggcccggcgacgccgacccggacaccggaatcgatgtgcgcagcctggaactcgacgccggcgacctggcgctcctcgacatcctgcgtcgcgaggacgtcatggcctacctcgcccgatggaacgcgggcggcgcactcggggaagacacgcgcgaccggatactggccagttcggccttggccgcaatcaccgtccggggacgtgagctgcgcgactatgcgcggggcggggctgccgtcgagctggtctggatcatcgcccagcgcctggggctcgcggtgcagcccgtctcgccggtcttcttgtacgcccacaaccgggcagagttcgaccagctgtcaccccaattcgccgacgagctaatgcaattggagcgcaacttccgagcactggcggagataaccaaagacgaagccgcggtgctgctgctccggttcaccgccgcaccgccggcatcggtgccgagccggcgcagcgtcgaacgaacccgggtgcgcaattgagcggctggctgctcgcacactgcatatcgattgtgagtccggcgctcggccggattcgtgactccgggcacattgcccgccccgttcccccgttgaagctacggtaatggaaatgtcgggcacgttggactacctggtcaccgccgctgccgccgaattgatggcggcgacggcggcggactcggccgcgatcagccaacgggtgctcggcaacctggttcgcgacttgggcgtggacttcagcttcctgcgccacaacgaccacacgatccgcgcgacgatcctcgtcgccgagtggccgccacgcaatgccgacccagacccgctcggtgtggtgtatttcgccgacgccgactccgtgttcgcgcaggccgaacacctcaaggcgccccaggtggtccgcccggaggcggcaaatgccgactaccaacgcaatatcgacgagggcaccggctggggaaccgtctcgcttgccgccgtgcccctgctctccggggacgtgacgaccggtacgctggccttcggcaaggccggcgaccgcgaatggctgcccgaagagctcaatgcgctgcaggcaatcgcggcgctcttcgcgcagctgcaggcccgcgtcgtcgccgagaagcagatccactacctcgccgagcacgatgaactcaccgggctgctgaaccgcagggcgctcatcgcatacctgacaagcgcctcgccccggggcaaccgggcccggtctcggtcgtgttcctggccgtcgaccggttcaaggtcatcaacggtcgcctcgggcaacacgccggcgaccggttcatcgaggccttcgccgcgctcatccgccagaccatcgacattccgtcggtcatcgctcgcttcggcggtgacgagttcgttgtcgtgcccgaggcgccaatggacgtcgaagcggccgaggcgttcgcccggtcgctgcacggcctgctgcaccagcaggtcgagatcgaccacgaaatgcttagtcgcacagtgagtatcggtgtcgcggccggtgcgccgggcgacgagaccacgtcggacctgctgcgccgggtcgaccaggccacccgttcggccaagagttccggcggaaacaacgtcgcgacgttcaggccggagatgtcgacaacggacacgatccgcaacgacatcgaactgcacttggaagggatgatcgacggagccagcggtgccctggtcctgcattacctgccggagttcgacatgcgcaccggcgcggtgctcggcaccgaggcgctattgcgttggcaacacccgactctgggattgttgatgcccgattcgttcattcaggtcgtggaatcgatcaacctgggcgccaaactcggtcgtctcgtaatgcattcggcctgtgcgcaattcgggctctggcaatcgcgtggtgtcggcaagggagcggtgctgcgcatcaacgtgtctcccgtacagctcgtcacggcaggcatcgtggacacggtcgcggccaccctcgacgagttccgcctcgatcccagcactatctgcctcgagatcaccgagagcgtcgtggtccaggacatcgacgctacccgccaaaccctgttcgggttgaaggacattggcgtgcagatcgccatcgacgacttcggcaccgggtacagcgtgctgacgtatctgaagtctcttcccgtcgattcactcaagatcgacaagggcttcgtgcacagtgtcgatacgaacgccggcgacctggcgatcgtccgctcgacgctggccctggccgatgccttcgggctcggcgtcgtcgccgaaggagtcgaaacggtggccgccgcccaaacgctgctcagcttgggttgtcatcgcgcccaagggtttctgctatcgcggccgctggacagcgccgcgatggagtcgcttctcgcccagcgcgtcgtccccatgaatttctccgagaccgggccagcggtctagatccgccaagagcgcagtacccccacgctcacgggcggcgttgaaataggtagtaatacgtcggggtcttgtcgtcgagcgcccgctcctggccagtggacaacagcgtccaacccgcggtgaaccgccgttcgatttcggcgcgatcgatgcccggcacgccgaaccggcccccgggaggaaacgcgacgatgaacagccgtgcgtcgggcgccgcaacggcgctgacctcccggacatacgcgtcgcgatcgccgccactcatgttgtggatgcagccgttgtcgacgatcaaatcgaaggccgccccaatcccagactggctcaactgcgtgacgtcggcacggacgaaatcgaccgcaacgccggcagcggcggccttcgcgcgcgccttgtcgagcggcttcgcgacgtagtcgactccggtgacattccagccgtgctgagcgaggtaaacagcgcaatcccccgtgccgcaccccaagtcgagggccgagcccgtgggcagcgcctgcgtgccagcggccccttcaaccagatcccgcagaccctgcccgatcggatgcccttcccagggggtgaagccgacccggtagaagaaccggaatcgtgcgcgccgtgaagccatagccgcaatgatggcattcaccgcagccggagcgtcgcccgccccccggcgacgagcgaggccaagcacgacagcgtcagcgccgtcgtctcaccatggccctgatcggcgccgccgcgaccatggtgaagggcacggccagcgggaaatcgtcggacagggactcgatttcgacgcggcgaacgatggttgccaacgcgagcgtagcctccagcatcgcaaagtggtccccgatgcacgagcgcggcccgcccccgaacggtaggtactgccaccggtcgcgatcaccggcgcggcggggatcgaatcgatccgggtcgaagcgcagcggggcgtcccacaagctcggatcggtttgtaccgccattctgccgaacgccagcatggttccggcttcgacgcggtagccggcgacttcgacatcgcgggtggccatccgggttccggtcggcccgggcgggcacagccgcagcgcctcctggagcacgcggaccgtaaatcccagccgcgcaacgtcatcgggagtaaggtggcggtccggtaactcggccacttcggccgcgacccgcgcctgatactcgggatggcggcccagcgcccacagcgcgtaggtcagcgtcgtcgccgtggtgtcgtggccggcgaacaggaagatgatcatttcgtcgcggatttccttgtccgacaacgcctgcccggtctccgggtcggtggccgcgatgagcgcatgcaccaacggggcctcccggccggggtcggcgcggcacgcctgcaggatctcatccgccagcgcgcgaatggcgccggccgcggcgcgggcgcgccgccgggacggcgtgggcagccactccggtgcgcgcagcggccgcagcgcccgccgcaccgcgtagctcgtcgccacgcgcaggggctcggcgatcgcgtcggagcgctcgtcgaggtccaaacccaataccgagcggcccagcgcgcgcaaggtcagtgtgcggcactgcgcatccaggtcgatctcggtgtcttcgggccacccggcgcacacgctctccgcggcctcggccatgtgtcccccaaactcacggacacgctgacgggtgaacaccggttgcagggtgcgtcggcgcggcaaccactcggtgtggggcaggacgaacaggttcggaccgagcagtcggcgcagctcggtggctaccgtgctcgtcttgtcaatcgaaccgtcccgcacgctgacgatgtcgcggatgccctgcggggacgtcgccaaaacgatcggtgaaatcagccacctgggtcccagggtgacccgggtgacgggtccgcccgcatcgcgaagcttgttagtaccggtgtggaattccttgatggcccttaaccgttcgcgataggaaagcggatttttgggggccaagggcaatccggcgatgtcacgcttgggttcggcgaccgacacgattcgaccctagaacactttcgcatcgggcacgcggaacttgcgacctcggaccgacatcgcctatgccgataggcggctgaggatttcggtgttctcggcgcacatcaacttgaattgcgccggatcggcatgggcggcgagggtgcggcggtcccaccacatcaccttggttcggtagttctcgttgggataggccgccgccggcacccgagacgccaccacaccgccggaggactgccactgctcgagcacgtgcgccgccgcggtggccatgacgaactgggcaccgagcagcgtcatcgtcggcaacgcggtgcgggccagcacggtggaaagggcccgattgccgtattcgcgggaattcgtccatgcgcttttcacttccacgacgccaaagggaatccggttggcaatcatgtagcgcagcagcggaagccccgggtttccttcccactcctgcagggcgtgcgaatcctccggagaccgcaacggccccaccacccgcgtccccccgacgacccgaccttgggggtcaagcgcggcaaagaacagggccgtgtcggcgccatccctgatccgctccaggtcgagcacccagtccaggccgtgcttgcgataactctcgagtgcgccgtccagatattgattccacaattcgggctccgcttccggcgtcgacgcggtgacccgacaacccgtcgcctggtcgtaccagccgaatccggtctccggccacgggccgtcgctaatctctcttgccgcgagctgagccgcttccatgtttacctccactcatttgccgtacgatccgagccatttttgaccgagccttcaacaccaatttgtttgttaataagactcgtgacaaataaccaaggtgattgtggcacaagcagctaattacgtcccttcggctcgggcaagaagttgcacggcgcgcttgctcagcggcgcatgggatttggcgaatagaacagctactgttcagtaaccgcggtcgcggccgatttatggttaacgccggtcccggccagagcatggaaaatgtggcgtgcagcgacgaatcttccccaatcgtctgtgccgatgatttgacgcccaacggtgacaacaggcgttgcctatttcgatcgccgccgcagtagcgtaaccgcatgcccgacgaatcagctacgccggccgacgccggctacgacaacgccggcgtgcccaccttcgattccgtccgggacaagatcgaggcgcgctacgcgacggcgcagggcgccgccgacctcgacgcggaatcgcccgaaggccgatcggtcgccgagcagtacgacgagcgggaacgcgccgccgcacggcggctggcccagatccgcgagtccatgcggccgcagcaggattgactcaggcggtggctttgcggcgccggctcgaccggcgcggggcgccggccgccgccccgccacggccgatcacctcggcgaggaacttgccggtgtagctctccggcaccgcggcgacgtcctccggagtgccttgcgcgacaacggttccgccctcggccccaccctccgggcccatgtcgacgatccagtccgaggtcttgatcacatccaggttgtgttcgatgacgatcaccgtgttgcctttgtcgacaaggccgttgatgaccttcagcagcttgcggatgtcgtcgaaatgcagccccgtggtgggctcgtcgaggatgtagatggtgcggccggtggagcgcttctgcagttcggcggccagtttgacgcgctgcgcctcgccgccggacagggtgggcgccggctggccgagccgcacataacccaggccgacgtcgaccagggtgcgcaggtagcggtgaatgccggtgatcggctcgaagaactccgccgcctcctcgatggacatgtccagcacctcggagatggtcttgcccttgtagtgcacctccagggtctcccggttgtagcgggcaccgtggcacacctcgcacggcacgtacacgtcgggcaggaagttcatctcgatcttgatggtgccgtcgcccgtgcacgcctcgcaccggccgcccttgacgttgaacgagaaccggcccggttgatagccacggactttggcctcggtggtggcggcgaacagggtgcggatcttgtcgaacacgccggtgtaggtggccgggttggatcgcggcgtgcgcccgatcggcgactggtccacccgcaccagcttgtccaggtggtccagcccggtgacccgggtgtgccggcccggcaccagccgggcgccgttgagccggttggccagcaccgtcgccaggatgtcgttcaccagagtcgatttgcccgagcccgacacgcccgtcaccgacgtcagcacaccgagcgggaacgacacgtcgatgccgcgcaggttgtgctcgcgcgcccctaccacggtgagctggcggcggcggtcgaccgggcgccggatcgccggcatctcgatgctttccttgccggacaggtaggccccggtgatcgattcctggttggccagcagctcggcatacgttccgctgtgcacgatctggccgccgtgctcaccggcccgcgggccgatgtccacgatccagtcggcatgggcgatggtgtcctcgtcgtgctccacgacgatcagcgtgttacccaaatcccttaatcgcgtgagggtttcgataagccggcggttgtcgcgctggtgcaggccgatggacggctcgtcgagcacgtagagcacccccaccaggccggacccgatctgggtggccaaccggatgcgttgcgcctcaccgccggacagggtggccgccgcgcgggacagcgacagatattccagcccgacgtcgagcaggaaccccagccgcgactggatctccttgagcacctgcccggcgatcgcctgctcgcggggccccagggtgagcgtgttgaggaactccgcgcaatccgagatggacagctcgcacacctcggcgatggacttcttgccgtgccgcccggcggccagcgtgacggccaggatctccggcttgagccgggtgccctcgcagaccgggcagggcacgtcgcgcatgaagccctcgtagcgctccttcatctgctccgactcggtctgggccatcttgcgctgcaggaacgccagcacgccctcgaaatcggcgtagtacgagcgggtccggccgtaccggttgcggtagcgcacatgcacctggtggtcggaaccctcgagaatcgccttgcgggccttggccggcagcttgcgccagggggtgtcgacgtcgaagcccagctcgtcgccgagcccggccatcatccgggtgaagtactccgcggtgtggcccgtcgaccacggcgccaccgccccctcggccagggtgcgctccgggtcgggcaccaccaggtcggggtcgacctccttgcggatgccgagcccgctgcactccgggcaggcgccgtagggcgagttgaacgagaacgaccgcggttccaggtcgtcgaccgccaacgcgtgcccgttggggcaggccagcttctcggagaaccgctgctcgcggttgtgggcgtcgtgctcgtggtcgacgaattccagcaccacgatgccgtcggccaggttcagcgcggtctccaccgaatcggtgagccgctgcttggcggacgccttgacggtgaggcggtccaccaccacctcgatgtcgtgcttttcctgcttcttcagcttcggcggatcggtcagtggatgcaccacgccgtcgacccggacccggctgtagccctgggcgttgagcttctcgaagaggtcggcgaactcgcccttgcgggtgcgcaccaccggggccagcaccaaaaaccgggtgccctcgggcatcgccagcacctggtcgacgatttgctggggcgtctgccgggcgatccgctcgccgcacaccgggcagtgcggggtgcccgcgcgggcgtagagcagccgcaggtagtcgtagacctcggtgatggtgccgacggtcgagcgcgggttgcggttggtggacttctggtcgatggacaccgccggcgacagcccctcgatgaagtccacgtccggcttgtccatctgccccaggaactggcgggcgtaggccgacagcgactccacgtagcgccgctgcccctcggcgaagatggtgtcgaaggccagcgacgatttgcccgatcccgacagcccggtgaacacgatcagcgcatcccggggcaggtcgaggtcgacgccgcgcaggttgtgctcgcgggcgcccttgacgatcagacggtcagccacgctgccctctctcaatgaatccgctccgtacagccggtatacgcacggcgcattccatgctaggtgcccataccgacaagcaacgtttgaccagtaacgtggccgctatgactgcctcggttgttcccagcgacaactacaccggacacgtcgatccgggcaccgcggcccgccggaccctacccggcgccacgatcataaaggcgtcggtgggcccgatggacaacaacgcgtacctggtgacgtgttccgcgaccggcgaaacactgctggtcgacgccgccaacgacgccgacgtgctgatcggcctgatccgcgactacgcccccaagctgtcgctgatcgtgaccagccaccagcacttcgatcactggcaggcgctggccgacgtcgccgccgccaccggagcgcccaccgccgccaacgagatcgacgccgacccgctgccggtcaaaccggatcgtttgctggcgggcggggacaccgtgcgcatcggggagctggcgttcgacgtcatccacctgcgcgggcacactcccggctcgatcgcgctggccctggacggggaggcgaccggcggggtcacccagttgttcaccggcgactgcctgttcccgggcggggtgggcaagacgtggctgcccggcgacttcgaccagctgatcgacgacgtcaccacccgggtgttcgacgtgtacgacgactccaccgtcgtctaccccgggcacggcgacgacaccgtgttgggcaacgaacgcccccacctcagcgaatggcgcgagcggggctggtaacggtcaaccggtagcggtcatgaggtggtgtgcacgatcagcacgtcggtcttggcccgccgcgacacgttggcgggcaccgagcccagcaaccgtccggcgatggtgctcagaccgacgttgccaaccaccagtaggtccgcctgctcctcctcggcgaggtgcacgagcgcatccactgggacccccacgatggggcgctcgtcgacgttcttcgctccggcctggtgggcgcgctccttggcgtcgcgcagaatcgcatagatcggggcggtgcccgacaccttgtagctttcttcccgcagggcgtcggcggcccgggcgtcctcatgctggggcaagtacgccgaggccacgatcagcttggcatccggtccggcgatctgcgccgcccgctctaccgcacgcatcgacgagtccgagccatcggttcctaccacgacagtccgataggcgcccatttaccctcccagtgtcggttggtcagccaacccaagacagtatcgcgtttgctcgatgctgaggaggtagatcagcgacacggtgtggcgcggcgggtttgccaatttggcgggcccggctgcggcaatggacaatttcgccgatgccaaaacaatcccatccccgagggcagcgcggaaagcattgcattacgccgcttttcgccgattgcggggccgacggcgaatagcccggcggctgtttgtgagccgccgcaccgggcgcgccctaaagtaacaagcatcatgtccatgcccaccctcgagccgactttcgagtcgggcgccggggatatcgtcgccgaacctgcgcctcgccgtccgcggggaaggttgctcgatccgtgggcgatcgcggtgctcgccaccgcgctcagcgccgcctgggcgtgccggccgtcgctgtggttcgacgagggggcgacgatctcggccgcggccaaccggacattgcccgagttgtggcggctgctcggacatatcgacgccgtccacggggcctattacctgctgatgcacggctggttcgcgctgttcccgcccaccgagttcttctcccggttccccagcgccctggcggtcggggccgcggccgccggtgtcacggtgttcaccaggcagttcgccccgcggcggacggcggtgtgcgcgggcgccgtgttcgccctgctgccccgcatgacgtgggcgggcatggaggcgcgcccgtacgcgttcgtggccgccgccgccgtctggctgaccgtgttgttcgtcgccgccgtccggcgcggcgcaccccgccggtgggtcgggtacgcgctggcgttgatgctggcgatcctgctcaacctcaacatggtgctgatggtgccggtgtacggcgtgatgctgccgctgctcacggcccgcggcgcgcgcaggtcggcggcgctgtggtgggccggcagctcggccgtcgccgtcggggcgatgacgccgttcctgctgttcgcgcacaaccaggtctggcaggtcaactggatctacccggtgagctggcattacgcgttcgacatcatcttgcgccagtatttcgaccacagcgtcgcgctggccgtgctgagcgccgtgctgatcgtggcggcggcggtggcccggctggccggggtgccggcgccgccgggcgacctgcgccggttgttgatcctctgcgcggcctggatggtgattcccaccgcgctggtggttgtctactcggccgtcggcgaaccgatctactacccgcgctacctgatcttcaccgcgcccgcgatggccatcgtgctggccgtctgcatcgtcacgctggcccgccgcccctggcccatcgccggcgcggtgctgctgtgcgccgttgccgcgctgccgaattacctgttcgtgcaacgctggccgtacgccaaggagggctgggactacagccaggtcgccgacctgatcggctcgcacgccgcacccggcgactgtctgctggtggacaacaccgtgccgtggcggcccggcccgatccgcgcgctgttggccacccggcccgcggcgttccggtcgctgatcgacgtcgaacgcggcgcatacggccccaaggtcgggacgctgtgggacggccacgtcgccatctggctgaccacggccaaaatcaacaaatgctcgaccatctggacgatcaccaataaggacaactcgctgcccgaccatcagtccgggcaatcgctgccaccgggcagcgcattcgggcaggcccccgcatatcgattccccggctatctcggcttccacatcgtcgagcggtggcaattccactactcgcaggttgtcaagtccacccgctgacgacgacggccgccggccgcgtgaagttccggttgctgggtagcttgacggcatgcagatctggctgaccggggcgccgctgctgggcggcagcgtgcagggcgcgcggcatgccgtcgaactgttcgcggcgttcgggttgacggcgctcatcgggctggagcgcaccatccagggcaagagcgccggtttgcggacgcagacgatcgtgggcacctcctcggcgctgatcatgttggtcagcaagtacggcttcagcgacgtgctgtcggcgggcagcatcgtgctggacccgtctcgcgttgcggcccaagtggtttcggggatcggattcctcggtgccggcatcatcatcacccggcgcggtgcggtgcacggtcttaccacggcggccgcggtgtgggaatcggcggccatcggtttggccaccggcgcgggcctgctgctgctggcgatcgcggtcgtcgggctgcacttcgtgagcgcgctggcgttcaatgcggtggaacgccaactcaatgcgcggctgcgcggcacggtccggttgcgcatcatctacgccaacggccgcggcgtgctgcgcgagctgctgcgtctttccgggcagcgcgactggcagctcaccgagctcgacgccgacccgcacgacatcgacgacggcgaagtcgcggtgtcaatgacgttgtcgggagccaagatcgccgatgcggcgcacgtcttcgccgaggtggacggggtcgccgcggtgctgtcggccgatgatgcgacggactgaattcagccgacgttgccgaccggctgcgcctggcgggtggcccgggtggcggcgtaagagacggccacccccgccgcactgagcgcggtgaagacggtgaacagcaggtgggcggccatctcgtcacccccggtggcggtgttgacgacgacgccggccaacccggcgccgatcgcggcggaggtcagctggacggtgttgatcgccgccgaagcggcgccgccctcggccgggtcgttgaccgacgccatggcccgcgccgacagatgcggccaggccatcccgatgcccgtgccggcgaccagcagcgccaccgcccacagcgcggcggtccaggccgacccgtcgccgtgccgggccaccgcccccagcgccagcccggacgccgccacgagcggcgccaccatgactacccgtcccacggtgcgcgggttctccagggaggcgctgacgatctcgctgaccgtccagcccagcgcgagcgccgctcccaggaagccggccgcgatcggggtgaggtgggccagccgctgaccgaacagcggcacataggtgttcaccatcgcggcggccatcagcacgcccatggtcaggtagatccacttcagcggccccggcgagaacacgctgggcggcaggatggcggcgtgcatgcgccagtcgacgatcacgaacagcccgaccagcatgattccggccgccagtagcccgaaggtcgccgcggtgttgtgcgggatctgcgccacgctgaccgccagcgcggcgacaccgatgatcagcagcgaccacaccggcaccttcatccggggtatggcgggggccgggtcgacgcgggccagcgcgaccggcaccagcagcgccatcagcgcggtcaggacggccatcaccacgaaggcccagcgccagatcccgagctgcgcgaacagcccgcccgtcgcgggcccgaccacggtcgcgacgccccacatcgccgacaccagcgccgagccgcgggtccacaaccagcgtggcagggccgagttgatcaccgcgtagcccaggccggccagcaagccgccggccaccccctgcatggcgccgtatggcgtgccgcggcgatgcgagctggagatcggttgccagcaaactcatttcaggccggcggcgtccatcccgcgcagctccttcttcaggtcggcgatctcgtcgcggaaccgcgcggccagctcgaactgcaggtcgcgggccgcggccatcatctgcgcggtgaggtccttgatcaggtcggccagctcggcgcggggcatgttggtggtgtcgcggccctcgacgatgccggcgctgacggcccggccgggctcgccctgggcgcgccgcccgcgggacatgctgcgcccggagccgatctcgacggtgtcggtgtcgtcggcctcacggtagacctggtcgaggatgtcggcgatcttcttgcgcagcggctgcgggtcgatgccgtgggcctcgttgtaggcgatctgcttggcccggcgccgctcggtctcgtcgatggcctccttcatcgactcggtgatggtgtcggcgtacatgtgcacctcgccggagacgttgcgggcggcgcggccgatggtttgaatcaggctgcgcgcggaccgcaggaagccttccttgtcggcgtccaggatcgccaccagcgacacctcgggcaggtcgaggccctcacgcagcaggttgatgccgaccagcacgtcgtactcgcccagcctcagctggcgcagcagctccacccggcgcaacgtgtcgacctcggagtgcaggtagcgcacccggatgcccatctccagcaggtagtcggtgaggtcttcggccatcttcttggtcagcgtcgtgaccagcacccgttcgtcggcctcggtgcgcttgcggatttcgccgatcagatcgtcgatctgccccttggtcggcttgaccaccaccttgggatcgaccagcccggtggggcggatcacctgctcgacgaactcgccgccggtctggctgagttcgtacgggcccggggtggccgacaggtagaccgtctggccgatgcggtcggcgaactcctcccaggtgagcgggcggttgtcgcaggccgacggcagccggaacccgtactcgaccaggttgcgtttgcgcgacatgtcgccttcgtacatgccgccgatctgcgggacggtgacgtgggactcgtcgatgaccagcaggaagtcttccgggaagtagtcgagcagggtggccggcggcgagcccgggccgcggccgtcgatgtggcgcgagtagttctcgatgcccgagcagaatccgacctggcgcatcatctcgatgtcgtagttggtgcgcatccgcagccgttgggcctccagcagcttgccctggccctccagttcggccagccgctcggccagttcctgctcgatggtggagatggcgtgggccattctttccgggccggccacgtagtgggtggccgggaagatccgcagcgagtcgacttggcggatcacgtcgccggtcagcgggtgcaggtagtacaacgcctcgatctcgtcgccgaagaactcgatgcgcaccgccagctcttcgtaggacgggatgatctcgacggtgtcgccgcggacccggaacgagccgcgggtgaaggacaggtcgttgcgggtgtattggacgtcgaccagcagccgcagcagggcgtcgcggggcacctcggtgccgacccgcagctccaccgagcggtccaggtaggactgcggcgtgcccaggccgtagatgcacgacaccgaggccaccaccaccacgtcgcggcgcgacagcaggctcgaggtcgccgagtgcctgaggcgctcgacgtcgtcgttgatggagctgtccttttcgatgtaggtgtcggtctgcgcgatgtacgcctcgggctggtagtagtcgtagtacgacacgaagtattcaaccgcgttgtgcggcaacatctctcgcagttcgttggccagctgggcggccagcgtcttgttgggcgccatcaccagcgtgggccgttgcagccgctcgatgagccaggcggtggtggccgacttgccggtgccggtggccccgagcagcaccacgtcgcgctcccccgccctgatgcggcgctcgagctcgtcgatggcggccggctggtcaccggccggcgcgtgcgggctgaccacctcgaagcggccgccggcccgcaccaacccttcgacggcctcctcggccgggcggtactccgaatgcgcgactactggatgttccgtggcaaatgccatgtcaccagggtagaggcgatcaccgacaagtgcggcggggcgggttcgcgaaggtggctcacgctggtcgcgcggtgaccggatcgatcacggtgggtcggcatagagacgaggttcattcaccacggggcgattttcgtcgcgaggccgctttgccgacgacgttcgctgcgatggcgtgatccggtaggtgtcggggatatccgacggacgtgcaggcagatcatcttccaggggatagccgcaccagaggatctcgcctggttcacgcggatagttggacgtcgcgcagccttcctccaagtcgaggaggaagtagtaggtcgccgcctcatccgcgtccggccacgggccctggtcaatgatcgactccctcgtgtcgcgcgccagtccccaggtgatgtcagacggtggggatgtgtaaaccaaatacatcatcggccccttggtccacgcatgcgacaccagatacgcgtgattcccctgcggggggttcgcaacttggttctcgaaatcgatgcggcgcaacaactttcgcaacacttctgccgcgaattcgtctcgagcgtcggtgatttcagttgattggcacattgttgttaacccatggcggagtccacgtccatttcggtcccaattgaatcactccgcttccgccctcgaggggaaacattgtgatcacccccttctgctccccaccgggcacgtccgcacgcccgacccggggatccaccacgatcctcatcgtcagactctcgccggtgtcctggcagctggcgatccccagcgggccgctggcgcagtgaacgcggttgataaggacgtcataacgaagcgtaccgtccggttggtgctctggacggctatgtgagatcaggtctttgaagacattggggttgaccacgccatgcctccaatacgccttgtcccagccccatccctctctttttttctgcgttgtagtagccccgccgcagcacgacatggttgccgtcgagatcggttgcctcggccaccacctcgttgactggataggatccgttgggcggtggatcttctttgaaggtgtggtggtcgaccgcatggaatttcggtttgcgctgaggcgcatcggaatccggggtttgcggaaacgtgtcgcggattccggccgtggccgcggtgactctgccggcgacctgctggtccagggcgaccaattcagcggcgcgccggcgtatgtcaccggcgaaggcttgcgcctgagcctgccgggccgctcgctgcgcagccgaaccacccgtcgaacgatctgcgaccgacatgtcttcgtacacatcgaagcccgaccgcatggcgtcttcgacggcgtagcggactcgcgagcgggccgcgaccaactcgcaggcgccgcttcgggcgactccggccgctgcccgcagttggtcggcgaccccgctggtcttccccacgtcgtcgtgcgtcgcagcgtgcaacgcgtccgccgcgcggcctcgccaatcactggacagaccgtcccgccagacttggtggatgactgagtaactccgctcgccgacggcctcccagtggcgggcggcgtcggtcaggtgttgggtcggccatgccaacacctgcgagaggtcggggaaccccgccaccgctgccatggcctacacggggaccgtcgaatgagccgccgaacgggccaccgcggccatcgcgttcgccgagtccgcctcgttggaggcgtagcgccggcccgcctcggcgacacgacgtgaatgcgcctgcacccggtcggcgagcctggccgtgaaagccgtgacgtcggcatgagcgacgttgaccgcggccacgctggcctggctcggcaatcccgaggccgtcggcgccgctggaacgtgcaattcgcccgctgccgtcgcccagcgaccagccatcgccgccaatccagcggggtccacccgcactgcctgcataggtggggattttattgggaatgcgacacggcgaaagtcagtcagcgccaggcccacccgtgccacatgcgtcacgtgcgtacctgtccggaaggacaacgtctctcccaaactcgctagcgcatccgctagcaagtttgaaactcacctcatggtgtccggagacccggcaccccgaggcggcaataggtgaggcgcccggagacggcgcccggagtcgaggcgccaaaagacaactacccagcgggacgcgtccacgtgcgggtgaccggatcgcactgcagcaggtagccgtcactggaggtgctcatggcgaacaccgaggtgcccggccggtcacacgagctgccggccgcgtgcacgcccatggtgatcggcgccttggcccagctgctgccctcgcagacgatctgctcgttgttggtcgggtcgtaggcgaccttgccgacatcgctgcacagcccgcccagcaccggcggcgccggcgcggtcgcggtgggcgaggcgttgatcaccgaagcgggatcggccacggtcactcccggcggcacgtcgccgacccgggtggccaccaccggcacccgcaccaccgccccctgagcaccgcactcgttgctgagcaccgtctcggtctcggtgccgcgcagcgtcccgtcgctctgcggcgccagcgaccaggcgatcgtctcctgctgagtcgcccctgccggcccgccgggccgggtgcagcccacccgctgctgttcgggcgccccctgccagtaaccgcccacgaagcgcagcgtgtccgtctggcccccgtcgggaccgccggccgtttgatgggtggcgtcgtccaaccgcgtcccggtggccgcacacccgctgctggtgcacgccgaccggaaggcccaccagttggtaccggctccgtcgtggcggatcccgatgccgttggtggtgcgcttggtctggtcgtagtccagcttgtaggtcccgttgagcaccggtccgcccgcgatgggcgcggcgacggcggcgggcggcgacggtttcgacgcgagcgcggggttggccggcggggcgccgggctgaaacgagtagagcaccgaccaggtcgccgcgacggcgacgagcaccgcgcacaccaacgcggcggcccaccgggtttgcgacgagaaccggtgcgtcacggcggcgatgacacggcccggcccgcgccggcggtgcggcggcgacgcgacgctgcgcgaccgggcatcagggccgatcgcggcggcgccgtcgcactcccggcggacggcggcggcgaacgcgcgacaccggtcgaacctgtcctcgggcgccttggccagggcctggcagaacacctcgtccagcccggccagctcgggccggaaatcgctgagccggggcgggtcctcgtgcagatgctgaccgatcaccgcgatcgggttggagtgctggaacggcggcgcaccggtgagcagatggaaagccgttgcggccaaggcatattggtctgcccggccgtcgatgggcgaacccgtcagctgctcgggcgcggcatacgccaccgtccccaccgcgacgttggtttcggtgatcccgctgatgtcgcccagatgccgcgcaaccccgaagtccgccaacaagattcgccgctcccccgcttcgggatgggtgagcaggatgttggccggcttcacatcacggtgcagtaggccgcgggcgtgcgcgtagtccagcgcgcccgccaccgcctgcacgatggccgacacctcgtccaacggcatgccgtcggggtagctctctttgaccagccgcgaggcgtcggtgccctcgacgtagtccatcgagatccacaggtggccgttgaattcaccgcggtcgtggacgccgacgatgtgcggatgccacagcgtcgcggccagatcggcctcccggttgaatctttcgcgaaactcgggatcgaccgtcaccgcctcggcgagcaccttgatcacgtcgcggcgcggcagccggggatgcagagccaggtacacctcggccataccgccggcgcccagctgccgcaaaatggtgtacccggcgaacgacgctccgttgcctatcgtcagtcgcggcccgccgggctcgctattcgcttgcgccgctgcgggttccgggtgcggacgggaatcgaccggcgggatccggcgaaacagctgcccgatgggcatgccgggcagcgactgaaaacccgcgcgcagcgccgcgcgggcctgtcgcgggttgctcaacagtcgccgcccggccccgatgcgccgggtagttcccttgtgctcgttcacgtctgcctcgccccctcgtcaccggtcgcctccactgtgatgcggatcgcacccgcggctggtccggacgcagtctgcgtgcacccctcccgttcgaataatgccgcacgccagtgggcgattcgcctcggcacgttatgaaagcgctgtgagtgaccgaaccgaaacaaagggaagtcacagccgctactcatggaggcactgtcgacgcgggccgatacttgagtggtgactcgacccgccccgcccatcctgacaattcggcacgacgggtcccaacgatccttcgcggccggccacgaggtggtcgtcggacgccacgtgcaggccgatgtgcgcatcccggatccgcggatctcgcgtgcgcatctgatcctgcgtttcgagcagggccgctggctggcgatcgacaacggctcgctcaacggcacgtacctcaacggctaccggatgccggtcgtcgacatccacgacggccagagcatccacgtcggaaacccgcacggcccgcggctgaccttcgcgctggggccgcagcagggtcacgcgggccacccgggccggccccggccgagtcatgactccgggccgccgaccctgacctggaccgcgatcaccgagcagaccaacccgacgcgcccgacgcggcgcccggtgccgccccgccggccggcccgaccgccgagcacaccgccggaggaacgcaccgtcatcgtccccggctcgccggcccgatcgcgcgtcgccccggcgagcgctccggccgggccaccgcggacatcgcccacgccggcaacggaattcaccgtgatcgacgccaagacggccgacgtgtcgaacctggcgacgcggttcgtgaaactgctgtccccgcgcgcctcctcggccgcgggcacggccggcgccatgacgatcggccgtgccgccgacaacgacatcgtcgtcgccgacgtcctggcgtcgcgccaccacgcgacgctggtgcccacggcgctgggcaccgagatccgcgacaacagcgtcaacggaaccttcgtcaacggcacccgggtgggttcggcgatcctgtccgacgacgacgtcgtcaccatcggcaacgtcgacctggtgttccgcgacggcacgctgaccgaacgcggccaaaccgcaacgcgcagcggcggtctcgaggtgcgcaacgtcacctacgtcgtcgacgacggcaagcagctgctcgacgacatctcgctgaccgcgcggccgggaacgctgaccgcggtgatcggcgggtcgggcgccggaaagagcaccctggcccggctcatcgccggctacacgacgccgagttcgggctcggtgacgttcgaggggcacaacattcatgccgagtacgcctccctgcgcagccggatcgggatggtgcctcaggacgacgtggtgcaccgccagctgaccgtcaaccaggcgctcggctacgccgccgaactgcggctgccgcccgacaccggcaaggccgaccgcgcccgggtggtcgcccaggtcctcgaggaactcgacctgaccaagcacgccgacacccgcgtcgacaaactgtccggtgggcagcgcaaacgcgcctcggtggccctcgaactgctgaccgggccgtcgctgctgatcctcgacgaaccgacctcgggcctggatcccgcgctggaccttcaagtcatgacgatgctgcgccagttggccgacgccggccgggtggtgctggtggtcacccactcgctgtcctacctggacgtgtgcgaccaggtgctgctgatggctccgggcggcaagacggcctactgcggcgcccccgaccggatcggcccggcgatgggaactaccaactgggccaagatcttcactcaggtcggcgccgatcccgaggaggccaaccgccgcttccgggaacagcgcgaggcccaacaacggccccacaaatccgaccgcgccgacgagcccgaagatctgggcgagccggtgcataccagtctgcggcaccagatttcgacgatcgcgcgccggcaggtccggctggtggtggccgaccgcgcctacttcgtcttcctggcgctgctgccgttcatcctgggttcgctgtcattgactgtgccgggccacaacggatttcgcggtccggcgcccgcggccgggacacccgacgaggccgcgcagatcctggccctgctgctgccggccgcggcgttcatgggaaccgcgttgacgattcgcgatctggtcggcgaacgcgccatcttccagcgcgagcaggcggtgggcctgtcgaccaccgcctacctgctcgccaagaccgcggtgttctgcggcttcaccgtgctgcagtcggcgatcgtgacggcgatcgtggtgatcggtaagggcgccccgacgcgcggcgcggtgctgttcggccattccaccgccggcgccgtcgccgaactgttcgccacggtcgcggcgacgtgtgtcgcctcggccgttctgggcctggccatctcgtcgctggtccgctccagcgagcagatcatgccgctgttcgtcgtcaccgtgatggcgcagctggtgctgtgcggcggcatggtgccggtgacgggccggctgggcctgaaccagttgtcgtgggcgatgccggcgcgctggggctacgccgcggcgtcggccacggtggacctgcgccatctggtgcccgattcgctgctgtcgcaggatcggttctggctgcacacgccggggacctggctgctcgacatgggcatgctggccgcgctggcgctgtgttacgccgtcttcgtgcgttggaagatccggttgcgccggtgaggaatcggtgaacggccggtagggtgacatcatccaccctcccaagcatgagacgttcgacctgcgggcccgcaccaacaccgatccgaagggcatcgtgcggaccgtcgacgagtatgcggtgcggccgtggggcctgtaccttgcccgccccacccccggccgcgtccagttccattacctcgagtcgtggctgctgccgtcgttgggcttgcgcgccacggtttttcacttcaatccagggcacgaacgcgatcacgactactacctggacgtgggcgactacctgcccgggcccacggtgtggcgttcggaggaccactacctggacatcgaggtccgcacaggcatccgcgccgagctgaccgatgtcgacgagttgctcgatgccctccggcacggcctgctcaccccggaggtcgccgaacgggcgatccaacgcgcggtggccgccgtcgacgggctggcccgcaacggctatgacttgacccggtggctgagcgagatcgacatggaactgacctggcggggacgcgccgcggcgccggagccggcgccgtgaccgacttcgccgcgctgcccgattccgtgcgtgccgcgctgcgcgacgagcccgtgccccagtggtgctcgcccacgctggccaccctcaccgagaagcgattctccgacccacactggatcttcgagcgcaagttcgacggcatgcgctgcctggccttccgcgacggcgaccgggtccggctgctgtcgcgaaaccgtaagccgctcaacgggacctacccggaattggtggagtcgctggccgcgcagcgcgagacgcgcttcgtgctggacggcgaggtggtggcgttcgagggccgccgcaccagcttcgcccggctgcagggccggctgggcatcaccgaccccgacgtggcccgggcatcgtcggtgcgtatctactactacgtgttcgacctgctgcatctcgacggcaagtcgaccgtcgcggtgccactgatctggcgtaagagattgctgcgcaaggcaatcgacttcaccgatccgctgcggtatgcaccgcaccgggtcggggacgggatggccgcgtaccgggcggcgtgcggtcgtggtgacgagggtgtgatcgccaagcgggccgaatcggcctatgacggccgccgctcggagaactggttgaagttcaaatgcgtgcgcgaccaggaattcgtggtcggcggctacaccagccccaagggcaagcggctcgagttgggcgccctgctgctgggctactaccagggggaccagttgcgctacgccggcaaggtgggcaccggtttcgacgaggcgacgctacaccgcttgcaccagctgctgtccgggatcgcttgcgacacaacgccattcacccggagtttggtgcccgaggccggcgcgcactgggtgcgcccggagctggtggtccagatcgggttcaccgagtggacccgcgacggaaagctacgtcacccccgctatctcggcatccgcaccgacaaggatcccaccgaggtgatccgggagacgcgctgatgccggaactgcccgacgtggagggattccggcggcaactggccgacgcgttgccggggcgacgcgtccggcgggtgaaggtgcacgatcccgggatcctgcgcaacaccaccgcgacgacgctggcccgccggctgaccgggcggcggttcgccggcccgcgacgacacggcaagtggctggtgcttcccaccgacggcccgacgctgctgatccacagcggaatgaccggccgcccctactattgcgccgacggtgccgccgaggaccgccaccagcgcctcgtggtgtcgctggaccagggcgaactgcgctacaccgatcttcgtaaattgcggggagtctggctggccgacgatcccgacgatctggtgcccatcaccggccggcaaggccccgacgcgctgggtcttggcctgcgcgatttccgcgacgcgctgacggcgcgctcggcccggaggcggcagctcaaatccgcgctgatggaccagtcggtgctcgccgggctgggcaacctgctggtcgacgagatctgctggcgggcccggatccgccccacccgcgcggtcgcggacctggacgacgacgaggtgaaggcgctgcaccgggcgatgacgcaggtgctgcgcaccgcggtgcggcatggccgggtgccgggcttgccgcgctggctcaccggcgcccgcgacgcgcccgacccgcactgcccccgctgcggcggccgcctggaccacgcccgggtgggcggccggaccaccctgtggtgcccgcgctgtcagcccgggtaatctcggcgcatgagcgccagcaaccacaggttgatgccgatcgccgccctgatcatcatcgcggccggctcccagctaagtccggcaccggcacgggcggatctgcacaacatcacctaccgggccaggatcgacgccgtcaccaccggcagtcaggccaccttcgtgaccaacggcggccagaccaacaccgccgcgctgagttcgatgcccggcaacgccttcgaggccgacacggtgctacccgacccgcagcaggccgggatgcgcatcgtgctgcacttcccctacgcggcgaacgtgcactgcgaaatcgacgtggacgacgacgttttcgtgcagaccgatcagatggtcaggccggcgccgggcaacaccgaccccatgaacggggcgctgcagtgcggcgcaccgctgccctgaggccccgcggctagggtttccagcccgtcgagtcggcccaatcccaggcccgccggtaggcgtcgcgaaaccacggctccttgacggcgacgtaggcgtcgatgtcaccgtcggcccgctgttcggcgctgcgcttgacggccagatagtcggcccgagcatcggggtcggcggtcaaccagtccacgaacagcagggcgaactgctggccgggccagccgtccacccggatgtgcacgttggtgggccggcccgggtccgccgaggcgtgaatccgcttgtgccacaaggccggatcgccggtgtgatcgtagcgctcgacggtgctgcgggcgtcgggcttggcgacgtcggcggtgatgtgttcgaggcgagggtatccggcggccagcaacggttcgacgagttcgtcggcggcggccagggattccacggtgatctggatgtcgatgacgtccttggccgcgaaatccggatccccgggcaacgccgtggagccgacgtggtcgacgcgcagcgcccgatggccggatgcggtcttgagccggttgacgattcgctgcgcctgggccggccactcgggatcgggcggcaccaaccgcaccggcgcccgggcgatctgacgcgtgctcaggttgtgggcgaacggcacgatgcgctcgttccacacctgctgggcccgttgcaccaactccgccgggctgcccgagttgtccagccagatgtcggcgacggcgcggcgctgctcgtcgctggcctgagcggcgatccgggcgcgggcgtcggcttcggccatgccgcgctgctcgaccagccgccgcagccgcacctcgacatcggcgtacacgatgacgacgagcgggaacagcggcgccatcccggattccaccagcagcggaatgtcctcgaccacaacggaatccgcgggcaccgacgcgattatctcggcgcggcgcgcacccaccagcggatgcacgatcccgttgagcgtctgacgggcggcgtcgtcggcgaaagccttggccgccaacgccggccggtccagcgatccgtccgcgagcaggatgtcgcgtccgaacgcctcgaccagcgccgccaggccctcggtaccgggccggaccacctcacgggcgatgacgtcaccgtcgacgatgaccgcaccgcactgcgcgaacgcggaggacagcgccgacttgccggcgccgatgccgccggtcaacccgatgcgcagcatcagcgagctgaatcaggcgttgccggcgagcttttcccgcagcgcggccagttgggcgtcgctggccagcgaaccgcccgccttctccgccggtgcgccgttgccgggcgactgctcgccgccggcgtgcccggccgcctcggccgcggcgaacttctccatctgcgcggtgtgcatcttgtgccggcgctcggcctcggcgtagcgggcctcccactcggcgcgctgcttctcgaatccctcgagccattcgttggtttcggggtcgaagccctcggggaagatgtagttgccctgctcgtcgtaggagtcggccatgccgtacttggcggggtcgaactcctcggtgtagtcctcgttggcctgcttgaggctcaacgagatccggcgccgctccaggtcgatgtcgatgaccttgaccatcgcgtcgtcgccgaccgcgaccacctggtcgggcacctcgacgtggcgctcggccagctcggagatgtgcaccagaccctcgatgccctcctcgacgcgcacgaacgcgccgaacggaaccagcttggtgaccttgccgggcacgatctggccgatggcgtgggtgcgggcgaagtggcgccacgggtcttcctgagttgccttgagcgacaacgaaacccgctcgcggtccatgtcgacgtcgagcacctcgacggtgacctcgtcgcccacctgcaccacctcggacgggtggtcgatgtgcttccaggagagctcggagacgtgcaccaggccgtccacaccgcccaggtcgacgaacgcgccgaagttgacgatggaggagaccacacccttgcggatggcgcccttctgcagctggttgaggaactcgctgcgcacctcggactgggtctgctccagccaggcgcggcggctcagcaccacgttgttgcggttcttgtccagctcgatgatcttggcctcgatctccttgccgatgtagggctgcagatcgcggacccggcgcatctcgaccagcgaggcgggcaggaagccgcgcaggccgatgtcgaggatcaggccacccttgaccacctcgatgacggtgcccttgacggcctcgtccttctccttgagcgcctcgatggtgccccaggcgcgctcgtactgagcgcgcttcttggacaggatcaggcggccctctttgtcctccttggtgaggaccagggcttccacctcgtctcccacggaaacgacctcgttggggtcgacgtcgtgcttgatggagagctcgcgggcggggatgaccccttcggtcttgtagccgatgtcgaggagcacctcgtcccggtccactttgacgatcgtgccctcgacgatgtcgccatcgttgaagtacttgatcgttttgtcgattgcggcgagaaagtcctcgctggagccaatgtcgttgacggctacttggggcgaggtgacggcgggactcggcatgttgttgggttgctccggacaggtttggtcgtagggacaattgggatttacctgtcgaggctactcgactgtgcgcaagctggccaaacccggacccgccgcgtcacccggtccgctgcgccacccgggtggtgaaggtgccgtgatagctcatcgggacgtgaaacggcagccacgcctccgcgaccggcccgtcggccacgtgcgccgcgtccaccaccatcaacctgctgcgatgccgcgattcgtcatagccgacggtgagcagccacccgtcgtcctcggcggtgccgccgggccgcggcacgaagatcggctccaccaacacctgcccgggtgggcagtacgtttgcgcctcgccggtgcggtggtcgacgcgggctatcccttgtccggggaacttggccgggtcctggacggtcaggtaggagacgtggtggcgcatggtgccgcggcgggggtcgatctgggggaattcgcagccgaaatcggccagtggctcgcgggtcacccggcccgacgccgcgatccggaaccgggtgagcaccacggcgtcctcgatggctccgtagtcgtcgacctgcgcgatgtccgagcggatgtgcgcggtgtagttcttcatgccggcgtaggtctgcggcgcgaaccgcggcagttcgacgacgacgtcgtcgccgtcgtcgtaggcgttggtgaaatgccagtgatagaacgggtcggtctcgaccacccggaccgccccgccgtcgcgtggggcgagcacgaaatacgacggcgcgtccggcttgaaacgtatggattcccaataagattggcggccggtcaacgcccacgggttgatccgcagcggggacagcacgaagacggcgtagcgcgtggtcaacgccatgtcgtgcaccacgcccatgcccggcagcggcaccgcgcgcaggtatcgcgtcaccccgtcggcgccggtctcatacaggcgcagccgcacccggggcaccgcctcggcggccagctcccgcagccgccgcagccgccggggaccgcgcagcgcatggccggggtcgatgcgcgggacgtacgggtcgaagccgaagttgaccttggtgttggtcatcgggtcgtagcggtagtgcgccgaataggcgcgcaccggaccccgcagcgccccgcccaggttgcacggcccgatggtgtccagcgtgtcgaggtcgagttcgtgcggtggcccgccctcccacagcgccagcagctggttgcggtgaaccatgacgctggtgttggcggtgttggccggcagccgcagcgcattggcccgcgggccgccgggtcgctggtaggcgaacccgcggtcgaccagccgccccgcagcggtcgacctcaggtagtggcgggtgcggacgaaccggttgcggaaccgcaccccggacccgtcgagcacgaacgcgctgaccatcccgtcggcgtcgaaaatgctctcgacctgcgtcgatcccaccgtccagcggcccgagccgttgcggtacagggtgccgacgaggccgtcgggcaaggtgccggtgatgtcggtgacgtcgaggtcggtttcgccggcgatgttttcccagtagcgcgacggcgcttgcacgtctgccagaaccataaaagacagtgtgtttattaatggggtccgctgtcaatggttctgatgtcgtcggcgtcgaacggcagcgccgcgccgccgtcccagcacagcgcggtcaggtgttcgacgagctcggcgcggggcatggtgccggcgcggcaccaccattcggcggccgacaccgccgacccgacgatggcccgcgaccacggcgcggccgcccggcgggcctgctccgaccccgaggaggtcgtcagcatctgttcgaccgccccggccagctgttcgaagacgctggtggacgggtcgccggtcagcgcccggtacaggttgggctcggcctgcatccacgcgctgatcacgtcgaagaacagcgccatccgctgccgtagatcggtggaacccgctgcgcgcgtggtgatttcgccgagcagccgctgcgcggttcgccggctcagctcggccagcagcgcgtcccgcccgggatacatcgcgtagaccgccgaccggacgaagcccgcctcaccggcgatgtcgaccagcccggcggacgggcccttggcccggatggcccgctcggcggcgtcgagaagcgcggtgcgccgctcgtcgggatcgacccgggaaccggccgggcgaccgcgacggcgtctcgccgcaggcatgggcggtggtcctcaatgcgccgcagcgtcccagctgcggccgtagcccacggacacctccagcgggacgtcgagcgggtaggcgccgcccatcttgtcgcgggccagcgcctccagctgctcccgctcgccggccgcgacctcgaagagcagctcgtcgtgcacctgcaacaggatccgcgaccgcaggcccgcctccttgatcgccttgtcgacctcgatcatggccaccttgatgatgtcggcggcgctgccctggatgggcgcattcagcgccgcccgctcggcggcttcgcgcacctgccggttgctgctgtcgagctcgggcaggtaccggcggcggcccagcaccgtcgaggtgtagccgtccttgcgggcctgttcgacgacggcgtgcaggtagtcgcgcaccccgccgaaccgggcgaagtaggcgtccatctgctccttggcctcctcggtggagatcttgagctgttgcgacagcccgtaggcgctcagcccgtaggccagcccgtaggacatggccttgacccggcggcgcagctcgccggtgacctcctcgatgggcaccccgaaggcgcgggaggccacgaacgagtgcaggtcctcccccgtgttgaaggcttcgatcagcccggcgtcctgggacaggtgggccatgatccgcatctcgatctggctgtagtcggcggtcatcagctcggcataaccgtcgccgaccacgaacgcgtcgcggatccgccggcccgcctcggtgcggatcggaatgttctgcaggttcggctcggtcgacgacaatcggcccgtcgccgcgatggtttggttgaaggtggtgtggatgcgcccgtcggaggccaccgagttgagcagcccgtcgacggtgaccttgagccgggtggcgtcccggtgggccagcagatgctgcaggaacgggtggccggtcttgtcgaacagcgactgcagggcatccgcgtcggtggtgtagccggtcttggtgcgtttggtcttcggcatctgaagctcgtcaaagagcaccgcctgcaactgttttggcgagccgaggttgatctgcttgccgatcaccgcgtacgccgcctcggccgcgtcgcggatctggtgggcgaaatcgctctgcaactcgctgagcaagtccaaatcgactgcgataccggcgttttccattccggcgagcacccgctgcaccggcagctccatgccgctcaacagcgaggtggagttgatgcgggccagttcctcgtcgagcgcgtcggccagatccagcaccgccaccgcccgcaggatcagcgtctgcaccgcctggtcgtcggtgccgtcggtgtcatccagcagcgaaagctgttgctgctgagggttttccgcgcgcagctcgcggcgcagatagcgcagtgcgagatcgtcgagggagaagctgcgctgaccgggccgcaccaggtaggcggccagcgcggtgtcggaggtgacgccggccagcgtccagccccgcccggccaggtcgtgcatcgccagcttggcctcgtgcagcgccttgggcggaccggggtcggccaaccaggacgccagcgcggcttcgtcgtcgggatccagcgccgaggtgtcgatgtagcggccctcgccgtcggcggagacgatggccagcgcggtgcagtcggcatcgtaggccaggtgggtgccggcgacggccagcccgaagcgcttgccggagctgtgctcggccaaccacaccgccagttcgccggcttccagcgcgccgccacgcacgtcgaaaccctcgtcgacctcaggctccaccgcggccagggtttcgaacagccggtcgcgcagcatccggaactccaggtcgtcgaagagccggtggatctggtcgcggtcccagggctgcagccgcagcgtgtcgggcgtctgggccagcggcacgtccttgatcagatcggtcagctcgcggttgcggatcacgctggccaggtgttcgcgcagcgcgtcgccgaccttgccgcgtaccgagtcgacgttgtcgaccagcgcctgcagcgacccgtattcggcgatccacttggaggcggtcttctcccccacaccgggaatgccgggcaggttgtcgctggggtcgccgcgcagggcggcgaagtcggggtactgctggggggtcagcccgtatttttcgacgaccgcctcgggggtgaagcgggtcagctcgctgacgcccttgcgcgggtagagcaccgtcacgttgtcgctgaccaactgcagcgagtcgcggtcgccggtgaccaccagcacccggtagccctcgttctcggcctgggtggccagggtggcgatcaggtcgtcggcctcgaatcccggctcggcgagcaccgtgatgcccagcgccgccaggacttccttggtgatgtcgatctggccgtggaactcgtcgggggtcgccgagcggttggccttgtattccgggtagcgatcggagcggaaggtctgccgggacacgtcgaaggccgcggcgatgtgggtcggggcctcgtcgcgcagcaggttgatcagcatcgcggtgaagccgtagaccgcgttggtggtcagcccgccgcgggtcttgaagttctcggcgggcagcgcatagaacgcccggaacgccagcgagttgccgtccagcagcatcagtgtcggccggttttgttcctcgccggccccggcggcggttttggtggcggttttcgtcgcggctttcgtggcgggcacggctctcactttaggcacccgctacgacgagttccgccccgcgaccgcgccgccggcagaactgcaacacgtttcagttttgtgctgccgctgggtacgctgacccggtgcccgaagtcatccgacaacaaccggcggtcgagggatggttcgccaccgacgaggccggcgccccgcacctgatcggcagcaaatgcccccagtgcggcacctacgtcttcccgccccgggagaacaactgccccaatccgggttgcgacggtgacgcgctggaatcgactccgctgtccaggcggggaacgctgtggagctacaccgagaaccgctatgccccgcccccgccctacccgtccccggacccgttcgagccgttcgccgtcgccgccgtggagttggcgaaggagggtctgatcgtgctgggcaaggtggtcgagggcacgctggccgccgacctgaaggtcggcatggagatggagctgaccacgatgccgctgtacaccgacgacgacggcgtgcagcgcatggtgcacgcgtggaggcgcgcatgacaaccccgagcaccccgcccgaaccgctctacatcctcggggcgggcatgcacccctggggcaagtggggcaacgatttcaccgagtacggcgtggcggcggcgcgagcggctctggccgaagccggcctggactggcgtcagatccagttggtggccggcgccgataccatccgcaacggctacccgggattcgtcgcgggcgcgacgttcgcccagaagctgggatggaacggcgtgccggtcagctccagctacgccgcgtgcgccagcgggtcgcaggcgctgcagagcgcccgggcacaaatcctcgcgggcttctgcgatgtggccctggtgatcggcgccgacaccacgcccaagggcttcttcgccccggtcggcggtgagcgcaagaacgatcccgactggcagcggttccacctgatcggcgccaccaacccggtctacttcgcgctgctggcgcggcggcggatggacctctacggcgccacactcgaggacttcgcccaggtgaaggtgaagaactcgcgccacggcctgcagaacccgaatgcccgctaccgcaaggaggtgtccgtcgaggacgtgctggccagcgcggtggtggccgacccgctgcggctgctggacatctgcgccacctccgacggcgcggccgcgctggtcgtggccagcgcgaagttcgcccgcgaacaccttggctcgctggccggtgtgccgtcggtgcgcgcggtcagcacggtgactccgcgctacccgcagcatctgcccgaattaccggatatcgcaacggattccacggccgcggtgcccgcgccggatcgggtgttcaaggaccagatcatcgacgcggcctacgccgaggccggtgtcgcgcccgaggacctgagcctggccgaggtgtacgacctgtccaccgcgctggagctcgactggtacgagcacctgggcctgtgccccaagggtgaggccgaggcgctgctgcgcagcggcgccaccaccctcggcggccgggtgccggtcaacccgtccggcgggctggcctgtttcggcgaggccattcccgcgcaggcgatcgctcaggtctgcgagctgacctggcaactgcggggtcaggccaccggccggcaggtggagaacgccacggtcggcatcaccgccaaccagggcctgttcggccacggctcgtcggtgatcgtcgcgcgatagggattgccggcggcctgggcttcgagtgtgaagcctgggcgagccccctcggcgtgtcgtcgccaacgatgcacactcaaagccaacgattcacactcgacggcctccggctactccttgggcgtgcccagcgtctccagcaccacctcggccacccgcttcatcgtggtccgccggtccatcgcggcacgctggatccacttgaacgcctcgggttcggtcatgccctgctcggtctgcagcaggcccttggcccgctctaccagcttgcgggtctccagccgctcggacagcgtggcgacctcgcgttccagctcggcgatctcgctgaaccggctgacggccaattcgatcgccgggatcaggtcgctgatggtgaacggcttgaccaggtaggccatcgccccggcgtcgcgggcgcgctccaccagatcgcgctgactgaacgcggtcagcacgacgatcggcgcgatgcgcttgctggcgatctcggaggtcgcgtcgatcccgtcgcggcgcggcatcttgacgtccatgatcaccaggtccgggcgatggcgctcggccagctcgacggcttcctgcccgtcgccggcctccccgacgatctcgtacccctcctcccggagcatctcggcgagatccagtcgaatgagcgcttcgtcttcagcgatcaggacccggcgcggcacagcagcgtcggtgtcggtcgtggggcctgtcatgacggacattgtgtcgtgaacgcctcagaccagcgagcgcgggggcggtgtgacgggtgaggacaccaaatcctctaaggtggtaggccgataagccctcgtatcccaactggcagaggaaacggattcaaaacccgtacagtgtgagttcgaatctcaccgagggcaccaccgctacccgccgcacgccgccggtccgccgcgtccggaatttgcattcatccgatcccacggtctgcgaaatcgaccaaataccgaccatgggtatgaaataagcgcaatttttaaacctggcgccaccaaaagctcgaatttgtcgcattccggcgaaatagctgaggcgcgacaaatgaattcatcaaatcctttcgccgggaccctcgaaaacaccggccgggctggcgcgcagacccctcgacagcgcggtcgcagctcagtggtgggtaccgatcgagacgggcggccgagtcagccgccgatagaaccggtgacgcaaacctggtttgccgcagacacattcagccccggcgcatcgttgccgatcgaatcgccggccacccgaagcagccaactcggctgaccgcacgcggcgctgcagccgcccatcagcaccgcggtgagaacaaggattaacgcaaaaacgaatctttttagacccgccatcaggcaccccttggtcgaggcgaacgcacgtccgacacagccgtcgaacatgtgtcagataacccaacgaatgacgcgcaaacccgattacaacccgataacgaaagtcgtatcagacttgggaaacttacgggggcgaaaacggcgatattcgtccgacagtcgacaagattgcctgctcagcggttaggcttgctgcgtggcggccaagagttgtggtgccgcaccgctatggccaaacggctcgtcgaagcgcccggactgtgtggccgcggcgcgggcccagtcgcgtgcccgcaaccagcactacgccgacagcgccgcgcgccagtcccgcgtgcttgccattgccgcgtggctggccgtgctggtctgcgccgacttcatccttctgcaagtggtcaccggggcgtggacctggcagatcgtttcgctcaacgtcgtcgccgcgttgattttcgcgatcgtcccgtggctgcaccggttcggtgacctggtcgccccgctgaccttcctcggcgcggcctatgtcaccgtcttcgtcagctgctgggacgtcggcacggcatcgggcgggcagtacttcttcctggtgggcgcctgcctggtgctgctggtgatgggcatcgaacacaccgtgctcgcggccgtcctggccgcgatcggtgccgggctggtgatcgcagtcgagttcgcctttccccgcgacaccgggctgcagccggcctgggcgcagtcgatgtccttcgtggtgaccatcgtctcggcctgcatcatggtcttcgtcgcggtgtggttcgcgctgcgcgacacccagcgcgccgaggcggtgatggagtcggagtaccaacgctcagaagcgctgctggccaacatgttgccgggcagcatcgccgagcggctgaagcactccgacggcgacatcatcgccgacaaatacgacgacgcctcggtgttgttcgccgatatcgtcgggttcaccgaacgcgccagcggtaccgccccggccgacctggtgcggttcctgaaccggctctacatcgccttcgacgatttggtggacaaacacggcctggagaagatcaaggtcagcggcgactcctacatggtggtcagcggcgtgccgcgggtccggccggaccacgccgccgctctcgccgacttcgccctcgacatggtcaaagttgctgcggcactgaaggatccgtacggccgaccggtgccgctgcgggtggggatggcctgtggaccggtggtcgcgggtgtggtgggctcgcgccggttcttctacgacgtgtggggcgacgcggtcaacgtggcgtcacggatggaatccaccgactcggtgggccgcatccaggtacccgagacgatgtacgagcggctcgcgcccgaattcgtgctgcaggaacgcggccgcatcgaggtcaagggcaagggtgtgatgcgcacctggtatctgatcggccgcaagccggccgaagcgcccaccgatctggttgccgagcaaccgcacaccgcgcacgtctgaccaaagtccctgtaccacggccagcgtttgtgccagactgcggccatgactatgtcccctggctcccctgttccaagcttgctgccgcatctgtggaaatccgctctgctgtcgggaattctgtcgcttgccctcggtgtcctggtgctggtgtggccgggaatctccatcctggtcgccgcagtcgccttcggcgtctatctgctcatcaccggtatcgcgcaggtggtattcgccttctcgctgcatgtttcggcgggaagccgggtgctgttgttcatcagcggcgccgcctcgctgattctggcgctgctggcgttccgccatttcggccagggctacgcaattctgctgctggccatctggattggtatcgggttcatcttccgcggcgtggccaccacgatctcggcggtcagcgacccgaacctgccgggccggggctggaacatcttcctcggggtgatcagcctgctggccggcatcgtcgtgctggcctcgccgttcgaatccattgtcacgctggcgattgtggtgggcgcgtggttcgtggtcatcggggtgttcgagatcatctcctcgttcggcatccgcaaggcgtccaagaccctcgccggctgaggccggccggtagcggaggcccgggcctatctactacactctgccgtagccgttggttcgggcctccgcagttcgggagatgacggatgaatgtcgtcgatatttcgcggtggcagttcggtattgtcaccgtctaccacttcatcttcgtgccgctcaccatcggtttggccccgctgctggccatcatgcagacggcgtgggtggccaccgggaacaccgcctggtaccggttgaccaaattcttcggcaagctgtttctgatcaacttcgccatcggcgtggccaccgggatcgtccaggaattccagttcggcatgaactggagcgagtactcgcggttcgtcggtgacatcttcggtgcgccactggcgatggagggactgttcgcgttctttttcgaatccaccttcatcggactgtggatcttcggctggggccgactgcccaagctgattcacttggcgtgcatctggatcgtggccatcggcgtcaacgcgtcggccttcttcatcatcgccgcgaactccttcatgcagcatccggtcggcgcgcactacaacccggcgacgcggcgcgccgagctggacgacatcttcgcgctgctgtcgaacaacactgcgcaagcggcgtttccacacaccgtgaccggagcgttgctgacggcgggcaccttcgtcgccgccgtcagcgcttggtggatggtgcgctcccgcgccggcggatccaccacgcccgccgcggaaaccgaggcccgcaccatgtttcgtccggcggccatcctgggctgcggggtcgtgttactggccaccgtcgccctgttcttcaccggtgaccgccagggcaagctgatgttcgtccagcagccgatgaagatggcgtcggcagaatcgttgtgccacacccaaaccgaccccgacttctcggtgctgaccatcggcacccacaacaactgcgacagcgtcaccgaagtgatcaaggtgcactacgtgctgccgtggctggccgagggccggttcagcggcgtgacgctgcgcggggtgaacgagctgcagcagcagtaccagcagcgcttcggccccgacgactaccggccgaatctgttcgtcacctattggtcgttccggctgatgatcggattcctggcgatcccggtgttgttcgcgctgaccgtgctgtgggtgacccgccgcgggcgcacaccgcggcaacgctggatgtcgtggttcgcgctgctgaccattcccacaccgttcctggccaacatcgcggggtgggtgttcaccgaaatggggcgccagccctgggtggtggtgccgaacccgactggcgaccaggcggtccggatgacggtccgcgagggcgtgtccaaccatgtgcccggcatggtgatcacgtcgctggtgaccttcaccctcgtctacgcggtgctggcggtggtctggttctttctgctgaagcgctacaccgtcgagggtccgttggaacacgacgcggaacccgctccgccgcgggcaccgagcgatgacgaggtggcgccgctgtccttcgcctactgacggggcacacctaccacgtaaggagctgaaccgatgggactgcaagaggtgtggttcggcatcatcgggatgctgttcctgggtttcttcatcctggagggcttcgacttcggcgtgggcatgttgatggaaccgttcgcccgggtcggaatcggtgagccagaaccgttgcgccgcaccgcactcaacaccatcggcccggtgtgggacggcaacgaggtgtggttgatcgtcggcggcgcggccatgttcgcggcctttcccggctggtacgccaccgtattctccacgctgtacttgccactgttggcgatcctgttcgggatgatcctgcgcgccgtggcgatcgagtggcgcggcaagatcgacgacaccaagtggcgcggctgggccgatttcggcatcgccgccgggtcgtggctgccggcggtgctgtggggggtggcgttcgccgtgctggtccgcgggctgccggtggacgccgacggccacatccacctctccgtcaccgacgtgctcaacccctacacgctgttgggtggcctggccaccgccgggctgttcctgttgtacggggcggtgttcgtggcgttgaagacgtccggtgcgatccgcgacgacgcctaccgcttcgccgtctggctttcgcttccggtgacgggactggttgcgggctttgggctttggacccagctcggctacggcaagaactggacctggctggtgcttgcggtggcggtggtggcgcaagtggcggcggtgttgttggtgtggcggcgcgcgtccgacggctgggcgttcacctgcctcgcgctggtggtcgccgccgtggtgatcctgctcttcggcgcgctgtatccgaacctggtgccgtccacactggacagccggtggagcctgaccatctacaacgcgtcctcgacgcattacaccctcaaggtcatgacgtgggtgacggcgatcatggccccggtgacggtggtgtaccaggcgtggacgtattgggtgttccggcaacggctttcggccgaccggatcccggcgcccgtcgggctgacaaggcgcccgtcctgagcggtgaacacggcaccagccgggcgccgctagacccgagactgtggcggtcctcgaggccggtgcgccgctacctggtggcggcggtgggctgcggggtgctgatctcgggctgcgcgatcggctcggccgttgtgctggccggcatcgtcgcgcgcgtcgtcggcgatacctccgccggcgagatgcgctcctggccggcgccgctgtcaatcctgttggcgctgtgggccatccgggcggtggcgcattggctgcaggcccggctggggcagcggggagccagcgcggtgatcgccgacctgtccgggcaggtgctcgccgcggtgatcgcccgcccgcccgccgagctggccgcgcaacgcgacgaagcggcggtggtggtcacccgcggcctggacgggctgcggccctacttcaccggatacctgccgacgctgatgctggccgccatcctgaccccggccaccgtcgcggtgatcgcggcctacgacgtgaaatccaccgtgatcgtggcgatcacgctgccgctgatcccgatcttcatggtcctgatcgggctggcgacccgtgaccgctccgcggcggcgctggccgcgatgaccaccctgcaggcccggctgctcgacctgatcgccggcatccccaccctgcgcgcgctgggacgaagctcgggtcccgaccggcgcatcgccgaactcgctgccgcgcaccgccgctcggcgatggcgacgctgcggatcgccttcctgtcggcgctggtgctggaattgctggccacgctgggggtggcgctgatcgccgtcggcatcggcctgcgcctggtgttcggcgagatgacactgaccgccggtttgacggtgttgctgctggcgccggacgtatactggccgctgcgccgcatcggcgtggaattccatgccgctcaagacggaagaaccgccgccggcgcggcgttcgccctcatcggcgagccgagcgggccgagcgccgcgaaggttcgcacccgcaccgtcaccgcccgcggcgcgccgatccgtctggaacacctcagcgtggcgggtcgcgacggccaggcgccctgcgacctgagcgcggtgatggaacccggcgcggtgaccgtgctgaccgggcgcaacggcgccggcaagagcaccacgctgcaggcgatcgccggcatcacggcgccgtcgtcgggccgggtcaccgtgcgcggtgtcgacgtcgccgacctggagccgcgcgggtggtgggcacagttgtcctggctgccgcagcgcccggtgctggtgccgggcaccgtcgacgacaacctgcggctgttcggcgaactcgacgacatcgaaaccgcctgtgccatcgcgggtttcgacactgtgctggccgagctgcccgatgcgggcgccaccccgctgggccgcggcggagtcggcctgtccctggggcagcggcagcggctgggccttgcccgcgcgctcggatcgcgggccgccgtgctgctgctcgacgagccgaccgcgcacctggacgccggcaccgaagaacgcgtgttgcgggctgtcgtcgaacgggcccgcgccggcgccaccgtcgtcgtggtggggcaccgcgagccggtcctggccatcggcgaccgggtggtcgcggtgtcggccgaccgtggagcacgttgtgccgcggcctgattcgttcgcgtccgcctccagccgcaggccgctgctggcggccgcgggcctgctgtcgccccggctgcctcgcctcgccgcggcgatcacgctgggggtgctgtcgctgggcagcgcgctggcgttggccggggtgtccgcgtggctgatcacccgcgcctggcagatgccgccggtgctggacctgtccgtcgccgcggtcgcggtgcggatgttcgcgatctcccgcggcgtgctgcactactgcgagcgactggtcacccacgacacggccctgcgggcggccggcgccgcgcgggtggcggtataccagcggctgacgcgcggcggcgcggcggccaccgtccggctgcacagcggcgagctggtggcccgggtgggcgccgatgtcgacgaactggccaacgtgctggtgcgcgcactggtgccgatgggtgtggcggcggtgctggcggtggcggcgaccgcggtcgtcgccgcgatctcaccggcggcgggcggggtattggcgatctgcctgctggtcgccggcttcgtcgcgccccgcctggcgggccgggccgccgcgacccaggaagacattgcgcgccaacagcattcgcagcgcgacagcgcggcgatgctggcgctcgaacacgcccccgagctgcgcatcgccggtctgctgcccgacgtcatcgccgaatcgcaacgccgccaacgggcgtggggcgccgccctggacgcggcgggcaagccggccgccgtggccgaggcgatgcccaccgcggcgatcggggccagcgtgctgggcgcggtggtggccgccatcggcatggcgcacgccgtcgcgcccaccaccctggcggtcctgatgttgctgccgctgtccgccttcgaggcgatgacgccgctgcctgccgccgccgtccagttgacccggtcacggatcgccgcgcgccgcctgctcgagctcaccgcgaccgaacccccgcgcccggccggctccgcaccccggccgacgggcccgggccggctgaccgccgacatccattccggtcacgacggcgcggcccgcgagtcccgcgtgacgctggacctgccgccgggggcgcggctgaccgtcaccggcgccagcggctgcggaaagacgacgctgctgatgacgctggccggtctgctgccgccgctgcagggacaggtggtgctggacggcgtcgcgttgagcgagttcgatgaatgcgagttagcaagggccatcgtctttttcgccgaggacgcacatgtcttcgccaccaccgtccgggacaacctgctggtggcccgcggcgactgccccgacgacgaactgaccgacgcgctggaagcggtcgggctgggcgactggctggccgggttgcccgacggcctgtccacggtgttgaccggtggcgcgcaggcgatttcggcgggccagcggcgcaggctgttgctggcccgcgcggtgatctctcccgcccgcatcgtgctgctcgacgagcccaccgagcacctcgacgccggcgacgccgagcggctgctgcgcgacctgctggcgccggattcgcggctgctgccttcgccgcgcaccgtggtggtggccacccatcacctgccggagggaatcggctgtcgcgaacttcacgtcgatcggggcccggcagacgccggctagcgatgcctacaggtgccggcggcgcggcaggaattccagcgacaacagcacgaacagcagcgggacgatctgcgtcatggagatcaccgcgtagcgccgcccgtccagcgcatgccacttgcgcacgtaccggtacagcgactccagcgcgatcaacgggtcgagcacgtgggtcaaccggtagaagatgcgccgggtccagccgcggttcttgtcctcgaagatctccgggaacgcggcgaaggccagcgatacccgttgcgccccacggtctttgccggccatgaccatgtcgacgctgagccgctcgtcgagtccgttgggggcgccgcggcgccgccacggcacgtcgagggtgatgtcgctgccgccgccggcggtggcgtagcggtgaaacgcctgcaccttgcccgtcgcgtccctggcgatgatcaacaggattccggggaaccgcccttccagcaccccgtcgaggttcatgtggaagccgcgatcggcgtgcgcccccttggacgactcccgcaccacctcggtcagctcggccagcagctcgtcgctgagttcctgctcggccacgatttcggttgtgacgccgcagttgtgggtgcgtttgacggcctgacgcaggttgcggaacttgcggccgaccatgtcgaagctgctcacgtcgaccaccacgtcgcgcccgatcggtatgggccgcaacgtttgtcccaggaccgccgagtccttccacaactcgaggcgccgctcgctgcagcccaccacggcgatgcgccatccgtgggcgtggcaggtgacggcgaaatcggcgaccagttccgggaagtgggcctcgtcgccgatcgggtccccgctgaccaccgcgatccctagccgcgtccggtaggccagcgcggcgctgccgtcggcgctgaagtggtagctcttgccggtctgcatggtgaacggcgccagcgcatcgtcgcgggtggcgttgatcagctcccatattcgcggcaggtcggcgggccgcgggtgcgaggacgtcggccacatcaacaccattcccgagccggcgatcagcacgtcgcccagcaggtcgaaggacaacacgtgcagccccagccccgccagcacgaaaaaggcggcgacggcggcgtgcatcgtcgtcaccggccggcccaggaagatcccgcgcgcgatccaggccacggcgaccaggacggtcagcgaccaggccagccgatcggcgtagtgccaactcggattgctgtggtggtgcacgaggatctggatcaaccagcacgccgcgcagaacagtgccagggctccgatcagccgggccgcccgtgaatcggcggaaaccacaacgcgttcccccgcgcgcggtttcgttgcgacgtccaccaccggcccgttcaccctcacctcccgatgcgctgacaacagccgggcggctgtgcgccgcctctgcaccgaatacccggcaccgtcaaaattacgcccgatcccgctcgtatcggccggtttcgggccgatatcctgcagcttttgcgtaacggtttaccggcgggcggagggaaagtatttcagcacaccctcctgcacgacggtggccagcggttgcccggaccggtcgaagaaatgcccggtgcccagcccgcgcgaatccgcggccaccggcgacgacgtggagtacagcacccagtcgttgaagtcgacctgacggtgaaaccagatggaatggttggccgaggcggcgaaaatgcggtcgaatccccaggaaagaccgtgcgtggtgatgacggagtccagcaccgtggtgtccgaggagtacaccatggtcgcggtgtgcaggaccgggtcgtcgggaagcttgcccagcgccttgacccagacccgattgtggggcagccgctcccctttcgtccgcatcacccacgccgggtcgttggtgtagcgccattcgatcggctgcagcgcgttgacgaagtgcggcacggtctcttcgtagccgcgcagtagctcgccgatcgtgggctgggtctccgggtcggccacccgtggcgggtcgacgccgtgctcgagtccgcggccaccggccatgtaggagatcagcgccgaggacagcagcgtgccgtcctgcaccgcgtcgacgcggcggttggcgaaccgccgctcgtcgcgcaaccgggtgacgcggtattcgatgtccttgccggtgtcgccgccgttgatgaaatgcaccgagagcgcgctggggggcaggtcgtcgcgaatcaggctgcggctgctggccacaaacgactgcgacatgagctgtccgccgaacgttcgcatcggactcttgctgggatgcgatccgacgaacagatcgtcggcgacgcgccggaggtccagcgtcgccagcagctcctcgaagtcggccgtggtgttcggctcctgggattcagcgccggctggcacgagctctcctctggttcgatgcgcccgcccgttcctcaggccgcgcagcggcccgtgtcgtcgccgggcaggctagacgtcgtcctccccgatccggtgcacgtggatcaggttggttgaccctactgtgccaggtggcgcgccggcgacgatcaccaccaggtcaccacgccggtaccgaccgagttccagcagcgacttgtccacctggcggatcatgccgtcggtggaggtcatcatcggcacgatgaacgtctcggtgccccaggtcatggccagctggctgcgcacctccggccatgccgtgaaggccagcagcggcagcggggtgtgcaaccgcgccagccgcttgacggtgtcgccggactgggtgaacgcgaccagcgccttggcgtccaggcgttcgccgatgtcgcgggccgcatacgagatcaccccgcgtttggtgcggggcacgtgggtgagcggcggggcggccgtggagttgtcctcgaccgcgcagatgatgcgcgccatggtccgcacggccgccagcgggtacttgcccaccgaggtctccccggacagcatcacggcgtcggcgccgtccagcacggcgttggcgacgtcggaggcctcggcccgggtcggccgtgagttctcgatcatcgaatcgagcatctgggttgccacgatgacgggtttggcgttctcccgggccatctggatggcccgcttctgcaccagcggaacctcttccaggggaagttcgacaccgaggtcgccgcgggccaccatgatggcgtcgaaggccagcacgatggcttccaggttgtcgacggcctccggcttttccagtttggcgatcacgggcacccgccggccgacgcggtccatcacctcgtgcaccagctcgacgtcggagggcgaacgcacgaaggacagcgcgaccaggtcgacgcccagctcgagcgcgaaggtgaggtcctcgatgtccttgtcggacaaggccggtgcggagacgttcatgcccggcagcgagatgcccttgttgttgctgaccgggccgccctcgaccacggtgcagatgacgtcgtcgccctcgatgccgtcgaccaccaggccgaccttgccgtcgtcgaccaggacccggtccccgaccgcggcgtcctgggccagttgtttgtaggtggtcgacacccggtcgtggctgccttcgcagtcggcgacggtgatgcggaccgtttcgccgtcggcccagtaggtgggcccggtggcaaagcgccccaggcggatcttggggccctgcagatcggcgagcacgccgacggcgcggccggtggcgtcggaggccacccgcacccgttcgtaggcggctttgtggtcggcgtagtcgccgtggctgaagttcagtcgggcgacgtccattccggcctcgaccagcgccaaaatcaactcgtccgaattggtcgccgggccaagggtgcagacgatcttcccgcgtctactcacgccgacccagcatagtcgtgtgcccgcgtcccggcccgcacataacgcacggcgcgcagtgtgctgttacccaccgagaacagtcggaaacagggggaaggcgggcaggttacgcagcactgtccacaccagggtggcgacgacgaccgccggcactgccgccgcgggcagtgatcgccggccgcgggcgcgccgaaccagcaggaacgcggccagcgtcgggacggcggccagcaggaagacgttgtcgtggacggcggcccacagctcgccgtgcagcaggtcgtgtgtcatacgcaggccgccgcagaacgggcaattccagccggtgagccatttgaatggacacggcgggtagatcgacgccggatcgtgcgggtcggccagcccgatgtagccgagcgcgccgctgagcaccacggccgtcccggccgcgacgtggcggcgatgacggccaccgcgcgcgagcggctgggatggcatcacctgcccagcatgccagatcgacgccgggtcgttgcctgccgctagcggcccgagagccgctcgcgcagtcgcgcaccccagcgccgtttcgtttccggctgctgcggggcgggttcgggttcctcggcgacgagttgctcgggcgcttcgccggattcctcttcgggctcttcgccggaatccgcttcgggctcttcggtttccggctcttcgggctcttcagcttctggcgcttcaggttcctcggcttccggctcgctcgcctcttcggccgcttccgtttcttcggattccggcttctcgacgtccggctccgccgattcttcgggccgctgcgccgtcgcgtcggcgccggcggcttcggcgccgtccgccggcgccgccacaccctcggtcgccgcctcggtcgtcgccgccaccgtcgccggctcgggctcggcgggttcctcctcgacgtattggttgccgcgcaagctctccgggtcctcgcggcccttcggcgccgccatcagatacaccacggccccgatgaacacgaacgtcgaggtgaacgaattgatccggatgccggcgatgtgggtggcggtgtcgtcacgcaacagctccacacagaagcggcccacgcagtagccggccacatacagcgcgaacagccggccgtggcccagcgtcagccgtcgatccgcgtacagcagggcgacgaaaatcaaaagattccacagcaattcgtacaggaacgtcggctgcaccaccagcgcgacctggcccgtcgagacgccgtccagcgaatgcgggtcgatgtatcccgacgggtcacgccggtagaagatctccaggccccagggcagggtggtttcgcggccgtagagctcctgattgaagtagttgccgagccggccgatggcctgcgccagaatgatgcccggcgccaacgcgtccgcgaacgccggcagcggaatgccatgccgccggcacccgatccaggcgccgaccgcgccgagcgccaccgcgccccagatgcccaggccgccgtcccagatccgcaccgccgcaccgaatccggcgccgccggggccccagtaggttcgccagtcggtggccaggtgatagagccgcccgccgaccaacccgaacggcaccgtccacaacgcgatgtcatagatgacaccgcgttcgccgccgcgcgcctcccagcgacggtcaccgatcagcagcgccgccacgatcccggcgatgatgaacaacgcgtaggcccggatcggcaccggtcccagatgccagacgccctgcggcgggctggggaaataggcgagcagcttggtcacgaggcggccgccctctgccgaacaccggcggcgagttcttcagtcagcgcacgcaatgcggtcaaacctccgtcccccagcgccgacaccagcgccgacccgacgatgacaccgtcggcgtagccgccgatctgggcggcttgctcgcgcgagcgcaccccgagcccgaccccgacgggtatgtccgagatctccctgaccctgctcaccaactccggcgcggcatgcgacaccgcgtcgcgcgccccggtgacgcccatcgtcgaagccgcatagacgaatccgcgcgacgcctcgaccgtcagcgccaaccgctgcggcgtcgacgacggcgccaccaggaagatccggtccagcccgtgccgctcggaggccgccagccactgcccggcttcgtcggggatgaggtcgggcgtgatcaggccgtagccgccggccgcggccaggtcgcgggcgaacgcgtcgaccccgtagcgcagcaccgggttccagtaggtcatcaccaccgcgcgcccgccggccgcgctgatcgcctcgaccgcggccaatgtgtcgcgcacccgcacgccgccgtgcagcgcggcctcggtggcccgggcgatggtcgggccgtccatccccggatccgagtacggcaccccgacttcgacgatgtcgcaacccgattcgaccagcgccaccatcgcctgcaccgaggtcggcacgtccgggtagccggtgggcaggtaaccgatcagcgccgcccgatcgtcgtcgcggcacggctcgaagatcggcgacagccggctcgcctggctctgcttgacggtcatcggtcgctggaccccaacagcccgaaccactttgccgccgtctcgacgtccttgtccccgcgcccggacaggttcaccacgatgatcgcgccgcgacctagctcgggccccaacttcagcgcacccgccacggcgtgcgcggactcgatggccgggatgatcccctcggtgcggcacagcacccgaaacgcttccatcgcctcggcgtcggtgatcggacggtattcggcacggccggtctcgcgcagatacgcatgttctggaccgactccgggatagtcgagacccgctgagatggaatgggattcgatggtctgcccgtcttcgtcctgcagcaggtaggagaacgacccctggaacgccccgggcgagccgccgctgaaagtcgcggcgtgccttccggtttcgacgccgtcaccggccgcctcgaatcccaccagccgcacgccggggtcgtcgatgaacggatggaagatcccgatggcgttggagccgccgccgatgcaggccaccaccgcgtcgggcagccggcccgcctgcgcctggatctgggcgcgggcctccagcccgacgatgcgctggaaatcgcggaccatggccgggaaggggtgcggcccggccgcggtgccgaagcagtagaaggtgttgtcggcgttggtgacccagtcccggaaggcttcgttgatggcgtccttgagcgttttcgaaccgctctgcaccgagacgaccgtcgcacccagcaggcgcatccgcgccacgttgagcgcctggcgctcggtgtccaccgcacccatgtagatcacgcattccaggcccagcagggcgcaggccgtggcggtggccacgccgtgctggccggccccggtctcggcgatcacccgcttcttgcccatccgctgggccagcaacgcctgaccgagcacgttgttgatcttgtgagaaccggtgtggttcaagtcttctcgcttgaggaagatccgcgcgccggcctgctcggacagccgcggggcctcgtacaacggcgacggccgcccggcgtagttcgcctgcagatagtccagcgtgtccaggaaatcctggttgacgcgctccttctcgtaggcggtggtgacctcttcgatgacggccatcagcgcctccgcgacgtaacggccgccgtacacgccgaaatgcccaccggcgtcgggttcatgacgggtgggttcggcgatcgctgcgctcggaagcggaaggtccggacgggtccggggggagatgtccaccgtcaccagggctctacgcggggatggctcatcgggttcaacgtttcggcggggcggctcttcactgacgtgagcggttagcgagccggtttcggacaggacggatgggtgcccgcggtaaccaggtcggcgaccgcggcgcgcgggtcaccgcttttcaccaggccctcgcccaccaggacggcgtcggcgcccgcgccggcatacgccagcaggtcaccggtgccgcgcacgccggactcggcgatccggatcacgttgctgggcaggcctggagcgatgcgggcgaagcaatcccggtccacctccagcgtcgccagatcgcgggcgttgacgccgatcaccttggcgccagcccgcagcgcccggtcggcttcttcctcggtgtgcacctcgacgagcgcggtcatgcccagcgattcggtgcggtccagcatcgacaccagcgccgactgctccagcgcggccacgatgagcagcagcatgtcggcgccgtgcgcacgcgcctcgtggatctgatacggctgcaccacaaagtctttgcgcagcaccgggatggagaccgcggcccggaccgcgtcgaggtcgtcgagcgagccgtggaagcgtcgctcctcggtcaacacgctgatgatgcgggcgccgccgtcttcgtaggcgcgtgccagtttggccggatcggcaatggtcgccagggaacccgccgacgggctggcgcgcttgacttcggcgatgacgccgattccgggctcgcgcaacgcggccatcacgtcgagtggcggtggcgcggcggccgcggcggctttgatctccgacaggctgatcagggcttcgcgcgcggcaacgtcggcccggactccttcgaggatggagtcaagcacggtagccggactcatgcctgtcgtttcccttcgccctgtcgcccgccgtcatcccacggccacttcgttgttccccagccgattgcgacgacgtcaatgaagggtagcggcccgcggctcgcgtcccgtcaccgaccctcggtgtcggacccgctgggtcgatcggtcgggtcgcgcccctcgtcaagggcgtcccagatcatccgctccgacatttcccggcgcccaggtaccgccgctcgctgccgaccagcgagatcaccgacaggtgcgccagctcggtgccgcgcaccgcgacgtcggacagcacccaaaggctgacgcccaggtagccgaccgccaggctggccaccgccagcaggccggccagcgcgcgcagcagccacccgcgcaccgcgatcgcggctaccgcggcggccagcagcagcaacgccagcggcagcaacgccgtcgaccacgtcccgccggacagggtcaccgccttgggcggccccagcccgtcgaacgagcggatcaccacccacggcaggcgcgcggccacccacaagcccacggccgcgatcaccagcagcagctgggcgatccggatcaaccagcggccgtccagcctccgcgcgcgggcctcggtcatcgccgcgcgcccggttcggtcagcgtctcggcggccgcgatcgcgccgagcaccgcgcgcgccttgttggtggcctcggtgtattcgtaggggccgttggagtccgccaccaccccgccacccgattgcacgtaggcggtgccgccgcgcatcagcgcggtgcggatggcgatggcgaagtcggcgttgccggcgaagtccaggtagccgaccacgccgccgtagaggccgcggcgcgtcttctccacctcttcgatcagctccatcgcccggaccttcggcgcacccgacagggtgccggccgggaagcaggccgtcaccgcgtccagggcggtcctgcccgcgtcgagcacgccggtcaccgtcgagaccagatgcatgacgtggctgtagcgctcgatgtggctgtagtcgtcgacccggacggtgcccggcgcgcacacccggcccagatcgttgcggcccagatcgaccagcatcagatgctcggcgcgttccttctcgtcggccagcagctccttttccagcagctggtcctcgtcgtcggtctgcccgcgccaccgggtcccggcgatcgggtgggtggtcgcgacgccgtcggccaccgtgaccagagcctccgggctggacccgacgatcgaaaagtccgttcccccagcatcattcggtacatgcagcagatacatgtaggggctggggttggtgacccgcaacatccggtacacgtcgatcgggtcgacgtcggtgtccatttcgaaccgctgcgagggcaccacctgaaacgcctcaccggcggcgatctgctcgacgaggtagtcgacgatcttgccgtactcctcgacgctgcgctgcgcgcggtagcgcggctcgggccgctcgaaggtggccacggtggaggctagcggctggcccagcgccgcggtcatcacgtccagccgggcgacggcgtcgtcgtaggcctcgtcgacccgttcgtcggtcccgttccagttcaccgcgttggcgatcagcgtgatggtgccctcgtggtggtcgacggccgccagatcggtggccagcagcagcagcatgtccggcaggcccaggtcgtcgacggccagctcgggcagccgctccaggcgccgcaccaggtcgtaggcgaagaagccgaccatgccgcccgacaacggcggcagcccgctcagcggcccggtggccagcaggtccagggtggcgcgcagtgcctgcagcggatcgccgccggtcggtgcgtcctgcggcaccacccccagccagccggcttccccgtcgcgcacggtcagcgccgacggcgacccggcgccgatgaacgaccaccgcgaccaggaccggccgtgctcggccgactccagcaggaaggtgcccgggcggttggcggcgagtttgcggtaggccgacagcggcgtctcgctgtcggccagcaccttgcgggtcaccgggaccacgcggtgctcggctgccagctggcggaaatcctctcgtgaggtcgtcgcggcgaggtgggcgtgcaccgacccatcctcccagacgcggcgcggtggcccgacccgcccgcggcccggtggcccgacccgcccgcggatgtaacgccacggcgaattcgcggcccattttccgccgtggcgttacgaccggcggcggcgcgcgtagcgtgtcgcccatgaaacctggtgacaccgtcgcggacttcgaactgcccgaccagacgggaaccccgcgcaagctcagcgacctgctcgccgcggggcccgtcgtcctgttcttctacccggcggcgatgacgcccgggtgcaccaaggaggcgtgtcacttccgcgacctggccgccgagttcgccgccgtcggcgccaaccgggtgggcatcagcgccgacccggtggacaagcaggccaagttcgccgacctgcagaagttcgactatccgctgctgtcggataccgacggcgcggtggccgcccagttcggcgtcaagcgtggactgctgagcaaactgctgccggtcaagcgcaccacgttcgtcatcgacaccgaccgcaccgtgctcgacgtgatctccagcgagttcaacatggacacccacgccgacaaggcgctggccacgctgcgcgcccgggcctgaccgtcacgggctgaccgccaggaagacgtaggcggccagcagcaccagatgcacctcgccctgcagccgggtggcccgcccgggcacgacggtcagcacgctgatcaccacggtcagggccagcaacaccagctggatggcgcccagcccgagcaccagcggacccttcagccagatcgaggccagcgcgatcgccgggatggtgagcccgatgctggccatcgccgagccgtaggccaggttcaggctgatctggatgcggccctggcgggcggcccgcacggccgccagggtctcgggcagcagcaccagcgccgcgatgatcacacccacgaacgtctgcgggaagcccaccgcggtgaccgcccgctcgacggccggtgactcctcctcggccagccccaccaccgccaccagcgcacacagcagcagcaccaggctgaccagcgcctcgcgggtgctgggcggatccgcgtggctctcgtcctcgaacaggctcttctgccccttctgcgcgatcggcaggaagaagtcgcggtgccgcaccgtctgcgtgaacacgaacagcaggtagaccagcagcgaggcgaccgcggcgaaggtgagctggccgggcgagaactccttgcccacctgggtggtggtgaacgccggcagcaccaggctcagcgtcgccagcgtggtcagcgtggccaacgcggcgccgctgccctcggcgttgaacaacgtgacgccgtagcggcgcgacccgagcagcagcgacagcccggcgatgccgttggtggtgatcatcagcgcggcgaacgccgtgtcccgggccagggtcgccgtctcgttgccgccggacgccatcaactcgacgatcagcgccacctcgatgatggtcaccgcggccgcgagcaccagcgacccgaacggctcgccgatccggtgcgcgaccacctcggcgtgatgcaccgcggccaccaccgcaccgatcaggaacagcgcggccagcgcgaccagcaccggccccagtcgctcgccccagatcaatgccagcacgacgacggcgagcaccggcaccaccacggtccaggacaacacgttccgggacaaccatttcgacattgcgtgccattctcgtccaagtgatgcgccgacgcccccggaagtgactcccgacacgctggtcaggcgccgggctcgacctgccgccggcctgaccccgccctagtcctgcgggtgcagcagcacgtcggcgtcgaagcagctgtggtcgccggtgtggcaggcgccgccgacctgatcgacggtcaacaacacggtgtcgccgtcgcagtccagccgcaccgagtggacgtactgggtgtgccccgacgtctcccccttgacccactgctggccgcgtgagcgcgaatagtaggttgcctcacgggtttccagcgtgcgggccaatgccgcgtcgtccatccaggcgaccatcagcacgtccttgctgccgcgctcctgcaccaccgccgtgaccaggccgtcggcgttgcgcttcagccgcgcggcgatctgcgggtcgagcgtcatcgcaccatcctcaccggtatgcccgcctcggccatggcggccttgacctgtccgatggtcagctcccggaagtggaaaacgctggccgccaacaccgcgtcggccccggcctcgatcgcgggcgcgaagtgttcggccgccccggcgccgccgctggcgatcaccggcacggtgaccgcggaccgcaccgcctgcagcatctccaggtcgaacccggccttggtgccgtcggcgtccatcgagttcagcaggatctcccccacgcccaaatcggctccgcgggaagcccattcgacggcatcgatgccggtgccacgccgcccgccgtgggtggtgacctcccagcccgacggggtgggcaccgcgcccggcggcaccgtgcgggcgtccacggacaacacgatgcactgggagccgaactgccgcgccatctcctcgagcagctcggggcgcgcgatcgcggcggtgttgacggagaccttgtcggctccggcccgcagcagcacgtcgacgtcggccaccgtgcgcaccccgccgccgacggtgagcggaatgaagacctgttcggcggtgcggcgcaccacgtccagcatggtggcgcggcccgacgacgacgcggtcacgtcgaggaaggtgagctcgtcagcgccctcggcgtcgtagacggccgcaagttcgacgggatcgcctgcgtccctaaggttttcgaagttgacgcccttgaccacccgcccgtcgtcgacgtccaggcaggggatcacgcgtaccgccaggccggtggagttcgggctcatctcagtagtcctccggtcggccgatattgcgcaggatgtccaggatctcggcgtgcgcgccgggtccggcggccagcgccgaatccgaggccggggtccacggccgcccggccaggtcggtcaccacgccgccggcggcccgcaccagcgccaccccggcggcgtggtcccacacgtgcccgccgaaactgaccgccgcgcccaatatcccgtcggcgacataggccagatccaggccggtggagccgtgcatgcgcaaccgggacgagacccggctgaggttttccagcaccgccatccggtagcgccccgggaaccggccgcgggcgtccgcgctgaacgatccggccccgaccagggcgtcggccaggtcgatggaagtcagtggcggccgcgggatttcgttcttgcgcagcgggccgccggtcaccgcggtgtagcgctggtcgaggaacggcaaccaggtcagcccggccaccgggtcgccgtggtgcagcagggccagcaggatcccggccatcggggacccggccgcgtagttgaacgtgccgtccaccgggtcgagcacccacacccattccgagtcgacggccgaaccgccgaactcctcgccgtgcacgccgatcccggtggcctccaccagcgcggcgaccacctgccgctcgatggcgaggtcgacgtccgtggcaaagtcgttgcccttcttgcggaccgcggagtcggcgcggtgaccggcgaggaagggcttcgaggcgtcgtcgaggatcgccgacgcccgcgccaccaacgcgtccaggtccatgcggcgttactccgcgaccgcggccagcgcctggggcagggtgaatcgcccggcgtagagggccttgccgacgatggcgccctcgaccccgcggccggtgagcgtggcgatggcacgcaggtcgtccaggctggacaccccgccggaggcgatcaccggggcgtcggttcggtcggccaccgcgcccagcaggtccaggttcgggccgcccagcgtgccgtccttggtgacgtcggtaaccacgtaccgcgaacagccttgccgctcaaggcgttccagcacctcccacaggtcgcccccatcggtttcccagccgcggccgcgcagccggtgctgcccgtcgatgatctggacgtccagcccgacggcgaccttgtcgccgtgctcgccgatcgcccgggcgcaccactgcgggttctccagcgccgcggtgcccaggttcacccgggcgcagccggtggccagcgccgcggccagcgaatcgtcgtcgcgaatcccgccggacagctccacccgcacgtccagcttgccgaccacctcggcgagcagctcgcggttggacccgcgtccgaacgccgcgtccaggtccaccagatggatccattccgcgccgtcgcgctgccagcccagcgcggcgtccagcgccgagccgtattcggtttcactccccgccttgccctgcaccaaacgcacggcgcggccgtcgaccacgtcgaccgcgggcaacaagatcaacacattccctcctgagctgcttttcacaggcgctcaatccaattgcgcagcacggccgcgccggcatccccgctcttctccgggtgaaactgcgtggccgacagcgggccgtcctcgaccgcggccagaaacggcccctcgtggcgcgaccaggtcagcaccgcctcgggcgaaccctcccactgttgggcggcgtaggagtgcacgaagtagaaccgggtgtcagcgtcgaggccgcggaacagcacgctgtccggcccggattcgaccacgttccagcccatgtgcgggatcaccggcgcctgcaggcgtgtcaccgatcccggccactgcccgcatccggaggtctccaccgagaattcgacgccgcgggcgaacaggatctgcatcccgacgcacacgcccagcaccggacgccccgcggcgacccgctcggcgatgatgcggtccccgccgatcttgcgcagcccggtcatgcatgcctcgtaggcgccgacgccgggcaccaccagtccgtcggcggccgcggcggcgtcggcgtcggcggtcacctgcaccgaggcgccgacccgctccagcgcgcgctgcgccgaccgcaggttgcccgagccgtagtcgaggacaacaaccgatttacttgtcacagaacacctttggtggacggcacgtccgacacccgcgggtcgggctcgacggcctgacgcagcgcacgggccaccgccttgtactgcgcttcggtgatgtggtgcgggtcgcgcccgtagagcacccgcacgtgcagcgcgatgcgggcgttcatcgccagcgactcgaacacgtgccggttgatgacggtgtggtagggcaccgagctgccggcgatcgtgctgtgctgcaggtgatccggctcgccgctgtgcacgcagtagggccggccggacacgtcgacggcggcgtgggccagcgtctcgtccatcgggatgaaggcgtcaccgaaccggcggatgccccgcttgtcgccgagcgcctggcccagcgcggcgcccagcgcgatggcggtgtcctcgatggtgtggtgtgcctcgatctcgacgtcgcccgtggtgcgcacggtcaggtcgaagctggcgtggctgcccagtgcggtgagcatgtggtcgtagaacggcacaccggtctccacgtcgacccggccggtgccgtccaagtcgagttcgatgacgatgtcggattccttggtgcggcgctcgattcgcgcgcgacgggcagcttgcacggcggtcatggggctcctaacacacggtcgcgacccgctgcgcgcggctcggctgcgtttgcgatcgctcctacgttgacgggggccagctcggtggcggcgagttgggcgctggcccgcaggaaggcgtcgttctcctcggccaggccggtggtggcccgcaggtagccggggatgccgacgtcgcggatcagcacgccggcatccaggtagcgctgccagctggccggcgcatcggtgaactcgccgaacagcacgaagttggcgtcgctgggaatgactcgaaaacccatgccggtcaaggctgttgacacgcgttcgcgttcggcgatcagcgcggcgacgctgcccagcgtgtcgtcggcgtgccgcagcgcggcccgcgcggcggcctgggtcaccgacgacaggtggtagggcaaccgcaccagcagcatcgcctcgatcaccgccggtgtggcgatcaggtagccgagccggccgccggcgaaggcgaacgccttgctcatggtgcgggtgacgacgagcttggtcggatactcgcccaccagctgcaccgcgctgggctgtgacgagaactcgccgtaggcctcgtccacgatcacgatgcccggcgccgcgtcgagcagccggcgcaggccggacagcgaaacgctctgcccggacgggttgttcgggctggcgacgaacaccacgtcgggcgtgcgctcggtcacggcggccaccgcggcgtcgacgtccaggctgaagtcgtcggcccgggcggcctgcagccattcggtgcgggtgccgtcggagatgatggggtgcatcgagtaggacggaacgaacccgatggcgctgcgtccggggccgccgaacgcctgcagcagctgctgcaggatctcgttggaaccgtttgccgcccagaggttttcgactcccagttggacgccggtctgggcggtgaggtagcgggccaggtcgctgcgcagctgcaccgcgtcccggtcggggtagcggtgcaggtccgcggcggcccgcgccaccgagcgcaccacgtcgtccaccagcgcccggctgggcgggtgcgggttctcgttggtgttcagccgcaccgggaccgccaattgcggtgccccgtaaggcgatttgccgcgcaggtcgtcgcgcagcggcaggtcgtccagcgtgggttggggggtggcccgctggccggtcaccgctcgaacctccgccgtatcgcctcgccgtgcgccggcaggtcttcggcctgcgccagggtgatcacgtgcccggacacgtctttcagcgccgcctcggtgtagtcgacgacgtggatgccgcgcaagaaggtctgcaccgacaggccgctggaatgccgggcgctgcccgcggtgggcaggacgtgattggagccggcgcagtagtcgcccaggctgaccggcgagtacgggccgacgaaaacggctccggccgcgcggatccggccggccacggccgccgcgtcggcggtctggatctccaggtgctcggcggcgtaggcgttgacgaccgtgatcccggcgtccaggtcgtcgaccaggatgatcgccgactggcgtccgcccagcgcggcggtcacccgctcgcggtgcacggtggtcggcagctgggcggccagttccgcgtcggtggccgcggccaggtcctcgctgggggtgaccagcacgctgccggccatctcgtcgtgctcggcctggctgatcaggtcggcggccacgtgcgcggggtcggcggtgtggtcggccaggatcgcgatctcggtcggcccggcctcggcgtcgatgccgacccgcgaccggcacagccgcttggcggcggtgacgtagatgttgcccggcccggtgatcatgtcgaccggcaccagctcggcgtctgcccccggcgacgatgcggatcgtgcgcgatccgaggagaagccgggccattcggccccggtatcggtcccgccgtaggccagcagcgccaccgcctgcgcgccgccgaccgcccacacctcgtcgacgcccagcagccgggccgcggccaggatggtcggatgcggcagcccgtcgaactgggcctgcggcgggctggccaccaccagcgacgcgacgccggcggcctgggcgggcaccacgttcatcaccacgctggacgggtagacggcgttgccgccgggcacgtacaggcccacccgctcgaccggcacccagcgctcggtcaccgtcgcgcccggtcccagcgtggtggtgacgtcggtgcggcgctggtcggcgtgcacggcgcgggcgcggtcgatcatcacccgcagggcgtctgcgacggccgcgtccaggtcggccagggccttgtccagcgccgcctccggcacccggaccgccgccgggcggacaccgtcgaaggaggcgccgaactccagcgcggcgtcggcgccgcgctcggccaccgcctgcacgatgggtcgcaccttgggcagcaccgtctccacgtcggcgccgccgcgcggcagcgccgaccgcaatcgggcagcggtcagctcggcgccccgcaggtcgatgccggccatcggtgacgccggggtgggactcacggtgtccattgtcccagaggaactcaagtcgatatccggccggtacagcgcctggatcgcggccggtacagtgcccgtatcgaggccgggatcgaggccgggatcgaggccctaccccgcgccgacagcacgagccgaccccacggagccgccatgtccgccaaggatcatcccaacaacgccccgggcgtcccgatggtctttccagtctggtttgagaaccttcaggtcaagtacctgaattcggcgatcaagccgctcacgcgttttcttcccgggaccgcgaccatcaagcatcgtggccgcacgtccggcaagcagtacgagaccatcatcacgccgtatcgcaagggcaacaccctggcgatcgcgctgggccacggcaagacgaactgggtcaagaacgtgctggccgccggcgaggcggacgtggtgttcggccgcgaccgctcggtgcacctgatcaacccgcggatcctgccggccggctccgacggcgcaggcctgccgttcatggcccgcgtccagctgcgctggatgggggtttttgtcgccgacatcgcctgagccgatcggcgtcgagtgtgcactggtggcgccgacacgccgagaagtcgctacctggtgctacaccgaacgcccaggatgcccactcgggcgcccaaggcgcccaggatgcccaacccgctacatgtccaggccgatgtcgagcacccgcaccgaatgggtcagcgcgccgacggccaggtaatccaccccggtcgcggcgtagtcggcggcgttctccaggctgaggccgccggaggactcgagcaggaccgcgggcgcgcgcgcgtcgcgccgctgcacggccatctgcgtctgccacaccgggaagttgtccagcagcaccagttcgggcttttccggcagcacctcgtcgagctgctcgagcgagtcgacctccacctcgcagggcagctccggcgccgcgtcccgcaccgcccgcagcgcgtcgaccaccgacccggcggccaccacgtggttgtccttgatcagcgcggcgtcgccgagaccgagccggtggttgacgccgccgccgacccggaccgcgtatttctgcaacgcccgcaggccgggcagcgtcttgcgggtgtcgcgcacctgggccttggtgccttgcacggcggccacccagtgcgccgtcgtggtggcgatcccggacaggtggcagatcaggttcagcatggtgcgctccgcggtcagcagaccgcgggtttcggcccgcacggtcagcagcgactggcccggctgcaggtgggcgccgtcctcgacgcggtcgagcacctgatagccgcgggcgccgagcacctcgtccagcaccagcagcgcgatgtccaccccggcgatcacgccgggctgccggggcaccatcgacgcggtggccaccgcctcggcgggcaccgtcgccaacgtggtgacgtcgggcccgtagcgcaggtcctcgaccaggccgcgccggatgatctcgcgcgccgcggtgagctcgcagtccgagatcatcgtcacaccaccgccgccagcgcctgcaccagcaccgagttctggtcgtcggccagtcgcagcaggttgctgcgcgcctgctcgggcgcggcctgcggatgctcctcgcggtggtggcagccgcggctctcggtgcgggccagggccgcggccgcgaccgcgcgggcggcgacggccaacgccacgtcctcgaagtcgcggcggccgccgatgctgcgggccggcgcctgcgacagggtggccgacaaccgggtcagcccggccgggtcgcgcaccaccgacgcgtcgcggctcatcgcggcctgcaactccgcgcgcggcggcgcggtgtgcgcaacgggctcgggcgccagcgcgcgggggcggccggcctccgccgcatgcgcggccgccgccctgccggcccggcccccgaccaccagaccttccagcaggctgttggacgccagccggttggcgccgtgcagcccggtgcgggccacctcgccggcggcgaacaggccgggcagctcggtccggccgtacacgtcggtgacgacgccgccgcagctgtagtgcgccccgggcaccacggggatgggttggcgcaccgggtcgatgccggcggcccggcaggccgccgtcacggtcgggaaccggtcggcgaagtcgaagatgtgccgcgcgtccaggtagacgcaggcgtcgccggtggctttcagccgcgcgtcgatggcggcggcgaccacgtcgcgcggcgccaggtcgcccatcgggtgcaccccggcggtcaccgaatcgccttgggaatcaatcagtttcgctccctcgccgcggatggcctcggtgaccagcgggcgccgaccgccgccggcgccgggggcgaagagcatggtgggatggaactggatgaactccaggtcgctgaccgcgacaccggcccacaggcccagcgcgatgccgtcgccggtggagccctccgggttggtggtcgcgccgtagaggtgcccgagaccgcccgaggccaggatcaccgacggcgcgctgatgatcccgcagccgtgcgggttgccgaccagcacgccggtgacggcttcgtcgcccatggagccgtcgtgcagcacccgcagcgccacgtgcgcggtgcggatgtccagcatccgtgcggcgtggtcgagcgcgcgctgcacctcggcgccggtggcgtcgccgccggcgtgcacgatgcggcgccgggagtgcccgccctcgcgggtcagcgcccactggccgggggccgattcgtcgaatcgcgctccgtcaccgaccaattcggagaccgccgcgtacccgtcggccacgatcgagtagaccgcctgcgggtcgcacaggcccgcgcccgcgacgacggtgtcggcgacatgggcctcgaccgaatcgtcgttgtgcggcaacaccaccgcgatgccgccctgcgcgtagtgggtggcggtggccccgcgcgcctggtcggccttgctcagcacgacgacgctgcggccggcgcggtgggcggccagcgcggcggccaatccggcgacgccggtgccgatcacgacgacgtcggcgctgtgtgtccactggggacgggcgatcattcgccaccgcccggctggccgatctcgatcatgcgctgcacgctgcgccggccggcagccgcgatgccgggatcgacgtgcacctcgtcggcgccctcgaccaggcagcgcagcagagccgccggggtgatcatcttcatgtaccggcaggaggcgcggtcgttgacggcctggaaatcgacttgcggtgcggcccggcgcaattggtagagcatgccgacctcggtggccaccagcaccttgcgcgcgctggtggtgttcgcggcgtccagcatgccgccggtggacaggatcttgacccgttccgcggggaaggcgccctcccccgcaaggtacaaagccgaagtggcacaaccgcattcgggatggacgaatagctcggcatcggggttggcgcgcgcccgctcacccagttcgtcgccgttgatgccggcgtgcacgtggcattcgccggcccacacgtgcaggttttcccggcccgtcatccggcgcacgtgcgcgcccaggaactggtcggggcagaacagcacctcgcggtcggggtcgatggacgccaccacgtcgaccgcattggacgaggtgcagcagatgtcggtgagcgccttgaccgccgcggtggtgttgaagtaggagacgacgaccgcgccggggtgttcgtccttccaggcgcgcaggtcctcgggcgtgatggagtcggccagcgagcagccggcgcgctggtcggggatcagcaccgtcttgtcggggctgaggatcttggcggtctcggccatgaagtgcaccccgcagaacacgatggtgtcctcgggtgcctcggcggcgatccgcgacagcgccagcgagtcgcccacgtggtcggccacgtcttggatctcgggcagctggtagttgtgcgccaggatggtggcgccgcgcaacttcgccaggcggcgaacctcggcggcccactgcgcatcgccgtccacaccggtgtaaccggtgggcgagtcggtgatgtcggcaaccatgtcttcagcgagcgtgtccatgcgattgagcaccgtcatggcggctcctttccggccaggaggttttcgacttataatcgaaaacatggcccatggtagcaccgcgcacgaagtgctcgcggtcgtgttccaggttcgcgaagcaagcgaaccggttacgaaggggcgccatcgggcgaaaccgcagctgaacgtgctgttatggcagcgggccaaggacccgcagcgcggggcgtggtcgctgccgggcgggcggctgcgcaacgacgaggacatgaccacctcggtgcggcgccagctggccgagaaggtcgacctcaaggaactggcgcacctggaacagctcgcggtgttctccgacccgaaccgggtgccgggcacccggatgatcgcgtccacgttcctgggcctggtgccctcccccgccagtccggagctgccgccggacacccgctggcacccggtgaactgcctgccgccgatggccttcgaccacggtcagatggtggacaacgcacgggcccggctgatcgccaagctgtcctacacgaacatcggattcgctttggcgccaagggaattcgccctgtccacgctgcgcgacatctacggcgccgcgctgggctatcaggtcgacgcgacgaacctgcagcgtgtgctggcccggcgcggggtcatcaccgcgaccggcaccatcgcccagtccgggcgcagcggcgggcgtccggccgccctgtaccggttcaccgacgcggcgctgcgggtcaccgacgaatttgccgcactcaggccgcccggcctgccaggctagacatcccaggtccgtaagttgtcaagccgcctgggagtcggggttggtttggcggtgtgcccaggctttgtgttcgtcgtagtgggttcggtgtcgtaggcagccgtggaggatgcctacgaggcggttaccgagggcgcgtagcgcttggtggtggaggtcgccggcagcgcgacgccggtcgtagaacaggcgggcgccggggctggtgttcagggcgcagaaggcccattggtcgatcgcgtcgtagagccggcggttgcggacgtggcgggccagcacggcgcgtttgcggccggaggcgacggtcagcggcgacgttccggcgtagtttttgcgacacttggcggtggtgtacctgttcgggtcgtccccgaactcaccgagcacccgggcgccgaggatgacaccaagtcctggcagggagcggtagatgtcggcgtccgggtgtgtctcaaaatgtgttgccagttcggcctcaaggtcggtgatctggcggttcagttcagcgatgatgccgaccgtggcgcgggtggttgcgccgaacgcggcggtgaccgcggcaggggcggcgagctgctcagcgcgtaaagcggtttgaatgtcctgggcgacggtgtcgaggttgcgttgtcgcccagcggctttgagtgcagaccggatcttcgacagactcaggttcgccgcttgcatgggggtgggcgctcggcccaggatcgccagagcgtcgcggtcgtgcagatcgtcgaacgcctccagcgcgcctgggtagtactcgcgcagcgccgagcgcagcgcgttggtgtgccgattgcgggtccagatcagattctgatgtgcccgggccagcactttgaccgcctcggtatcagcggagtcaccggcgacgcggcggtgattgtggcgatcggtgcgcaccagatccgccaagagcttggcgtccccggcatcggatttggcccccgacacatggtggcggtcgcggtagcgggcggccgccatcgggttgatcgcatacacctggtaatcggccgcggtgagcgcctcgacccacaaaccacggtcggtttcgattccaatcacgacctggtcgggctcttcggcatggcgggccaaaagctgatggaactcgccgatgccggcaagtccctccggtaaccgacgcgaggccagccgggccccggattcatccatcaggtggacgtcgtgatgatcctccgcccaatcgtcgccgacaaatatcacgtagcgcctcctcggtggtcatcgaacatgttcgagcccaagggcacccggcgacaagctaatggatcagtgctcaacggcacgacaccccatcagtgctacaggaaccctcaccaaccggccggggcgtgatctagccttagaagtcggccatcgcttcagctggcaacgacgctcaccgaccggcggctcggtaaacagcgtcccccgaacaagggatcaacagccgaaggctcactgttcgatccccattaggctggcacaacagcgtcgtcaggcgacgcggtgctcgaccacaccggtggcgcaggcgaccacggccgtagtgtcgagaagtcgctcacaatgcggcgattacgttttggccacccgctgttcgtacgcgacaatgccgggtggccacgaagggagcctcaatggcggagctcggcaacctggcaggcacgcacggcgcggaatggatcgcccggccgccgcacgaggaactgcagcgcaaagtgcgtccgctgctgccctccgacgatccgttctaccagccgccgctgggcttccagcatgccgaacccggcacggtgctgcgctcccgcgacgtcgagctggcgttcctcggcctgattccccagccgatcaaggccgtccagctgctctaccggaccatggacatgaacggcgagccggaggcgaccgtcacgacggtgatcgtcccggccgacgccgtgccgggtcggccctgccccctgctgtcctaccagtgcgcgatcgacgccgtgtcgtcgcgctgcttcccgtcctacgcgctgcggcgccgggccaaggcgctcgggtcgatcggccagttcgaactcttcctgatcaccgccgcggtcgccgagggctgggcggtctcggtgcccgaccacgagggcctgcgcggcctgtggggcgcgccgtacgaaccgggttaccgggtcctcgacggcatccgggccgccctgggctcagaacgcctcgggctgtccccgtccgccccgatcgggctgtggggctattccggcggcgggctggccagcgcctgggccgccgagacgtgcgccgaatacgcgcccgaactcaacgtggtgggcgcggtgctgggctcgcccgtcggcgacctgggcaacaccttccgccggctcaacggcagcttcctgtccgggctgccggcgctggtggtggccgcgctggcgcacatctatcccgacctggaccgggtgatcaaggagcacgccaacgaggaggggcgcgccctgctggactcgctggagaagatgacgaccgtggaggccgtcatccggatggccggcaagaacatgggcgactacctcgacgcgccgctcgagcagatcctgtccacgccggaggtcacctacgtcttcgaccacatcaggctgggcgccgccgtcccgacgccgccggtgctgatcgtgcaggccgtgcacgactacctgatcgacgtgcacgacatcgacgtgctggccgacgcctattccgccggcggcgcgcaggtcacctaccaccgtgacgccttcaacgagcacatgatgctgcacccgctgtcggcgccgatgacgctacgttggctgaccgatcgcttcgagggccgcccggtgaccgagcacctgatccggaccacgtggccgacgatgttcaacccgatgacctacgtgggcatggcccggctgctcaagatcgccgccaaggtggtcaccggccgaaagattcaccgccgcccgctgtgacggccgcttccgcggcgcgcgcatcggtcggcgcggtcggcggcagcgcacccaggtcgtcgcgggcgtcggcggccgcccgcacggcgtacaccagcgcggcgatcccggccggccacatcaggctgaccgcgatctgcagcggaccgtccgagaagaacaccggcggcgcctggatcacgtaggcgaccgacgggctcctgcccagcggcaccgcgtcgaagtccagggcgccgtagcgcagccgcaccagcccggcccccaccgcggcggcgatgagggcggccgtcgccatcgcgacggacaggaccgcgaccgtggcgggtccccggtgccggcgcgactgccaggccgccaccgaggccaccaccgccaacacggtcagcaggcccagcagcagggtgggtgcgacgaagaagtgctcggactcgttgcccaggtagtcgtgcacccgctcgccggagcgggtcagcgccaccaccgcgcggaccggcgggacgatccacgcccatagcgcgccgagcaacgcgccgacgaccgccgacccggccaccacgaccagaagggcgcgcagctcggcccggccgggcagcccgacggcggcgacgtcgccggtcggcgcggcatcgggttgcccgctcaccgccgcgtctccagctcggcggagtcgacctgaccgtgcctcgagcagcgcgcccgccagccgtcggggcgaacctggaccaccatccggcgcccgcacgccgcgcagaaccggggaggctccagacccaactgggccgccggcggcaccgcggtaccccctagttccccggtgtagacgttgtagacgccggcgccgacgacttcgcccagggcgcccagatcaccaaccacaagtttccaaccctagccgcgcgggcgacaaaccggcgtgcgggccggctcagaggctggcattgagccccttgaggggcatttgcagatcgtccagcaattccaggtcggattcggccggacgccccagcgtggtcaggtagttgccgacgatcacggcgttgatgccgcccaggatgcccttcttggcgcccaggtcgccgagggtgatctcgcggccgccggcgaaccgcagcatggtgcgcggcaacgcgagccggaaggcggccaccgacttcagcgcctcggtcgccggcatcacctccaggtcgccgaacggggtgcccgggcgcgggttgaggaagttcagcggcacctcgtcggggccgagctcggccagttcggcggcgaattccgcacgctgctcgagggtttcgcccatgccgaggatgccgccgcagcagacctccatgccggcgtcgcgcaccatcgacaaggtgtcccagcgctcttcccaggtgtgggtggtcaccacgttggggaagaacgaccgggccgtctccaggttgtggttgtagcggtgtacgcccatctcggcgagctgctccacctgctcggcggtcagcatgcccagcgagcaggcgatgttgatctcgacctcgttgcggacggcctcgatgccggccgcgacctgggccagcaaccgctcgtcggggccgcgcacggcggccacgatgcagaactcggtggcgccggacttggcggtctgcttggccgcctcgaccaggctggggatgtcgagccgggcgctgcgcaccggggacgcgaacagccccgactgcgagcagaagtggcagtcctcggggcagccgccggtcttgaggctgatgatgccctcgacctcgacctccgggccgcaccaacgcatccgcacctcgtgggccagcgccagcaggtcgtcgagccggtcgtcgggcagccgcagcacctgcagcacctggtcgcggctcaatccctggccgccctccagtacctggcgccgcgccaccgccaggatgtcctcgttgccgatctcggccgtcggtcgcgtcgccgcttgcgtcaccaggtactcccctgcctcttgcgggtgcccgcgcgtgcgggcacgtctgccatcgatggcagcctgaacgaaaaggtgttcaaagtagggtaacggccgagcaactccaaccacccctgggtatacgaccatggtgaccgcgcacgcccaattcctggcgcaccactatctgctgctggcggtgccggcgttcctgcctgcggtgatcgtggtggccgtggtgctgtacgtggcgctgcgcgaccggcgggccgaccggaccagcacgtcggccggagcggagccggccggcgccgacacaccggacgaaaaccgtgattgacgcgccgtggatctgggcattaaacaatcaatcacgaacctacttggcagtaatgagcggttgacttaatcggatcctccggggtggcccggcgcggttgggaggcacgacgatgcggtcggacgaactgacgattgttgctgaggcaccggcgcgcggtgcggggttgacccaggtgatcgggctctcgctcgccgcggtggtgatcacgctgctgatgctgtgggtcggccacgcgcaccgcacccaccgcatccaatggctgacgcgcatcgccgacaagatgggcgagaagttccaccggcccaactgggtcgccctgccggtgctgatcttcaccacgtcgatcatctgcgcgctgttcggcttcatctgggacgtcagctggcacatcggcaacggccgcgaccccggcccgctggccaacccggcgcactacttcatcatcatcggcctgttcggagtgttcctgggcggcatggtgtcggtggtgctgccgttcgacaagcccggcccggcggcggtgcgcatcacccgcaactggtacgcaccggtcggcggtgtgctgatggccggctgcgggctgtacgcgatgatcggcttccctctcgacgacatctggcaccgcatcttcgggcaagacgtaacactgtggggcccaacgcatttgatgatgatcggcggcgccggcttttcgctgttcgcggtgttgatgctggggcgcgaaggcgaggccgccgagggtgaggacgtctaccacagcgtcttcatcaggttcttgcgctacctgtccttcggcggcatgttcatcggcctgtcggtctttcagatcgaatacgacttcggcgtcgagcaattccggctggtgctgcagccgatgatgatcgccggcgcggcggcgctggccgcggtcgccgcccgcatcacgatgggccgcggcgcggcgctgatcgcggccgtcttcgccatcgcgctgcgcggcgccgtcgcggtgctggtcgggccggtgctgggcgccccgctcaactggttcccgttgtatctcgggcccgcgctggccgtcgagttggtcgcgttgacgccaatcttcaagcgccccatcgtcttcggcgcggtgtccggcctgggggtgggcaccctcgggctgtggctggagtcgctgtggatctcggcggtgtaccactacccgtggccggtcagcatgtgggccgaggcgctggccatggcggtgccggtcgccgtgctgatgggcatgtgcggcgccatgttcggcatggtgctcaccgggcagcggctgccgggccgggccatcggcatctcggtggtggtggccacggtgctggtgatcggcggcgcggtggccaacggcctgcacatcgtggtgccgcggcagaacaacgccaccatcctgctgaccgacctgcccagcccacccgggcagcggatggtctccgccgacatccagctcatgccggccgacatggtcagcccggatccggagtgggtgacggtgctgtcctggcagggccggatgcagaaccaccgcggcctgcagatcgaccacctggccagggtcggtcccggccactaccggtcgacgcagccgctgccggtgtggggcacctggaagacgctgctgcgagtgcaggacggttacaccatgaccgcggtgccgatctacgagccggccgacgacgcgattccggcggccgaggttccggcgctgtcggcgatgaaccgcccgttcgtccaggagatcaccatcctgcagcgggaacgcgaccagaacgcgccggtgtggttgttcaccgccggctcgatcgtggtgctgtgtttgaccctgatggtgatcgctagcctcacctggggcgccggccggctcaacaacgccgtcggcaggccggaacccgtcgaggacaagcagccgatcccccgggcggcgtaaccgatgacgcttcgaggcaccctcatcgcggcatgggtggcggcgctgacgtgcggcctggtcggctgcggcggctcccccgataagaccgcggccgcgccgctggtcatcgacgtgaccatcgcccagggacaggtgaccccgaccaacgccaccctgcaggccaaggtgcaccagcagatcaccctgcacgtcaccagcgacgccaccgacgaactgcacgtgcattcgacgccggatcacaagttcgccgtcgccgcggcgccccaccagaccttccagttcgccgtcgacgtgcccggcaacgtcgccgtggagctgcaccacctggaccgcacgatcgcgaccatccaaatacagccgtgagccccgcccccgcggcggtggtgctcgcgcacgggctgggcgggtccggcgacctgccggtgccctacgcctatgcgatggtcggcgcggcgtgggcgctgaccttcaccttcgccctggtggccttcgcctggcggcggccgcggttcgatccgctcaagccgggccgggcgctgccggcggcgctgaccgcgttcgtcgacgcccgggccacccgatacaccgcggccgggctggccctggccgtggcggcgtgggcggtggccgccggtgtctgggggcccgagtccgacgccaacgcgctgctcggcgccttctacgtgctgctgtgggtggggctggtggcggtgtcgctggcgatcgggcccgtgtggcgggtgatctcgccgatccgcacgctgtatctgctggcgcgccgggtcgtcccggagcggctcgcccggccgcggctgtcctacccaaagcgctgggggtaccggcccgccgcgctgggcctgttcgcgttcgtgtggatggagctggccagcccgaacccggcggccccgtcctgggtgacgggctggctgctgatctacaccgtgctgatggccgccggggcgtggctgtgcgggcagcgctggctggcccgggccgacccgttcggggtgtacagcatggccgtctcccggctgtcgccgtttcgccgcaatccgcggaccggccggatcgtcgtcggcaacccgctcgaccacctgccgtcgctgccggtgcggcccggcgtcgtggtgctgctggcggtgctgctcggctccaccgcgttcgacagcttctcgtcgtcgccgacctggcggggcttctccgatcggctgacccgcgaattcgcggcgccgcccgcgctggcgtcgtcggtgctgcgcaccctcggcctgatcgtgttcatttgcgttgtggccctgaccttttcactggcggcacgggccaccggcggggtcgacgcgcagcagcgccgcgcgttgcccggccagatggcgcattcgctgatcccgatcgtggtgggctacatcttcgcgcactacctgtcctatctggtggagcggggacagcaggcggtgttcgcgctggccgacccgttcggccggggctggaacccgctcggcctggcgcatctgcaggtcgcctacgtgctgtccatgcatccgccggtgctggccgcgatcaaggtgacctgcgtggtcaccggccacatcgtcgcggtgatcgccgcgcacgacaaagcgctgcggctgctgcctgccggtcaccagctcaccgggcagctggcgatgatgctggtgatggtcggctacacgttcaccggtttgtatctgctcttcggggggtaggcgttgcggcgtgcgccgctatcccccaacccgcccggcccccagcgattgatggcgcggcgctcgagggagcagcccgcaccggacccgcagcagccggctcggcaggccggacgccgccggccggggctgtcgtggatcagcatccagtccaaggtgatggtgatgctgttggtgtccagcctggcgtcgctcggggtgatcgggacggtcgagtacgtcgcggcgcgcaatgcgctgcagccggccgcgtccgagcggatggtgcagcttcgcgaggcacagaagcgggccatcgagacgctgttctcggacctgtcggactcgctggtggtctacagccgcggatccaccgcgttggaggcggtgcaggcgttcaccgccggcttcgaccagttggccaacgcgcccgtggatcccgcgcagcaacgggcgctggtggacttctacaccgagcggctgatcaaaccggtcgagcgtgacaccggcaagaagttggccctggacgcggtgctgcccgccgacaatgcgcagcggtacctgcaggcgcactacaccgtggtggcgggcggacccttcgagggaacggggtccgcccccgacgacgccggcgacggcagcgcctggtcggccgccaacgcccgcttcaacgattactttcgcgagatcgcgacccgcttcgagtaccgcgacgcgttgctcctggacacccgcggcaacgtcgtctacagcgtgcgcaagagcgcctcgctggggaccaacatcctcaccggcccctaccggcagtccaatctgcgcggcgcctacgagaaggcgatggccgccaactcggtgaacttcgtgtggatcaccgactttcagccctaccagccgcagctcggccagcccaccgcgtggttggtcgcgccgatcggcgcgccgggcagggcggcgggcgtgctggcgctaccgctgccgatcgcgaaggtgaaccggatcatgaccgccgacaagcagtggagagccgccggcatgggccgcaccgccgaaacctacctggccggaccggacaacctgatgcggtcggcttcacggttgatcctcgaagaccctgagcgctacgcgcgcgacgcggtcgccgccggcacgccgcgcaacaccgtcgacaccgcgatccgctggggcggcaccaccctggtccagcccgtcgccaccgcggccgtgcgcgccgcgcaacgcggcgagaccggaaccgtcaccgacaccggctacctgggccggcgcgaactggcggcgtatgccccgctgtccctgccgaattccgacctgcactggtcgatcctggctacccgggaaaccgccgaggccaacgcccgtgtggtgtccctgacccagaccctggtattgaccaccaccgcaatggttttcgtcatctgcgtggccgccctgctggtcgcccagatgttcgtgcggcccatccgcaggttgcaggccggcgcccgggagatcagcgcgggcaactacgacgtcaccatcccggtcacctcgcgcgacgagatcggtgaactcaccgccgctttcaacgacatgagccgcaacctgcagatcaaacaggagctgctgggcgagcaacgcaaggagaacgaccggctgctggcctcgttgatgcccgagccggtcgcgcgccgctaccgcgagggcgaacagaccatcgcccaggaacaccaggacgtcaccgtgatcttcgccgacatcgtcgggctggacgagatctccgccaagctctccggccgcgagctggtgggcgtcgtcgacgagctggtccgcgagatcgactctgcggcggaaacccttggcgtggaaccgattcgcacgctacacaacggatacctggccagctgcggcctgaacgttccccgcctggacagcgtgcagcgcaccgtcgagttcgcggtcgaggtgcagggcatcatcgcccggttcaacggcaggaccggctaccacctgggactgcgggccgggatcaacaccggcaacgtggtcagcgggctggtcgggcgctccagcctggtctacgacatgtggggcgcggcggttaacctggcgcaccaaacccgaagtagcacaacgcaaaccgggatctatgtcacctcgaaggtgtgtgaggtgatgcgcgacatccgccacttcacgccggccggcacggtcaccgtcggcggggtcgagcagcagatctggcagttgtcggaaaggaccgggccgtgagcacctttgactcgtcgtcgctgtactgggcggccgcggtggtcttgggcctgccgctgctgctgatcgttttcaccgaatggcaccagagcctggtccgcaagcacagcccgctggcccggcccgtcttcctgctgcgcagctacctgatcccgctcggcgcgctgctggtgctgttggtgaatgtggccaggatgcccgcccagttcacctcggtacgggtgctggcaacggcgttcggcttcgtagtggtggtgctgctgctgtccgggctcaacgccaccgtcttcgagggcgcaccggaaggctcctggcgtcagcgggttccgggcatcttcctggacgtgacccgcttcgtgctgatcggtgtcgggctggcggtcattttctcctacgtgtggggcgtgcgggtgggtggcctcttcaccgcgctgggcgtgacgtcggtggtgatcggcctcatgctgcagaactccgtcggccagatcgtgtccgggctgttcatgttgttcgagcagccgttccgcatcggcgactggctggacaccccggcggcgcgcggccgcatcgtggaggccaactggcggtcggtgcacatccagaccgggcgcgggctgcagatcacgcccaactcggtgctggccaccacctcgttcaccaacctcagccgcccgcccggtgggcaccaattgacgctcaccgcaacgttttccgagacggatccgcccgaccgggtgtgcgcgctgctgcgccgggtcgctgacgcgctgccgcaacgccggcccgacgcggtcgcggcggcggtgtccgccggaggggccgagtatcacgtcacgatcggattgacctcgcccgccgacgattccgccgcgcaggcgacgctgctgcgctgctctggtacggcgcgcgccgcgagggtctgcgcctcgacggcgccgaggacgacatctccacccccgagcgcatcgagcgggcgctgcgcatggtggtcgccccggcgctgcggctgggcccgccggatcagcaggcgttggtgtcgcacgcccgaatcgtccggtacggggccgacgagatcgtcgagcacgccggccgcgtcccggagaagatgacgttcctgctcgcgggcggggtgcggttgaccgccgccgccccggacggatcggtggtcgcggtcggcggcctggacgagggctcgtttctgggagtgaccgcgctgacccgccagcccaacctggccgacgcgcaggccgtcgcgggtgaccgcgctggagatcgaccgcgaacacctcgtcgagttggtgaccggcaagccgttgctgctgcaggacctgggtcgcaccatcgacgagcggcgcgccctggtgcaccgggccgtgaccgccgagccgatgccgtcccgggagccggtgtcgtaagccatcgctgtcgtcccgggcgacaaggaacgggtcaacgccgatctgctcgacttcctgcgccgctgaatccccgcctaaccgatcgggtgctcgaccttcttgttgccgtcccagcggcgcaaacccacgaagctgcactcgatctgggtgggccggccggcgatgcgcagcgcccggccgagttgggcgccgccgacccggcgggccatggtgacgtgcccggtccactggccgggcaggctgttgggcatcggcgcgggccgcaggtgcggggcgcacagccggtgcacctgggcgtgcaggtccagcagttcgccggtgggcaccaccagtcgggcgaagaccacgctgccccggccgaacagcaccggcgcgccgatcaggcacggcagcggtagccgggtacacagcggggccagcagagcgtccacgtcggcggcgatcgcgtcggcgaccgccagcgtcacgtgcggccggctcgccggcgcctggctgggaattccggccgccgccaacgctttccaggtctgccggatggccgcctcggtgtccgggtcgaagaccagctcgatcgagtggaccatcagccggccagcgcggtgacccagtcgcggtcgaatgcgccggcgctcacggcctcgaactcggcggcggccagcgccgccgcccccgcgggcagcacggcgcgcaccggggcaagcgcttcgagcgcgggccgattcgacgtctcgaccgggccgggatgttcgggccaggcgccgatcaccagcccggcacacgaaaggccctgcgcggcaagcgcttccagggtcagcgcggtgtggttgagggtgcccagcgccggccggaccacgaccagcaccgccgcgcccagcgcgacggcgagatcgcgtgcggtgacaccgttttcgccgagctcgaccagcagtcccccggcgccctcgaccagcgtcagccgccccggccggtccagctcgccgatgaaccccagcagctgctcgcggctgggcaaggccatccccgccgcggcggcggcggccaccggcgccagcggccgcgggtagcgggccagcccggccagctcggtcaccccggacagccgggccacctcggcgaggtcgtcgtcgccgtcgtcggtgccggtctgcaccggtttgcacaccgccacgtcgatgccggcctgacgggcatgacacgccagcgccgccgtggcgaccgtctttccgaccccggtgtcggtgccggtgacgaccagaaccgtcacggcctcagccgagcccggcgagcacatcggtgagcacccggcgcgcgacctccagttcggcgtcgtccagcgacgcgcgggcggtcagccgtagccgcgacgtcccggcgggcaccgtcgggggacgaaagcagcccacccgcacaccgccgtccaggcaggcggtcgcggcggccaccgccacgtccgggtcgcccaggatcaccgacaccaccgccgactgcggcgcctcgcgaacccggcagacctcggccagcacgccggcgtggcgcagcaccgcgccggaccgccagggttcggcgcgcagcacgcccagcgcggcgcgcgcggcgcccaccgccgccggggccaggccggtgtcgaagatgaacgtgcgcgccgcgtcgatcagatgggcccgcaccgccgccggccccagcaccgcgccgccctggctgcccagcgccttggacagcgtggtggtcatgaccacgtcgggcgcgccggccaggccggcctcgaacaccagcccgcgcccgccgccgcgcacccccaggccgtgcgcctcgtcgacgatcagcagggcccggtgccggcggcacacctcgtgcagttcgcgcagcggcgccagggcgccgtcggtggagaacaccgactcggtgatgacgacggcgcgttcctcgtcgcggtcctgcagcgccgcccgcaccgcgtcgacgtcgcgatgcggcgtcactaccacccgcgcccgcgacagccggcaggcatccaccagcgaggcgtgcgagtacgcgtcggagaccaccagcgccccgcggcccgacaggcccacgacggcccccaggttggccgcgtagcccgacgagaacagcagcccgctggccgcgccgacgtagtcggcgagctcggactcgaactgctggtgcagctcggtatccccggtgaccagccgcgacccggtcgccccggcgccccacatgcgcagcgcggcgaccccgccgtcgatcacgtcggggtgctgggacagcccgaggtagtcgttggaggccaggtccagctcggtggccacgggcggccgcggccgcagcgagcggcgcagcccggccgcgcggcgctgctgttcgaccgcgtccagccaggccagcggggaaacctcgatgggtgctttcatcgacctagagcctacgagagccgaggcgcgcggcgacctgcaccatcgccgaggcgatccgggcgatctcgtcgggcgggcagatgtagggcggcatggcgtagatcaggttgcggaacgggcgcagccagacgccgtggtccagcgccgccggggtggcgacggccaggtcgacaggccggtcgcattcgatgacgccgatggcgccgcgcacccggacgtcggtcacgccgggtagctcccgggcgggttccagcccggccgccaggccggcggagatctcggcgacccgcgaccgccagtcctgcccgagcagcacctcgacgctggccatcgacacggcgcaggccagcgcgttggccatgaaggtgggcccgtgcatcagcgccccggcctcgccggcgctgatgacctgcgcgatgtcggtgctgcacagggtggcggccaggctgaggtatccgccggtcagcgccttgccgacgcacatgatgtcggggctgacccgggcgtggtcggcggcgaagagctcgccggtgcggccgaacccggtggcgatctcgtcgaagatcaacagcacgtcgcgccgggtgcaggcctcgcgcaggtcgccaagataccgcgggtcgtggaaccgcatgccgccggcaccctgcacgacgggctcgacgatcaccgcggccagctcgtcggcgtgccgggccagctgcgcctcgaacgccgcgctgtaggccgggtcgtagtcacggggcacctgcggggcgaacacctgccgggccaggatgtcggtccacagcgaatgcatgccgccctcggggtcgcagacgctcatcggggtgaaggtgtcgccgtggtagccgccgcgccaggtcatcagccggtgcttggccggccggtggcggctgcgccagtactgcagcgccatcttcaccgccacctcgaccgacaccgaccccgagtcgctgaagaacacggtgtccagcccggccggggtgatgctcaccagcagctgggccagccgcgccgcgggttcgtgggtgagcccgccgaacatgacgtggttcatggcggcgagctggtcggacagcgccgcgtccagcaccgggtggccgtggccgtggatcgcggtccaccaggagctcatggcgtcgagcgcccggacctcggcgccgtcgcggatcagggtcagccaggcgccgcgggcgccgactgccaccaccggggcgacggattcggcgccgatggtgctgtaggggtgccacaggtgcgcggcgtcgatcgcgctgatctgctcgggcgtcagcccggccttcgccgcgggcatagtgatcgagggtagagcagccgattcgcgcaaaaccgggccgtcgggaagcatgggacagcatggccaccccgcagccgcccgacgggtcgggccccgacgcagggcccgccggcccgggctggtccggcgacgcccgcggcccggtggccgagtacgacgaggaagcgccccgggtgctgcgcctgcggctggcggcgtgggacgtcgtctgcaccgtcgccctgctggtcctgctcgcgttgctggccacggcgacgtcctggccggagcggctgttcgggtttctggccaatgtctgcgaggacgagacctgcgggccggttccctacgggctggatctgtacatccatccggtggtgtggggcggcatcggtgcggccctgacggccgccgtggtgggcccggtggtgtccctcctgaagggctggtacatgtccttctggccggtgctgtcgctggcgctggtgatggtcagctcggtggccggatcgatgctgacgatgttcagcgaacgctactggctgtgatcgggccgcccggcggcgccgccgttcgctagccgactgagaccgaaatcacaactgcgcatacgggattcgccgcggcagtcaccgtcgggtcacggtacgacaaaaaatcccccgcgaccctggcggctaacaccttctgttgtcaaagtggctcttgtgactggtgtgaatacagcggttcggccggctggttcacgtcgcaagtggcatggacggcgtgcgatcccagcgtgggggtcctcgcccggtccatgaaccggggcggacgcgcgaggtcaccgcgccgaggcccgacgagtgccggagaggccaggaaaggccaggaaaaatgaaacgcatctacgccttcgcgatcggtttggccctactcggggcgccggcggcgccgatggtggttccccccgtcgcgaccgccgacccgggcgtcagggcgatggactatcagcaggccaccgacgtggtgatcgcgcgcggtctgtcgcagcgcggtgtgccgttctcctgggccggcggcggcatcaacggccccacccgcggcaccgggaccggcgccaacaccgtcggtttcgacgcgtccgggctgatgcagtacgcgtacgccggcgccggcatcaagctgccgcgctcgtccggcgcgatgtaccgcgtcggccagaagatcctgccgcagcaggcccgcaagggtgacctgatcttctacggccccgagggcacccagagcgtcgcaatgtacctgggcaacaaccagatgctcgaggtcggcgacgtggtgcaggtgtcgccggtgcgtaccgccggcatggcgccctacatggtccgggtgttgggaaccacggcgcccacccagcaggttccgcagcaggcgccgctgcagcagaccccggcgcagcaggcgcccttgcaacagaccccgggccagcaggcgcccttgcagcagaccccgggccagcaactgcccacccagcaggccccgctgcaacaggttccggggcagcaggttccggggcagcagctgcccacccagcaagcgccccagcaggcacccctgcagctggcgccgacccagcaggcgccgctgcaacagctgccgacccagcagtcaccgctgcagcagctgccggtccagcagtcgccactgcagccggcgggcgccggactcacccggtagtcccggaccctgcgcgcccgtccgacacccgccacctgctccccgccgcgcgcggtcaggagtcggtggcgggttttcggtaaattagcggtcgatcatgcagaccccgtccccgtccccagcaccggtcgccgccgccgatccgggcacctcgggagcgcgcacgccggggtctcgcgggttctaccgctacgacctcgacggcttgcgcggcatcgccatcgccctggtcgcggtgttccacatctggttcggccgggtttccggcggcgtcgacgtgttcctggcgctgtccggattcttcttcggcggcaaggtcattcgcgccgcgctgaaccccgcggtggcgctctcgccggtggccgaggtgatccggctggtccgtcgtttggttccggctctggtggtggtgctggccggctgcgcggtgctgaccatcctggtgcagcccgagacgcgctgggagaccttcgccgaccagagcctggccagtctcggctactaccagaactgggagctggccaacaccgcgtcggactacctgcgggccggtgaggccgtcagcccgctgcagcacatctggtcgatgtcggtgcagggccagttctacgtcagcttcctggtgctgatcgccggcctggcctacctgttcggccgccccctgggcgcccggctgcgcaccctggtcctggtggtgctggccgcgttgacggtggcctcgttcggctacgcgatcgtcgcgcatcagcagaaccaggcggccgcctactacgacagcttcgcgcggggctgggaattgctgctcggcgccttggtcggggcgctggtgccgcggatccgctggccgatgtggttgcgcacgctgttggcgacggtggcgctgggcgcggtgctgtcctgcggggcgctgatcgacggggtgcaggagttcccggggccctgggcgctggtgccggtcggcgccgccatgctgatgatcctggtcggagccaacctgggcgccgacggccgcctgccgctgccgaaccggctgctggccacccgcccgctggtcgagctgggcgccatcgcctactcgctgtacctgtggcactggccgctgctgatcttctggctgtcctacagcggccacaagcacgccggcttcgtcgagggcacggtgttgctgctggtgtccggcgtgctggcgtacctgaccaaccgcctggtcgaggacccgctgcggcaccggggctccgcgcggccggcgccccggcccgccgcgccgacggtgccgtggctggcgcgggtgccgcggccgacgatggcgctggggtcggcgatcgtgctgctgggtgtgacgctgacggcgacctcgttcacctggcgccagcacgtcaccgtgctgcgctcggccggcaaggaactcagcgtcctcaacccgcaggactatcccggcgcccgggccctcaccgaacacgtgcgggtgcccacgctgccgatgcggcccaccgtcctggaggtcaagcaggacctgcccgcctccacccgggacggctgcatcagcgacttcgtcaacccggccgtggtcaactgcacctacggcgacgtgaccgccgaccggaccatcgcgctggcgggcggatcgcacgccgagcactggctgccggccctggacatgctcggcaagctgcaccacttcaaggtggtgacctacctgaagatgggctgcccgctgtcgaccgaacaggtcccgctgatcatgggcaacaacgccccctacccgcagtgccgcgagtgggtgcagcgcaccatgaccaaactggtcaccgatcggcccgactacgtcttcaccaccaccacccggccgtggaacatcaagaccggtgacgtgatgccggcgacctacatcgggatctggcaaacgttgtccgacaacaacattcccatcctcgggatgcgcgacaccccgtggctggtgaaaaacggccagcccttcgacccggcggactgcctggccaaacgcggcagcaccgcccaatcgtgcgccatcaagcgatccgacgtgctctccgagcgcaaccagaccctcgacttcgtcgggcaattcccgcaactcaaggtgctcgacatgtcggatgcgatctgccgcgccgacgtgtgccggccggtggagggaaacgtgctgatctaccatggggcccatcacatgtcgcccacctatgtgcggaccatggcacccgaattgggccggcagatcgccgagagcaccggttggtggtaatcggccccgtaatcggctctgccgcctcgaaataccccgaaatatgtccacgcggcccgcgcgtgcttcccaccgcagcacggtcgcaaccttcgtgagcgccgcgcggcgcggataaggtcaagaggtgtcaagcaacgaacccgcttcagcagcaggcggcggtactcaccaacccgaagtgcctaccgtctggccgggcagcccctacccgctgggggcgtcctacgacggcgccgggacgaacttctccctgttctccgagatcgccgagaaggtcgagttgtgcctgatcgacagccgcggcgccgagacccggattccgttggacgaggtcgacggctacgtctggcacgcctatctgcccaacatcaaccccggtcagcgctacgggtttcgcgtctacggaccgttcgaaccgtcggccggtcaccgctgcgaccccagcaagctgttgctcgacccgtacggcaaggcttttcacggcgacttcacctacggccaggcgttgttctcctatgacctcaaggccgtcgcggccggcggcgacgacgccgaccccgggatcccgcccatggtcgactcgctgggccacaccatgaccagcgtggtgagcaacccgttcttcgactggggatcggaccgggccccgctgacgccctaccacgaaaccgtcatctacgaggcgcacgtcaagggcatgacccagacccaccccagcgtccccgagcagctgcggggcacctacgccgggctggcgcacccggcgatcatcgaccacctcaagtcgctcaacgtcaccgcgatcgagctcatgccggtgcaccaattcatgcacgactcgcgtctactcgatctgggacttcgaaactactggggctacaacacattcggcttcttcgccccgcacaaccagtacgccgccaaccgcaactccagcgtcgcggagttcaagtccatggtgcgcagcttccacgaggccggcatcgaggtcatcctcgacgtggtctacaaccacaccgccgagggcaaccacctgggcccgaccatcaacttccgcggcatcgacaacgccgcctactaccggctggtcgacaccgacctgcggcgctacaaggactacaccggcaccggcaacagcctcaacccgcgccacccgcacgtgctgcagctgatcatggactcgctgcgctactgggtcaccgagatgcacgtggacggattccgcttcgacctggccgccaccctggcccgcgagctgcacgacgtcgaccggctgagcgcgttcttcgatctggtgcagcaggatccgatcgtcagccaggtcaaactgatcgccgagccgtgggatgtcggcgaaggcggctaccaggtcgggaattttccgggtttgtggaccgaatggaacgggaagtatcgcgatactgtgcgcgattactggcgaggtgagcccgcaaccctgggcgagttcgcgtcccggctgaccgggtcgtcggacctctacgaggcgaccggccgccgtcccagcgccagcatcaacttcgtcaccgcgcacgacgggttcacgctgaacgacctggtgtcctacaacgagaagcacaacatggccaacggggaggacaaccgggacggggaaagccacaaccgatcctggaactgcggtgtggaaggccccaccgacgaccccgacatcaccgagctgcgctaccgccagatgcgcaacttctgggccaccctgatggtcagccagggcacgccgatgatcgcgcacggcgacgagttcggccgcacccagaacggcaacaacaatgtctactgccaggactccgaattgtcttggatggactggtctttggtcgacaagaactccgacctgctggcgttcgcgcgccgggccaccacgttgcgcaccaagcatccggtgttccgccggcgccggttcttcgagggcgaaccgatccgcagcggcgacgaggtgcgcgacatcgcctggctgacacccggcggccgggagatgacgcacgaggactgggggcagagcttccacaaatgcgtggcggtcttcctcaacggcgacgccatcaccgcacccaacgcccgcggcgagcgggtggtcgacgactcgtttctgttgtgcttcaacgccggtgagcaaccggtgcagttcgtgatgccgggcggcgactacgcgaaagagtggacggtggaactggacaccaacgaaccgaccggccgcaaagaaggcgccgagccgctggtggtgcacaccgaagaagagctgacgctgccctcgcgttcgctgctgatattgcgtaagacgttgtgacgcatgggtttacccgttctatccagctaccggctgcagctgcgcggtgagtccagcgggttcgcgttcaccttcgccgacgcggaacacctgctggactatctggacgccctcggggtgacgcatctgtatctgtccccgatcatgaccgcgaccgcggggtccagccatggctatgacgtcaccgaccccaccacggtgtcggccgagctcggcggccgcgacgggctggcccggctgtcggcggcggcccgggcccgcggcatgggtctggtcgtcgacatcgtgcccaaccacgtcgggatcgacgcgccccggcagaacccgtggtggtgggatgtgctgcgaaacggccgttcttcgccctacgcaacgtttttcgacgtcgactgggatctcgacgaggacggccggatcgtgctgccggtgctgggctccgacgacgacgccgccgacctcacggtggacggggagctgttgcggctgggcgatctggcgttcccgatcgcgccgggcaccgccggcggcaccgggcccgaggtgcacgaccgccagcactaccggctggtcggctggcgcaacggcgtctgcggctaccgccggttcttctcgatcacctcgctggcggggttgcggcaggaggaccccgcggtgttcgccgccacccacgccgaggtcgggcgctggttcgccgaggggctcgtcgacggcgtgcgcatcgaccaccccgacggcctgtccgatccgtgcggctatctgacccggttgcgcgaactcgtcggcccggacgcctggatcgtgatcgagaagatcctggccgccgacgaggcgctcgagcccaccctgccggtcgccggcaccaccggctacgacgtgctgcgcgaaatcggcggcgtgctgctggatcccaacggcgccccggcgctgaccgcgctggtggactcctccggcgtcgactaccaagcgatgccaaagatgctggccgagctcaagatccatgccgccacggtcacgctggccagcgagctgggccggttgcgccgcagcatcgcggccgccgccgacgtcgatcacccgctgctgcacgaggcgatcgccgcgctgctcaccaacatcggggtgtaccgctgcgactaccccggcctggtcgcactgctgcccaccgccctggccgaaacccagtccgcggcaccgcacttgggcccggcgctgcaggtgctggccgccgcgctggcccgcggcggtgagccggccacccggctgcagcaactctgcggggccgtcaccgccaaggccgtcgaggactgcctgttctaccgcgacgcccggctggtgtcgctgaacgaggtgggcggcgagccgcaccgcttcggcgtcggcgcggccgagttccatcacagcgccgccacccgcgcccggctgtggccgcacaccatgacgacgctgaccacccatgacaccaaacgcggcgaggatgtccgggcccgcatcggggtgctgtcccaggtgccgtcgctgtggaccgagttcgtcgcccgctgggaggtcgccgccccctcccccaacccggcgaccggacaattcctgtggcagaacatcttcggcgtctggccggtcaccggcgaggtcaccgccgcgctgcgcgagcggctgcacggctacgccgagaaggccatccgggaagcggcctggcacacctcgtggaacgacccggacgccgacttcgaggacgcggtgcaccggtggctggacaccgtgctggacggtccggtcgccgggcagctgaccgagcttgtcgcccaactcaatccccatgcctccagcgacgcgctggcccagaagctgctggcgctgacggtgcccgggataccggacgtgtaccagggcaccgagctgtgggacgacagcctggtcgacccggacaatcgccgcccggtcgactaccgggcgcggcgcgccgcgctgcaggcgttgcagcatccgaagatccgggtggtcaccaccgtccttcgggtgcggcgggcccatccggataccttcctgcacggtgactacgcccccctgctcgccgacggggacgcctgcgatcacgtgctggcctttacccgcggtgccgacatcgtggtggcggtcacccgctggaccgtccggctggccgaaaaaggttggggcaacacggtgttgccgctgcccgacggcacctggaaggacgccctcaccggcagcgtcgtggacgggccgacgtcggccgcgcagttgttcgccgaactgcccgtcgtgctgctggagcgacaccatgactgagcagaagaccgaattccgggtctgggcacccaaacccgcgcgggttcgactggacgtcgagggccgcccgcacgccatgacacgcaccgacgacgggtggtggcacgccgcggtggcctgcgcgccggatgcccgctacggcttcctgctcgacgacgaccccaccgtgctgcccgacccgcgttcgccgcgccaacccgacggggtgcacacccgctcgcagctgtgggatccggccgccgcgacctggacggactccgcctggccgggccgctcgacccacggcgcggtgatctacgagctgcacctgggcacgttcaccgcggccggcaccttcgactcggccatcgagaagctggactatctggtcgacctgggcgtcgacttcgtcgaactgatgccggtgaactcgttcgccggtacccacggctggggctacgacggggtgctgtggtacagcgtgcacgaaccctacggcggcccggacgggttggtgcgcttcgtcgatgcctgccatgcaaggggtttgggcgtgctcatcgacgcggtgttcaaccacctcggcccgtccggcaattacctgccgcggttcggcccctacctgtcgtcggcgagcaacccgtggggcgagggcatcaacatcgccgacgccgactccgacgaggtgcgccgctacatcatcggatgcgcactgcgctggatgcgcgatttccacgccgacggtctgcggctggacgccgtgcacgcgctggtggacaccaccgccattcacatcctcgaggagctgtccaccgaaacggactggttggcaacacaattgggccgtccgctgtcgctgatcgccgagagcgacctcaacgatccgcggctgatcaccgcgcgcgaacgcggcggctacggcctgaccgcgcagtgggccgacgacattcatcacgccatccacaccgcggtgtccggcgaacgccagggctactacgccgattttggcagcatcgccacgctggcgcacacgctgcggcacggctacttccacgcggcgacgtactcgtcgttccggcgccgccggcacgggcggccgctggacacctccgcgcagaccggcatcccggccacccggctgctggcctacacctgcacccacgaccaggtcggcaatcgcgccctgggcgatcggccgtcgcagaacctgaccgccgggcagctggccgtcaaagcggtcctggcgctcctatcgccgtataccgcaatgcttttcatgggtgaggagtatggggcctcgaccccgttccagtttttcagctcgcatcccgaaccggagctggcccgggccaccgccgagggacgcaagaccgagttcgccgaacacggatgggacgcctcaaagaagggggaaatccccgacccgcaggacccgcagaccttcgcccgctccaagctgaactgggacgaggtcggcacgggcgagcacgcccgcctgcaccggctgtaccgagacttgatcgcgttgcggcacaacgatcccgacctcgccgatccgtggctggagcacctcaccgtcgactacgacgaggatcagcgctggatcgtgctggcccggggccggctgcgcatcgtgtgcaatctgggtgccgagccggtgacggtcccggtcggcggcgagctgatgctggcctgggacgagccgacggtcgacgctgacaccacggtgttgcaaggccattcgttcgcgattctgtcgacgccggggcagcctgtggataactgatggcgggcgggcggcatcgcgccgcatgatgcggccatgagtcattctgaattcggccaccgactgcgacggatctgctcgtgcaaaccggaccgccgcggcgcccggcgcccggcgcgccacgacgtacccccgcacgccagcatcgagatgctgtggaagggccccggcatcgacatgcccggcgacggcgcctgatccgcggtcagacgatgggccgcccgctggggcgcaccgcctgtgcgacggcgtcggcgagcggttcgatctcgtcgggtgtcaggtcggcgatggtgatgcggatgcccgccggcgtctgcatccggaaccgggcacccggcgcggccgcccagcccgcgccgagcaaccgggataccgcgaccgcctcgtcgggaacgcgaacccacacgttgagcccggaccggccgtgcgcgtcgacaccccgctcggccagcgcgccgcacagccggcggcggcggtcggcatagcgccgctcggccgtcgcgacgagctcggacgccgctgtgtcggaccataattcgacggccagctgctgcaggacgtggctcacccagcccgggccgagccgcaaccggccgtgcacccgatccacggtgcgctggtcgccggccagcaccgccacccgcaggtctgggccgtaggccttggacgccgagcggacgaacgcccaatgcgcggtgcagccggccacggggtgcagggccgcgccggaaatgcccgcgcagtggtcgtcttcgaccagcaggacgtcgtcggcccgcccggacaacagatctcgcagcgccgcggcgcgatccgccgacagcgcggcaccggtcgggttctgcgcgcgcgtggtcagcaccagcgcccgcgcgccgcggcccaacgcgcgggccaggtcctcgggcagcggcccgtcgtcgtcgacccgcaccggctcagccgaaaacccgagtgcggcaagcagatcgaggagattcgcccagcccggatcctcgacggcgacgcgatcaccgggacgcagatgtgcggtcagcgcgcgctcgatgccgtccagcgcgccgctggtcagcgccaggtgatcggcgggcacgccgtcggcggacagcgcggcccgggcgtactcccccagcgccggcgagatggccggctcgccgtagaggaccgcgcggccggaggccgggcgggccggcgcggcggcggcgaggggtaacagggcggggtgcgggttgccggtcgacaggtcacgcacgccggcggggacgtcgagcccgagcagcgatcgcggggtggtcgccggccggtgccgcacccgggtgccgcgccggcccgcggtctcgaccgcgccccgatgccgcagtaggcggtaggccgccgcggccgtgttggcgttcacgccgagccgcgcagccagctcgcggaccggcggcagcgcatcgccgggcgccagcgagccggccgagatggccgcttcgatgctggcggctatggattccgcacccgtcgcggttatgctcttatgtactgccacgcaacagattatgtactaggacaatatctatgtcgaccgaagccgactaccagccgacgccgcgcagcacgccgacccgctaccgggaacgggcgcgctacgaccgccgcaccgtccaccgcatcctggacgaggcgctgatctgccacctgggctacctgagcggcggacgcccggtggtgttgccgacgacgcacgcgcgccggggcgagacgctgtacctgcacggttcgacgggcggcgggccggtgctggcggccagggcggccgcggccgcgggggcgggactgccggtctgcgtcaccgtcacgctggtcgacgccctggtgctggcgcgcgccgcgatgcaccactcggtgaacttccgctcggtcgtggtgctgggcgacgcgcgggtggtcgacgatccggcggagaagtcgcgggcgctgagccgcctgctcgatcacatcgcgcccgggcgcgccgccgactgccgggcagccgacgcccgggaactggccgccaccggggtgctcgcgctcgacctggccgaggtgtcggccaaggtgcgcagcggccccgccggtcgacgatccgcaggacctcctgttgccgcactgggccggggtggtgccgctgcagctgagcgccggcccgccggtgccggcgccggacctcgacccggccgttccgctgcccggctacctcgggtagcggcgactcacacctgtcgttgccgctcgcgggccgggcgggtgttgtcccaccaggttccgacgagcatgacggcgaacgcccaggccgtgcccagcatccagccggagagcacgtcgctgaggtagtggacgccgaggtagatccgcgagaacccgatcagcaggaccgcgccgatggcgagcgcccacaccagcacccgcccggtccacccgggaatcagccagcgggtgagcagccacgcggagatggccatcatcgccgcggtgccggtggcgtgcccggaggggaacgagtacccgtcggcgtcgacgagggcgaacggcagcggggggcgatggcgacccaccagcgccttggcggtgaacagcatgaccgggaccccggcgccggccaccaccgcgagcagcacgggccgccacgaccgggaccgccacgcggcgaccacggaaatcgggagggccagcgcggccaggaacagcgggccgcccgcgacggtgatcgcctgcaggacggtggtcagccacagatcgcggtgggccgcgagccatcgggtcaccggatggtcgatgacggcgatgccgtcgccctcgagcacgtcgtcgagcacttcggtgaagccgaccgccagcaacgcgaccgccgcgagcccgagaagcaatgccacaccggcgatctagctcaccggaaagcggcgcgccagcgcccgcccccgatcgccgatccggtcgcgcagccaggccagcgcctcatcgaccacggcgttgtgggtcgcccgctgccagagccgctgcaacgggcccgcgcgccgggcgatccacacggccgcccaccccagcagcaccagcgacgcgaggacggcggcgctgatcagcccgaaaccggcatgaccgggtccatacgatgggggcatgtatcggatttagagcagcaggtagcggtaggccggcgagcccggcttcagggtctcgacgtgcagctcggtcgcccgcatccgggccaacaggccgtccaggtcggccgaggaccccagctggatgcccaccagcgcctcgccggtctcccggttgttgcgcttgacgtactcgaacagcgtgatgtcgtcgttggggccgagcacctcgtcgaggaaccggcgcagcgcgcccggctcctgcgggaagtcgaccaggaagtagtgcttgaggcccaggtgcaccagggaccgctccagcacctcgccgtagcgcgacacgtcgttgttgccgccggagatcaggcagaccaccgtcgaaccgggttcgatgtcggcctccagcaacccggtgaccgacagcgcgcccgcgggctcggcgatgatgccctcgttctggtagaggtcgagcatcgcggtgcagaccgcgccctcgtcgaccgtggtgatcgacaccatgtcgccggcggccgccagcgcggcgtaggtcaggtcaccggcccgccgcaccgcggcaccgtcgacgaactggtcgacgtggtccagcgtcaccggctcgccggccgccagggcggccatcatcgccgcggccccggccggctcgacgccgagcaccgcggtggtgtcggtgcgctcggcgaggtaggtggtgatgccggcgatgcagccgccgccgcccaccgggaccaccaccaggtccggctcggtgtcgagctggtcgagcagctcgacggcgatggtgccctggccggcgatggtgcgcagatcgtcatagggcgggacgagggtggcgccggtgctcgccacgtcggccagcgccgcctcggcggcctggtcgtaggtggttccgccgacgatcagctcgatgaactccccgccgtggtagcggatccggtcccgcttctgcagcggcgtcttggccggcacgtagacgcggccgtgcacctgcaacatccggcacgcgtaggcgaacccctgggcgtgattgcccgccgacgagcacaccacgcccgcggccagctccgtctcggacagctgcaccagcaggttgtaggcgccgcgcagcttgtaggagcgcacgatctgcaggtcctcgcgcttgaggtagacctgtgcgccggtgatcgccgacagccggtcgctgaactgcaacggggtcggcgtgaccaccgcggcgatccgcttggccgcgtcgtcgatgtcagccgctgaaagcggcgcgacgctcggggactggctcaattcggcggacacggactaatggtgccatgcgggctggtcaactacggaattcaggcgaccggggtcagcacgaataccgggatctggcggtcggttttggtctggtattcggcgtagtcgggccaggcttcgacggcccgctgccaccagacggccttctcgtcgccgaacacctcccgggcgtcgtactcccgggtgaccgggccgtcctgcagttcgacgcgggggttcttcttgatgttgtggtaccagaccgggttcttcggcgccccgccgagcgaggcgacgacggcgtactgcccgtcgtgctcgacccgcatcagcggcgtcctgcgcagcttgccggtcttggcgccgaccgtggtcagcacgatgatgggcttgtccttcatgtcggcggcctcggccccgcccgatgcgacgtacttgtcggcttgctcgcgggaccaatcccacgggctgggtgcgtattcacctgaaagcggcatgacacaaccttaagcgcggtccgggtggggcggcccgacggccgggcgcgcgacgaacgaacgcagacggcgccgggtctggtggtcgggcgccccgggttcgccgtcgctgtgccggccgcgggtgtagtcgccctgccacggcacgcgctcgtcggccacttcctgctcgcgccccagcgcgccgcgcgagctcaggaagaactcgtgcttgcggtgcagttcttcgtcggactcgatgggccgcagttccggggcgaactcctccagctcggcccgccgctgcggcacgatcatgcagatcggctcgtccacctcgaaccgcaccggcatgaattcccgggtgaatttccagttcatgctgaaactcgaactggaccaatcggtttcgacgatgccctccaacggcgatatcgcgtccttgggatggttggccggtccgcggaccaacaggttgtagcccggcggggtgcggaacaggatcggcagatgccaggtcaggatgccgaagccgaagtgactgtccggcaaaaactgaccgctggcacgggtgtcgggcacgatcgtcaggctggtgcgatcatcaccgcccatccacgtcgcggtgaaggcgctgcggttgcgcacctcccagccgctctggttggcgatcaacatcggcaggcatcggtgtggccagccctggcgcatctgcgacatccaggcgcgcccgatcggcgcgggggcgatctgcggcgcgatgtcatgggtgatgtacccgatcaacgggcgctgcggcccctcggactgctccgtcatcagatcctcgcttcaccggctcgctggtcccctacaggcatagcgcacgccgggcgtcggcgcgcgcggcacagtatcgggaccggacgtgaacgtttcgtgtcgagtgcttgcgtgctataccccggggcggcgcggcgagccgtacgggttcagcgcgtccgggccagctccgcgatggtgttgacccgccggatggcggtggcgatctcgtcggcgaactgccggcgccgtcgcgcgatatccgggtcctcgaacccgtcgaccagctcgcggtgccgggccaggcgcagtgccgtcttgaacagttccatcgaccgcgactcggcgttggcgatccggcgctgcagctcccactgcttgccgacctgcaggcactccgccagaaacgcctgctcgtcgaacgaatcgtcctcgtagcaggccagccggtcggcgacgatgtgataggcgtccaggaacgggcgcagcaccaggtgcgccagcagcaggtcggcctgctccagcagcccgcgcaccacggcggcactggcggccttgccggtgtccaccggatcctcggcgggcccgatcagccgcacctcgtcggcgagctccttctcgaactgggcgcgggcggagaacaggaactcgaacttgagcagctcccgcagtttcagcgcctcgtcgcgcaccgtcgccggcagcaccgatccgtccccggacgtctcggagacttcgacggccgccagcagcgccgtctcggcgatggcccggtcgaccaggatgtggatggcggtgttgcggtagaaggcggcgaccaaatgctggtcggtgccgatcccccacaccgcctcggtgccggcgtcgtagacgttgaccacgccggaggccaccagttggtgcagggtccagcggatggtggagcggttggtcagatcggccgccccggccaccacccagttgcgggccgcgatgtagctggccagcggtcgcacggtggccagcacctcgctgagggtcagcgaccggtcggcgcccagcagcgccaggctgaccaccgcggtcggggtgaccggcgtggcgcggttgatgcggtgctcgacgtccagggcgatgcgttcgatctcggtttggctgcccgactcctcggcccgcagctcctcgagccgcttgcgcagcggcagcggctcgccgaagtccagatacgcccggcccaaccgggtgccctgctggcgcgcgagccggatcaggaagcggaaatcctcgggccgtttcgccgcgccgtaggcctcggtggtcatggcctccacctcgtgcagctggtcgtacacgatcgaggtcggcaccaaatatacttccgggccgtcgatttcgtcgaccgcgtcggcgaggtagcgcaggatcccgaacaccgggggccgcagcttgccggtcctggtgcggccgccttcgatggaccagctcaggttggcgtggttttgcaccagctgggcggcgtaggcgcgtaacacgaagcggtagacgggaagatccttggtttggcgccggatgaagatcgccccggtgcgcttggcccaggcgcccatcgggaagaagttcaggttcgacccgccgaaggtgagcgcggggaacagccggttggccaagatcacctcgggcagcagcatgccgtccaggtacgagcgatgcgaaaaggcaaatgccagtgtggctttgcgatccagcttgcgcagcgccgcgatctggtcctcgtcgatcagcacgtcgtaggcccgcatcagccagcggctgaacccgcgccaggccgccaccgccgactcgtcgagcgaggccgccatttcgcgcaggtagcccgcggcctcggcgcgcacattggccgggtcgcggccgagctcgccggccagggtgcgcagccgctcgtcgtaccagggcgcgcccagcaactgcacgacctcggccgggtcggtggccagcggcgacgtcgcttcgtccagaatgccggtgcgctgcaacagctttcgcattccgacgcgaccgatctcgcgggcgctgccggccggcccgccggtcatgcgggctgcaccgcggtggcggcgggctcgtgcacctcgggcgggggtggatcggcgtagagctgctcgatctcctcggcgtatttcgccatgatcggcttgcgcttgagcttcatcgtcagcgtgatctcgtcgccgccgggctcccacagcgtgggcaggatgcggaaccgtttgatctgttccacccgcgacagtttggcgttgcccgccgccaccccggcggcgatctgggcgatgacgtccgggtcggcggccagcgcggccggcgacgcgtcggacaacccgtgccgggcggcgtacgggcccaccgagtcggcgtcgaaaaccagcagcgcggtgttgtacggacgcccgtcgccgatggtgatcatcacgccgatcatcgggcaggcggccaggatggcgttctcgatgttggccggcgacatgttctttccggccgcgttgatgatcagctccttcttgcggtccaccacccgcaggtagccctgcgcgtcggcctccaggatgtcgccggtgtgcaaccagccgtcggcgtcgatggcctcggccgtcttcgccggttccttgcggtagcccttcatcaccagcgggccgcgcaccaggaactcgccgtcgtcggcgatcttgccctccagcccgggcagcaacttgccgaccgagcccaggcgcgcgtcgcggggatggctgacggccgccacacagctcagctccgacatcccccacacctcggcgatcgggatgccgatgccggcgaagaacgccagcgtctccttgggaatcggggccgcccccgacaccgcccagcgcagttcgccgaagcccagccgttcacgcagtttcgagagcaccaactcgtcggcccgcgcccattcggcggccagctcgtcgggtatctgctcgcccgcgaccaaggccgcggcgcgttgggcggccaccgacatcgcccactgcagcgccgcccgggtggactcgtcctgctcgttggcgacggtgaattcgattccggccttgagcttttcccatatccgcggcaccgccgcccacaccgtgggtcgcacgtcgggcagcgccgcggcgatggcgcgcgggtcgtcgacgacggtcacctgcgcgccgaacacctccaggccgtagagccccatcgcgcggtcggcgatgtgcgccgacggcagatacgacgtgacccggtcgccgaatttcgacggcagcaccgcgttgagcgcgtggcactcgaacagcaggttggcgtgggtcatctccacgcccttggggtttccggtggttcccgaggtgtagatgagcgtgacgacgtcgtcgggccggaccgaccgccaggtcgactcgaagtcgaaatcccttggggcggcggcatacagctgctcgacggagatggtgcccggcggggcgccgtcgatgcagacgatgtgttcgacgggcgcgccgctggcccggatgcggtcgacgtactgctgttcgcagatcgccaccttggtgccggcgttgtcgaacaggtaggtcagttgctcggccggcagcgtgttgtacaccgaaaacgacgtggcgccaaggtgttgcgcgccgatctccagcgggtagaactcgatccggttggccatcatcagcgacaccgtgtcgccgcgccgcacgcccagccccgccagcccggcggcgaacttgcggacctgctcggcgagctctcgccaggtcaacgtctgggtagccccgggggtgcgcagcacgaccgcgtccgggtcgatcgcggcgttgcgctggaatgcctcgcacaaggtggccggacgttccgccgtcatttccgctctccttgccccggatcagaaccttctggctgagcggacgtccgggccgacgggtgcgggccgggttgggtgaatgccgcaggtgcaggcgtcgatcgacgggcaagtgcaccgcatcccccactcgatgacggcgcgggcccgggccagcgactccagctgggcgtcgatctgggcgagtttggcccgggccagcgcgcggctggccgggcgtcccggcgcgtcgtcggcgaacaggcgctggatctcgtccagcgcgaagccggcggtcttgcacagcgcgatcacctcgagccgggacagcacggcctcgtcgtagcggcgctgcccgcccagccggatcggggcgggcagcaggccgatctgctcgtagtagcgcagggtggtcgcggcgaccccgctgcggcgcgcgacctcgccgatggtcagcatgggcggctcccgggttcgtgcttgactcagagttaactctaagtcgttgactggggccatgccgcatcgatccttcgccgagttgcacaccgaccgctatgcgctgctgcggtctttccgccgcgacggcactcccgtcgacaccccgatctggttcgccgtcgacgacgacggcgtgttgtttcgcaccaaggtcgggcccaagacccgccggctcgccgcgcatgccggcgtggaactcgcggcctgcgactaccgcggccgggtccgcccgggcgcgacgacgctggcgggccgcgccacgatcctttccggcgcggacgccgagcgcgccaaccgcctgctgcaccggcggtacggctggcagtggaatatcgtgccgctgctcaagattcccggcgtgacgaacgtgcaccgggatctgtgcctgcgtgagaagctgcgccgggcccgcgatcgcggggtgtggccggacagcgtcatcgtgcgggtgcagcccatgtgaccgccggcggcgcggcgagcgcggcggccccgcgcctgccgcccggcggccccgcgcctgccgcccggcggccccgcgcctggcccgcggcggccccccggcgagcccgcgcctgcccccggcgagcgtgaaattagcttcacggtcgcggccgagcgtgaaactaacttcacgctcggcgcgccgaagacccgctacccgccgaggcagccggggccgagcagctctttgaggtcgcccatcaacgccggcgacggcgtcacccgcagcgacgcgtccagctccaacgtggtgatccggtcgccgctgatcagccgcagatgcacctgcgaggtccccggatgacgggccagcacctgcttgagcgcggtgaccttgtcgatggtgcactgccgcgtcggcaggctgaccgccagcggccggtccacctgggcagtggaaaagtccggcaccacaagctcattggcgatcagcgcgatccggtcgtcacggatcgccaccttggcgttgatcagcaccacggcgtcgtcagcgatgtcggcgccgtaggtggagtaggcgtgcgggaagaacatcacctcgatgccaccggtgaggtcctccaattgcgctgacgcccaaggcatcccgttcttgttgacccgccggttgaccgacgccaggatgccgccgacccgcacctgggtctcgttgggcacgtcgccgtccaggatggccgggatctgggtgtccacctgcgcggccagcagatgcgccaccccgttgagcggatgcccggacacatagagccccagcatctcccgctccagcgcgagcttgtgcttgtcctcccactcgtcgtcgggcaccttgatggtgaacaccgactcggtgcaaccgccgtcgccgccgaacaagtcgaactggcccatcgcctcggccttcttggttcccagcaccgaatcgaccgcatcggtgtgtaccaggaagaggcccttgcgcgcgtgcttgagcgagtcgaacgcgccggccttgatcagcgactcggtcaccttcttgttgcaggccgagatgtcgatcttgttcaggtagtcggagaagtcggtgaacttgcccttctcgttgcgggtcttgatcagcgaaccgaccacgttggcgccgacgttgcgcaccgcgcccagcccgaagcggatgtcctggccgaccgaggcgaagttgaccagcgactcgttgacgtccggcggcaacaccgtgatgcccagcttgcggcagtcggccagatagaccgcggccttgtccttgtcgtcgcccaccgaggtcagcagcccggccatatattcggcggggtagttggccttcagatacgcggtccagtacgacaccagcccgtagccggcggcgtgcgacttgttgaacgcataccccgcgaacggaaggatggtgtcccacaaggcttttaccgccttctcggagaacccgttggcggtcatgccctcgtagaagcccttgtactcggcctcgagcacctctagcttcttcttgcccatcgccttgcgcagcgcgtcggccttgcccatggtgtaggaggccaccttctgggcgatgaacatgatctgctcttggtagacgatcaaaccgtaagtctcggcgaggatttcgcgcagcggctcctcgagctcggggtggatcggcttgatcggctggcggccgttcttgcggtcggcgtagtcgttgtgggcgttcatgcccatcggcccgggacggtacagggccagcaccgcgacgatgtcgttgaactccgtgggctgcatgcggcgcagcaggtcgcgcatagggccgccgtcgagctggaacacccccagcgtgtcgccgcggcccagcagctcgtaggtcgccttgtcatccagcggcaccgactccaggtcgaggtcgattccccggttggccttgatgttgtccagtgcgtcgccgatgatcgtcaggttgcgcaggcccaggaagtccatcttcagcaggccgatggcctcgcacgacgggtagtcccagccggtgatgatggcgccgtcctgcggccgcttccacagcgggatggcctcggtcagcggctcgctgctcatgatcaccgcgcacgcgtgcacgccggcgttgcggatcaaaccctccaggccgcgggcggtctggtagatggtgcgcacgtcggggtcggtctcgatcaggccgcgcacctcggcggcttccttgtaccgctcatggctggggtcggtgatgccggacagcgggatgtccttggccatgatcggcggcggcagcgccttggtgatccggtcggcgatcgcgaagcccggttgaccgtagtggatgcgcgccgaatccttcagcgccgctttggttttgatggtgccgaaggtgatgacctgggcgacccggtcggagccccacttgtcggcggcgtagcgcaccatctcgccgcggcgacggtcgtcgaagtcgatgtcgatgtcgggcgccgacggccgctccgggttgaggaaccgctcgaacagcaggccgtgcggaatcgggtcgatgttggtgatgcccagcgcgtaggccaccagggagccggccgccgagccacgcccgggccccacccggatgtcgaccgagcgggcgtagttgatcaggtcggcgacgatcaggaagtaggacggaaaacccttgtcgcagatgaccttgatctcgtattcggcccggtcgatgtagtcctggccgaccccgtccgggaaccgccgccgcagcccggccatcacctcgtggtgcagccagctggcctggtcgtgaccctcgggcaccgggaagaccggcatccggtcgcgcggcgtccacacctccgcgtaggactgcacccgttcggcgatcaacagggtggagtcgcacgcgccgggcacctcggcgtcccagatctggcgcatctcggcggccgacttgaggtagtagccgtcgccgtcgaacttgaaccggttcgggtccgagagcgtcttgccggtctgcacgcacagcagcgcctcgtggttgtgcgcggcgtcgcgggtgatgtagtggcagtcgttggtggccagcggcgggatgttcagcttgcggccgatctccagcaggccgtcgcggacccgctgctcgatggacaggccgtggtccatcagctcgaggaagaagttgtcggcgccgaagatctcgcgccacttggccgccgactcgagcgcctcgcggtcctggcccagccgcagccgggtctgcacctccccggaggggcagccggtggtggcgatgatgccgtcggcgtgttcggcgatcagctcggcgtccatccgcgaccacttgcccagctggccctcgaacgaggccagcgaggacagcttgaacaggttgcgcaggccggccgcgttctcggccaccatggtcaggtgggtgtaggagccgctgccggacacgtcgtcggccttctggctgggatccccccacaggatccgccgggtgtcgaaccgggagcccggcgcgatgtaggcctccacgccgatgatcggcttgatcccggccttggtggcggcgttgtagaactcgctggcgccgaacatgtttccgtggtcggtcatcccgactgcgggcatgcccagccgttccacctcggcgagcatcggggtgatcttcgcggcaccgtccagcatcgaatactcggtgtggttgtgcaggtgcacgaaggacgagtggttcatagggacgccagtctatgaccgaggaccgacgggtttcgggcgtgtcgggtccgtgtgttgggttttatccgtagagctcgacgaagttacgcagcgacctctgcacgtcgcccttgacggcgcgcgcggcggccgatccgaccggcccgaacagcgcccgaccgcccagctcgagccgcaggccgagggtggagccgtcgccggtgggccgcacggtcagcgagacggcgtacttggtcccgcccttgcccgagcccgtcatcgccacccggtgcggcggttcccaggtggtcaccgtccaggtcacccggttgcgaaagcctttggcgcgggccacgccgacgacctgggtgccctcgcccagctcgtcgggcagttcgccgcgccaggcctcgtgcagcaccagccagtcgcccagctccgacaggtcggacacccggtcccacatctgttgcgggctcatcggcacctcggcggtcatctccacggcggccatgagtttcctcctcgctccccccgcgtccgccccacgctggcgtgacgctcggcaccgaacaccacgctggcgtggcgctcggcgacactcagcgcttgggcccgccgcggaaccggttgccgatccggatgcccggcagcagcaggctgcgcggggcgaaacggccgcctgtgctgaccaccttgggcaccacgcccggcaccacggtgcgacggccggtgagcatgccgccgatcgccgcctcggccacgtcccgcggcgaaacctgcgcgatcgggatgctgaaccgctcggcgttggcgatctcggcccactcggtgggcaccgggcccggacacagacaggtgaccgacaccccgctgccgtgcagctcctcgtgcacggcctcggagaacgtctgcacgaacgccttggtcgccgagtagacggccatgtagggaaccggctgaaaacccgcgatcgacgcgatgttcagcaccgcgcccgccccccgcgacaccatgccgggcagcgtcgcgtgcgtcagctccatcagcgccagcgcgttgagggtgacctcttcgctctcgcgctccatcggcagctcgtggaagaccccgctggtgccgaagcccgcgctgttgcacaacccggcgatcgattcgctgcgcagccggccggccaaccgggcacgggccttcgagtcgccgaggtccagcggcagcacctcgacgccgaccgagtactgcccgcccacctcgttggcgagatcgtcgagccgctcacggcgccgggcgaccagcagcagcgggaagccacggcgggccaggccgcgcgccagttcggcgccgatgccggacgaggcgccggtgatgacgacggtggtcgcgatgtcgggtttgggaaggctcatcctctcaccaatgtatccctcgggtcgcccgcacgaacgtttcgctgcgcgcgtcgaattcggttgcgtcggttgcggattcatcgcccttggcggcgctggagtcgccgaacatggcgaacgcccggttgcgcacccggtccatcacggccgggttgaccgcgtcggcgacggcggcgaactgcccgaacggcgagctggcccgccgcggccggtgcacgatcgcgtcggcgatcaccccggccgcctgctcgggcgtcagcgccgggaacttgtcgtacaacgtggtcgggctgatcatcggggtgcgcaccagcgccatgtgcacggtggtgaatttgacgttgtcgttgacgacttcggcctgcagcgcgtcgcacaggctgtccagcgcggccttgctggcgatgtacgccccgaaccgcggcgcgcgggtctgcaccccgaccgacgacacgttgatgatctggccgaagccgcgctcgcgcatgcccggggatgaacttgaggatgagctgcaccgcgcccaggtagttcaactgcatggtgcgctggtagtcgtggatgcggtcgtaggacagctccagcgagcgccggatcgagcggcccgcgttgttgatcaggatgtcgacgccgcccaggtcgtcgagcacccgatcggccatcgcggcgatggcgtccatgtcggacaggtcgcacgggtacacgtgggcgctgccaccgttctcccggatttcggaggcgaccttctccaggttctcccgggtgcgggccaccagcgccacgacaccgcccgcctcggcgatcttcttggcggcggcctcaccgatgcccgaggaggcgccggtgatcagcacggtcttggcgtcgacggcctcctcgagggtgcggccctgcaccgcgtccagcaggttccgcagatagagcggccggtatcgcccggccgagttcggggtgttgatgatgttggagaccgccgcgaggggcttttccaccaggttcgtcaggtcaccaaggttcatcggcttcggctcccccgccctcgcgcaactgatgtgacgtgcgtcatgacgccaacctaggacaaaagcgccccgcgtcgatgcggattgcggtcatgcgccccgacgcggtctctcaccgttcccttaggccgaccgccagatgtgggcaatccgcttgttacacagagcaatccgggtgtgatcgcgccctaactgacgggcaacgccgcgatgttccaatcgtggtcatgaaaattctggcgcgcttccgcaaggccgagccggccagcatctacgaccggatcggcgggcacgaggcgctcgaggtggtggtcgagaacttctacgttcgggtgctcgccgacgagcaactgtccggatttttcaccggcaccaacatgaaccggctcaagggcaaacaggtggagttcttcgctgccgcgctgggcgggccgcacccctacaccggggcgccgatgaagcaggtgcaccagggccgcggcatcaccatgcaccacttcggtttggtggccgggcatttggccgacgcgctgaccgccgccggcgtgccgtcggagacggtgagcgagatcctgggggcgatcgcgccgctggcgccggagatcgcaaccggcgaggccggcaaggtcacggtctgagcgtttgcgcctaacatgcctgcatggggcgcacattcgacgagctgatcgcggaggccgacagcgtcccggtggaaggctgggatttctcctggcttaacggccgcgccaccgaggagcggccgtcgtggggctaccagcggttgctgagccggcgtttggcgaacgtgtcggcggcgctggacattcacaccggcggcggcgaggtgctggccggggcggcccccttcccgcccaccatggcggccatccagacctggccgcccaacgccgcgctggcgaccgcgcggctgcatccgctcggcgcggtggtggtggcggtgggcgacgagccgccgctgccgttcgccgaccacgccttcgacctggtgaccagccggcacccggtctcggtgtggtggagcgagatcgcgcgggtgctgcggcccggcggcagttacttcgcccagcacatcgggcccgccaccatgggcgagctggtcgagtacttcatcgggccgcagccgcagaagtgggccgagtttcaccccgacgcggtgcgcgcgcaggtggcggcggcgggcctgcgggtggtcgacgtgcgcatggagcggttgcgggccgaattcttcgacatcggcgccgtcgtgtacttcctgcgcaaggtgatctggacggtgccggacttctccgtggcgcgctaccgcgaccggctggccgaactgcacgagcgcatcgagtcgcaaggcctgttcgtcgcgcacccgactcgggtgctcgtcgagtcccgcaaaccggagtgatcagccttcgtcgcgcagcacgtcgagcgcgtgctgcagatccggcgggtaggggctgacgatctccatccgccggccgtcggccgggtgcgcgaacgacagcgaccgcgcgtgcagccattggcgttgcagcccaagctttttcgcgagcttggggtcggcgccgtagaccaggtcgccgcagcacgggtgatgcagcgcggagaagtgcacccggatctggtgggtgcggccggtttccaggtgcacgtcgagcaggctggcggcgacgaaggcctccacggtgtcgtagtgggtgaggctgtgccggccgtccttggtgaccgcgaacttccactcgccgccgcggtgccgcccgatcggggcgtcgatggtgccgctggacgggtccggatgtccttgcaccagcgcgtgatagcgcttgtcgacggtgcgttgtttgaacgcccgcttgagcagggtgtaggcgcgctcggacagcgccaccaccatcaccccggaggtgccgacgtcgaggcggtgcacgatgccctgccgttcgggcacccccgaggtggtgatccggtaaccggcggcggccaggccgccgagcaccgtgggtccggtccagcccaccgacgcgtgcgcggccaccgcggcgggcttgtcgacggcgacgatgtcgtcgtcggagtacaggatggtcatgccctcgatgtcgaccggggtgttctgcggcggcgccggcgcctcgggcaggcgcacgtgcagccacgccccgccggtcagccgatcggatttgccggccggcaccccgtccagttcgacaccgccgtcctcggccagggccgccgccgcgctgcgggacagtcccagcaggcgggccagcccggcgtcgacgcgcatgcccgccagtccctccgggaccggcatcgagcgctcagtcacggctctggtcggcctttttccgtcgaccgacggtgtcgaagtcgtagccgaagatcgacagcacgaccagcaggatggccccgccgaccaccgaggggtcggcgacgttgaacaccggccaccagccgaccgacaggaagtccaccacgtggccgcgcagcggcccgggggcccggaagaagcggtcgaccaggttgcccatcgcgccgcccaggatcatgcccaggcccaccgcccaccagggcgacaccaaccgtcgtcccatccagaagatgccgaccaccacgccggtcgcgatcagggtcagcacccaggtgtagccggtcgccatcgagaaggcggccccggagttgcgaaccagggtccaggtcaccgtgtcgccgatgatcggcaccggctgaccgggcggcaacagcttgacggccagcaccttggtgacgatgtccagggccaggactgtcgcggcgaccgacagcagcagacgcagccgtcgcggcggccggtcgtgcggcgcggtcgatcccgttggttgttcaggcacgctcatatcatcccctaccgcgtccgtagaccggcgacgtgcgggcggcggcgatgcgcgatgattcccccatggcccgcctcaccgtgatcgccaccgggggcaccatatcgaccggcaccggcgccgacggggtgcaccggccctgctacagcggggcggatctgacggcgccgttccgcgccgatcacgacgtcgaggtggtcgacctgctggcggtggacagctccgagctgaccctggccgactgggaccggatgcgcggcgcggtgacgggggcgctggacggcggcggcgccgacggcgtggtgatcctgcacggcaccgacacgatggaggagaccgcgctgtggctcgatctgacctacgacgggccggccccggtggtgttgaccggcgcgatgcgcagcgccgacgcgccggacgcggacggtccgggcaacgtgcgcgacgccctggcggtggccgcgcatccggccgcccgcgggctgggcgtgctgctgtgtttcgccggccgggtgctacagccgctgggcctgtccaaggtggccaccgaggacttgagcggcttcgccggccggctggtgggcacggtcgccggcgatgtcgcgctgaccggcccgaaaacccggccctacctcggtgacctgggtgccgccgcggcgccgcgggtcgacatcgtcgcggcgtatctgggcagcgacgcggtggccctggacgcctgcgtggccgccggggcgcgggccgtggtgctcgaggcgctgggttcgggtaacgccgggccggcggtggtcgacgcggtgcgccggcactgcggcaccggggtggtgatcgcggtgtccacccgggtgcccggcgggcgggtcggcgcgagctacgggcccgggcacgagatggccgccgcgggggcggtgccggtgcccacgctgcggccgccgcaggcccgggtgctgctgatcgccgcgctggcggccgggctaccggccgccgacgtcctcggccggtggggctgacgactcctgcaggccctcgacgtagtccggccagtccagcgaatcgaccgggttggcgcgcaccagctcggcgctgtcggcggggaaggtgcgggcggggcccgggccggaggtgcgggtctcgaaccgggcggtgaccacgccgtgcccggcgccctgcacccagccgtgccccaggtcggggtgggcgacgtcgtcgcccacccgccagcccgcgtcgtgtccgggcccgaacatcgcctcggccgcggtctcgaccgactgcgaatccgattgcggcgcaggcatttccaggtccgggaacagcgactcctgacgcacctcgctcagcccggaaaaccccaccccgagcaggcggatcggcccgatctcgcgcgggtcgagcagcagccgccgggccacgccgactagcgcggcggcctcggtggtcgcgtagggcagggtcgcggagcgggtcagcgtgctcatgtcggacttcttcagcttgaccgtgacggtgcgcgcgccccggccgtcgcgcagcaggcggtgatgggcgtgctcggcgatcggttcgatcgcctcgcgcagctgctcgagggtggtcaggtcggcggcgaaggtcgactcggagctgatctgtttggcttcggcgcgttcggcgacgggccggtcgtcgatgccgcgggccagccggtgcagcgcggggccgatggtggcgcccaggatgttggcggcctcggcgtcggtcagcgcggccagctcgccgatggtctcgatgcccagccgatgcagcttctcctcggcgaccggcccgatcccccacagccggcgcaccggcaacccgccgagcagctcgcgttcctcggcgcggcgcaccacccggaccccgtccggtttggccaggccggaggcgatcttggcgatctgcttgcccgagcccgcgcccaccgaggcgatcagcccggtctgctcacgaacccgtcggcgcaactgttcgcagaacgcctcgacgtcctgagccggcgcgccggcgagttgggccggctcgccgaacccctcgtcgaaggacagttgctcgacgacgggcaccacggcgcggatggtgtcgaagaccctcctgctggccacgccatagaccacgccgcgcggcggcaacaccaccgcggagacgccgaccagcctcttggcctgatgcatgggcatggccgagcgggcgccgaacacgcgcgcctcgtagctggcgccggccaccacgccgcggccacccaaaccacccaccagcaccggacgcccgcgcagcgtcgggcgggtgagctgctcgacggacgcgaagaacgcgtccatgtccaggtgcagcacccatcgggactccacccgatcgatgctattgcccgggcctgctgcggcccgggctgaccgcgagagtgcatctaccgacgctgcctctcgggaaacacgtcgctggttgcactttcgcggctcacagcgggcagcccgccgcgcgcagcgcctcccggatcctgcccactaagacgtccggccgattacgcaacaggtccgcgctcacccggatgatccgccaaccccggcgctccaattctgcgacccggtcgatgtccttggcgcggatgcgcggatcggtccagtgttgggcgccatcgtattcgacgcccacgcgccactgttcccaccccagatcgatgcgagccagcacgaaaccccagtcgttgtgcaccgtgatctgggtgctgggtttgggcaatccggcgccgacgatcgccagcctcgtccgggtctcttgcggcgactcggcccctgcatcgatgagaggcagcacccgtcgcaactgacgcacgcctctggcgccgcggtgggcccgcatgagcggttcgacacactcggtcgtcagccccgtagccctcgccatcgaatcaatcgctatgaccgcagccaccgagccgggtcgccgtcccaggtcgtacgcggtgcgcgcaggcgtcgtcaccggcacaccgcggacttcggtgatctcgtcaggcagcaacgtctcattgcgggcgacgatcaatggcggcggccgcttgcgatcagtgatcagttcggcgggtgcgcgcggatcgacccattgcgcgcccagcaacgcggccgccgagttgccggcgaccaccgcgcgcctgcctgaccacagccaggcagctatcgcccggtcgctggcggtgaagtcggcaccgcgctggtagacgttgcgatagatccgcgtgcacgagcgccgcaggtcgcgctccgtcagcgcgcctgcgctcagcgcctcggtgcccacaaacagctgcccctcgcccatgggcggaggctgccacacagctccgacaaccgacgaaagtgcatctaccgacaccgttactcggtaaatgcgtcgccagttgcactttcgcggctcagactttggaaatgctcacccgcacgccgtcgccgatcgcgacggggtcggccggctccccgaattcgaaacgggtggccaggatttcaccggcgatcaggtcgcggtgggtgcgcgcccactcggcccgcccggcgggcaccgacatcaccacgctgatccggtcggagacgtccagcccggtcgacttgcgcagctcctgcaattcgcggatccggtccttcgcccacccctcggcctctagctccggggtgaccgtgccgtcgaggaccaccaggccggccccattcggcagggccgcggtgaattccgggtcggcggccaccagccgtgagctgtactcctcgggccgcagcacggccgggcctgcggtcagggtgccgtctgcgttgacgacgccctcccccgccttgacggccttgatggccgcctgcacgtccttgcccagccgcggcccggccacccgggcgttgacggtcagctcgaaggtgccgtaggtgtcgatcgcgtcggtcaactcgacgctcttgacgttgagctcgtcggcgatcaggtcgacgaacggcgccaggtgttgcggattctccaccgccacagtcagtttcggcagcggtaggcgcacccgcagcttctttgccttacgcagcgaggaggcggccgagcacacctcgcgaacctggtccatcgccgcgaccaggccggggtcggcgggcagctcgccgctgcgcggccagtcggtcagatgcaccgagcgtccaccggtcaggccgcgccagaccaactcggtgaccgagggcagcagcggcgcggccagccgcgcggtcacctccagcacggtgtgcagcgtgtcgatggcgtcggcgtcctcgctccagaaccgcgaacgcgaccgtcgcacataccaattcgtcagcgcctcggtgaactggcgcagctgctcgcaggcccgcgaaatgtcgcaggcgtccatctcccgggtcaggtcgtcgcgcagttcggctaatttggccaggatgtagcggtccagcacctggggcgaatccgtgcgccaggtaccgattttcggcgcgtagagggccaggaagctgtaggcgttccagaacggcagcagcacctggcgcacgccgtcgcggatgccctgttcggtgacgattagattgcccccgcgcaggatcggcgaggccatcaagaaccagcgcatggcatcggagccgtcgcggtcgaacacctccgacacgtcggggtagttgcgcagcgacttgctcatcttctgtccgtcggagcccagcacgatgccatgggccacacaggttttgaacgccggccggtcgaacagcgcggtggccagcacgtgcagggtgtagaaccagccgcgggtctgcccgatgtattcgacgatgaagtcgccggggtaatgcgtctcgaaccagtcgcggttctcgaacgggtagtggacctgcgcgtacggcatggaccccgagtcgaaccagacgtcgagcacgtcggggatgcggcgcatggtgctgcgaccgctcgggtcgtcggggttgggccgggtcagctcgtcgatgtagggccggtgcaggttgtccggccgcaccccgaagtcgcgctcgagttcgtcgaggctgccgtacacgtcgatccgcgggtaggccgggtcgtcggacttccacaccggaatcggggtgccccagtagcggtttcgtgagatcgaccagtcgcgggcgccggccagccacttgccgaactggccgtccttgacgtgttcgggataccaggtgatctgctggttgagttcgaccatgcggtcccggaatcgggtgaccgccacgaaccaggacgacaccgcccgatagatcagcgggttgcggcagcgccagcagtgcgggtaagggtgctcgtaggtttcgtggcgcagcagcaccggcgcgttggccgcggcggcgccgctgccgttcttcaggtcccagatgatctgcgggttggcgtcgaagacgttgagtccctggtaatccgggacggcggcgtcgaagcgtccgttggagtcgaccggcgtgaccggggcgatgcccgcggcgtcggcgacggccatgtcgtcttcgccgtaggccggcgccaggtgcacgatcccggtaccgtcctcggtggtgacgaactcgccggccagcacccgaaatgcgttggggttgtccatgaaatacgggaacggcggcaggtaccgggtgcccagcagctcggcgccccggtagctgcccaggatctcgggttcggggcccagctcgcgggcgtaggcggccagccgcggctgggccagcacgaaacgacggtcaccggagcgcacctgcacataggtcacctccgggtggacggcgacggccaggttggacggcagcgtccacggcgtcgtcgtccagatcaacaggtgcgcgccgtccagctcgccgcccaccaccttgaacccgaccgtcagcgccgggtcctgccggctcgggtacacgtcgtcgtccatccgcaattcgtggttggacagcggggtttcgtcgcgccagcagtacggcagcacccggtagccctcgtaggccaggcccttgtcccagagctgcttgaacgcccagatcaccgactccatgtagggcaggtcgagcgtcttgtagtcgtggtcgaaatcgacccagcgggcctggcgggtcacataggcccgccactcgtcggtgtagcgcaacaccgattcgcggcaggcgtcgttgaacgcggcgatgcccatgtcgtcgatctgcgatttgtcggtgatgcccaactggcgttccacttccagttcggccggcagcccatgggtgtcccagccgaagcggcgctccaccttgttgccgcgcatggtgcggtagcgcgggacgatgtccttgacgtagccggtgagcaggtggccgtagtgcggcagcccgttggcgaacggcggcccgtcgtagaacacgtattcctcggcgccgtcgcggcgggcgatgctggcccggaaggtgtcgtcgcgggcccagtagtcgagcacctcgagctcgagcgccgggaagtcgggcgcgccgccggccggcttcgggtaagtctggacggaatccgccggctgagcctcgcggtcagcctggaacccgagattgtcggtcacgatgcgcgttgtctcctgtgccacggtgcaaaccggggacgacgacgcgctggctgcgcgagcgccgcggtaccaccccgcttgccgcgctttcgcgtggccactcggttgcggctgtgacgggcctacccgttcggttctactgagccgccccgccgggccggccgttcttccgaaggctccccggtgatggccggatcgacgccagtacgacgattctacgaaaccccgcaaccgcgggtccgctccaaggggctacctggtctcaggggtcgcctgcggccgggaagcccctcggagcggtgtaggttcgctgtccattttcaggcctggacttccagcacacccacccgccacagcgccgcgtacacgtggcgcagcgggatgctcaacaggcgggcggcgccgtcgaccagcgggtcgccgccggcaccgaacggcgcgccgctgccccggcgcgtcttgggcgcgggggccgcgatggtgtcggtgtcgcgcaccacccgcagggtcggggcgggcgccacggcggccacttcgtcgtagaaagctgcggtcatgatcgcctcctggcggagaaattccaacggggactacggggactgacgtgtcccgtcccggggttggttccgatcttcggagaacgcttggccggcaagggttttcgcgttggcgacggctcagccgagcgggtcgcgccggagaccgggtcgggacgaaacacggttcggacttcggtccggactgtcactggaactcatgtgtccctcacctcctcgcggtcccgacgcatgcggggtcgcatgcgatctacgcgcagcatgaggagcagaacccgacgatcgtcggcgatccgcacccctctcgtcagagctttgacgccacacgacgtgtcctggcccgaacgacaatccgagccggaagccacctgggctcaacccttaagccgggaggagctgtcctgacccggggcgtctttcgacgttcggggtcagtggcctgtattcgtgtagacgcctcacctaacgaggtgcttacccgaccgataatgcacgagcgctccgacacggtcaaatcccccgccagcgtgtccgcgattctttacgcgttccgtgggggcgcccacagcattcggtcagctaccggcgctgacctggccgtatggcgatggccgatcagttctcgatcaggccgtcgagccgtccgacggtgtcgatgaactcctcgaccatgtccagcaccaccgagcgggtggggcagatccggtccagcgagcccaccacctgcccgacgaagtaggtggccagctcgcgggccttggcacccggctgggtggcggcggcgttgatccgcagctgcggctcggtgatcagcgcggtctgcagcggcatgcccagcgggtcggggttttccgggcggtcccactcgtcggtccacgcggtgcgcagcatccgggccggcttgcccgtcatcgagcgcgaccgcacggtgtcggaggaggtggcggccaggaacttctccttgaccaccggcaccgtctcggcctcctcggtggtcagccacaccgacccgcaccacacgccctcggcgcccagcgccagggccgccgcgatctggcggccgcgggcgatgccgcccgcggccagcaccggcaccggcgcgacggcgtcgaccacttcgggcaccaggaccatggtcgccacctcaccggtgtgcccgcccgcctcggtgccctgcgcgacgatcaggtccaccccggcggcggcgtgccgttgggcgtgcgcggtggtgccggccagcgcggccaccagcacatcgcggtcgtgcgcgcgttcgacgaggtcgggcgggggcgggccgagcgcggaggcgatgagccggatgtcgtgggcgaaggccacgtcgagcagcggctggtaggtcttgggcgagatgttcagcccgccggcacggatgtccgcggcgggcgcggtcaccccgtagcgggccagcaggtcgtcgacgaacgcgcggtgctcgtcgggcagcagggtgcgggcctggccggcgtcgatgccgccctgctcggcgccgacgtatttgggtggcagcaacaggtcgacgccgtagggcttgccgccggtctgctgctcgatccagttcagttcgttgtccagccgctgcgggctgtgcgcggtggcgcccaggatgccgaatccacccgcattggtcaccgcggccaccacgtcgcggcagtggctgaacgcgcagatcgggaattccaccccgagcaactcggcgaccctggttctcattgcccgacgctaagagctctcgacagagaagtcaatcggttacggccgtgggtgattcggcgtcagctcgcgggctcccggccgtccggaggccagctcgccaccccgtcctccaacggcacctcgaggctctgcaggatcgaggcgaccatccgccacgcgccgatgaccgtgaccagctcaacgagaaccgttgtgtccccgttgaattcgtgctcgcactgcgcccagctggcggcgctgaccgagccgtggcgcaccacgtcgtcggtggcggccagcacggcccgctcggtgggcccaaaccccgggtagttccgccaatctcgcaccccgagcagatcgtcgccgggcacgccgagccgggacgcgacccgccagtgctgcgtccactcgtagtcgcagccggtgagccagccgatgcgcatgatgaccaattcgcgcaaccgggaatccagcgcgccgtgccagagcatggtggcgagcaggtcgttgatggcacgggccagcggcggatggttgagcagcacctggaagatgctgagctcggccatgtagttgggcacggctgcttcgtcggcggcggccttggcttcgtccaggggcagtttgggcaggcgcattgtgggcatcgggtgagcactcctcggtactggcgggaccgtcgcgttctacggtcatggtagccagcgccgggcgcggcgacgacggcccgcgcacctatcaccagagcctttgcggcccaatatctttcagagcaagcccagcaactgcaggtcggtcacgtatttgacgatgaccggggcggtgatgtgcgggatgtcgttgtcggcgccgattttggcttcttgcaccgcagcgcggaaccgctcggtgggccccaggcagccgcgggccgggtcggccggcggcacgtgccgggctttgcgcaacgccagcagctgcagcaccgactggtggcgctgccgttccggcagggcgtgcagcgcggtctccatccggtgcagccactggtcgaagtcgtcgacccgctcgatcaggtagcccgcctcgatcagccagtcgacgtactcgtcgagcccgatgccgtcgtcgtgcgggttcatcacgtggtaggtcgcgaacccgatgccggcgtcccggcccacctgggcgcccagcgtggcgatcgcctcggcgacgaactcgaccggcagcgcgtcgaagtgcgcgcgctgccggttgccgtgcgcgtcgagccggtagaacgagcgcggcgccacgccgctggccaccacgctgaacagcagccgggtgaacatgtccgacaggttgagctggcccgcgtagctggtgtcggccaggatcatgtcgcaacggaacaccgagaccggcagcccgcacaggtcgtgcgcctcgcgcagcaacacctcgccggcccacttgctgttgccgtagccgttgccgtagccgccgtcgatggtgcggatcggcccggcgacccggatgtcggcgtcctcggtgaacgccgacggctcgatctggtcgccgacgttggcggtcgacacgtagctgtacggcttgagtctggtggacagcgccagccggatcagctcggcggtgccggcgacgttggggccgaacagttcctggtagggcagcacgccgttgaccacggccgccgcgtcgacgatcaggtcgacggtgtcggccagccgctgccaggtccgatcgtccaggccgaggttggcgcggcccttgtcgccggcgatgacttcgaggtggtcggcggccagttcgtggaagtaccgcagcagggcgggatcgccgctgtcgaaagtgcgctcgaggcggcgccgcgcgtcgtcgtccgaggcggcccgcaccagacagatgagtttcccgtcggccagttccaggcgttccagccattgcagcaccaggtagcggcccagaaagccggtggcgccggtcagcagcacggtgcgcacctcggcgccggggccgggcagcgcgggtgcggcggacagcgtcgcggcgtcgatgaacttgtccagggtcaggtcgctggcgtacacctcggtggcgtcgcggccgtgcaccgatgcgaagtcggcccgaaggccttgcgccacagcgggatcggcgttcagccgctggctcaggctgcgcaccgagggcgcctcgaagacggcccgcaccggcaggtggatgtccagcgcgttgtagatggccgcgaccagccgcatggccgacagcgagtcgccgcccaggtcgaagaaggattcctgcaccccgacccgccgcggcagccccagcacctgggcgtagagccaggccaggatctcctccaccgcgccggccggggccaggtagtcctcggggccctggtagtcgggggcgggcagggcgccggtgtcgagtttgccgctgggtgtcaacggcagcgcgtccagcaccagcaccgcggcggggaccaggtaggcgggcagccgttcggtcagcgcggtgcggagctgcgccgggtcggcggtcccggtgacgtatgcgaccagccgctcgtcgccgggacggtcctcgcgggcgatcaccgccgcctgctcgacgctgtccaattcggccagggcggactggatttcgccgagttcgatgcggtagccgcgaatcttgacctgttcgtcggcgcggcccaggtattgcagctgcccgtcggcgccccaccgggccaggtccccggtgcggtacatccgctcgccggcgccgccgaacgggcaggccacgaaccgcgacgccgtcagaccgggccggcccagatagccggcggccaccccggcgccggcgatgtacagctcgccggtcacaccggcaggcacaggccgcagccatccatccagcacgaagaatcccaagtgcgccaagggcattccgatcgggctgacgttgccgtcgatgtcgccgtcgacgatctcccggaaggaggcgtgcaccgtcgtctcggtgatgccgtacatgttgatcagccgcgggcgtgcgggatgcccgtccagccagccgcccagccggtgcgggatcagcgcttcgcccccgaagatcaccgtctgcgggttgagccgccgggcggagtcggcgcgctgcagcgcatcgaatgccgacggcgtttggctgagcacgtcgacccgttcctcgatcagcaaggcgcacaggtcttccggggagcgcaccacgtcgtcgggcaccaccagcacgcgcccgccgttcaggagcgcgccgaagatctcccacactgagaagtcgaaggccagcgaatggcactggccccacacctttccgggtgcggcgggcaggccggcggctcccagcgacgcgaacagctgggtggcgttgcggtgggtgaccgcgacgcctttggggacgccggtggtgcccgaggtgtagatgaggtaggcgatattgtccggggcgggcgccggtggtgcggtgacgggttgttcccggatcgacgggtcgtcgacgtcgatgacggtctggtggtaatcctgtagacggcaatggaattcggtgctggtgagcacggccgcgggtgcggcgtcggtgagcatgaactcgatccgggcactgggcaggctggggtcgatgggcaggtaggcggccccggccttgagcacccccaggatggccgcgacggcctcggcggaacgctccagcagcagcgccacgcaatcgcccggccctgcgccgtaacgaataagttggtgcgctaattggtttgcgtgttcctcgagccggcgataggtgaccgagcgaccgttggcggtcagcgccacggcgtgcggggtgcgcgccatctgggcggcgaacatcgcggggatggaggtgggcgggttttgtggtcgggtcagtgctgcgcggttgccgagggcgtcgaggcgggcgtgctcgtcggggtcgagcaggtcgatcgaggacaaccggcggccggggtcggcggtcatggccgccagcacccgccgcaaccgctgggtcaacgcctccaccgtggcggtatcgaacacgtcggtgcggaattcgaccgctcccccgataccggcgggtgagccatcgggtgcccagcgttcggccagcgaccaagccagatccatccgggcggtgcgggtatccaccggcagcggagtcacccgcacctgccccaggctcagctcggtgggctcgatgttctgccaggccaacatcacctgcaccagcggatggtgcgccagactgcgggccgggttgagccgctccaccagcacctcgaacggcacatcctgatgctcataggcagccaggctgcgttgccgcacccgcgccagcagctcgcccaccgtgggatcaccggagacgtccacccgcagcaccagggtgttgacgaaaaaacccaccacgtcatccagcgccgggtcgcgccgcccggcgatcggaaagcccaccgccacatccgaactcgcgctcaccttggccagcagcaccgccaacgcggcctgcaccaccatgaaactggtggcattatgcgcccgcgccaaccgcgatatttgctgctgcaactgcgccggccactccaccgcgacactggcgccgcggaaatcggccaccaccggatacggccgatcggtgggcaattccaaccgctcgggcatgcccgccagggtgtgctcccagtagcgcagctgaccggcgatcaggctgtgcgggtcgtcgaggtcaccgaactgggcgcgctgccacaacgtgtaatcgacatactgcaccggcaacggcacccaatccgggacccgccccgccgaccgactcgcatacgcccgcgccaagtcacgcaccaacggcgtcaacgaccacccgtccgcggcaatatgatgcaccaccgccaccaacaaatgctcctccgcgccacaccgcaaaagcactgcacgcaacggaatttcagcagccaggtcaaaggtatgccgggcggtgtcgcggatggcgtcatccactcgggccggcgaccagccactggcgtcgatgacctgccagccgatgtcggcacggtcgggcggcagcaccacttgggcgggcgtcccgtcggtcgcggcgaacaccgtgcgcaggctctcgtgccgggtcacgacatcatgcagtgcggcgcccagcgcgccgatgtccaccggcccgtgcagccgcagcgcggccaccatgttgtacaccggggacggcccgtgcagctggccgatgaaccacagccgcgactgcgcgaacgacaacggcaccaccgccggccgctcggcggccaccaccgcggcgaaccggtgcccgccttcgccgaggcgcgccgccagttgcgcaatggtgggcgcttcgaacaacactcgcaccgacagccgggcgtcgaggccggcgttgacggcggcgatcacccgcatcgccgacagcgaatcaccgcccaggtcgaagaacgagtcgtcgacaccaaccctgtgcaggccgagcacctgggtgtagatgccggcgatgatctcctcggtgggagtggacggcgcccggtatgccccgcccgcgtattccggcgccggcagggcccgggcgtccagtttcccgttgggagtcaacggcagcgcctcgatcgccagcaccgcggcgggaaccatgtaggccggcaaccgctcggccagccgggcgcggatcgccgccgggtcggcggtgccggtgaggtagccgacgatccgtttctcgccggggcggtcctcgcgggcgatcaccgctacttccccgacgccgtccaattcggccagcgcagaatggatttcgcccagctcgatgcggtggccgcgaatcttgacctgctgatcggcccgggcgacgtagtgcagtcggccgtcgcgatcccagcgcaccagatcgccggtgcggtacatccgcgcaccggcgtcgccgaacgggcaggccacgaaccgcgccgccgtcagaccgggccggcccagatagccggcggccaccccggcgccggcgatatagagctcgccggtcacaccggcaggcacctgccgcagccacgcgtccagcacgaacagcgtcgcacccgctaccggggagccgagtgggggtgctccggcgccggcggccagcggtgtgctgagcaccgcgtcgacggtggtttccgtggggccgtaggcgttgatcatcacccggccgggcgcccaccggtcggcgagcgcggccgggcagggctcgccgccgatcaccaacgccgcgtgcaggtttcgtggtgacagcgccgccagcgccgacggtgtctggctgagcacggtgacgttctcggcgatcagcagcgcgtgcagctcgtcgggtgagctggtcaccgactcgggcaccaccaccagccggccgccgccggccagggcgccccagatctcctggaccgagacgtcgaagccgtaggagtggcactgcgaccacaccccggtgccgggcagcgacgcgtgcagggactcgagcagctgggcgacgttgcggtgggtgaccgcaacgcccttggggacgccggtggtcccggacgtgtagagcagataggcgatgttgtcgggcgcgggcgccggcaacgggccgccgggctgggcgccggtggcggcgacgtcgacgaccggcaggccgaaggcctccagccgggcgcgcaggtcggcggtgctgaccgcgacgacgggtgcggcgtcgccgagcatgaactcgatgcgggtcgccggcagcgccgggtcgatcggcaggtaggccgcgccggttttcagcaccgccagcatcgcgacgatcgcctcggccgaccgggaaaacagcagtgccacaaagcaacccggggtggcgccgtggccggccagcaggtgggccagccgggtcgacgcctcgtcgagttcgcggtaggtcatcgaccggccggcgtagcgcagcgcgacggcgtgcggagcgttggcgacctgtgcggcgaacaactccggcagcgacggcccggttgccggccggctcagcgccggccggttgccccaccgttgcagccgggtgtgctcggtggcgtcgagcaggtccagtgatcgcaacgggcggtccgggtcggcgggcatggcggccagcagcttccgcaaccggtcggccagggtgtcgatggccgccgggtcgaacacgtcggtgtcgaattcgaggcgaaggcccagttcgtcgccgggcaccacttgcagcgacagcgggtagtggttgtagtcgtggcagctgaattcggtggcggtgaggtcgtcggcggccgacagggcggcggtgtcgatcggatagttctcgtagaccagcagggtgtcgaagagttggtcctgtccggtgatgcggtggatttcgttgagcgccaggtgctgatgctccacggtgtggttgtgggcgcgttgcagctggtcgacgaggtccgcgatggtggtcgccgcggtggcgtgggcgcgcaccgggacggtgttgatcaacagcccgaccatcgactcggcgccgggcagctcggccggccggccagagacggcggtgccgaacgcgacgtcgtgctggccggtcagcatcatcagcagctgcgcccaggcggcctgcaacacggtgttgacggtggtgcggcggcggcgtgcgagttcgcttaccgcgctggtggtttcggcggccacccggaacgaggcgaccccgcgccgcccgggcgcgtcggcaccccgcggggccaccagggtgggggtgtcgaaaccgtcgagcaccgcgcgccatgcggcgcgggcggccggcacgtcgcgggccgccagccaggtgacgaagccgcggtacggcgccggcgccggcagccgggcaccgtagtagcaggcgaagatttcctgcagcagcaccggcagcgaccagccgtccatcaccaggtggtggacggtgagcacgaaccggtgttccgtgtccgcggtgcggatcagcgcggcgccaaacggcgggcggtcgccgagctctcgcaccgcggcgcgttcgtccgcggacagctgctcgagctgttcgtcgatgtcgccgccgtcgagttcgaggtagcgccaagccatttcgggttcggccgggatgatctgcaccggctcgccgagctcggggcagaagcgggcggccaggttcgggtggcgggtgacgacggtgtgcagggcgcggtgtagccggtgcgggtcgagggcgccgcgcagcgtgacgctcagctgcaccgcgtagacgtcgccctcggcatggcttccggtcgcgtggaacagcagcccctgctgcagcggggtcagcggcaggatgtcggcgacgtcgtagtgccgttccagctgctcgatccggccttggtcgaggagggtgggcgcgatgtcggacggcgtcagcccgccgccgccggcctgcacgtgcgcgcagatgccggtcagcgcctcgaaccacaaccggctcaaccggtttagctgctcgtcggtgagcacggagcgcgcccaggtccagttggcgtgcaactgcgggccggcgtcggtgtccatggtgccggcgttgagttcgacggtatgtcccaacggcagtgggatcgccgcggccgcggcgctcaccgacggactgtcggggctgaggcgccagtgctcgtcggacaggtcggcggccgcgccgccgagccggcccaggtagttgaatccgatcaccggatccggcccctgcacctcgatctcggggttcaggtagcgcagcaacccgtagctcaggccgtcgggcagcgcccgcaactgctccttggcatccttgatcaccgcgcccagcgcggcctcccccgccaccacccgcgcccaatccagacgctgactgatcgtcagtgccacaggatatttcgtggtgaaccagcccaccgtgcgagacagatccacccccgaggcgatctcctcgtgccgcccgtgaccctccacgtcgataccgatcggcgcgccaccacccacgaactccgtgcaggccaacccgaacgcaatcagcaaaatgtcttgcaccccagcgtgaaacgccgccggcacctcccccaacaacaaccgggtggtctgcacatccagcgacgccgacaactgcccctccgaggcataggtgtcatcgggccccaccgccggcagcaccgccggcgtggccaccacctgctgccacgccgccgccgcagccaccactgccgggctcttggcgtactcggccagaatcgacgaccaccgcgcaaacgacgtgcccggcaccggcaacgcgatctcctgaccgctgtgatgctgcgcccaggcgatgttgatgtcctcgatcaacgtccgccacgacaccccgtcaaccgccaggtggtgaacgaccagggccaattcgttggtggcgcttgcccataccgcggacagcatcaggccggcgccggggttcagccgggaccgcgcccgcgccagcgcggcctcggagagcacgtcgaccgtgcgcaggatggcgcgggcgtcaaccgaaccggggggcggcacgtgcaggtcccagccgccggcgccgtcgtcgtcgaggcacagccgcagcatcgcgtgccggtccagcagtgcctgcagcaccaccgcgacgtcgtcgacaccgaccccggcgggcgcggccagcaccatggtctggttgaactcgtcgatcgggccgtcgatgtcctgcagccagcgcatgatcggggtgggctgcaccggcccgatcccctcgtcggcggcgcccagctcgccgtcgacagccacttgggacacccgcgccagccgggccaccgtctgctcgacgaacacgtcgcgcggccgacagatcacccccgccgcgcgggcgcgggccaccacctgcatggacaggatgctgtcgccgcccaggtcgaagaacgagtcgtccaccccgacccgctccacgcccagcacctgggcgtagatgtcggccaggatctcctcgatcgcgtcgccgggcgcccggtattcgccggcggcgtattccggcgagggcagcgcgcgcttgtccagcttgccgttgccggtcagcggcagcgcgtccagcaccatcaccgcggtcgggaccatgtagggcggcagccggtcggccagctgcgcgcgcagctcggccgggtcggcggtgccggtgatgtagccgaccaggcgcttgtcgccgggccggtcctcgcgggcgaccaccgccgcctgctccaccccgtccaaaccggccagcaccgactgggtttcgccgagctcgatgcggaagccgcggatcttgacctgctcgtcggcgcggcccaggtactgcagctgcccgtcggggccccagcacaccaggtcgccggtgcggtacatccgcgagccgggggcgccgaacgggttgggcacgaaccgcgaggcggtcaggccgggccggcgcacgtagccgtgccccacgccgcggccggccaggtacagctcgcccaccacgccggcgggcaccggctgcagccacttgtcgagcacgaacatcgccgccccggcgatcggcgagccgatcggcaccaccgggtcgccggccgtcagcggtgtgctgatggacgcgcacaccgtggtctcggtcgggccgtaggcgtccagcatcacccgaccgggcgccgcccaccggtcgaccacgtcggtcgggcaggcctcgccggccaccactagcgcggtggactccaggccctcgggtgagagcatcgccaccgccgacggcgtctgggtgagcacgctgacctgctccgcgaccagcagggcgtggaagtcctccggcgacgacgccaccgactcgggcaccaccagcagtcgccggccgcgcagcagggcgccgaagatctcccacaccgagaagtcgaacgccgacgagtggcactgcgtccacacgtttccgggcggcaggccggcgtccagcgactcgatcagccaggtgacgttgagatgaggaatggcaacacctttgggggtcccggtggttcccgaggtgtagatgatgtaggcggtgtcctccggcgccggccacggcagcgcggtgccgggctgggcttcgacggccgggtcgtgcacgtcgacgacgaggaggtcgtgatcgtccagccgcgagcgcaggtcggaggtggtgatcaccgcgctgggggcggcgtcggcgagcacgaagtccatccgcgacgacgcgtgcgccgggtcgatcggcacgtaggccgccccggtcttgagcaccgccagcatcgagacgatggcgtcggcgcagcgggggaacatcaccgccacgcagtcgcccgggcccacgccgtggtcggcgagcagatggcccagccggttggacgcctcgtcgagctgggcgtaggtcagcgaggtcgccccgaacgtcaccgccaccgcgtcgggggtgcgctgcacgtgttcggcgaaggcctgggggatcgacaccggggcgggtgcgggctcggtcagcgccggacggttgctccaccggtcgatcagcgcgggctcgtcgccggtcagcagttcgatcgaggacagcgggcggtccgggtcctcggtcatcgcggccaggatctgctgcagccgaccggccaggtccgcgacgccgaagctggcgaacggttggcccgggcccgcggtgctgaggaacagctggtcgccggcgcccaggaagaacagcccgaagtgccccaccgggccgtggttggtgtacgacgccgtcgccggggaaccggccaggtccagcgtcagccgggacgggatgaagttgatcccgacccggttgggcgcctgccgcaacccgtcgccttcgagggtgtgcaccgggaagcgctggtgcgccagcagctcgcggatgcgcttgtcgacgtgcttgcagaagtcggccaccgtcgactcgggcgcggtgctgagcaccagcggcaccacgccggccagcatcgcgggcagcgttttggactccggacgcacccgtcggctgaccgggaagtccagcgccacctccgatccgctacccgaccagccgcgcaccaacagcgcgcacgcggcggtggtgaccgaaaagcggcggatggcaagctttttggacagctccttgatccggttggcgacggacgggtccagctgcaccgacgcggacggcgagtagtggtcgcgctccccttcggcgtcgggcagccggtcgaccggcccgctctccggcgggaggtgctcgctccagtacgccttgtcctcggcatagtccggggaggcctcgtagcccgactccaggtcgatcaggtcctgcaccgtgccgaagtaagcgtccggaatcggcttaccggccaccattgccgaataaatggtggccacccgtcggcaaacaagagccatgcccagaccgtcgatagctatgtggtggcagcaaccaaacaaatagaattcgtcgtgccctgtttggaaaagcacgaatttgaacatttggccgttcaacggcatcggcgtgcgctgaatggccgaagacatctcccgcgcctcggccaccgggtcggcgtggtcggtcaggtcgtgaaaagccagctcgacgtgcgggtagtcgatcggcttctgcaccacctggccgtcgagctcgaagaacgagacccggccgggttcggcttcggcgacggcctgggtgatggcctgctcgagcgcgtcgcgatggaccttgccgtcgatcttgaccagcagaccgagctgccactgggtgccggcgaaaccggcttcctgggataaccagatatcaagctgccctcgcgtcagcggaaacgcccgatcatccctcgccatcgactcccccaagtctccacccacccgccccgtaccccggcaggttactgatcaaaaccccgacccgttgcgagcttgtcccgcaggctcttcggccgaatgtcgggccagtgctgctcgatgtactccaaacacgcagcgcggtccgcttccccgtgtaccaccctccagccagctggaacatcggcgaaggccggccacaagctgtgttgctcctcgtcgttcaccaggacgaaaaagctgccgttgtcgtcgtcgaatggattgatgctcacaattctccaggatgcatagtggacatgagtggaacaggtccaaaccatagttcagggcaacagtgcccgtcggtggtttggccaaagttcctgctgtgacctgcaaggctgttgtcgccatcgggtgatcggtgtgcggtggggccccgatgcccctttattcgctgcagcgacctgcatcaatggcgttgactgcgaaatttcgctattggagcaggcacgtccttgcggccgatgaagttattgtgcttgtggctcacagcctagccgaagtcgcgggggtcgggaaaatcaccgcgagcccaacgcgcgacgcgtacctggcaggctgctggcaacaagccccgaggcgaaccgggcggtgacacggcgcgggcggctgtgcttaggtaagtgggcggccttgcgaaggacatgtgtacggagcagattcgtcgcttcagcaaaatgccgtttgcgcacgcgataggcattacgatcgcgtatcgcgttgccaaagcagtgatatggacgtcaatggcatggtttactcatcaagatctggtcgcgctcccggggcggggctcgcatgaggtgacggatgcacggctagtctgcgacgggcaccgcatcgcggcaccgcagtctggcgtgtcgcgaccgacgtgcagttggatgttcgggcgacggaaacggcgcgggcgtggatacgggtgaagggggtgcagtggtcgaacccgacgtacgggcccggcccgacaacgcattcacggaaggacaggacgttagccgatcgcctcgccgtcgacgtggcttcctgggctttgctcgtcgatcatcgactcgccccatacagcaaagtcgcccccgcaagggtggccggaacctgggcaccacgtttgtcgggtttttgaagcggctgtggattccactggtcatcgtggcggtggtggttgccggcggtttgaccgtctcgcgactgcacgggattttcggttcggagaagcgcccgtcgtacgccgacaccaggcagcaggacaccaaaccgttcaaccccaagcacgtgaagtacgaggtcttcgggccggccggcgcgatggccgacatcagctatttcgacgccaatggcgaaccgcagcacatcaacggcgtcgagctgccgtggacgttcgatatctcgacgacgttgccgtcgatcgtgggaaatgtggtggcacagggcaatagcgatagtctcggctgccgcattctggtggacggcgttgtcaaaaccgagaggatctcgcacgaattgaacgcattcacctactgcgtgttgacggccacatgagtacccagcaattggagacccagcaggccgcgcgaccacgggtggcgcggatcattcaccgtttgtccgttcccattattttgggctggctggcggttgcggtgctgatcaccatcggcgttccctcgctggagcaggtcgaggccgagcacgcggtgtcgctgagtcccattggggcgccgtcgttcaaggcgatggagcgcctcggcgaggacttcaaggaaaccaacaccggcgcgctggccatgatcctgctggagggccagcagcaactcggcgacgacgcgcacacctactacgaccgcctgattcggctgctggaaaacgaccacaggcacgtccagcacgtgcagaacttctggggcgatccgctcacccgcggcgccgcgcaaagccaggacggcaaggccgcctatgttcaggtgaacctgaacggaaatgcgggcgcggccgccggtgacgaatccgtggcggcaattcggaagctggtccaggaggcttctcccccgccaggtctcaaggtttacgtcaccggtcccgcaccgatcgtcgcggacatgaacatcgcggggcaaaagacggtcatgctggtgacgctggccagcctgatcgtcatcttcgtgacgctgctgctggtgtatcgatcggtcatcaccgtcattctgctgttgctgatcgtcggcctggaattgcagatcgcgcgcggaatggtcgcgctactgggccatctcggggtggtcggtctcaccaccttcgcggtcaacctgctggtggccgccgtcatcgcgaccggcaccgactacggcatcttcttcgtcggccgatatcaggaggcacggcaagcgggcgagagccgggaagaggccttctacaccacgttcaacggggtggccaaggtggtgctggcctccggcttgaccatcgccggtgcggtgctgtgcctgagcttcacccgactcccctacttccagccgctcggtatcccggttgcggtgggcatctcgatcgcggtcctggtcgcgctgacgctcgggccggcgctgctggccgccggggcccggttcggcctgttcgagccgcgccgggcggtctcggcccggaggtggcggcgcatcggcaccgcgatcgtgcgatggccggcgccgattctcatcgccaccctggcggtctcgctggtcgggttgctggcgctgccgaattaccggcccagctatgacgaccagaaattcattccggacagcatcccggcgaacgtggggtttgcggcggcggcgcggcatttccccggccagcggatgcagatgccggagatcctgctggtcgagaccgaccatgatctgcgcaacccgacggacatgttggtgatcaacaaactcgccaagggtgttcttgcggtccccggcatcgccaccgtgcagacggtcacccgccccgagggagttccgttgcaacacacgacgattccctggatcatcagcatgggtcaggccagtcagatgcagaacatggccttccagaaggaccgcatgaacgacatgctcgtgcaggccaacgagctgggcaagatgatcggcatcatgcagcacatgctggacctgatgcgcgagctcgtcgccacgacgcaccacatggtcaagacgacgcacgaaatgcaggacatcacttcggaattgcgggaccggatttcggatttcgaggacttctggcgccccatccgcagctacttctactgggagaagcactgctacgacattccgatctgtttctcgctgcggtccatcttcgacgcgatcgacggtgttgacgagatcaacgacaagctgggcgatctggtgaagaacctcgatcagttggacgcgctgctgccgcagctggtcatgcagatcccgccgatgatcgagaccatgtcgagcatgcgcaccatgatgctgaccatgcacagcaccatgtccggcgtcatgggccaaatggattccagcgcaaaggatcccagcgccatgggtcaggctttcgacgcctcccgcaacgacgactcgttctacctgccgccgggcatcatcaacggctcggactcgttcaagcgggtggaaaaggtgttcatgtcgcccgacggcaaggacgtccgactgctgatctcgcagcgcggcgaccccgccacacccgagggcctgtcccgggtggaacagatcaagaccgcggccgaagaggcgctcaagggaacaccgctggagaattccaagatctatctgaccggcaccgcggcgatcaccaaggatttggtggagggatcgaaattcgacctgttgatcgccggcgtctccgcgctctgcctgatcttcatcatcatgctgatcatgacgcgcagtttcatcgcggccatggtgatcgtcggcaccgtgttgctgtcgctgggcgcgtcgttcgggctgtcggtgctggtgtggcagtacctgctgcacatgcagctgcactggaccgtgctgtccacttcggtgatcgtgctgttggcggtgggttccgactacaacctgctactggtgtcccggatgaaggaggagctggccgccgggatccacaccggcatcatccgcgcgatgggcggcacggggaaggtggtgaccaacgccggtctggtgttcgcgttcaccatgggcgcgatggtggtcagcgacctgcgcagcatcggccaggtgggcacgacgatcggcctgggcctgctgttcgacacgttgatcgtgcgggcgttcatgacgccgtcggtcgccgcgttgctgggccgctggttctggtggccgcagctggtccgtccccgcccggccagcaccatgctgcgcccgaccggtccccgtccgttggtgcgttcactgctcctgaagcagccgcagtaggcggcgccttccacttcaggatggaaacggcaaccgtggtgaacaacgtgagggcagcatgactaccgaacgcgtccggcctcccggggcctttgcgcgggtcatccgtcggctggcggtgttcatcatcctcggctgggtggcactgacgctgttggtgacgttcggcgtgccacggctggagatcgtcggtcagcagcattcggtgccgttggcgccgcaggacgcgccggcggtgcaggccatgcagcgcatgggccgggacttcaaagaatccgattcggacagcttcgccatgctggtgctcgaggggcagcagcagctgggcgatgacgcgcacgcctactacgacaagctggttcgtgaattacgcaacgacacaaagcatgtcgagcacgtgcaggacctgtggggcgatcgcctcacccaggcgggtgcgcaaagcccggacggcaaggccgtctacgtgcagttgaatctggccgggaaccagggcaccacgctgggccaggaatcggtggcggccgtccgtgacgcgatcgcgcggacaccaccgccgcccggactgaacgcctacgtcaccggccccgcggcgctgttctccgatatgcagctcgccggtgaccgctcgatcctgaagatgaccctgatcggcgcgctgatcattttcatcgtgctgctcttcgtctaccgctcggtgaccaccgtcgtgttgctgttgctcacggtgggcatcgaagtcttcgccgcgcggggcgtgatcgccttcgtcgccaacaacaatctgatgccgttgtcgacgtttgccgtcaacctgctggtggccctggcgatggcggccggaaccgactatgccatcttctttttcggccgttatcaagaggcgcgtcaggccggcgaggaccgcgcgacggcgtacttcaccacctatcgcagcgtcgccccggtggtgttgggttcgggcttgaccatcgccggcgcgatgttgtgcctgagcttcacccggatgcccatcttccagaccatgggcctgccgtgctcggtgggcatgctcatctcggtgttcatcgccctgacgctggttccggcggtgctgaccgtcggcggcggcttcggtctcttcgatcccaagcgcgccatcggcttcggccggtggcgccggatcggcacggccatcgtccgctggcccacgcccatcctgacagccaccatcgcggtcgccctggtcggtctggtcaccctgccgggctacaagaccagttacaacaaccggctctacatgcccgacagcgttccggccaacgtcggatacgcggccgccgaccggcatttcacccagtcgcgaatgatgcccgagctcttgatgatcgagtccgatcacgacatgcggaaccccgccgatttcctggtgctgcatcgacttgccaagggagtattcggggttcacgggatttctcgtgtgcagggcatcacccgtcccgaaggcacgccgatccagcacacctcgatcccgttcctgctcagtatgcagcaggccaccatgcatcaagacatccggtacatgaaggctcgcatggacgacatgctcgtgcaggccgacttgatgcgcaagcagatcgagatcatgaggcacatctacgagctgcagaagcggctcaccgacatcacgcacgactcgatcgtcaagaccaaggaaatggccaccgtcctttgggaattgcgggacaagatgtcggacttcgaggacttctggcgtccgctgcgcagctacttctattgggagaagcactgctacgacatcccgatttgctggtcgttgcggaacatctttgaaacgctcgacggcgtcgacacgctcagcgacaagatgacgtatctgctgcaagacctcgatcacatggaccggctgatgccgcagctgctcgagcaatatccaccgatgatcgcgatgtcggaggacatgctcaggatgatgctgaccaaccacagcaccatgtccgggatcatcggccagatggacagcaatagcaaggatgccaccgccatgggcgaggcgttcgatgcgtccaagaatgacgactcgttctatctgcccccggacatcttcgagaacgcggacttcaagaaggcgatgagccagttcctgtcgcccgacggaaaggcggcccgcttcatcatttcgcaccggggcgatccggccacctcggaagccctgaaccggatcgacaagaccagatcggcggccgaggaggcgctcaagaacactcccctggagaacgccaagatctacctcgccggcaccgcgtcgacgttcaaggacttccgggacggatccacctacgacttgttcatcgccggcgtcggtgcgctgtgcctgatcttcatcatcatgctgattctgacccgaagtttcatcgccgcgctggtcatcgtcggcacggtgacgctgtcgctgggcgcctcgttcgggttgtcggtgctgatctggcagtacatcttcggcatccagctgtactggatggtgctgccgatgtcggtcatcgtgttgctggcggtgggatcggactacaacctgctgctggtgtcccggatgaaggaggaaatctccgccgggatcaataccggcatcattcgggcaatgggcggcaccggcaaggtggtgaccaacgccggtttggtgttcgccttcaccatggcttcgatggtggtcagcgacctgcgcatcatcggtcaggtcggtaccaccatcggtctgggtctgatgttcgataccttgatcttgcgctcgttcatgacgcccaccatcgccgcgctgctcggacgctggttctggtggccgcagctggtgcggcggcgaccggccagccagctgcttcggtccgagggaacccggcggtcggtgcgcgtcctgctgcaccagaacgacgacgcggacgccgacacggccgaaatcccggtccccaggccgaccgcctaggtgcttctcgtcgcctcacccggcgttggccgcgaaacggtcgacgcgttcggcgaaaaggattggacgtcaatggttttgccccggacattcggaactcccccgccgcgaacgggtttggcgagcggctcagcaaggggcggtgccctgccccgggtcgctttccacctataccgccgacacggcggtgcgcaccgtgaaatactcctaccgtgagcgcaccggcgatcgaggtcgaaggcctcacaaagaaattcgggggaagcacgctcgcactggccggggtggacttctcggttccggccgggacggtgtgcgggctgctcggccacaacggcgccggcaaaaccaccacgatcaacatcttgtccacgttgatccgcccgacgtcgggccgggccagtgtcgccgggcatgacgtcgtacgccgccccgccgaggtacgtgccagcatcgggatggccggacagttcaccggactggaccccatgctgaccggccgggagaacctggtgctgttcggcaggctgcgcggactcaatcggcggcgggcgaaggcccgcgccgatgaactgctcgaacagttcaacctggtcgacgcggccgatcggcggctgtccacctattccgggggcatgttccgccgcgtcgatttggccagcgccctggtggtgccgcccaaggtgctcttcctcgacgagccgaccaccgggctggacccgcgcagccgccgcgacgtgtgggcgctggtgagttcgctgcgggtgcagggcattaccgtgctgctgaccacccagtacctggaagaggccgacgtgctgagcgactcgatcgtcgtcatcgatcacgggcgggtgatcgccagcggcacgtccgaggaactcaagcgggcggtggggaccagctactgccaggtgaccccggccaaccccgccgacctgccccaggtagtggccacgctgaccggccttgacggggttgatatcgacaacgacaccggttcggtatcggtgttcgccccggacggcgtggcgaccctggtcgaggtattccgccgcgtggacgcgctggggctcgagctcgccgacatctcgctgcgcaagccctcgctggacgaggcgttcctgcacctgaccgaacggaccgtcgcgcgaccatgagcgttttggccgcactgaccgaacgctcgctgaagtccgcggcacgcgacggcgagatgatcttcgagatagtctcgcccgcagcgtatttggcaggcttcaccgtggcgttgcatgggctgattgacaccggccggatcagctattcgcagtacctgctgcccgcggtggtggttcagtcgatgatcgtcgtaggactgctcacggcggatcgtgcggcacgcgaccatcttttcgggttcggggagcgaatgcgaacgctgcccatcgccgcggccgccacggtgaccgcacgcgttgcggcaaccttgatgcgggcgctgctgtccctggttgtcgcgatggttgccggttacgcctttggtttccgcataacgggcggactgggctacgcgatggcgtttctcttcatagcgctgttgttgtgcttggccgtgacgctgggtgccgatgcagtgggatctcgcgccaagagcgtccagggggccagccatttgctctttgtcccccagctactgctgttcatgctgtccaccggacttgccccggaacagacattcccggcctggctgcaaccgtttgtccgcaaccaaccggtgtcgcaattcgccgagacactgcgcggcttagctgccggacgtgtggtgctcagcaatgcgacggccgccctggcctggtgtgcaggcatggtgctggtcttcggcgcaatcacgctgcggatgcaaaggcgcggctagtggcacatcgcctacagccacaaggttccctgttgacccagagcttggtgcaggcggggcgactcctgctgcgatggaggcgtgaccaggcagtcctcatgggctcgctgttgcttcccatctttcttctttttgcctaccaaattgtgctgggcgagcgggtgcaccaggtcaccggcatcggaagcgtttacggcatagcacccatgtgcgcagtgatatccgctctgttcggttcgctcggcaactcagtcgggatcaccatagaccgtgaatcccgcgtgctcagtcggatgtgggtgctgcccatacaccgggccagcgcggttaccgggtgggtgatcgctgaagtggtgcgcgcactcattggcaccatcctgatcacagccatcgcgctggccatggggctacgcttcacgaacggctgggccgctgcactgcttttccttctgatcccgtcgatcaccgtaactgggttcacggcgctggtaatggcgatggcggtccgaaagaagggccgaacggcgatgacctggctgttgagcgccaccttcgcgctggcgttcgtcaatcctggtgccacgcccatcaagctgttcccggattgggcacgaccattgatccgcatgcaaccaatatcgccacccatcgaggcgatgcggtccctcgcccacggaggcccgatcttgtggcccttggccataacttttgcgtgggcggtcgtgctgatcgccgtgtttatccccatagccgtgcgcggctatcgattggccgctgaagccaccgcttaagtcggcccgccagttcccggccagcgcagtgcggacgccacaacatagtgacgttccgaacgtgcagcttccgaaccgcacgagcacccagaaacaccatcgctttccggtcagggctcgcaaccgtcttggctggcaacagtagtggatggggtcccgcgttgagtggtgaatcgcttgaccaccgaccggctctcagccggaacacaacgccttacaaagccggtcttgggctcggcgcgggaggatcttcggctttctcgccaataaagcgggcccgccttccgggaatgtcatttgagcggccgactgatccaccatcttccatattggctagcgcaattgaactgtttttccgccggagacgactcttccaggacaacgcaggtttctcgaccaagaaccaactgagcgcggcgagcggcaaaatagctgcgacagaaatcgcgcagaaagcgattggatttatctcggcgaatccacacaggaccagcacttgctgaattggaaacgcataaatatatactccataggatagatcggtgcggaacctcatcctttgattgtggatgagcgaacccgaagcgatgattaggtacgccatcggaagggccgccaccaaccggtagttcggcagcacggcagaggaaaccacaacgataatgaggccgacggcaacgaaggaccaccgagccggaatcacgttacggaattgatacagcaacgctccggccgaaaacatcacagcgaatcgcgcagcattggaggcgatcgcgtgtattccgccccatgccggcaagaacaccgaccacgacagcgccaggatcaatatccctggaacgaaccaacggcgactaagaagtccgagcataccaaatactgctacgccgatatagcaaagcacctcccaacccaatgtccacagagaaccgttccaaatacccgcaactggaatatcgcgaggtgtgccaccgatatcgaacttaaacatccaaaccgcactgtcttttagcacatactcgatcggagcgccggacatcagtagtttcgcggccgaaccgccctgggcgcccacacctatcggagcgatgacaaacgccgtcaagatgagacagatccacagacccgggagaatacgaagacatcgagcggtgaagtattgggcgggatgcgggttgcgaagccagctcgagacgatgagatagccggagaccgcaaagaaaccatcaacgcatccaaggccaagcaactggacgaacggcgcccacggcatacgtccagtgagcggaaacgaatgccataggatcaccccgctcgccaacaccaagcgccacgcattaagtgcattcgcgcgcgggtcgaaaacctgtcccaggctcataggccgttctccccttcgcatgttgctcaagcttcgaatccctttgcatccgctttcagccgcgagctggaggcgcttgtgcacgcactccagtagtcttgcggtgtcttgctcaaccgcgactgaaacctttcgcgacgccgagttgcactcattggcttcagtcacgtgacacgctacctctaggggcgggcgcgaacgtcaagaacgcgaaccagagtgctcgacgctttccaagcactggcacgagaacagtgatgcgatatgcgaccactctctgcgcgccgcgtcacgcggaacggggttgaaaggtggatcaggacgcaaacgcgttaaagaagtccaatgtggatccgcgactacggttctgcgcttcgttctttggagacggccttaacccttatcaaccgcgtacgcaaggccagacggcgattctccttgtctttcaaaaacgccagcatgcgcctgcaagtctcccaccctgcaacccagaagtacattggcagccgttttctgaactctttatcagtcccctgcctcatgctgaagccggtcatgtcgttgtattcggaaatcacgacgtccatgtagcgggtaatcagcgccgggttggagaagcagcgaatattgaagtcccagtccgcccagactcggtagcgcaggttgtaagggccgatgccgtcgaaaagctcacggcggtaaaagatcgattggtggcacaaattcgtctcaaataggaggcggtcgaggtcgaaaggtccggcatgccggcttttcgtcgaacgcatcacaacatcgccatagacaagatggcttgccgcatggtcgccgagaaaagcggctacctgggccaacgtggttggttcgtagagggtgtcgtcggcgcctaaaaaaagtacccattcgcctgtggctacgccgacgccgcggttcatggcgtcgtaggggccatcatcgggcccgctgtgaacgaccagtcgcgagccgagttccgggcggaaactgttcgcgatgtcgagggtccgatcggtcgaaccgccgtcgacaaggaccacttccacttcccggtaggtctgcccgacgatgcttccgaggcaggcttgcagcgtcaccgctgcattgaaggtagggataattatcgagaacactggcgcagtcatgacgtgtgtaacgctagcagccggccacctgttcgtgccgcacgtcgcggccgcctcaatttagatagtcgattaggtgcccgggaggccggctcaccagatcgcccgtttggataccggcagggtgccgacgcaagcatttatgtcaatcgtccccacggaagaaaatgccgtcagcttgaagcattcgaccattgcgcggatccgtaaatccgggcaacaaacccgtcagtctgaaacctagggaatagacaagttcaagcgcttcatgaatcagcatgtcaccttcgtacaacggaataaaagaaagttcgagttgcatgccgacgcagctttcgttaagcgttgacttactgcccgcgataacctgcttctcgaaaccctgtacgtcgatcttcaggaaagtaacatcggtagggttcagaaattctgatgcaaccgaatcaaggcggtgtattgcaacgtcttcggtgccaatataattcgcgggaggaaaggcatcttgatgacttttaagcatcggcagcacggaactacttgcccccgcattgcctgccacattgatggtaatcgtctcatcggcgtcgcctagggcatactggtgacactcccatagtggatccgatgccgacttgcgcgttagttgcgcaaatggccccgaaagaggttcaaaggaaacgatacggctcttgaatcctgcacgacgcaaagcgctaccgaactggccggagttagcaccgacatcaataacaacgttgactccgtatgctttgaattggtttactaataggcgctttcgttcgaagtggcgcagcatctcggtgctaacgttacgagccatcaagccggcgttgcgcaaaaaatccatcgagcgatattagcatgcgaaattgggaaacgagtcggttcgagcttgcgtggtcgtgccacaccggaccatgaggagacctgaacgggatgctgccgcaagcctgcgagctggcgcgaaagcggtcaactgataatgcgtaggggcgagccaagccaggctatgggatactcccataggccatgcgcctcgccggccaggcgactgccgtaccactcgatggcaggtcgccctacccgtccggccggagggataacatcggccggcccgcagctttacctcctcacggcatcggcatttgtgcggtaccacgacaccgttgcatcgatgccctctttcagtgcgattcgcgggcgccaacccaactcgcgtagcgcggagacgtccaatagtttgcgcggggttccatcgggtttagttggatcccaacgtgtttcgccgatgtagcccaccgccgtagcgaccatgtctgcgatctcgctaatgctgtgatcgacgccggtgcccacgttgacgtggttcggaccatcgaaatgttccaaaaggaacaggcatgcgctcgccagatcgtcgacatgcagaagttcgcgccgcggagtaccggtcccccaattcgtcacctcttctgcaccaccagctttggcttcctcatatcgacggatgagcgccggcaagagatgcgacccggacggggagaagttgtcgccgggtccgtagaggttagtcggcatcgcagagatccacgccagcccatattggcgcctaaccgcctgaacttgcaggataccggcgatcttggcgatcgcatacgcgtcgttggtgggctccaaagggccagtcaataaagcactctcgtggataggttgcggagcgtacttcgggtagatgcatgacgaaccgaggaaaaggagccgcggcacacgcacggcgacagctgcgtcgagcaaattggtctggattcggaggttttcggacaagaagtccgcgggataggtgttattcgccatgatgccgccgacccgtgcggccgcatcgatgatcacctgtggtcttgtctcagacacaaaatcaaacgttgcggctcggtccgtcagatcaatctcatcgcgtgatcgcacaatgagattggtgaacccctcggcctcaaatctacgtacgagcgctgagccgaccagcccccgatgaccggcgatatacacgggcgttgcgcggtccagaggcccaggtgtagtcgtcaacttactctgccccaaccaggcaacatcggcgtgtcgatccatggtgtgccatcgcactccaacgcggcgatgtccgcgtccaccatgatgcgcgcgagttcaccagtatgaaccgaagctttccagccgagtgactgggccgccctgtcggcatctcctactagcgaatcgacctcggtggggcgcaaatagcggtcgtcaaacttgacgtgcttttgccagtcgagcccgacgtggtcaaaagcagcttgagcgaactcacgtacggtgtaaccacgccctgtcgccaggacgtagtcatcaggttcaggcgcttgcaacatcctccacatcccctcgacatattcgggcgcgtagccccagtcgcggatcgcatcgaggttgcccatatagacctccgattggacgccagctcggatgcgcgccacggcacgcgtgatctttcgggtcacgaaagtctcgccgcgccggggggactcatggttgaacaagatgccattcactgcgaataatccgtacgcctctcgatagttgcgagtcgtccagtacgagaagaccttggccgcgccgtatggcgaacggggatagaacggcgtcgattcgttctgcggtggcggagatgcgccgaacatctccgacgaggaagcctgatagaaccggcagtccacccgagaaaggcggactgcttccagaagtcggatcgatcccatgccggtggtgtctccggtatgcactggctcgtcaaagctgacgcgcacatgggactgcgctgcgaggttgtagacctcatccgggtcgatactgctgagcagggtcaccaaccgggtgccgtcagtgaggtctgcatagtgcaagaacaagcgcgcgcccggttggtgtgggtcaacgtagaggtgatcgatccgcgacgtgttaaacgtcgaagctcgacgaacgagcccgtgaacctcgtatcccttgctcagtagtagctcggcgaggtaggaaccatcctgccccgtgatccctgttataagcgctcgcttcaccgggttctcacttttgtcactccggcgttgactccgcccagccgatatttcgtcatcatggcggtctcactctcgttgtggtgcaagggatccgaatcgtcaggcactcggtgccgggatcggtggcgctttccacctggccattcaggtcgcagtgatcgcgctgcgcgcctcggcgctgctcaggtcaggcagtagaagttggtttcgatgaattttgcttccgcgaagctctggcgaacttcgctcgcaagaactttaccgcgttgaacgcggccaggtcggcccgaatcaagtactccttcacacgcaagtaagcccacgacactctgcgcccacccagcgggtagtcgccatgcaggtcccagagccgccgcagggtccgatagtgctcacggatgggctgggttgaaccaggtcccgtgacatcgaagtcgcaaaccacgcggtcgatcgtgacggaaggccgtattagtgcggcacggtagatgaacagctggtccgcctcgagtccaaaatcaagatcgtaaccgcccaacttggctaccagcgacgcgccgaagaatgtcgcctgatgcgcaaccgtcgcgccgagcagaaatttccgcatcttaaacggcatatagccgtacggccgagggaaaagtggtttgccgtcgagtccgacaaggttgttcttcccgtaaccccacaaatcacgtactggtccatgccccgagagcgcctccaccacggaagcgactgcatctggatcggagaaacgatccgtggagtgcataaaccatggcgaatcgagcacatcgtcatcgacggtcggaacacccggcgaacgacgctgttggtccgggcctgaaaatccgtgaaggcggtgcgaaagtcgcgctcactcgcccggtacgactcgaaaacccgatccagcgtggccgtgtccagcgggtcgtcgtgcgcggcgccgcgcagcgccgcatagaccgccgacatccagtccgcgccgaacaggtccgttaccggcccgcagtgtcgctggcgtcgcagatccgcggtgaggaactcctcgatggcgccctcttctgcggtgtccagctcgatctccagcgcgccggcgatccgcttcatctcccggtgccagtcgtcgagcaggttcgcgtagtccacgaacacccgctgcaccccgcgggtgtgccgctcggccagcaggttgtatttgagccacagcgcactcgagagctccggcgaggtcgacacgtatttggccgccgacgcgatcacctcctgcgggtggcgcacggcgataactgccgccacgtcgaacccgactcggcgcgccgcctcgaaccacaggccgggcagggccgtgatccgcggttccttgaccaccaccagcggcgccgccggcagcgtggatagatacgccgtgatctccgcgatgcacgcggcgcgctcggcggcgccgaaggcggcctcctgctgcagccgcagcgtggggtcgtaccagttgctgtcgtggcggcgcaggatcgcttcgttgagcatgatggccgcgcgcggctcccaatagccgcgcggattgttgccgtcggcgccgcacatcccggccggaagcgtgctgccgcacagcgacagcacgcgggtcagtgccgaggtccccgaccgcgccatgcccagcacgaacaacgcgacgggacgaacgtcgcccgggaggcgggtggggtgccgcgggaggtcggggccgtcggcgggttgactcgtccgggcagctctcatcggggacccacaccctttcagttgcgcatctgacggcccccgggttcccggccattatccatgacattgcgagttctcgcgcggtgttgaattaccggtctccggcaacgcgcaatgggcggatcggaaagcgtcaatccgggcttttccaagctctctggctaaaggtgacagtgagggttttgctattgcgcaaaagccgcggctatgactttcctatgagcctggtgtggaaatgcgtgagccaccggagaccacggcgccccacccgcgcgctcggcgcttgatgcgagatttgagcgacagggcgcgcttttccaccagaaaccagctcagtgcggccagcggaagggtgacgacgacggcgacgacggcgaacacgacgggaggcaagaagctgagcccgcagatggccagcagctgctgcatgggccacgcgtagatgtagacgccgtaggacaggtcggtgcgcaacctcaaccgctcgtggtggatcagcgctccggagacgacgacggcgtaggccagcggaatcgcggccagcacccggtaattgggcaccagcaggccggccgccaaaacgatcaccgcgctgagcgccaccagtgaccagcgggcggggatcttgtcctggaactgatgcagcagtgttcccgccgcgaacaccagggcgaaccgcccgatcatctggaagacggtctgcacctcgaccgggtaggccaccagtgccgagaagaccagcagaaggatgaataccaccaccgccggccaccggcgtttgagcagtccggccaccccggcgacggcaatggcgacatagcagaagatttcgaagatcagggtccacagcacgccgtcccacacgcccgggaacggcacgtggcgcggcgttccgtcgatgccggcgtaaaagacgtgcaggaccgcgttgtggagcacgtactcgatgggcgcgcgcgacatcagcagcttcgcggccgagcctccttggatcgccaccgcgatcggggcgatgacgaacgcgatcaccaccaggcagacccacaacccgggcagaatgcgcagcgcccgcgccgcgacatattcgcgcagccgcggattgcgcacccagctcgccgcgatgaggaatcccgagatcgcgaagaacccgtccacccagacttgggtgaacagttggtcatacggtgggtgcaccttccggccggtcagcggccaggagtgttgcaggatgacgccggaggccagcgtcaatcgccacacgttcagcgcgttgatccgggtgtcgaaaacctgggcgagtgtcggccccgggacccgtcgccgggcaggcccccgcgcagcgatggtagtgggatcggaaacgttcgggtcggcgctcaccggtgcgattcccgcaccgtcgcccggccgcaccgagtttgaccggcccggtattctccggcgacaccgcgggaatgcgcgggaatggtcggagcaaacacccggacagagtacattgcgtgcgaactactgcgcagcggcgttcctgcgaaagggattgccgatttaagcgccgtgttcaataccggccattcccgtgacggcgcctcagccggcgacggctcccggctcgcgaaacggcgcgccgaattcggtgaccggccggaacccgtgcttgcgcacctgctcggccgcccggcggatcaacgcgtagatcccgacgaacgccgcatggtccgtcatcaccagcggcgtcagcagccggttgtgcaccagcgagaaggccaccccggaggccgggtcggcccacccgagcgaaccgcccatgcccacgtggccgaacccgggcatcacgccgccgatcggcacactgtgatagcccagatgaaaagccaacggcacgtacaggtttcggtccggccgcaggctccgctcacccgtcaggcccgccaccaggtcgcgggagaggaaccggatgccgtcgacctcgccgccgttggcgatggcgccgtacatccgcgccagacctcgggccgtcgccaccccgttggccgccgggatctcggcgtccagcagcggggtgtcgccctgcacggcggcgatcatgcccgggaagtacaacgcccggaatccgccggaaagctggttggcgaccttgcgggacacgtagttgacgatcgagctgcccaccaggttctgcggcgcgacgatctcggcgacccgcgtcggcgcccccgccggcgggcggcccaggtacaggccgtcggtgcccagcggctcggcgagctcctcccggatcagcgtgcgcatccccttaccggtgacggcccggcccaggcccgacatcagccagccgaacgtcagcgcgtggtaggccgatttgcccagcagccgtccgggcgccgccgcggccagccgctcctccatcacgaggtgatcgagcagctcctccttggtggcgccgcgcagcccggacaggccggcctggtggcgcatcacctggcgcaccgtcatgttggccttgccgttggccgcgaacgcgggccagtactcggcgaccggggcctcgtagtcgatcagcccgcgatcgaccagccggtggatgaccgtggcggccattcccttggtggccgagaacaccatcggcgcggtgttctccgaccacggccgctgaccggcccgatcggcccaccccgtccagacgtccaccacgggctggccgtcgacatagacggccagcgccccaccgccgaaccggcgggccgggaacatgctggcgaaactgcgaacgacgcaaccgaagtgtgagtccgccgcgccggacacacggtgacctgcgtcaaggtcatcgtggacacggaccgcgcggcgatcgactcgggcatccaccgtcacacttccgaatctacttggattacacacccggcaggagcgaaatccggattatttacctatccgttagcgcgacgcggccgccaggatttcctgggcagccagcgccggggtgagctcccccgccttgacgcgtcgctcgacgtcggcgcgcatcgtgcggaccgccgggttggacagcagccggtccagcaccgtgtcgcgcaccatctgccaggtccagtccaccaattgcgaccggcgccgcgcctcgaactcgccggccttgctgagcacctgacggtgccgttcgatggtctcccacagttccggcagaccggtgccctgcgccgcgctcatcgtgagaaccggtgggcgccaaagggtttcgcgagggtggatcagccggatcgcgccggacagttcacgcgcggcggaccgcgcctcggccaggtgctcgccgtcggccttgttcaccacgacgatgtcggccagctccagcacgcccttcttgatgccctgcagctgatcgccgccgcgggccagggtcagcagcacgaacgtgtcgaccatgttggccaccgtcacctcggactggccgacgccgacggtctcgatcaggatgacgtcgaaacccgtggcctcgagcaggaccaccgtttcgcgggtggccttggccacgccgcccagcgtgcccgacgtcggcgatggccggatgtaggcgtccggatgattggccagccgggccatccgggtcttgtcgcccaggatggagccaccggtgcgggtcgacgacgggtcgacggccagcaccgccaccttgtggccgagcccgatcaggtgcatgccgagcgcctcgatgctggtggacttgcccaccccggggatgccggtgatgccgactcgatgcgcgtcgccggcatccggcgtcagctccaacaacagctgctgggcctgctcctgatggtcggcgcgggtggactccaacagcgtgatggcgcgcggcagcgccgcgcggtcaccgctgcggatcgccgcggcgagctcggtcaccgtccgcccgctcatgggaccgccgcctgtaacgccatgacgaaaatcggtgccattcttcgccgtagcgttacgagagcggcaggaatcgcggccatcagccgaggtcgtacccgagccgctcggccagcttgtgcagcaaaccgattgcggcgtcggcgattaccgtcccgggcgggaagatggcggcggccccggcggcgtacagctcgtcgaagtcgccgggcgggatgaccccgccgaccacgatcatgatgtcgggccgccccacctctttgagcgcgtcgcgcagcgccggcaccagggtcaggtggccggcggccagcgaggacactccgaccacgtgcacgtcgttgtcggcggcctggcgggccacctcctcgggggtggagaacagcgagccgacgtcgacgtcgaagccgatgtcggcgaaggccgtcgcgatcaccttctggccgcggtcgtggccgtcctggcccatcttggccaccaggatccggggccggcggccgtcggcctcggcgaacttctcgaccagttccgtagcggtggcgatgttggtggcctttccggcttcgtcacggtagacgccggcgatggtgcggatctccgcctgatggcgcccgtataccttttccagcgcgtcggagatctccccgaccgtggccttggcccgggcggcgttgatcgccagcgccagcagattattacccagcccgtcctcaccggcgcggccctgtgccgccgccgcgcgggacagctcggccagcgcggcgtcgacggccgactggtcgcggctgtcccgcagttccttgagcttggccagctgctcggcgcgcacccggctgttctccaccttgaggacctcgacctcctggtcctcctcgacctggtacttgttcaccccgatcaccggctggatgcccgagtcgatgcgggcctgggtgcgcgcggccgcctcctcgatgcgcagcttggggatgccgtcgctgatggcctgggccatgccgccgtgctcggccacctcggcgatgtgcgcgcgggccttgcgggccaggtggtgggtcagccattccacgtagtaggacccgccccacgggtcgatgggccgggtggtgcccgactcctgctgcaacaccagctgggtgttgcgggcgatgcgggccgagaagtcggtgggcagcgccagcgcctcgtcgagcgcgttggtgtgcagcgactgggtgtgtccctgggtggcggccatcgcctcgatgcaggtgcgggcgacgttgttgaacgcgtcctgcgcggtcagcgaccagcccgaggtctgcgaatgtgtgcgcagcgacagcgatttggggttcttcgggttgaactgggagaccagctcgctccacagcagccggcccgcccgcagcttggcgacctccatgaagaagttcatcccgatgccccagaagaaggacagccgcggcgcgaacttgtcgatgtccagctcggcgtccaggccggccttgatgtagtccaccccgtcggccagcgtgtaagccagctccaaatcggctgtggccccggcttcttggatgtggtagccggaaatcgagatggagttgaacttgggcatcttcgcgctggtgtaggcgaagatgtcggagatgatccgcatcgacggcttgggcggatagatgtaggtgttgcgcaccatgaactctttgaggatgtcgttctggatggtgccggccagcttctccggcggtaccccctgctcctcggcggccaccacgtacaacgccaggatgggcagcaccgcgccgttcatggtcatcgacacgctcaccgtcgacaggtcgatgccgtcgaacagctgccgcatgtcgagaatggaatcgattgccacaccggccattccgacatcgccctgcacgcgcggatgatcagagtcatagccgcggtgggtggccaggtcgaaggccaccgacaggcccttctgcccggccgccaggttgcgccggtagaaggcgttggactccgcggcggtggagaacccggcgtactgccgaatggtccacggctggttgacgtacatcgtcgggtaggggccgcgcacgaacggcggctcgccggggaaggtgtgcagcgggtacccgtcggcctcgacggcggcccggtcggcgccgatgtaaaccggtttgacggcgatgtcttccggtgtgtgccagtgcagttggtcgggcgtgtacaggtgcgcggccgcgatcgccgcgacgtgttcctcgacggcagcctcggtggccggcgcgacgggccgctcgctgcgcagtggcacgtcggcgaagctgccgacagcaggtgcagtggtcgtcatggtaactacgcccccagccttgtgagcagatccgacagtgcttcgaccgcattgattttcgcggtcaggaattggtccggccggtgctcggcgtccgccacggctttctccggcccggccagatagacccgggagacgccggcgccgcgcgctgcctgcacgacgcccgacgcctcgtcctggtagcgcttgtcggtgccgcagatgaccgccaccgccggcgatcccgcttctttgacagccttagcgatgccggcggcgtcgacggttcctgggttgaccgcctcgatgcccccggaagccaacaggttcgacgcgaacgtcgcgcgaatgttgttctcggccaacggccccagcggcagcaacaacacctgcgggcgcgagccggtgcgggccaggtaggcgtcggagcggtcgcgcagggcctcgaagtcggtggcgtaccggatcagcttgcccgccgcgagcggcgaatacgacgaatcgctgtgcggcagcgccggttcggcgaggttggggaattcgttgacgccggtgatcgcggtccgccgatgcgcaatgtcgtcgcggcggcggccggcgatctcggcgatctggccggcgatgaaatcgcgggcctcggcgaatcccccgcgcgcctcgatggcctggaagtgctgccaggcctgctcggccagccgctgggtgaggtcctccacgaaccaggatcccgcggccgggtccagcacccggcccacgtgcgactcctcgagcagcagcagctgggtgttgcgggcgatgcggcgggcgaaactcgttgcggtgcccgggaatccgccgtcgatggccacgtcgaacgggaacaccagcagcgagtcggcgccgccgactccggccccgaacgcggccagcgtgcagcgcagcatgttcacccagggatcccgctgagtcatcatcggcagcgacgtctcggcgtgcaccacggccgcaccggcgtccggctcgccgaccacctcggccacccgcgcccacaccgtgcgcgccgcgcggaacttggcgatggtcatgaactggtcgtcatcggcggcgaaccggaagctgatctggcgcaacgccgcagcgatcgtcaaccccgattcggtgagcacccgcaggtaattgaccccggccgcgatcgaggcgcccagctcccatgacgcgttggcgcccaggttgtggaaggcgggcccgtcgacggtgatcgcgcggaccccggtgtgaccggcggcccgcttggcgacggcgaccacgtccttgagccccggggcggggcgcccgctcagccccgcggtcagcgggtcgccggccaggtcgatcgacaccgtggcgcgctggtcgggttcgatctcgttggccaggcccagcaccgcgtcgctggcccccgggtagtcggcgccggcctccaggatcagcggcgccatgctcaggtagacgccctgcaggctgtccgccacctggtcgggcgccacgcccgactcgccgatccgcagcagcacggcgccggcgccgttgcccagcgcctcgagcaccgcggagttgatgtccttggccgcgacgccgggcaccggggtggccgggaacgcctcggcgaccttccagccggacctgacgtcgcgcagcgcgtcgccgccgcgcacgaacggccactcgcccggcagcggcggttcgggcagctcgtcgagcgcggtgtagagcgcgcggatcgcgatcccgtcgtaggtcggggtttccaacagccgctccggcgcgtcccccaactgctcggggtccttccgggtgcttttggccagcactccggcaaccgcactgcgccaacgcccgcgaacctgttccaggtcggcgagttcgggtacatcaatggacaccgattgctcccttttcccagcatttgggcaacagctttggggataccacttgactaccgaggctaattgatcggggctccgcgctgaaaaccgccggccggcccgcgcggtccggattcggagggaaacgccagccgcgggaaacgctggattcacctgcgccccgtaatcttggaaggcgtgacgggttccgccaccagcaaaatcgccgaaacactgcgcgatctcggctgcgcgatcggcgcggccgcgcgcggtgtgtcccggtcgcggatcgcctggacagtggcgggcatcacagcgctggtggtgctggcgtcgctgatcccgctgccctcgccggtgcagatgcgcgactgggcgcagtccgtcgggccgtggttcccgctggcgtttctgctcgcgcacatcgtggtgacggtggtgcccgtgccgcgcaccgcgttcaccctggcggccgggctgctgttcggcccgctgctgggggtggccatcgcggtggccgccagcaccgcgagcgcgatgatcgcgatgctgctggtgcgcgcggccggctggcggttgacccggctggtgcggcaccggtcgatggacacggtggaagagcggctgcggcagcggggctggctggcgatcgtgtcgctgcggctgatcccggcggtcccgttctcggcgctgaactacgccgcgggtgcgtcgagtgtgcgggtgctgccctatgggctggccaccctggccgggttgctgcccggcaccgccgcggtggtgatcctcggcgacgcgctggccggtcacccctcgtcgctgctgtacctggtgtcggcgctcaccagcgcgctcgggctgaccgggctggtcatcgagatccgccacttccgccggcaccaccgccgcgcacaccggcaccgcgacgacgagccctcccccgagccggccaccatcggctgacaccgaatttcgctgagcgacttcgctgagagcgccgcgcgatgcggcaaagatcgatctaatggtgagcgtggacgcgctggagctcgccagctgggggacgccatactcacccgctcgtaccgttgcgctgccgctcggcgcgctggtgctcgcggtgctggccgtgttgggttttctgcccggccgcgccgaacggcggcgcaagccggcgacgggcgctttccccgccaccgatgtgctgccgccgcgtccgcgcacccacaccaccttgctcaccctggcggcggtgtgcagcatcaccgcgctggtggccgcggtgtgcttgctgccgagggcggccacgccggcgcagcagcccaccccgccgcccgtgctggcgccgatcgacctgcccgcggccagcgccatcggcccgggcgccgggatctacgtcgactacactgacggatccggtggaatgggttgcaccgcagggtttttggtgcacaccagcagcggccaggccggcattctcaccgccggccactgcaaccgtcccggcgagccgagcaaggtgacgatgaacctgggcggcgtgctgccctacgcgacgctgggcacgttcagccagacgatcagcgagggcgtgcacgacgaacagcacgacatcggtttgatcatcctggacggcgacaacgtgccgcagtcgccggcgatcgcggcgtcggtgccggtgtccggcgtcgccgccaatctgcaagtgggacaacagctgtgcaagttcggcatgggctcgggcgcggacgcctgcgggcagatcgtcgagatcaccggcagcaaggtgaaattcctggccggcggccagtgcggcgattcgggcgggccggtgtaccggtacgagaacgacggcaccgtcagcgccgtcggcatcctcatccgcggcggtgacccctacacccgcaaggccgggtgcgcggcccgggccaaattctcggtcgccgagctggtgcggccgtggctggacacatggcggctgaccatggtgacggcaccgtcggcgccgcgctgattcgttcgtcttcagcttggcttcaggctggcgtcctaccgtctgctggtgactggtaatacggtgcgggaccgccgttttcgcgctgcaccgatcgaggatggagggacatagtgaggctgagacaagcgatcgctggttcgttgatcgcgggagcgctcggggtggccgcggcgggcttcggcgccgcggtggcgagcgcggatcccccgccaccgccgccgggcccggggcagccgtgggggccgggcggcccgggcgggccgggtggaccgggtggaccgcccccgccgccgggtggaccgctgggcccgccaccgggcgggccgggcgggcctccgccaccgccgggctggtgatgcgtcgacgggtggccgcctcgagtattcgaagncggccaccgttcactgtgtggtcgcccgcggcaatgtgagccggaaccgggcaccgccccgatgcggcaggcacaccaggtcgccgccgtgcgcgcgggccagcgcccgggcgatggccaggcccagcccggcgccgccgtggtcgcgggcgcggccggcatccaggcgcaccagccggtcgaaaatgcgctcccgctcgtcgtccgggatgcccgggccggtgtcggtgacggtgatctcggcggcgccgtcgccggcgcgcaggtcgatctcgatggcgccgccgggcggggtgtagcggcgagcgttgtcgagcaggttggacacgatctgcgacagccgggtggcgtcggcccggacgttcagcgcggtgagtcccgtgcggcgcacgccgatttggggtgccagcagggccgcccggtcggcttcgtcgcgcagcacggcggccacgtcgacgtcgtgcagttccagcggaagcccggcgtcgatgcggctcaggtccagcatgtcgttgacgagtcgcccggcgcggcgcgcgtcggagagcagcaggcccgcccgacggtattgcccgtcgtcggggtgttcggaggcgccgtgcgcgagttgctcggcggcgacctgcatgccggcgatcggggtgcgcagctcgtgggcggcgtcgacgaggaagcgccgggtcgccgtctcggcgcgctgggcggcctgggcggcctgttgggcccggcgttccgacatctccagggcgtccagcatcgtgtcgaaagcgcttgcggcgcggcctaattcggtgtcggcgcggtgcgggcgcaaccggcggccgcggtccccggtggtgatggcgttggccagcgcggtgagccggtccagcgggcgcagggccgcccggctgaccgcgatcaacagcagcgccgcgatcagcagggtcacgatgccggcggcgatcatcagaccccgcagttgccgggtgacctgagtggtttgcgtggtgtcggcgaccaggatcagccgcgcgccgtcgggcaacgggtgcacgacggccgtcgcagtcgtatccggcggcgggccgggcgggggcggatagggcggtgggtacggcggcgggtaggccggcggcggtaacggcggcgggtacggcgggggcggttcgaccggcccctcggccaggtcggggctgatcgcgcggtccccgtaggcctggccgtccgcggtgacgacgagcgcgcggatcccgccgccgttgagctcggcggcgagcaggtcgggggcggtgtgcgcggcgctcagcgcgtcggcccgcgacgtcgcggcgagcagccggtcgtgcaggttgcggcgggcgagcacgcccatcgtgacgtcgatggtgacgccgagcaccaccagcagcacggtcaacagcgccagcaccaccagcgtcacccggcgttgcagcgacggcgtcggcgtcatgaccgctcgggttgtaggcggtagccgatgccgcggacggtgtgcaggatccgcgggccgtgtgcctcgagcttgcgccgcagcccgctgacgtgaacctgcaccaggttggggtcgtaggcgtcgtaaccccacaccccgttgaggatctggccggcgctgacgatccggccgcgctgctccaccagaaatgtcagcacgcgcagctcggtggcggtcaggtccagccggtgaccgccgcgcgcggcgactccggcgccggggtccagcgtgacgtcgccgacctggatcacctgcggcagccgtccccgccggcgcagcaccgcgcccacccgcgacaccagctcggccagctcgaagggcttgatgacgtagtcgtcggcgccgccgtccaggccgcgcagccggtccggcaggccgtcgcgggcggtgatcagcacgatgccgatgtcgccccagtcgcggatcacgtcgatcagcgcgaacccgtcgcgtccgggcagcatcacgtcgagcaccaccaggtcgggccggatgccgtcgagcagctcttcgagtcgctcgccgtcgcggcgggcctcggtgtggtagccgacctcggtgagcgcctcgctgaccatctcgcggatggtctcggagtcctcgacgaccagcacccgcggggtgccgacggtgaattggccggccgccccgcggagacaatccgtcatggccaccattgtcggcgccggtgctgaaaccaacctgaaggcgtcggtgcgccggcgtcgcatcccgccccgttggcaccaacctccgccccgttggcaccaacctccgccccgttggcaccaagaagtggggggtgtgtcaagtgcccgcctcacagcgacaacctcgttaggacgtctgacctgcggaaacgcgttgtcgctgtgaggcgggcacaacaccgcttctctcctcgggaaacgcaagtggcgcctggggctcagcggacagccgttccttcagatccacttcagctgcggctcctaccgtcgcgaccatgaccacgaacgacgacatcaacaccacaacacccgcgccgccgccggccgcgcaccaaccgcccgagcgacgccactccaccggcgtggtgatcggcgccggcgtggcgggcgcgctgctcggcgcggtcggcaccgtggcggccatcgccttcgcctggatcatcagcgtcggaccgcccggcccgccgccgcccgggccgccgccgatgtgggccgcacccccgatgccgcccccgccgctgcacgggccgccgggacccccgcacggcttcccgccgccaccaccgggcgaggcgtttccgacgctgccgccgccctcgccgcgcccctgagggcaagatgggaggcgtgtcggccggccgggcctcgtcgctttccgccagcatcgccgcgcggctgttgcggtcgcgccggctgatgcgggcaccgatctggatctaccgcgctcgcgggggcgcggtgttcggatcacgcatcctgctgctcgaacacgtcggccgaaagtcccgggcgccgcgctacgcggcgctggaggtcgtcgaccacccgtcgcccgacgcctacgtcgtcgcctcgggcttcggccgaaaagcccagtggttccgcaacattcgggccaatccacgggtccgggtgtacgccggcagccatccgccccgggccgccaccgcgcgtgtcctcgaccaagccgaggccgaccgcgccctggcggcctaccgcacccgttacccgcgggcgtggcagcggatgcggctcgtgctggaagagacgctcggcgtgccgatcactgacaccggcaccccgctgccaatggtcgagttaaggctggaccagcgcatgcacacaaaaaagccaagcacgccataagcttcccctcatggatcggctcgaggtaacaagcgccgagttgcggatgctttctggcaaatggcacacgaacgccgcccgtctgcgcgtcgctacaccgccgccgtcgggtatgtcctaccaacccagtgcggtcgccgtggacgccgcccatgcagctgtcgaggtggcagcgaactctctgatcggccgcatgatcgaaaccgcaacgaaagtcgcggcggcggattttagttacaccgccaacgaggccgattcggcggataagatgtcggcgattggccggcaaccggcgaggcaatagcccatgcgtgccgtccccataccgcgcctgtccgagctcttagcctggccgacggatcatcttacggaggcagccgaccattggatgtccacccgtgaccggtggtatgaggcgttcacggagacatggaaagactccctgagtatcgggtggcaaggcaacggcgcggaggcgctgcgcagccgcacttatgccgacaaagtgaaggtcagcgacatggtcgaccaattgcacgaagcggccaaagtggctcgtgctggcgccacggacctctccgccgcgcggtcgcgcatgagaaatgcggttgtcgatgcacacgaagcgggcttctatgtgcatgaagatctttcagtcaccgacctctcgacaggtaactcctcggccgaccgcgcgatccgagaagcggaggccgaagcttatgccgccgatatccatcagcgtgccgctgatctcatcagagcggacgtacgcaccgctgacaggatcagcaacgcaatggctggcttaaacggacaggtacccgaaagtccctcgacaccgacaccacaaccgtctgagtgcgcagatccgacggaactgcttcacgattggagcgagttgatcaacgagataaacgagcacaacgaacggcaatacaacccatacgacccagccgaagttgcggcctacgaagaagagtatctaaacctgaacgcgaagttactgaagctctcgagcgagctcttggactgtggaattccaacgtccgttaccccggcgcccgcaccgactccctctcggtgaacgcaattgataactactcgtcaggccgatcgctttgggacgaagtgtggtgtcgctgtttttctggcgttggccattctggtcgtggcctccttattgcccggttgcggtcgcacggatacccccaccacaaaggaaacgacaaccacttccggaaagagcgtcgaaacgttactcgtcaacctcgatgacgtgcgccgcatagcggacaccgaaagcctgaattctggccccggctcacaagtccagtaaccgcgccactcggattcgaacacccccaccccgtgccgcgccgtattcgaccaagaggcgattttcgacggcgactggacacagtttcgttccgcgacttacaacggtgacgtctacagcggcacgggccaagtcaaagtgcgcggtatcgccaatgtggtgcaagccgtgggtatttaccgggatgcggacacagcgcgcgcccattttgatcagcttcttccatcgctgacggcctgcactgccctgcacgccaagaactatgatttcacagtacgccagctggacaccgacaccctgagcctgagctccagcgtgtggaaactgttctaccgggtgaaatcatcggtgctgctatacgttggagcgcttggcgttccgcaaaccgaacaaagcgcccaacagatacttcagacgattacgaaccgggttacgtaacgcacgcgacggcgcgctctaactccgctcgggcccgcgcaccgtcatcgcggcgaacaacgccacaaacagcgcggccggaagaccgttgacgaccttgtcgcgcacccgcacgtgcgcgccgaccgcgagcacgaagtacagcgtcagcatcgccgtcgtcagccgggccagcccgggaaagcgggtgaccgacagcaaaccgaccgccgcggccgccttcacgaccggcagcaccggccggatgttgtccggaacacccaggttgtcaagggttttgcggatcggggcgacctggacgccgcacgcgaccgcgtcgacggcgtggaacacgcccagcgccgcgtaggtcttcggtgaagtcaacgcactcatggggcaatcctagggaggctattgggtcagctcccccgtcgggccgtccgccggctggcgggcgatcgcctcggccttggccaccgcctgcgcgatcgccggatcggtctcggtggagaaccagtccgcgacgtcggcgtcgtcgtcggcgctgtgcttgggcacgtcctcgaccggcgacggctggaaccggaacaccccgtcctggcccggcgtgcccagcagcttggtgaatccctgcagcgccgcgctgaagtcgctgggcaccacccacaccttgttggcgtcgccgcgcgccatctccggcagcgtctgcaggtactggtaggccagcatctccggggtcgggcggccggccttgatcgcggcgaacgtcttctcgatggccttggcctggccctgcgcctgcaggtaggccgcggcccgctccccctgggcgcgcagcatccgggactgccggtcggcctcggccgccaggatcgcggcctgcttggcgccctcggcggccaggatctgcgcctgcttctggccctcggcctccttgatcgccgactcgcgcatgccctcggcggtcaggatcatcgcccgcttctcgcggtcggccttcatctgcttttccatcgacgcctggatcgacggcggcgggtcgatgctgcgcaactccacccgcgccacccgcaggccccagcggccggtggcctcgtccagcacgccgcgcagctgcccgttgatctggtcgcgggaggtcagcgtctgctccagcgtcatgccgccgaccacgttgcgcagcgtggtggtggtgagctgttcgacgccgacgatgtagttgctgatctcgtagacggccgcctggggaacggtgacctggaagtagacgacggtgtcgatgttcagcgtcaggttgtcctcggtgatcaccggctggggcgggaacgacaccacccgctcccgcagatccacccgggcccggatccggtcgatgaacggcaccagcagcgtcagctgcccgctgaccgtacggctgtaccgacccaggcgctcgatcaccgcggcctccgcctgaggtatcagcgcgaccgacttggccaccaccacgatggcgaagatcaccagaacggccagcagcaccaaaccagcaaccgcaccttgcattggaattcctttctcttgcagcccttttcgctaaagactgctcttgaagaccactgcggtggcgccgtcgatctgcatgacggtgaccggctcaccgggttcgtagacgtcgttctcgtcgagcggacgcgccgtccacacctggccgtccagcttcacctggccgcggtcgcgggcgacccgctcgagcaccagcgcggttttgccctccagcgccacgatgcccagctgcggcaccgcggccggggtcagccggcgccgcagcggcgggcgcaccaccaccaacagcagcaccgagacgaccaggaacaccgcccgttcagccacgccgggaaatcggtcagccaactggtcagcgccgcggccagcgcgcccccgccgagcatcaccaggaacagatggccggtgagggcctccgcaccggccagcaccagcgcgaatattagccaaagcaccgcggcgtgcatgcggcaagaatacgcgtgatcggccttcccggggcaaaacaactacactgccttctcgtgtggtgtcccagtgtttcgctgtccctgtgggccaatgcctggctcgccggcaaggccgcgcccgacgacgtcctggacgcgttatccgtttgggcgccaaagcaatcggtgaccgcgtatgatgccgtcgccgcgggccacaccgggctgccgtggcccgacgtgcacgacgccgggacggtcacgctgctgcagacgctgcgcgccgcgatcggcgtgccggtgggctccggactgatgcgcgggacgatcaacgtggttttgccggtaccgggcgatgtgcgcgggctggcccccggcacccagttcgagcaggacgcgctggccgccggcgaggcggtgatcgtcagcaatccgcaccagcccggcgccgccgtcgggctggtccccgaattctgttacgccgacgacgacgatgggtccgaggactacgcgctgaccgaattgtgcgcgctgagctggacggtgtattcgctgcccggggcgccggtgctggaccatcacgagctcggcgacgccgagtacacgttgcgctccgcggtgcgctcggccgccgagacgctgggcgccatcggcctcggctcggccgcgtccgacgtcgacgacccgcgggggctggtcgagcagttgctggaatcggcacggcagcaccgcattccggatcacgcgccgtcgcgcgcgttgcgggtgctggagaacgccgcgcacgtcgacgccatcatcgcggtgagcgccgggctgagccggtcggattcgccggaccgattcgccgcgccgatcgccgccggtctggaaccgcttggcacacaatcgtcgtcggaggcgcgcatcgccggcgatgcgctgcggccgctcaccgcggtggtgcgttcggcgcggatggcggcggtcaccgcgatcctgcattccgcctggggcgattaggtcctagccggtagcttgggccgcgcagtgcggcggccggcacggcgcgccgttgacgctggccagacaaccgggcaccgggtcggggccggtcacccgggcgggcgttcggccgcaacgcaattcgtcgatcaggtcggccgccaaccgcgcgaaacgcggctgggcgttgggcgtcgacgcgcgcgccatcagcatccccgccgactcggcctgcgcgcgcagctcctcgtcgaggtcccacaccacctcgatgtggtcggccacgaacccgatcgggcagacgatgacggcccgggtgccggattcggccagggcgcgcagatggtcggcgacgtcgggttcgagccagcggacctggggtggcccggaacgcgactgccacaccaggtcgtgctcggcgtacccggcggcggccgccacaagccttgcggcatatgcgacttggcggctgtacagtcgcggccccaggcgctcgtccgcggccaccgggaccgaatgcgcggtgaacaccagacgcgcccccgcgggtaccttcgccgccgcgtcggcgatcgcgccggcgaacatctccacgaacagcggatggtcgaaatacggtcgcagcttgaccagttcgggcgcgcccgtcccggccgcggtgcgcgcccgggcgatgtcctcgacgtactgcgtgcagctggagtagccgctccaggcggaggtggtgaacaccgcggcacgccgaatcccgttgtcgcgcatgaccttcaccgtgtcttcgacgtagggctcccagttgcggttgccgaagtagacgggcaggtcctgggcggcccgcagctgctcgatcagcgcgcggttgatgccgttgatcggtgacaccccgccgaaatgcaggtagtgctcggcgacgtggtcgagacgttccggcggcacgccgcggccccgggtgacgttctccaagaacggccgcacctgctcgggcccttccggcccgccgaaggacagcagcaggacggcgtcgaaatccattgcccgtctacagcaattgggtgctggcgccgccgtcggcgtagatgatggtgccggtggtggccggcagccagtcggacagcagcgcgcacaccgtcttggccaccggggtggggtccttcatgttccagccgatcggggcccgctgatcccagccctcctcaagcagccggatctgctcggccgcctggtcgccgagcacgccgccgacgatcccggccatcgccagcgtgcggatcgggcccgccgcaacgagattcgagcgcacaccgtgcggcccggcctcgcgcgccacgaaccggttgaccgactccagcgcgctcttcgcgaccgtcatccagttgtaggccggcatcgcccggctggggtcgaagtccatgcccacgatcgacccgccggggttcatgatcggcagcagcgccttggccagcgaggcgtacgaatacgccgagatatgaatgcctttggagacatcctcgtacggcgcgtcgaagaacgggttgatgcccatgccggtctgtggcatgaagccgatcgagtgcaccaccccgtcgagcctgttgccctcgccgatctcggcggtcacccgttgggccagggtgttcaggtgctcctcgttctgcacgtcgagctcgatcaacggggccttctccggcagccggtcgacgatgcgctggatcagccgcagccggtcgaagccggtcagcaccaactgcgccccggcctcctgggccaccttggcgatgtgaaacgcgatcgacgagtcggtgatgatcccggtgaccaggatccgtttgccgtcgagcagtcctgccatgtccgtccttaatgtccttgtgtgctggttggaatcagtggcccatgcccataccgccgtcgacggggatcaccgcgccggcgatgtaactggcgtcctcggaggccaggaagctgacggccccggcgacctccgcggcggtgccgacccgcttggccgggatgaactccagcgcgcccgcctggatccgctcgtccagggcgcgggtcatctcggtgtcgatgtagccgggcgcgacgacgttggcggtcacacccgccttggacagttcgcgggagatcgagcgggccatcccgatcaggccggccttggcggccgcgtaattggactggttgccgatgccccacatgccggacaccgagccgatgtagatgatgcggccgaaccgctttttctgcatgctgcgcgccgcgcgctgggtcacccggaacgccccggtcaggttggcgttgatgacctcggtgaaccgctcctcggtcatccggatcaggaatgcgtccttggagataccggcgttggacaccagcacctcgaccggcccctggtgctcctccacctctgtgaaggcgcggtcgacggcgtcgttgtcggtgacgtcgcactcgacaccgaacagcccgtcgggcgccccggatccgcggtgcgtgacggccaccttgtggccgtcggcggccagccgctgggcgatcgccagaccgatgccccggtttcctccggtcaccaggacggagcgggagacgaatgccggtctgccgtagtcggcggcactttcggtggtgttctcggtggccgtgtcagtcaccccgtcaacctatcgcctcggctgatcggcccggaaaccggctggccccgctcgtaacgccagggcggaaatccgggcgagtttgcgccgtggcgttacgagcgcgccacggtgtcggtgtggcgcagcacactttcgccatgacggaccccttcctgggcagcgaagccctgggcgcgcggttgctgtctcgccacgagttgcgcagccggtacgtcgcgctgcaccgggacggcatgtcgctcgcgacgccgagttgacggcggtggtgcgggcgaaggcggcatggctgcggtcgcgccggcgcggcgtgctggcgggtttctcggccgccgcgctgcacggttcgaagtggatcgacacggcgcggccggccgagatcatcgacaccaatcgccgtcacgcccgcggggtgcgggtttgggaggagcgcatcgagtccgacgagatcaccgtcgtcgccggcatggcggtcaccacaccggcgcgcaccgcgcttgacctggcgcgccgccatcccaggggcgtggcggtcgccgccaccgacgccctggtgcaggcgacggagctgaagatggcggacgtcgagctgctcgtggaccgctaccgcggtcggcatgacatcaaggcggccagagcggcgttggcactggtcgacggcggcgcccagtcgcccaaagagagctggctgcgggtgctgctgatcgacgccgggttcccgcggccgcagacgcagatcccggtccgcaacgaatggggttgggccgaggcgtatttggacatgggatgggaagagatcaaggtcgccgcggagtatgacggcgaccagcatcgggcgagccgctatcagtacgtcaaagacatccgccggctcgagacgctcgagcggtacgggtggatcgtcgtacgggtcatcgccgaggaccgtcccgacgagatcatccgccgggtgcgcgacgcccggcgacgccgctcgtaacgccagggcggaaatccggccgagattccgccgtggcgttacgagcgcggcgaagagggcgcagcgcggcgaagagggcgcggccggcgggcgcgccccacctaggtgggcaggcggcggttgatgagcagcgcggtcagcgcggccagcgccagcaccagcgcacccagccgcacccagcccacgctcgcgtcgcccttgatggtctcgtagccgatctgctgctgcagcgtcgcgtacaccgacttcagctcctgcaatgacgctgcgttgtaagcgtttccgccggagagctgggccaccttcttcaacgtctcgtcatcgaccggcaccggctggcgctggtcgttgatctccacgaacccgtacggggtgccgaacgagatggtcgagatcggcacgccctgatccttggcggtgcgcgcggcggtgaaggcgcccttcgggttgtccggattggtcggcatcgtctccttgccgtcggagaacaacacgatgcgcgccggcggcggcttgtcgccgccgccgatcaccgcgcccaccgtcgcgatcgcctgcagggcggtgaagatgccctcgccggtggcggtgcggtcggcgaactgcagcttgtccaacgcgttcttggtggcctcccggttggtcgtcggcgacaccagcaccgtcgcagttccggcataggcgatcagccccaggttgataccgggggtcagctcgtcggcgaactgcttggccgcctcctgggcggccgccatccggttgggcgcgacgtcggtggcccgcatcgactgcgacacgtcgatcaccagcatcaccaccgcgcggttgcggggaatccggacgtcgttcgtcgggcccgccatcgcgatggtgaacagcaccagcgaggccaccagcaggatcgccggcagatgccgccacgtggacggccgcttgggcgcgacgctttccagcagctccatgttggcgaaccgcagcatccgccgctgccgggccaactgcatcaggatgtacagcgcggccagcccggcgaccaccagcaggaacaggaagaaccacgaatgttcgaagcccgacaacgacattgggccgaggaacggcaggctcatattcgagtcactgccgccctgccaatgccccgcgccggcgggattccacgaaccgcacgatgtcggcgatccagtcgcggtcggtgcgcagcgtcaggatcggcgccccgcagctgcggatggtgcgcgccacgtcggcccggtgcgccgcggcggccttggcgaagtcgtcgcgcagctgggcgtcgatggtgaactcgcgggtcacgcccgtctcggcgtcctgcagcaccacgtcgccgatgtcgggcagttcgacgtcccgcgggtcgagcacctcgatggccagcacctcgtgccgggccgcgatcgcccgcagcggccgctgccagttgatgggaccgaggaagtcgctgatgatcaccgccatgccgcgccggcgttccggacggcgcagcgcgtcgatggccgtcgccagatcgccgcgcaccccgaccggcgcccgcggtgtggtcgcgatggtgcgcagcagcgtctgctcgtgctggcgcccggaccgcgccggcacccgagtcatggtggcgccgttggcaatcagcgcgccgagccggttgccgccgccgctgttgaggaaggtgatcgcggccgcggccgccaccgccaggtcgcgtttctcgcagacggtggtgccgaagtccaggctggccgacatgtcgaccaccagccaggtctccagctcgcggtcggcgatcatctgccgcacgtgcggatgcgtggtgcgcgcggtgacggcccagtccatccgccgcacgtcagcgccgggctggtactcgcgcgactcccccggctcggatcccggccccgggatcaggcccaggtggtcgccgtgcagcaccccgtcgagcttgcgtttgacggtgagctcgagcgtgcgcagcgccgccgacagcttcgggtcatcgatctgcccgcgctgcatcgagggcggatgcagcaccggcctcttggggtcggtcaccgaccgctggccgcaccggcaggctgcatcaccgggggcaccgaatgcccttgctgcggaacggcattcacttgaggcagggcgaccgtctgcagcacccggttgatgacgatctccggcgagatctcgtcggccagcgcgtcgtaggtgagcaccagccggtgccgcagcacgtcgggaatgacgtccacgacgtcctgcggaatcacgtagtcgcggccgcgcaccagcgccagcgaccgcgccccggcgatgatgcccagcgaggcgcgcggcgaggcgccgaacgagatccacgtcttgacgtcgttcatgcccagctgttcggggtgccgggtggcggtgaccacccgcaccacgtagtcgaccagcgcgtggtggacgaagacgttggccgcgatgtcctgcagccggaccaggtcgccggtgttgaggatctgcttgggctccggcgggcgcacgcccatccggtagatgatctcgcgctcctcctccggcgatgggtagccgacattgatcttgaacaggaagcggtcgcgctgggcctcgggcagcgggtagacgccctcgtgctcgatcgggttctgcgtcgccatcaccaggaacggattgggcagcgggaacgtcttaccgccgatcgacacgtggcgttcctgcatgacctccagcagcgccgactgcaccttggcgggcgcgcggttgatctcgtcggcgagcaggaagttgaccaccacggggcccagctcggtgtcgaactcctccttgccctgccggtagatgcgggtaccgatgatgtcggtgggcaccaggtcgggggtgaactggatgcgcgcgaacgtcccgcccaccaccttcgcgaaggtctcgacggccagcgtcttggcgacgccgggcacaccctcgagcagcacgtggcccttggacagcaggccgaccagcatccgctcgacgagctggtcctggcccacgatgatgcgtttgacctcgaagatggcccgttccagggtctgcacctcggcggccaggccattgccggcaccggcgccgccggtcggcgcttcgtgcgcgcccgggccggactgcccgcccgggcccgagtaaccgccggcgcctggcggcggcccacctgctgctgtcatcgataaccctccagagctcaatcggacacgactgccgggcagcgacgtgccctcgtccaactattccaggcccgccgaattccgtcgacgctcgcccagccgatggccgggccggcccgcgatcagtactcgatgatcctagtcaggaacggtgtcatgccgggcttgcgcaccgggctgacggtgaccttgccggcgctgccggacgcctcgagcatctgcccgttgcccaggtacatggtgacgtgctgggacccgcccgggccgtagaagatgaggtcgccgcggcgggcctgatcctgcgggatgtgacgcccggcgttgtactggtcgccggagaaccgcgggatcagcacgccgaccccggcgaagccgtagcgcatcagccccgagcagtcgaacccggtgatgttggcgccgtcgccgacacccttgctgggaccgtccagcgagccgccgccccacgagtacggcacccccatctgcgaccccatccgcttgatcacgtactcgatggcctgccggccgtagacccgcgggatcttgccgcccgggttggacggcgtggccgcggccgcgggcgcgtcgttgccgcccaggttgatgccgagcccgccgaggaattgcttgcccaggttcagcgtggtctgggtggcctgcgcggtggcctgcagcgaggcgttggcgacggcgagcggatcgcccggggcgccggcactgatctgggccggcagggtgggatcccactcgccggggtcggccagcgcggccggcgtcggtgccacggaaaacatcagcccggtcaccatcgcggtgatccaggcgaagacgatgagacgaaaccggttgcggcgcatggctcctcgttcactgctcacttgctcaccactcgatgtaacggaccacgtagggcgtcatgccgctggtgcggacgggggcgacgcggaccttcaacccgatatcgggcgcctcgagcatctggccgtcgccgaggtagatggtgacgtgctgggagccgcccggtccgtagaagatgacgtcgccgcggcgcatctgcgaggacgggatcttgcggcccaggttgtactgcgagcccgagtagtgcggcagcttgatgcccaccccggcgaacgaatacagcaccagccccgaacagtcgaagccgacgatgttggcgccggagtcgatgcccttgctggggccggccgcgttgccgccgccccaggagtagggcaccccgatctgcgacatgccgcgacggatcacgtactccgtcgcctgccgcccgtacacccgcgggatgcgcgccccgaccccgccgggcgccgcgttggtgatgccggtgtcgtcgggcttgaggatgccgagctgctgcaggaagttacggccgagaccggcggtgacctgggtcgaggtggccgagatgcccagcacctggttgatcaccgcaatcgggtcgccgggaacgttggcgctcggaatcatcggcagggtggggtcccaggcgccgtcccattgccggcccgcggacggcgccggcgcgcccgccgatcccgtctcccagcggtcgcccgagcccgcggtggacagctgacgtttggccgcctccagcttggcctgggcctggtcccgctcggtggccagccggatcatctgctcgcgctgctcgtcgaacttctgccgggagttggtcagcgcggccaccgcggcgtcctggctggccttggcgtcggcggcggccttgtcggcgttctgcttggccagccgcgccgccgactccctgttgacctgctcggtgcgggcctgctgcagtttggccatcaccgtctgcgagctggcggtcagggtcttggcggcggcctcggtggcgatgatgtcgtcggggttgcgtgcggtcaggtagctgttcgacgggccgttcatgtaggccgccgcggcaaacgtgtcgaagcggcgctgcgcgccggcgatggcggcgttggcgtccttgaccgcttgctggctggcttccaggtcgtgctgggcggcggccgcgttgtcccgggcggtctccacgtcgaccagcgccttgttgacgctttcctgctcggtctggatttcggcgctgaggttctgcaggcgctggttggccttggcgacgttggcgatcagggcggccaggttgtcggcgacgggatcagcctgcgccaggcccggggtgcagatcagcagggccacgctcaacaccgacggcacgacgggccgaaccagcctcgcggccggccgcgcggaagtcccccagcgtgtgcgtctcattcgactcaggtctcctacggctcaacgcaacgggtggcgccgaccacggaataatcgttaggcaccaaagacaacaccagcatcatttgcaccgtacgtcacacaattgggcgcgcaaacgctccaccgaaatcgcactctctacgtgcgtttaatgtgaccgaacggttatctgccgggtttgccgcggcgcggcgggccggtggcggcccgaagccggacgggcgtgctacgcggtgtttgtcggcgtcacggtgtcggcgccggccgcatcgggcggcgttgctgcgcgcctgctgcggacctgcagcacgcgggtgccgacggccgccgcgaagaccgcgatcaacaggaagatggtcagcccggtccaggggaactcgggcgtgtcgagctcgtgcagaaagtgctgcgcggagaccaccgggttgccggtcttggcgatgtcctcgcccgcctcgagcgtgacgcgcgggaactgggtgctgtagctgccgacgtaattggggctgagggtcagcaccgtggcgtcgtggtagtccgcgccgaccaccgtcgagatgtcgcgcagcggggtgtcgttgggcggattgtggtccagcagcacgattttgaggttgatgccctcggcgcgcgcctggttgaccacctcgagcaggccgggcatggcggccggcggcgcgctgaccccggtggccgcgaccgcagccttgaccatcgtcatgtcgacgtccaccggaatgtagagcggtggcgcagaatcgtgcgcggtcatcgtcgtccctcctgctgcggcggtcacgctggcgtgacgctcggccccggcggtcactctagtgtgacgctcggcgggcattcggggccgaacgggggtttaaaccggcgggaacggcgataagactgagatcaggaccgccgacgtaatgcaggacaagcgtactgttaaagttggcaccgtcgccgacacggcccgtcggcggaagaactaaatccttgggagttgaagtgactgattctgtgaactcgttcggagcccgcaacaccctcaaggtcggcgacaagagttaccagatctatcgcctcgacgccgtccccaataccgagaagcttccctacagcctcaaggtgctggccgagaacctgctgcgcaacgaggacggcagcaacatcaccaaagaccacatcgaggccatcgcgaactgggatcccaaggcggagcccagcattgaaatccagtacacgcccgcccgggtggtgatgcaggacttcaccggggtgccgtgcatcgtcgacctggccaccatgcgggaggcgatcgccgacctgggcggcaacccggagaaggtcaacccgctcgcgccggccgacctggtgatcgaccactcggtgatcgccgacctgttcggcacggccgacacgttcgagcgcaacgtcgagatcgaataccagcgcaacggcgagcgctaccagttcctgcgctgggggcagggcgccttctccgacttcaaggtggtgccgccgggcaccgggatcgtgcaccaggtgaacatcgagtacctggcccgggtggtgatggagcgcgacggggtggcctatccggacacctgcgtgggcaccgactcgcacaccacgatggtcaacggcctgggcgtgctgggctggggcgtcggcggcatcgaggccgaggccgcgatgctcggccagccggtgtcgatgctgatcccgcgggtggtcggcttcaagctgaccggtgagatccagccgggcgtgaccgccaccgacgtggtgctgaccgtcaccgagatgctgcgcaagcacggcgtggtcggcaagttcgtcgagttctacggcgagggggtggccgaggtgccgctggccaaccgcgccaccctgggcaacatgagccccgaattcggttccaccgcagcgattttcccgatcgacgaggaaaccatcgactacctgaagttcaccggccgcaacgccgagcaggtggcgctggtcgagacctacgccaaagagcagggcctgtggcacgaccccgcccacgagccggccttctcggagtacctggagctcgacctgtcccaggtggtgccctcgatcgccgggcccaagcgcccccaggaccgaattgcgttgtcgcaggccaagtccgtcttccgcgagcagatccccagctacgtcggcgacggcgacgggcagcagggctactcgaagctggacgaggtggtcgacgagacgttcccggccagcgacccgggggcgccgtccaacggccacgccgacgacctgcccgcggtgcagtcggccgccgcgcacgccaacggccgcccgagcaacccggtgacggtccgctccgacgagctgggcgagttcgtgctcgaccacggcgcggtggtgatcgccgcggtcacgtcgtgcaccaacacctccaaccccgaggtgatgctgggcgcggcgctgttggcgcgcaacgccgttgagaaggggctggcctccaagccgtgggtgaagaccacgatggcgccgggctcgcaggtggtccacgactactacgacaaggccgggctgtggccgtatttggagaagctcggcttctatctggtcggctacggctgcaccacctgcatcggcaactccggtccgctgcccgaggagatctcgaaggccatcaacgacaacgacctgtcggtgaccgcggtgctctcgggtaaccgcaacttcgagggccgcatcaacccggacgtgaagatgaactacctggcgtcgccgccgctggtggtggcctacgcgctggccggcaccatggacttcgacttcgaaaagcagccgctgggcaaggacaaggacggcaacgacgtctacctgaaggacatctggccgtcgcagaaggacgtctcggacaccatcgcatcggcgatcaactccgagatgttcaccaagaactacgccgacgtcttcaagggtgacgagcgctggcgcaacctgcccaccccgagcggcaatacctttgagtggagcccggattcgacgtacgtgcgcaagccgccgtacttcgagggcatgccggccgagcccgagccggtcgccgacatctccggcgcgcgggtgctggcgctgctgggcgactcggtgaccaccgaccacatctcccccgccggcagcatcaagccgggcaccccggcggcgcagtacctcgacgagcacggcgtggaccgcaaggattacaactccttcggctcgcggcgcggcaaccatgaggtgatgatccgcggcacgttcgccaacatccggctgcgcaacctgctgctcgacgacgtggccggcggctacacccgcgacttcacccaggacggcggtccgcaggcgttcatctacgacgcggcgcaaaactatgcggcacaaaacattccgctggtggtgctgggcggcaaggaatacgggtccggctcgtcgcgagactgggcggccaagggcacccggctgctgggcgtacgcgcggtgatcgccgagtcgttcgaacggatccaccgctccaacctgatcgggatgggtgtgatcccgctgcagttcccggacggcaaatcggccaaggacctggggctggacggcaccgaggtgttcgacatcaccggcatcgaagagctcaacaagggcaagacaccgaagacggtgcacgtcaaggcgagcaaaaacggttcggacgcagtcgaattcgatgcggtggtgcgcatcgacacccccggtgaggcggactactaccgcaacggcggcatcctgcagtacgtgctgcgcaacatgctcaagtccggctgacccggccgacgactccctgccggatgcccagctagatgccaaaagtcagcgaggaccatctggcggcccggcgccgccagatcctcgacggcgcccgccgctgcttcgccgaattcggctacgacaaggccacggtgcgccggctggagcaggccatcgggatgtcgcgcggcgcgatcttccaccacttccgggacaaggacgcgctgtttttcgccctcgcccacgaggacgccgagcggatggccgaggtggcgtcgcgggccgggctgatccaggtgatgcgcgacatgctggccgcgcccgaccagttcgactggctggccaccagattggagatcgcccgcaagctgcgcaacgatccggcgttcagccgcggctgggcggaacgctccgccgaactggcggccgcgaccaccgaccggctgcgtcggcagaccgaggcgcaccgggtgcgcgacgacgtgcccggcgatgtgctgcagtgctacctggagttggtgctcgacgggctggtggcccggttggcgtccggcgaggatccgcagcggctgtccgcggtgctggacctggtggaaaactcggtgcggcgcaacgactcccggccgggctaggcgcgcgccgccttggccgtgcggttgggcccgccgcggctgcgcatcgtggtccccgactcgcgcagcatgctgtgaatcgacccgtaggaccggccggtccgcgcgaccagactgcggatgctggcgccgctttcgtaggcgtgacgtagctcgtccaacaactggtcgcgcgagttggccgaccgctgcactgttcttctcatggctcctccgacgcccggacacatcgcaagcccctagagtagaaagccgtcgccgggtgcgggcggatttcgccgaatcgcctgcggcggcgtgccgtcagatcaggcgagctcgatgagatcgcggtattcgtcggaccagtagtcctcggtgccgtcgggcaacagcaccacccgctgcgggtcgagggcctcggcggcgccggggtcgtgcgtcaccagcaccaccgcgccggtgtagctgcgcagcgcgtcgagcacctgctcgcgcgaggcgggatcgaggttgttggtcggctcgtcgagcagcaacacgttggcggtcgacgccaccagaccggccagtgccagccgggtcttctcgccgccggacagcgtgccggccggttggtcgagttggggcccgctgaacatgaacgcccccagcaggccgcgcaggtcctgctcgccggaatccggtgcggcgtggcggatgttctgccagacggtcgcatcgttgtccagcgtgtcgtgttcctgcgcgaaatagccgatccgcaaaccgtgtccgggctcgatccgtccggtgtcgggcgtctcggcgccggccagcaggcgcagcagggtggtcttgccggcgccgttgaggcccagcaccaccacccgggagccgcggtcgatggccaggtccaccccgctgaacacctccagcgacccgtaggacttgctcagcccggtggcggtcagcggggtgcgcccgcaggcggccggcgtggggaacttgatgcgggccaccttgtcggcgacgcgctcctcgtcgagtgcggccatcatccggtcggcgcgacgcaacatgttctgtgccgcaacggctttggtggccttggcgcccagcttggcggcctgggtgcgcagcgcggcggccttgcgttcggcattggcgcgttcccggcggcggcgctgttcgtcggtggcccgcgcgtcgaggtacttctgccagctcatgttgtagacgtcgacctcgccgcgcaccgcgtccaaaaaccagacccggttgacgacgtcggcgagcagctcgacgttgtggctgatgatcaccagcccgccggtgtgggcccgcaggaagtcgcgcagccagccgatcgaatcggcgtccaggtggttggtcggctcgtcgagcaggagcgtggtcgccgaacccgaaccggtggccccaccctcagcggcggcgaacaggatgcgggccagctccacccggcggcgctgcccgccggacagggtgcgcagctgctgcgtcagcacccgttccggcaggccgaggctggcgcagatgcggctggcctcgctctcggcgccgtagccgcccagggccacgaaacgctcctcgagctggccgtaccggcggatcgcgcggtcgcgggcgtcgtcgtcggcgacctcggccatcaacgcctgctgcttttccaggtcggtgagcaacacgtccagcccgcgcgccgacagcacccggtcgcgggccagcacgtccaggtcgccctctttgggatcctgtggcagataaccgatttcgccgctgcgggcgatcgtcccggtgtacggctcggtctcccccgccaggatgcgcagggtggtggtcttgccggcgccgttgcggccgaccaacccgatccggtcgccgggctgcacgcgcaggtcgggcccgtcgggtgagagcaggatgcgcgcgcccgcgcggacctcgaggtccgtggccgtgatcacgatcgctctcctgaactgaaaaactatttgtcgtcggtgaacaccggcggccgtcgttccgcgcgcgcggcaaccgcttcctcgaagttggcggtgagcaggcggacgaaaagctgtcccaagccctcggcttgcatgtgcccctccaggctaccggcgtccagtccactccacagcgtgcgcttggtcaactcgattcccggccgggagaacgccgcgatccgcgcggcgatggcgtagcaggtgtccagcagttgctcctcgggcacctggcaggacaccaggccgatccgctcggcctcttcggcggtgacgtcgcggccggtcagcatgatctcgaaggcccgcgacgacccgatcgcccgcggcagcaggtaggacaggcccagctcgctggcggtgagcccgttgttgatgcccgcggcgcggaagtaggcgctggtggaggccacccggatgtcggcggccagcgccaggcacaggccgccgccgatggccgggccgttgaccgcggcgatcaccggttgatgcagccggcgcagcgccaggatgacctcgtcgaggatctccatggaccgcagcgcatagctgggccgggtcaggccctcgacgtggggcaccgtgcccgcggacttgtggtcggcgcccgaggagaagccgcggccggccccggtcagcacgaccacccgcaccgcgttgtcgtaggtgaccttctgcagggcctccttgagcgggaccatgacgtcgaacgccatggagttcatccgctcggggcgattgagggtgatcagcgcgacgccgggccgcgggtggtctaccagtaccaaactcacccgtgcacggtagcgcgtcgggttattcgccttgctcggcgatggccgcgtccacgtcgaacgcgcggacctgctgcaccaggtcttccagagcggcgggcggcagcgcgccgggctggttgaacagcagtttgcccttcttgaaggccatcagcgtgggaatggaccggatctgggcggccgcggccagctgctgttcggcctcggtgtcgaccttggcgtgcacgatgtcggggtgtttctccgacgaagcctggaaagtgggcccgaactggcggcaggggccgcaccaggacgcccagaagtcgacgagcacgatgtcgttgccctcgatggtttcgttgaatttctcggcggtgagatcgactgttgtcacatttgctcccaacgcgcggcggccacccgatgttcccggacctgagcggcgccggcctggttacggttgcgtacgttttctcgcgtccgacagactgagcctgacgctccgccgcccgcaacgagcagtgagggaatcacgttgggccactacatcgctaacgttcgtgatctcgagttcaacctgttcgaggtcctcgatgtcggcgccgtgctgggcagcggaggctacggcgacctcgacgaggagacggtacgcaccattctggccgaggccgcgcgcctggccgaaggcccggtggccgagaccttcgccttcgccgaccgcaacccgccggtgttcgacccggccgagcacgccatcaccgtgcccgaggagctggccaaaacggtggccgcgctcaaggaggccggctggtggcggctgggcatggccgaggagatcggcggcatgcccgccccgccgccgctggcgtgggcggtcaacgagatgctgatctgcgccaacccgtcggcgaacttcttctgcctgggcccgttcatgtcccaggcgttgtacctggagggcaacgagcagcagcggcgctgggccgccgagggcgtggagcgcggctgggcggccaccatggtgctcaccgaacccgacgccggctccgacgtcggcgccggccgggccaaggccatcgaacaacccgacggcacctggcacatcgagggcgtcaagcgtttcatctccggcggggatgtgggcgataccgccgagaacatcttccacctggtgctggcccgccccgagggcgccggcccgggcaccaaggggctgagcctgttctacgtgcccaagtacctgttcgacccgaagacgttcgaattggggccgcgcaacggggttttcgtcaccggcgtggaacacaagatgggcatcaagtcctccccgacctgcgaattgactttcggcgcaacggatgtgcccgccgtcggctacctggtcggcgacgtgcaccgcggtatcgcgcagatgttcaccgtgatcgagcaggctaggatgacgatcggggtcaaggccgccggcacgctgtccaccggctacctcaacgcgctggccttcgccaaggagcgggtgcagggcgcggatttgacgcagatggccgacaagaccgcgccgcgggtcaccatcatccaccaccccgacgtgcgtcgcagcctgatgacccagaaggcgtatgccgagggcctgcgcgcgctctacatgtacgccgccgcacatcaggatgatcaagtggcgcaacgtgtttcgggtgccgatcacgacatggcgcaccgggtcgacgatctgctgctgccgatcgtgaaaggggtgagctcggagcgggcctacgaggtgctgaccgagtcgctgcagacgctgggcggttcgggcttcttgcaggactacccgctcgagcagtacatccgcgactccaagatcgactcgctgtacgagggcaccaccgccatccaggcgctcgacttcttcttccgcaagatcgtgcgcgaccgcggccaggccctgcagttcgtgacggctcagatcaccgcgaccgtcgacgactgcgacgaggcgctgcggccgatcgccgagctgctgcagaccgccttcgacgacgtcacggcgatgacgggtgcgctgaccggctacctgatgtcggcggccgagcagccgaccgacatctacaaggtggggctggcgtcggtgcgctatctgctcgcggtcggcgatctgctgatcgggtggcggttgctggtacacgccgacgtcgcacagcgcgcgctggcggccggcgccggcggcgacgacgaggcgttctaccggggcaagatcgcgaccgcggcgttcttcgccaagaacatgctgccgcggctgagcgggctacgcggcatcatcgaagccatcgacgacgagatcatgaagctgcccgaagcggcgttctgagcagctccgccggcgaacccacaggttaggcacagtttcagcgggtaaaccatgacgttggcgttaaaccggcgattggagaaaccttgatgtctgccagctgtcacgggctcgcccgcgtcgcggtgttcgccgtggcgggagccaccgcggtgtccctgtccgcctgcggcacgtcgaacaagtccagccccacctcgacgtccacctcgacctccacggtcacctcgaccagcacctccgccgccccgaacgccgaagcgaaggtcagcggcctgatcgcgtcggtggcgggcaactccatccaggtcaccaaggaagacaacggcaccgccgcggtgaacttcacctccaccaccaagatcaccgaggcggtcccggccgggctgcccgacgtcaccccgggcagctgcgtcagcgtcaagccgaccgagggctcggcgcccggccagccggtcaccgccgcatcggtcaagatcagccagtccgtcaacggcgcctgcccgaagccgcaccagcccaccccgggcggatccagcagcccggccccgtcgctgccgccgtcgcaggcgcccgccaagccggccctggtcaccggctcggtggcctcggtctccggtaacaccatcaacgtcaccggcaccgaccccagcggcaacaccacccagaccactgtgacggtcgacgacaaaaccaaatacaccaagcagtcgtcggccaacaccgacgcgatcacgcccggcaaatgcctgtccgcgcgcggaaccaacgacagcggcggcgcgctgcaggcgaccagcattcagctacgtcaggccgtcgacggcaagtgcggcaagcccaagcagcccggccacggcggatgagcccggccggccccgcctgagattgccgtcacttctgccgggcgcggcgtgagaaccgcggccggcgggggtacttgctgacgacggcgaaccgcgcgatcggagaagagtctgtgcctgccctttcgttgaagccgcggcggacgcagatcgcgatcggcgcggtgatcgccctcatcgtgttcggggtggccatgtgcgggccctcgcacgactcgtcgagcagcagcgccccgccggccgtcaccgccgtcccgccgccggcacccagcgcggcgccccccgcgtcaccggcgccgccgccggcgggcagggactacgtcgagggcatggtccagtcgaattcgggcggcaccatcgcgctgcggacccgcaccggctcggccaccgtggactacaccccgcagacgcgggtggttcaggtcggcccggcgaagctggccgacgtgacgcccggcagctgcgtgaacgtgcgcgccaccccgcagagcgcgccgccgcccggcgcgatcaccgcgcagtcggtgacggtgaccccggccgcggacggcaaatgcccgccgccggccgggttcttcggcacggtcgcctcggtggacggcaacaccatcgccgtcaccggcctgggccccggcggccccaccaacgtgaccgtcgccgactcgacgtcttaccagaagcagacgccgtcggacgcccaggcgatcacgaatggaaagtgcttgggggccaatggaactcaagacggcggggtgctgcacgcgacgatgatcagcctcgagacctgcccgccgatggggcatccgcaccaccacctgcacctgccacacctgccgctgcacctttagcggctgttcaggcgggctgctttagacggttctagacggtgaagccgagcgcgcgcagctgctcgcggccctcgtcggtgatcttgtccgggccccacggcgggttccacacccagttgatccgcaggtcgtcgaccaggccggcgcccaccagcgcgctgcgcgactggtcctcgatgacgtcggtcagcgggcaggccgccgacgtcagcgtcatgtcgatcagggcgaccgttccctcgtcgccctcctcgacgttgagcccgtagacgagtcccaggtcgacgacgttgatgccgagttcggggtcgacgacgtcgcgcatcgcctcctcgacgtcggcgagcagttcgtcatccggcgcggtggtttcgctcatcggtcacctctcttctcgaataggcttgggccagcgcgtctttgcacgccatccagcccagcagcgcgcatttcacccgggccgggtatttggccactccggcgaacgcgatcccgtcgccgagcacgtcctcgtcgccctcgacggcgccgcgcgaggacaccatctcggcgaacgcaccgatggtgtcgagcgcctcctcgacgctgcggccgatcacctgctcggtgagcaccgaggtggccgcctggctgatcgagcagccctggccgtcataggagacgtcggcgacggtctcgccgtcgtcggacagcgtcacccgcagggtgacctcgtcaccgcagacggggttgacgtgaaacacctcggcgccgaacggttcccgcaacccgcgatgctgcgggtgcttgtagtgatcgaggatcacgtcctgatacatctgttccagacgcacggctcacactccgccgaagaagtccagggcgcggcgcacacccgccaccaggcggtcgacctcctcggcggtgttgtacaccgcgaaggacgcccgggcggtggccgccaatccgaaccggcggtgcagcggcagcgcgcagtggtggcccacccgcaccgccacgccctcgtcgtcgagcacctgcccgacgtcgtgcgcgtgcaccccgtcgacgacgaaagacaccggcgagccacggttttcggtcgacgtcggcccgacgatgcggaccgcgtcgataccggacaggccctcgatggccgcggcgaccagccgctcctcgtgggcctgcaccgcgtccatgccgaaggcgccgagatagcgggcggccgcggccaacccgaccacctgggaggtcatcggggtgccggcctcgaaccgctgcggcacctgcgcgtagctggaggactccatggtcacggtctcgatcatcgagccaccggtgaggaacggcggcagctgcgacaacacctcgcggcgcccgtagagcacgccgatcccgttggggcccaacatcttgtgcccggagaacgcggcgaagtcgacgtcgagcgcgtggaagtccaccggctggtgcggcaccgactgacaggcgtccagcaccgtcagcgcgcccaccgcgcgggcccgccccaccagctcggccaccggcgccaccgcgccggtcacgttcgaatgatggctgaaggcaaccactttgacccgctcgtcgagctgcaacgagtccaggtcgatccgcccgtcgtcggtgacgccgtaccagcgcaggctggcgccggtgcgccgggccaactcctgccacggcaccaggttggcgtgatgctccagctcggtggtgacgatcacgtcgccggggccgacggccccctcgaaacggttgtcccccaccacgtacgacaccaggttgagcgcctcggtggcgttcttggtgaacaccagctcgtccgggtcggcgccgacgaacgccgcgatgtcggcgcggccctgctcgtaggcgtcggtggactcctccatcagctggtgcgcgccgcggtgcacggcgccgttggaggtcagcaggaattcccgctcggcgtcgagcacctgcagtgggcgttgcgacgtcgcaccggaatccaggtacgccaactggtttccgctgcgcatgatccgtttcagaatggggaaatcggcgcggatcgcggccacatccagttgtgtcgccgtcatgcttacgcccccgctgccgccgcttgggtgaagcgcacgtagccgttctgctcgagttcgtcggccagctccgagccaccggattcggcgatccggccgccgacgaagacgtgcacgtattcggggtggatgtagcgcaggatgcgggtgtagtgggtgatcagcaggatgccgccatgctcggcctgcgcgtagcggttgacgccctcgctgaccacccgcagcgcgtcgacgtcgagccccgagtcggtctcgtcgaggatggcgatcttgggcttgagcagctccagctgcaggatctcgtggcgcttcttctccccgccggagaagccctcgttgacgttgcgctcggcgaacgcggggtcgatctcgagggcacccatggccgccttgacctctttgacccagtgccgcagtttgggggcctcgccgcgcaccgcggtcgccgccgagcgcaggaaattcgacaccgagacgccgggcacctcgacggggtactgcatggccagaaagatgccggcgcgggcgcgctcgtcgatgctcatcgccagcacgtcctggccgtccagggtgatggagccggaggtcaccgtgtacttggggtgaccggcgatggcgtaggacagcgtcgacttgcccgagccgttggggcccatcaaggcatgcgtctcaccggatttcaccgtcaggtcgaccccgttgaggatgggaatctcgcgctcggactcggcggcgttcgggttcacgacgctgacgtgcaggtctttgatttccagagtggtcatgaagctgttgctctcgattcggtgaaggccagttcgtgttcgatggctgcggtgaggcgttcccggatctcgggcaccgcgatcttggagatgatttcggcgaagaagccgcggatcaccaggcgccgcgcctgctcttcggggatgccgcgggaacgcaggtagaacagctgctcgtcgtcgaaacggccggtggcactggcatgtccggccccggcgatctcgccggtctcgatctccaggttgggcaccgagtcggcgcgggcgccgtcggtgagcaccaggttgcggttcacctcgaaggtgtcggtgccggtggcttcggcgcggatcaacacgtcgcccacccacacggtgtgcgcgtcgggcagcgcggaggccggatcgccttgcagcgcacccttgtacagcacgttggatttgcagtccggctgcgcgtggtcgaccagcagccgcgactccaggtgctggccgtcgtcggcgaagtacaggcccaacagctcggcgtcgccgccggtgctcgtgtagcgcacattggcggtcaaccgcaccagctcaccgccgagggtgaccgcgacgtggcgcagcaccgcgtccttgcccagccgggcgtggtgcatgctgacgtgcacggcgtcgtcggcccagtcggccagccacaccacggtgagccgggcggcgtcgtcgacgacgaattcgacgttgtcggcgagggttccgctgccgcggtggtcgatcaccaccaccgcctcggcgagctcttcgacgcggatctgcaggtgcccataggccaccgccccctccccgggcccggtgacggtgacgccgatcggctcggcgatttgggtgtcacgcggcacggtgatcagggtcgcggagttgaacgacgaaaacgcctgcgcggcaacacggtccgtcgggatgccgccctggcccagccgctcgtcgccgcggcgcacggtctgtacccgcaggccgggttgctcgccgacgctgacctcggccttgccggtggcgggcgccgagccgtcgtgcaggccgcgcagccggcgcagcggggtgaaccgccagatctcgtcgcggccgtgcggcacctcgaaggcgtccacgtcgaaggaggcgaacagctcccccttgttcgcggcggccagggacgaaccctcaaccgcttcagtcagattcgtcactacccgaccgcgccttccatctgcagctcgatcagccggttgagctccagcgcgtactccatgggcagctccttggcgatcggctcgacgaagccgcgcaccaccatcgccatcgcctcgtcctcggtcagcccccggctcatcaggtagaacagctggttctcgctgaccttggacacggtggcctcgtgccccatagtgacgtcgtcctcgcggatgtcgacgtacgggtaggtgtcgctgcggctgatcgtatccaccagcagcgcatcgcatttcacgctggaacacgatccgtgcgcgcccttgttcacctggaccaggccgcggtaggaggtgcggccgccgccgcgggccaccgacttggacacgatgttgctcgacgtgttcggggccaggtgcagcattttcgcgccggtgtcctggtgctggtcctcgccggcgaaggccaccgagagcacctcgcccttggcgtgctcgccggtcatccacaccgccgggtacttcatggtgaccttcgacccgatgttgccgtcgatccactccatggtggcgccggcctcggcccgggcccgcttggtgaccaggttgtagacgttgcccgaccagttctggatggtcgtataccgaacgcgcgcattgggtttcacgatgatctcgacgaccgccgagtgcagcgagtcggacttgtagatcggcgccgtgcagccctccacgtagtgcacgtaggagccctcgtcggcgatgatcagcgtccgctcgaactggcccatgttctcggtgttgatccggaagtaggcctgcagcgggatgtccacgtgcacgcccggcggcacgtagatgaacgaaccgccgctccacaccgcggtgttcagcgcggagaacttgttgtccccggccgggatcacggtgccgaagtactcctggaagatctcggggtgttcgcgcagaccggtgtcggtgtccatgaagatgacgccctgggcttccaggtcctcgcggatctggtggtagaccacctcggactcgtactgggccgccaccccggcgaccagccgctgcttctcggcctccgggatgcccagccggtcataggtgttgcggatgtcctcgggcaggtcctcccagctggcggcctgcttctcggtggagcgcacgaagtacttgatgttgtcgaagtcgatgccgtccaggttcgagccccaggtcggcatcggcttgcgctcgaagatgcgcagcgccttcagccgggtctgcagcatccactcgggctcgttcttcttcgccgagatgtcgcggacgacggcctcggacaggccgcgctgggcgctggcgccggcgacgtcggagtccgcccagccgtagccgtaccgccccagcgaagcgatcgcctcttcctgggtcagcggcgcgacggccgtcttgctggcctcgggcgtgagggtcatagggacgctcctttgttgctcgtggtgtggcggcgcgggctgggcgccttggctgtctgagccagcggcacgtgcgtggtgcacgcgcagtcgccgttgacgatggtcgccaaccgctggacatgggtgcccagcacctcggccatcgcctgctgttcggcgtcgcacagctccgggaactcctcggcgacgtgcgacaccgggcagtgatgctggcagatctgcacgccgtggatcggcccgccgacctgcgtggtggtggcgacataccccgccttggtcagcgcggtggcgatccgctcggcggccgcctcgatgtcgtcgtcggccgcgctggcggcgccggggacaccggccagaatggcgtcgatgcgctgccgggcgaatgcctgaaccgcctcctcaccgccgatttcacgcagctggcgcatggccgcggcggccagatcgtcgtaggcgtggtcgagcttggcgcggccggccgacgtcaaccggtagcgcttggccggacggccgcgacccgcgtgctgccacgccgcgggtgcgatggactcggcgtcgcccgcctcgatcagcgcgtcgaggtgacgccgcaccccagcggccgccagacccagccggtcaccgatctcgccggcggtgatcgacccggattccagcagcaggcgcacgatggcgcggcgggtgtgaccatccggcacagccgcgcccgccgcgcccacggcagcgtcatcgaggctggttcggattttcacaacaccagtgtgacgcaattccggggatcggtctagcaagggtgccctgggtggacggttgccctggtcacaccggataggctgcactgatggcagcccgccaccacacgctgagctcgtcgatcgcgagtctgcacggcgacgagcaggcagtgggctcgccgctgaacgataccgagctcaccgcgctgcgctgcacccggctgttcggcgccagcggcaccatgctgatggcgatcggcgcgctgggcgccggggcccggcccgtggtgcaggaccccacattcggcgtgcggctgctgaacctgccgtcgcgcatccagaccgtgtcgctgaccatgaccaccaccggcgcggtgatgatggcgctggcctggctgatgctcggccggttcgcgctgggcacccgccggatgtcgcgcggcgacctcgaccgcaccctgctgctgtgggtgctgccgctgctgatcgccccacccatgtacagcaaggacgtctactcctatctggcgcagagccagatctcgctggaggggctcgacccgtaccgggtcggcccggcctccgggctggggctgtcgcacatcttcacgctgtcggtgcccacgctgtggcgcgagacgcccgccccgtacggcccgctgttcctgtggatcgggcggggcatctcggcgatcaccggggagaacatcgtcgccgcggtgctgtgtcaccggctggtcgagctgatcggggtggggctgatcgtgtgggcgacgccccgcctggcccggcgctgcggcgtcgccgaggtgagcgcgctgtggctgggcgcggccaacccgctgctgatcatgcacctggtggccggcgtgcacaacgaggcgctgatgctcgggctgatgctggccggggccgaattcgcgctgcgcggaatcgattccgcgcggctactgccgcactcgctgcggcccggcccggactgggagccgctgggcatgctgctggccggcgccgtgctgatcacgctgtcgtcgcaggtgaagctgccgtcgctgctggcactgggcttcgtcacgatggcgctggcctaccggtgcgggggcaacctgcgcgcgctgctgctggccggcggcggcatggcggcgctgtcgctggcggtgatggcgctggtcggctgggccagcgggctcgggttcggctggatctacacgctgggcaccgccaacgtggtgcgcagctggatgtcgccgccgacgctgctggcgctgggcaccgggcaggtcggcatcctgctgggcctgggcgatcacaccaccgcggtgctggggctgacccgcgcgatcggtgtgctgatcatcacggtcatggtgggctggctgctgctggccgtgttccgcggccggctgcacccgatcggcgggctgggcgtcgcgctgggcgtcaccgtgctgctgtttcccgtcgtgcagccctggtatctgctgtgggcgatcatcccgctggccgcctgggcgacccgcaccggtttccgggtggccgccatcgtgatcagcctggtggtcggcatcttcggccccaccgccaacggcgaccggttcgccctgttccagatcgtcgacgccaccctggccagcaccgtcatcgtggcggtgctgatcgcgctgacctacacccggctgccgtggcggccgctgccggcgccgcagcgggcgcccgacggcgaaccggtgatcgacccggtggcccccgcgcggtccccgtcgaccccccggccggcgccggcgcatgacgcctacgctgattccacgtgagcgcggacgttcctgaaacggtcgtgcggctgcgcggggtcagcaagcactacggatccaccacggcggtccgcgatctcgacctcgaggtgcacgccgccgaggtgctggcgctgctcggccccaacggggcgggcaagaccacgacggtcgagatgtgcgagggcttcgtgcgcccggacgccggcaccctcgaggtgctcggcctggacccgatcgccgacaacgcccggctgcggccgcggatcggggtgatgctgcagggcggcggcggctatcccgcggcccgcgccggcgaaatgctcaacctggtggccgcctacgccgccgacccgctggacccggcctggctgctggacacgctgggcctgaccgacgccgcccgcaccacctatcggcgactctccggcggccagcagcagcggctggcgctggcctgtgcgctggtcgggcggcccgagctggtgttcctcgacgagcccaccgcgggcatggacgcacacgcccggctgctggtgtgggaactgatcgacgcgctgcgccgcgacggggtgaccgtggtgctgaccacgcatcaactcaaggaagccgaggagctggccgaccggctggtgatcatcgaccacggggcgacggtggccgcgggcacgcccgcggagttgatgcgcagcggagccaaggaccagttgcggttcagcgcaccgccgcggctggacctgtcgctgctgagcgccgccctgcccgaggactacaaggccaccgagctgacaccgggcgagtatctggtcgagggcccggtcgacccccaggtgctggccacggtcacggcgtggtgcgcccggatcgacgtgctggccaccgacatgcgcgtcgaacaacgcagcctcgaggatgtgttcctcgacctcaccggcagaaagctacggcagtgactgattccggcgtcttccccgtgggcaccttcacccccaacccgcgacccagtgcggtgccgaaaatgcttgccgcgcaatacggtttggagctcaagctgttgctgcgcaacggcgagcagctgctgctgaccatgttcatcccgatcacactgctggtggggctcaccctgttgccgctgggctcgttcggccagcaccgcgccgccaccttcaccccggtcatcatggcgctggccgtgatctccaccacgttcaccgggcaggccatcgcggtggccttcgaccgccgctacggcgcgctgaaacgccttggggcgacaccacttcccgtgtggggcatcatcgcgggcaagtcgctggccgtcgtcacggtggtgttcttgcaggcaatcctgttgggggccatcggttttgcgctgggatggcggccggcgttggccgcgctggcgctgggtgcggcggtgatcgcgctgggcaccgcggtgttcgcggccctggggctgctgctcggcgggacgctgcgggccgagatcgtgctcgcgctggccaacctgatgtggttcgtcttcgccggcctgggcgcgttgaccgtggacagcggagtgatcccggccggcgtcaaatgggcggcccggttgacgccctcgggcgcgctcaccgaggcgctctcccgggcgatgaccctgtcggcggactggttcgggatggccgtgctggtcgcgtggggggcgctcggcgcgctgggggcgctgcgctggttccgcttcacctgacggcccgggtgccgctcgccctgcccgggtgcccggggcacgacacgtacatggtggcgaagacacgccgacgcccgtgtgcgtggtttaaaactcgtggacccggcgggcttactacgggctgtagttttcggtcgcataccatcgggcaatgctcggacgaacgctgctgcggttggtggacctgctgcccaatcccagcgtgggcgtccagcgcctgatcgccgtggccgtcatcctgacccagggcggaatcgccatcaccggcgcgatcgtccgcgtcaccgcctcgggcctgggctgccccacctggccgcaatgcttcccgggcagcttcgtcccggtgccgcacgccgaggtgccacgcatccaccaggccgtcgaattcggcaaccggatgatcaccttcgcggtcgtcgtcgccgcggcgctggccgtactggcggtgacccgggcgcggcgacggcccgaggtgctcgtctacgcctggctgatgccggtgtccaccgtcgtgcaggcggtcatcggcggcatcaccgtgcgcaccgggctgctctggtggacggtggccatccacctgctgacctcgatgacgatggtgtggctgtcggtgctgctgtacgtgaagatcggcgaacccgacgacggggtggatcagccgcgggtgcccaccccgctgcgggtgctcacggcgctgtccggcgtcaacctggccgcggtgctggtcaccggcacgctggtgacggccgccgggccgcacgccggtgaccgcagcccgacccggacggtgccgcggctcaaggtgcaggtcgacaccctggtgcacctgcactcctcgctgctggtcgcctacctggcgctgatcgtcgggctgggtttcgggctgctggccgtgcgcgccgcgcggcccatcctgctgcggctcggcgtgctgctggtgctgctgtgcgcgcaggccgccgtcggcaccgcgcagtactacacgggggtgcccgccgcgctggtggccgtgcacgtggcgggggcggccgcgtgcaccgcggccaccgccgcgctatgggcgtcgatgcgacagcgggcccaggccgagccgctcacaggctgactcgaccgccagcgcgaaccggcgctgcgcggcctcgcggcccggggtgtcgaggtgtcgccagcccagttccggcgcgaccaggtccagccgcaccagccggtccccggccaggtcggcgcgcgcgaacagcaactccggcacgccgatcccggtatggtcggcggccacggcgagcgcggcgtggccgaggtcccaggactcgaattccggctcggccggccaggcgtgcgactgcgcgccgcccaggaagatcaacgatgtgtcgggctgagcgcccggccgcgtcggcacgccgccgtcgcgcaggtcgcgcagataatgcgcgtcgaggttccacgccagcgccgcgggcgggttgagcaggtgccgggggcggcgggtccaggccaggaactcgtcgcgccgcgcggcatccgggccgacccgcacgatcaccaggtcggcctgcagcgtctcggggtcctcccagggcagccggcgtgcatgcaggccacgccggcgcagcgcggacaccagcccgggatcgtcgcggcgacccgccagcacgatgcggggatggaagacgtccggacgggcgagtttcatgcccgggcatgataagcacatgcacgcaatcgaagtcagcgaaaccggcggccccgaggtgctgcgctacgtcgaaacccccacacccaccgccgggccggggcaggtgctgatcaaggccgaggccatcggcgtcaactacatcgacacctatttccgctccgggcagtacccgcgcgagctgccgttcatcatcggccaggaactgtgcggtaccgtcgccgccgccggtgacggcgtcgacggcttcaacgtcggggaccgggtggtcagtgccgcggcgacgggcggctacgccgaatatgcaacggccccagcatctttgaccgcacacgtgccggacggggtggccgccgacgtggcggcctcggcgctgctgaaggggctgaccgcgcactacctgctgaagtcggtgtatccggtgcaggccggcgacacggtgctggtgcacgccggcgccggcggggtcgggctgatcctgacgcagtgggcgcacctgctgggcgcgcgggtgatcaccacggtgtcaacgccggagaaggcgcgccggtcggcgcaggcgggcgccgacgaggtgctctcctaccccgacgacgccgacgaattcggcagccggatccgcgcgttgaccgacggcgccggggtggccgcggtgtacgacggcgtgggcgcgagcacgttcgacgccagcctggccagcctggcggtgcggggcaccctggcgctgttcggggcggccagcggcccggttccgccgttcgatccgcaacgcctcaacgccgccggctcggtgttcctgacccggccgtcgctggcgcacttcatccgcaccggccaggaattcagttggcgcgcagaggaattgttcgcggcgatcgccgccggcgacatcaccgtcgaagtgggcggacgctatccgttggccgacgcggcccgcgcccaccgcgacctgcagggccgcaaaaccaccggctcgatcgtgctgctcccctaggcatttcactcaggccacatgggccacggcgcgaggacgatggacgaagtgcccgcctttgagcgacaaccgttgaggcgagccgattgtcgctgcgaggcgggcacacgcggtccacttccgcgcagggacgggcgtgacggatgtgacgcgggaccgggcccggcgccaacaactcagaacaggtgcggcaacccgatcgccgagtcgatcgccagcgcgcagaacaccaccgccaggtagttgttcgactgcaggaacaaccgcagcggcttgaccggctcgccggcgcgcaccccggcatagagctggtgggccatcgccaggaaccacaccccggccaccagggcgaccgccgcgtacagccagcccgtggccagcgccagcgccagcgtggccagcaccgtcagccaggtgtagaccacgatctgcttggtcacctgacgctcggtcgccacggccggcagcatcgggacgcctgccgccttgtagtcgtccttgtaccgcatcgccagcgcccaggtgtgcggcggcgtccagaagaagatgatggcgaacatcaccagcgccggccactgaatcgtgccggtgaccgccgaccagccgatcatcaccggcatgcagccggccgcgccgccccacaccacgttctgcgaggtgcgccgcttgagcagcagtgtgtaaatgaacacgtaaaacgcgatcgtcgccagcgccagcagccccgacagcagattcgtcgtccaccacagccacaagaacgagccggccgtcagcaccagcccgaacaccagggcgttgcgggtcggcaccgccgcccgggccagcggccggcgtgcggtgcgcttcatcaccttgtcgatatccgcgtcggccacgcagttcagcgcgttggcgccgcccgcggccagcatcccgccgatcagcgtgttgacgatcaacagcgggttcacggtgccgcgctgggcgagcagcatcgccggaatcgcggtcaccagcagcagttcgatgacccgcggcttggtcagcgccagatacgccagcacggtgcctggtatccggcttggcgtttggctcggcgcgacgcgcccgcgaacgctcacgcaataactccttggggtcgcagcggcgcgcagcatctactacacacgatggtagaccgggtggcggcgatgccgggcccgtgggtcccttcccggccgacttttcccggattcccgaactgaatgttaaggcctgacgacgggcgcgtaattttcactcctaccggccgcgggtacccgaaaacctgcactgcaccagccggccctcccgcactagggtgggattgatcagctcgatgacccaaggactgagtctgtgacgacacttgaagagatctctgcgctgacccaaccgcaccttcccgacgactggtccgagctggactcggccgccgtcgacaccattcgggtgctggccgccgacgcggtgcaaaaggtgggcaacggacatcccgggacggcgatgagcctggctcccctggcctacacgctgtttcagcgggtgatgcggcacgaccccagcgacacccactggctgggccgggaccggttcgtgctgtcggccgggcacagcagcctgacgctgtacctgcagctgtacctgggtggcttcggtctggagctgtccgacatcgagtcgctgcgcacctggggctccaagacgcccgggcacccggagttccggcacaccaagggtgtggagatcaccaccggcccgctgggccagggcctggcctccgcggtgggcatggcgatggcctcccgctacgagcgcgggctgttcgacccggacgccgccgccggcaccagcccgttcgaccacttcatctacgtgatcgcctccgacggcgacatcgaggagggcgtcacgtcggaggcctcgtcgctggcggccgtgcagcaactgggcaacctgatcgtgttctacgaccacaaccagatctccatcgaggacgacaccaacatcgccctgtgcgaggacaccgccgcccgctacgaggcctacggctggcacgtgcagcgcgtcgagggtggcgagaacgtcgtcgccatcgaggaggccatcgccgcggccaaggccgtcaccgaccggccgtcgttcatcgagctgcgcacgatcatcggctatccggcgcccaacgcgatgaacaccggcaaggcgcacggcgcggcgctgggcgaggaggaggtggccgcggtcaagaagatcctcggcttcgacccggacaaaacgttccaggtgcgcgacgaggtgatcgcccacacccgcaagctggtcgaccgcggccgggaggcacaccagaagtggcagaccgatttcgacgcctgggcgcagcgcgagcccgagcgcaaggcgctgctggagcggttgacggccgagaagctgcccgacgggtgggacgccgacctgccgcactgggaggcgggttccgacgcgatcgccacccgcaaggcctccggcgcggtgctcaacgccgtggcgccgaaactgcccgagctgtggggcggctcggccgacctggccgagagcaacctcaccaccatcaacaacgcggattcctttgggcccccgtcgatttccaccaaggagttcaccgcctcctggtatggccgggtgctgcatttcggtgtccgcgaacacgccatgggggcgatcctgtccggcatcgtgctgcacggcccgacccgcgcctacggcggcaccttcctgcagttctcggactacatgcgtccggcggtgcggctggcctcgctgatggacatcgacaccatctacgtgtggacgcacgattccatcgggctgggtgaggacgggccgacgcaccagccgatcgagcacctggcggcgttgcgcgccatccccaagctgtcggtggtgcgcccggccgacgccaacgagaccgcctacgcctggcgcaccatcctggcccgcggcaacggcagcggcccggtcggattggtcctgacccgccagggcctgccggtgctcgagggcaccgacgccgacggtgtcgcccgcggcggctacatcctgggctcggacggcgaggaggccggccaggagcccgacgtcatcctgatcgccaccggctcggaggtacagctggccgtcgaggcgcagaagttgttggcggacaaggacattgtggcgcgggtggtgtccatgccgtgcgtggaatggttcgagtcccagcccgacgactaccgcgacagtgtgctgccgccgtcggtgtcggcccgggtggccgtcgaggccggggtggcgcagagctggcacaagctggtcggcgacaccgggaagatcatctcgatcgagcactacggcgaatccgccgactacaaaacgttgttccgtgaattcggattcaccgccgaagccgtcgctgccgccgcggaagaagtcgtggacaactgaggaaagggtaattcacatgaccgctcagaaccctaacctcgcggcactgagcgccgcgggggtttccgtgtggctggacgacctgtcccgggaccggctgcggtcgggcaacctgcaagagctgatcgacaccaaatgcgttgtcggcgtgaccaccaacccgtcgatcttccagaaggcgttcgccgagggccacgcctacgacagccagatcgccgaactggccgcgcggggcgccgacgtcgacgccaccatccgcaccgtcaccaccgacgacgtgcgcaacgcctgtgacgtgttgacccgcgagtgggagaactccgacggtgtcgacggccgggtgtccatcgaggtggacccgcggctggccggcgacaccgacaagaccatcgcccaggccgtcgagttgtggaagatcgtcgaccggcccaacctgttcatcaagatcccggcgacccaggccgggctgccggccatcaccgccgttctggccgaagggatttcggtcaacgtcacgctgatcttctccgtcgagcggtaccgcgccgtgatggacgcctaccttgccggcatggagaaggcgcgcgaagccggccacgacctgtccaagatccattcggtggcttcgtttttcgtgtcccgggtggacaccgagatcgacaagcggctggagaagatcggcggcgagcgggcgctggcgctgcgcgggcaggccggcgtggccaacgcccggctggcctacgcggcctaccaggaggtgttcgagggcggccagcgctaccaggcgctcaaggccgacggggcccgcgtgcagcgcccgctgtgggcgtcgacgggggtgaagaacccggactactccgacaccctctacgtcaccgaactggtcgcccccaacacggtgaacaccatgccggagaagacgattgacgcggtcgccgatcacggcgtgatccgcggcgacaccgtcaccggcaccggcccggacgcccagcgggtgttcgacgaactggccgcggtcggcgtcgacctgccggacgtcttcgtggtgctggagaacgagggcgtggagaagttcgtggattcctggaccgagctgatggaggaaacgcagaagcagctgggctccgcctccaaatgagcccggctcgcaccgcgcagcaatggcataacccgttacgcgacaagcgcgacaagcggctcccgcgcatcgccgggccgtgcggaatggtgatcttcggcgtcaccggcgatctggcccgcaagaaggtcatgcccgccatctacgacctggccaaccgcgggctgctgccgcccagcttctcgctggtcggcttcgcccgaagggattggagcacccaggatttcggcaaggtggtatatgaggccgtcaaggagcactgccgcaccccgttccggcaggagaactgggatcggctggccgagggattccgtttcgtgccaggcgctttcgacgacgacgaggcgttcggccggctcgccgagacgctggacaaactcgacgccgagcggggcaccggcggtaatcacgccttctacctggccatcccgcccaagtccttccccgtcgtgtgcgaacaactgcacaagtccgggctggcccgcccgcagggcgaccgctggagccgagttgtcatcgagaagccgttcggccacgacctggagagcgcgcagagcctgaacaaggccgtcaacgccgtctttcccgaggagtcggtcttccgcatcgaccactacctgggcaaggagacggtccgcaacatcctggcgctgcggttcgccaaccagttgttcgacccgatctggaactcgcactacgtcgaccacgtgcagatcaccatggccgaggacatcggcctgggcgggcgggccggctactacgacggcatcggcgccgcgcgcgacgtcatccagaaccacctgatgcagctgctggcgctgaccgcgatggaagagccggtcagcttcagcccgttggcgctccaggccgagaagatcaaggtactctcggccacccacctcgcccacccgctcgacgagaccaccagccgcggccagtacaccgcgggctggcagggcggcgagaaggtggtcgggctgctcgacgaggagggcttcgccaaggactcgatcaccgagacgttcgccgccatcaccctcgaggtggacacccgccgctgggcgggggtgccgttctacctgcggaccggaaaacgcttgggccgcagggtgaccgagatagccctggtgttcaagcgcgcgccgcatctgccgttcgacgcgacgatgaccgatgagctgggcgccaacgccatggtgatccgggtgcagcccgacgagggtgtcacgctgcggttcggttccaaggtgccgggcaccgcgatggaggtccgcgacgtcaacatggacttctcctacgggtcggcgttcgccgaggaatcaccggaggcctacgagcagttgatcctcgacgtgctgctgggtgagccgtccctgttcccggtcaacgccgaagtcgaattggcttggcacatcctcgatcccgtgctcgacaactgggcgagcggcggcaggcccgagccctacgaggccggcacctggggcccggattcggcgttcgagatgctgcaccggacgggccgcgaatggcggcggccatgactcctggcgatgaggaggagtggcgcaattgataattgacatgccggacgccaccaccaccgcggtcaacaagaagctggacgaactgcgggaaagggtcggcgccgtcgccatgggccgggcgctgaccctgatcatcgctcccgacagcgaggagatcctcgaggagtcgctgaaggcggccaacgacgccagccatgaacaccccagccggatcatcgtcacgctgcggggcaacccgtatgccgacaaaccccgcctggacgcgcagctgcgcgccggcggcgacaccggcgccagcgaggtcgtggtgctgtggctgtctggggcgctgtccgggcacgccgccagcgtggtcaccccgttcctgctgcccgacatcccggtggtggtctggtggccggacgtggcgcccgcggttcccgcgcaggatccgttgggccggttggcgattcgccgcatcacggacgcgaccaacggggtcgacccgctggcggcgatcaagagccggctgcccggctacaccgcgggcgacaccgatctggcctgggcgcgcatcacctattggcgggcgttgctggccgcggccgtcgacttggcgccgcacgagccgatcgaatcggcgctggtgtcgggtttgaagaccgagccggcgctcgacgtcctggccggctggctggccagccgcatcgacggcccggtgcgccgggcggtgggcgagctcaaggtcgaactggcgcgcagcagcgaaaccatcgtgttgagccgcccgcaggagggccgcaccgccacgctgagccgcacgtcccgcccggatgccctacttccgttggcgcgcagggaaaccggcgagtgcctggccgaagacctgcgccggctggacgccgacgagatttatcaatcagcgctggaaggcatcgagaaagtgcaatacgtgtgagcacccgcatcgaaattttcccggacagccaggccctggtcaccgccgccgcggcgcgactggccgacaccatcgccgacgccgtggcagcccggggccgggcgctgatagtgctgaccggcggcggcaacggcatcgggctgctgaagtcgctggcggggcggccgatcgactggtcggccgtgcacctgttctggggcgacgaacgctacgttcccgaggacgacgacgagcgcaacgagaagcaggcgcgtgaggcgctgctgtcccatgtcgacattccgtccagccaggtgcacccgatgccggccagcgacggcgaattcggcagcgacctggccgcggcggcgctggcctacgagcagctgctggccgccaacgccgcgcccgggcagccggtcccgaatttcgatgtgcacctgctgggcatgggcccggaaggccacatcaattcgctgttcccggacacccccgcggtgctggagaccacccgcatggtggtgccggtcgaggactcccccaagccgcccccacagcgaatcacgttgacgctgcccgcgattgcgcgctcccgcgaggtgtggctgatggtgtcgggcgccggcaaggccgacgcggtggccgcggccatcaacggcgccgccccggtctcggtgcccgcggccggggcggtcgggctggacaccacgctgtggctgctcgaccgggaggccgccgccaagctgccgccgggcaccgccgtccagggttagccgcaccgtcggggcctgccgcggccctgggcgggtgataatgacgggcatggcagacagaaccgtgcgcgggggccaagagcgaagccggatcaagacgctcacccaggccgcgctgaacgccgacaaaacggtcgagcaggtcgaagacgtcctcgacggtttgagcagcacgctcaaagagctcagcagttccctcgcggcgctgaacgccacggtggagcggatggagaccggcctggaccacctggacggcaccctggccagcctggacgatctggccaagcggctgatcgtgctggtcgagccggtggaggcgatcgtcgcgcgggtcgacgacttggtgaaggtgggcgagacggtgatgtcgccgctgtcggtcaccgagcacgcggtgcgcggcctggtggatcggctgcgcaaccggaccgcacagtagccgcccggcgggacctcgatggccaccctgctgctgcatcatcccgacttcgccgcccaccggaccgcgcccggtcatccggagcgcccggaccggtaccgcgccgtggcggccgcgctgagccggcccgggttcgacgcgctggtgcgcgagacggccgagccggccgagttggcggccacgcgctacgtgcattccaaccgctacgtcgacgcgccggaagcggcgcggccgcaacacggttacgtctacctcgacggcggcgacaccatgatggagccctcgacctgggagacggcgctgcgcggggtgggcgccacgctgcaggccgtggaccgggtgctggccggtgacgtgcagaacgcgttcgtggcgtgccgtccgccggggcatcacgccgaaaccgaacgggccatgggcttctgcttgttcaacaacatcagcatcggcgcgcggcacgcccagcgcaagcacgggctgatgcgggtggccatcgtcgacttcgacgtccaccacggcaacggcacgcagcagatcttctactccgatcccagcgtgctgtacgcgtccacccaccagatgccgctgtttcccggcaccggcgcggcggccgaaaccggggtgggcaacatcttcaactctccgctggcgcccggggacggtggcgccgaattgcgggccgccttcaccgatcggtttgtgcctgcgctgcaagccttctcacccgagttgatcatcgtgtccgccggcttcaacgcccacgaacgcgatccgctcggctcactgaccatgacgaccgacgacttcggctgggtcacaagggaattgatgaagtcggcggaaaagctctgcgacggccggctggtggcggtgctggaaggcggttatgacctgcaggcccttgccgattccgtcaccgcgcatgtcggtgagctgctgaagggctgactcagctcgccttctggtgcatctcgggatagggcccgccgaccggtgtcgccgccgccaggacgttgtcgacggcggccaggtcggcatccgacagcgtgacgtcggccgcgcgggcgctctcctgcaggtagtgcaggtgctgggcacccacgatggcgacgtgcacacccggctgcgccagcacccgcgcgatcgccagctggctgatcgtcacccccaggtcggacgccaattcctgaagctgcgcaacgacttccaggttgcgcaggaagccgtcaccgctgaagatgtcgctcttggcgcgccaatcctgcggggcgaaccgggtgtccggcttgaccgtcccggtcagcaaaccgtgcgccagcgggccgtacaccatcaccccgatgtcgtgctcgcgggcatacggcagcagcgtctcctcgatgtcacgccggaacaggtgatacggcggctgcacgacctccaccggcagcgtggccgaaaactcctccacctgtgcggtgtcgtagttggacaccccgacatgccgaatcttgccctccgacaccaattccgcgagcgccccggcggtttcggcggccggcatccgggggtcgggccagtgcaccaggtacacgtcgatgtggtcgatgcccagcgcggtcaggctggactccacgcccttgcgcagccattgtgggctggcatcgcggaccagtccgccgtcggtggcgcgcaatccacccttggtggcgatcaccacctcgtcgcgtgcgcgggcgaggtcgtcgcgcaaagccttgcccagcaggcgttcagacgccccgaagccgtactgctgggcggtgtcgaagaagttgatcccgaggtcgcgggcgctgcggatcatggtgatcgcggcgtcctcgtctgcatggccccagtcactgcagaactcccaggtgccgaacgccaaccgggaaacctcgagccccgtcttgccgaatgtgatggtcttcaaatgccaacctcccccgttggtgtaggcgcccccggcgcgcgggcggcgcggccaactcaaccataacgacgccgcagcgcggtgacgcaacgccaacgctcagcgcgggaagtagcggctgtcgttgtcgacggcgtcgaaaatgtccagggcgtgctggaacggcccggacgtgatgcgctgatcggtggcatacgagtggtcgagttcgaacacggtgcacagcagcagcgcaagcagcaccgcgacggtgccggacaccacgacgtggccgacggtgctgcccagccgcaggaaaccggtgaaggcgaccagcaccaccgcgccgaagatcaggcccgcccacagcagcgggggtatgcgcggtttggtgccgacgatccgctcgttgcggtcggatgccagctcgctcagctggttgaggaattgctgattgatcggccgggcggcgatgttgggctgctggcggccgacggtgcgatacatccgggtgatcgctgcgcgggcgccctcgttgcgctgcttgttccactccggaccggccaccgcgccggcgtatttgcgcagcagctcctggatttcggtgcgttccggttccggcatggccacgctctggcggtacatggtggtcagcgccgacgcctcggcggacaccacgacctgggtggacgagaagtgctcccaggtggccaccaccgtgaagcccagcagcgcgccgtagacgaacccgacgacggtgagaaacgacgcgatcgccgggttctgttgcctgccctgcaacagccggcgtcccagccagatggcacccaccgcgaccccgatcgcggcggcgaccgcgcagaccagcagcagccacaggggaaggccgggtccgctcacgggtctccttggtcgaggtcgcgtcggctcagcgtatgcgcgaccgggccgccggggtgagcaattcgcgtgtcgtcagccgctgtttcgcagcgcgctggccagtccgttcatcgtcagcaggatgccgcgctgcaccagttcgtcgtcgtcgccgctgcggtagcggcgcagcagctccacctgcaggtggttgagcggctcgaggtaggggaagcggttgaacaccgaacgcgccagcgcggggttgtcggcgagcaggttgtcctggccggtgatcagcttgtgcatggcgatggtgcggcggtgctcgtcggcgatcttgccgaacacccgccgccgcagtgccgcgtcgtcgaccagctcggcgtactgcgcggccaggcccaggtcacttttggccagcacctgggccaggttcgacagcacgctgcggaagaacggccagcgacggtacaggtcgtgcaggatgtcgacccgctcggcccggctctgcgggccggccgcgatccactgctcgaacgccgaaccggtgccgtaccaaccgggcagcatcacccgggactgactccaggccagcacccagggaatggcgcgcaaatccgcgatggactcggtgggcttgcgtgaggtgggccggctgccgatgttcagcgagccgatctcgctgaccggggtggaggccatgaagtagtccacgaaacccggtgtctcgtgcaccaattcggcgtaggcgcgctgcgccagcactgccacctcgtcgagcacggcatacgcgggttcggcggtgtcgcccaggccctcgacgtcgagcagcgtcgactccagcgtggcggccaccaggctttccagattgcgttgcgccacttggggttcggcgtatttggcggcgatcacctcgccctgctcggtgagccgcagcgagccgttcaccgcgccggggggctgcgccaggatcgcttcgtagctcggtccgccgccgcgcccgacggtgccgccgcgaccgtggaagagccgcaaccggattccgattttgcgggccacctcgaccagcgccagctcggcgcggtacaccgcccagctcgacgccaggtacccgccgtccttgttggagtcggagtagcccagcatcacctcctggctctgtccgcgggcggccaccaacgcccggtacagcgggagctcgagcatcgcgtgcaggatcgccgcgccgttgtgcaggtcctcgatggtctcgagcagcggtgagatgcccaccgggcaatagggttcggggcccgacgcgtcgatcagccccgcctctttgagcaggatcgcggcctcgagcacatcggagaccgagcggcacatcgagatgacgtagttgggcacggcggccgggccgtaccgccggatggcgtgcgccgccgcgcgcaccacacccagctccttgtcggccagctcggacagttccgcgcggtccccgaccagcggccggcgggtgcccagctcggccgccagcagctccacccgctcgtcctcgggcagcgaccggtagtccgggtgcacgcccgcccaggccagcagctcggccaccacttcctcgtgcacgtcggagttctgccgcatgtccaggccacacaggtgaaacccgaagacccgcacgccttctcgcagcagggccaggcggtcgtcggccagcagcgcgctgccgtgcgcgcgcaacgacgcgtcgacggtgtcgaggtcggcccgcagttcggccggcgtggcgtacggcggcaaacccaggtccagctcgtgttgcggtcggcggtccaggatctcggcggcggtggcggtgagccggccgcggatcacccgcagcgcccgccggtacggctcgtcggcgcgggccttctcggcgcagtcctcggccagcgcggccagctcgggggtgaccgcgaccaggcgcgccgacatcgacagctcctgctcgcaggcggtcagctcggccaggtagtgcgccagcgcggtgtaggcggcgtcgccggtggcccggcgcaccacgtcggccgtcacgttggggttgccgtcgcggtcgccgccgatccaggagccgggtgccacgatcggctcgtcgagcaggtcggcgccgggccagcgggcccgcagcgcgttgcggacctcggcgttgacctgcgggatgaccttgaagaaggcggcggcgtagtagcgcagccccacctcgatctcgtcggtgatctgcaggcgggacagccggatcagcgcggtctgccacagcgtgaggacctggcggcgcagctccagctcgatgttgcggccgtcgtcggtttcggtgtgcccttcggcgtgcagccgcatcagctcggtgatccggtgctgggtgacgaagacggtgcgccgccgggtctcagtggggtgggcggtgatcaccggggacaccaccgcgccccgcagcgcctcggccaccatggccgaatccagttgtgcgcgatcgagtttggcgtaggtggcggccaggctgctgtcctgcggcggttcgccggcggcgacgtggatcgcccggcggcgctcccggtggatgtcctcggcgacgttggccagcagcgcgaagtggctgaaggcgcggatgaccgggatggcctggtggatgtcgatgcccgcgaacatccgggccagctcggcccggtcgatctcggagcgccgcacccggaacgattccacccgggcgcgttcgacgagctcgaacacctgctggccgttctgctcgcgcaccgtgtcgcccaggatggcgccgagcagccgaatgtcggcccgcatcggctcggtggcctcgcgccccaccagggtgcgctggacggcgccgatcggttccagcgtgccctcggatgcctcaaccatggaacccagtatcggtgccggcgccggcggccgcccgtcggcgcaatcgcggcgcccggggccgcccggaattgtcgcgcgggcgcccgcgttggttgacgacatgtccgccggaatcatcctcatggcccaccccgacgccgccaatctggtcgacgacgtgatcgcccaggcccgacgcgcccacgagttcggggtcgggcaggtgtggctggcccagcagcagagctatgacgcgatcgcgctggccgcgctcgtgggggccgcggtgcccgggctcggcgtcggcacgtcggtggtgccgatcaacccgcgtcacccgctgatcgtggcctcgttggcgcagacggcgcaggccgccgcgcacggcaacttcagcctcgggctggggctgggcgcggccgacctggaacgccggacgttcggcaccgaatggcccaacacgatcacgcggctgcgcgagcacctgaccatcctggggtcggtctttcacagcggcgccgtcgactttcacggcagcgaactgtccgccgcccccagctttccggtgcgggtccccggcggcaccccgatcccggtgtacgtggcagcgatgggacccaaggcgctgcaggtcaccggcgaactggccgacgggacgctgccctatctggcggggcctcggacgatcgaggagttcatcgtgccccggatcaccaaggcggccgccgaggcgggccgcccggcgccgcggatcatcgccgcggtgccggtgctgctgtccgacgacgtggagggcgcccgcgccgccgccgcgcagcagctgagcttctacgagaccatcccgtcgtatcgcaatgtgattgcccgagaaggactttccaatgctgttgagctcgccgcgatcgggccggaggagtcggtgctgcgccaggtgcgccgctatttcgacgccggagcaaccgatgtggtgctgagcccgttggaccgctcggcttccgtcgaccgcgaggcgctgtggcggctcaccgccgcgctgtgagccgcgcgggcagccggtcagcggtacttgatcagcagggccataccgatgatgcagaccagccaaatgccggtgatgaacagcgtcagccggtccaggttcttctccaccaccgtggacccggacaggctggactgcacgccgccaccgaacagcgtggacagcccgccacccttggcgcggtgcagcagcaccagcaacaccaccaggatgctggtgacgaccagggtgatctgcaaagccaactgcatgacggccagcctaccggggcgggctcgttctcacggcagcggcccgccggcggcgatggcggccagcgtggcgaactgctcgccgtccagcgacgcgccgcccaccaggccgccgtcgatgtcgtcctgggcgatcagctccccgacgttcttcgcgttcaccgagccgccgtagagcacccgcaccgagtcggcgatctgcgccgaggcgagtgacgccaactctttccggatcgccgcgcacacctcttgagcatcggacgcactggccacccgtccggttccaatcgcccacaccggctcgtaggcgatgacgaccttgccgatctgctcggcggacagcccggccagcgagccgcgcagctgctcctcgcagtggatgacgtggttgcccgcctcgcggacctcgaggtgctcgccaatgcagatgatcggggtcagctcgtgcttgagcgcggtcgcggccttggcggccaccagcgcgtcgtcctcgttgtggtaggtgcgccgctccgagtgcccgacgacgacgaacgtgcagcccagcttggccaggaaggcgccgctgatgtcgccggtgtaggcgcccgagtcgtgctgggacaggtcctgggcgccgtagctgagccgcagcttgtcgccgtcgaccagggtctgcacgctgcgcaggtcggtgaacggcggcagcaccgtgacgtccaccttgtcgtagtacttgtccggcagcgcgaacgcgatcttttgcaccagcgcgatggcctcgaagtggttgaggttcatcttccagttgccggcgatcagcggcttgcggctcacgcggcgcctcccgtcggttgcggacgtcccagcacctcgatgcccggaagtgccttgccctcaaggtattccagcgacgccccgccgccggtggaaatgtgcgagaagccgctctccgggatgcccagcgcgcgcaccgcggccgccgagtcgccgccgccgaccacggagaaggcgcccttgccggtcgccgcggcgatcgcttcggccagccccttggtgcccgcggcgaacgccgggaactcgaacacgcccatcgggccgttccagaagatcgtctcggcgttggacagcagcgcggtgaaccgcttgaccgatcccggcccgatgtccaggcccatcaggtcgtcggggatggcgtcggccggcacggtctgcggcgccgcgtcggcggcgaacctgtcggccgccacgatgtccaccggcagccgcagcacgtcgacgtaggtgtccagcagccggcggcaggtgtccaccatctcggtttccagcagcgacttgccaaccgaaaacccttgcgcggcaaggaaggtgaagcacatgccgccgccgatgacgatgctgtcggccttggtggccagcgactcgatgacgccgagcttgtcggacaccttggacccgccgagcaccaccgcgtaggggcgtttggtggagccggtcagctgctccagcacggcgatctcctcggccaccagcgtgccggcgtagtgcggcagcagcgtggcgacgtcgtacaccgaggcctgcttgcggtgcaccacgccgaaaccgtcggagacgaaagcgcctgtgggaccgaccaattcggccagctgccgggccagcgcgagccgctcggcgtcgtccttggacgtttcgcgggcgtcgaaccggatgttttccagcagcaggacgtcgccgtcggtcaacccctcggcgcgggccagggcgtcggtgcccaccacgtccgaggccagctgcacgtgccggcccagctgctcgccgagcgcggcggccaccggggccagcgacaacgccgggtccggcccgttcttgggacgcccgaggtgcgcggcgaccaccaccttggcgcccgcctcgaccagtgcgctcaacgtcggcaccgacgcggtgatgcggccggggtcggtgatccggccttgctcaccatcggagtccagcggcacgttcaggtccgaacgcaccagcacaccgcgtccggaaacaccttcggcgagaaggtctttgagattgtggacagccacggcttacagcgacttgccgaccagggcgaccaggtcgacgaggcggttggagtagccccactcgttgtcgtaccaggacaccaccttggcttggttgtcgatcaccttggtcagcccggagtcgaagatcgagctgtgcgggtcggtgacgatgtcgctggagacgatcggcgcgtcgtagtacttcaggatgcccttgagccggccttcggcggcggccttgaacgccgcgttgatgtcctcgacgctggccggcttcttcagctcggcggtcaggtcggtgaccgagccggtggggatcggcacccgcagcgcgtagccgtccagcttgcccttgaggttgggcatgaccagcccgatcgccttggccgcgccggtggaggtggggacgatgttcagcgcggcggcacgcgcccggcgcaggtccttgtgcggcccgtcctgcaggttctggtcctgggtgtaggcgtggatcgtggtcatcaggccgcggacgatgccgaactcgtcgtcgagcaccttggtcagcggcgccaggcagttggtggtgcacgacgcgttggagatgatgttctggctgccgtcgtacttgtcgtcgttgacgcccagcaccacggtgatgtcctcgtcggtggccggcgcggagatgatcaccttcttggcgccggcgtccaggtggcccttggccttggccgcgttggtgaacagcccggtggattcgacgacgacgtcgacgcccaggtcgccccagggcagcgcggccgggccctcgcgcacctccagcgccttgatcttggccgggcccaccacgatggtgtcctcgccctccaggctgacgtcgtagggcagccggcccaggatggagtcgaatttcagcaggtgagccagggtgctgttgtcggtgatgtcgttgaccgcgaccacctcgatgtcggcggtgccctgctcctgttgagccagcaaggcccggtagaagttgcgcccgattcgaccgaagccgttgatgcctacccggaccgtcacttgtctctcctccgtcttctttcctgtgtcggctgatttgcgctcgtcgccagcctagatcagtgccgcggccggttgccgctccggtatcgccccggtgacctcggccacagcctgcgcaagctagccgccgcggcggcgcagccagcccagcgcggcctcggcggcgtgatagccacacagcccgtggatgcccggtcccggcggcgtggactgcgaacacagatagacaccgggcacgccggtggcgtacgggctgaccgagacgcgcggccgcaggatgacctgcagcccgtcgttggcgccgccgaggatatcgccgccgatgtagttggcgttgtaggcggccaggtcggcggtgcccctcctgacggtggcgacgacgcggtcgcggaatccgggcgcgaaccgctcgatctggtcgacgacgagggcggtggcgtcgccggtgtagccgaacggcacgtgcgcgtaggcccagatcgggttgatgccgccggccgagcgggacgggtcggccaggtattgctgtcccaccaggacgaacgggcgcggcgccagcttgccctgcgcgcgttggcgttcggtgtcggcgatctcggcgaagctcccgcccaggtgcacgctgccggcccgggcgcagtgcgggttggtccacgggatgtcgccctcgacggcgaagtcgaccttgaacgccgaggagccctgccggtagcggcggtaggaccgcgcgatgcgccccggcatcagctcgccgtagagccgcagcgccgcggcgggggtcaggtcgagcatgacgatgtcggcgtccgggatgtcgcgccggtcgctgaccgtgacgccggtggcgacgtcgccgccgtgcgcgcgcagggcggcgaccagggcatggatgatcgagcccgatcccccttcggcgaccggccagccgtaccggtgcccgctggccaaaaacagcaggcccagcgaggcggtcagcggacggtccagccgggtgtagatgtgggcggcggcgccgccgaacagcgcccgggcctgctcggtgcgaaaccagcgggccagcacggtggccggcagcagcgcgcggggcccgaatcgggcgaggcgcaccggatggtgcgggacgcgcagcaccgggcgcatcaaatcgcttgccagctggtcgaatccggccgccaggtccccgagggcgcgccgccaccgggtggcgtcgggccccatgccggctgtcgtctgctcgatcgaccggtacagcacaccggcgctgccgtcgtcgagcggatgggcgcagtcgatctgcggccacttccacaccagcccgtagctcggcaggtcgatctccttccagaacggcgagccgacgccgaacgggtgggtggccgagcacaggtcgtggatgaccccgggcagcgtcagctcacccgaccgcgctcccccgccgggcgtctcgccggcctcgagcacctgcacctcgacgccgcggcgggccagctggatcgccgcggccagcccgttgggcccggccccgaccaccaccgccctagccatggacgtggacggggtattcgtcgccgggctcgggccagggctgccggctcagcatgctcgcgacgtcgacgtggcccgcttcgatcagcccggtcctggcgtcgacgatgcggtaggcctgcgtctggcgctggatgggttgggcttccaggatgatcacccgcacctcgccctcgtcgaagttgcagcggcgctgcacggcggccagcagctgttcgttgtgcaggtggccctcgccgaagttccagccgatcagcgggccggcgacgatctcgccgtcgcgcagcaggtagtcggcctcgtcggcaccgccgggcagggcgcgcggcaccagcccgcccagcgcccgcccgtgcgtgtgcatcgaccgccagcccatcaacttgtcgatcatcagttcggcggattgcggatcataaaggcgggcaagctgattgggaaccagcgccgacgccttggtgatgttggcctcgatcttgtcttcggcgcccctgcggaagcaccaggtgctggtggcccagttgcccgcgtagtagcgcatcgccggcaggaacgagatctgttgcgggaaaaggtttcccaggatcggcaccacggccagtgcggcgatcaggatgcccagcagcagcggtgagctcagcccggtggccgtgacgccggcgtagtgcccgaacaggtagaacagcgagaagatgaagaagacgttccactccagcgggactcccatcggaatggtggaggcgatgttgaggtggaacagcaccatgaaggcgatcaggaaccaggcccagcggtgtccgtcggcgacgaacaccagcaccagcgggaccaggaattcggcggtggtgccgccgacgtgggccatcaccttcgggatccaggacggccgcaggtcgtcgacggggtcgagatagagccggcgtttgaaccagttgaacgcccgggcgcgcagcagcgggctgttgctcatcatgaccgccaccacgtaggggaagtggtggttgagcttggaggtcgccgcgccccaccacagcgccagcatgatgatcttgaaggcggcgatctggtcggtgaagccgaaaaagaagaccagcagcgtcaatccgtagtgttcgccccgcgcggcgagaaagatcgtcttgtcccgcaaccccagcagtgccagcgcgacgatggccggcaccaccaggacgggatcgatcaggccgacgtcgccggccgcggtgaccggcccgccccgccccggcgacagcagagccgcgacgcccgagcccagcaccaccagatacagcgcgacgtcgacgacggtgcggctgtccccggcggtgaacgggaccttgtccggccacggcggcagccgaatcgtgttgggccgcaaccagtacaggaagccgccgaacggcggccagaaccgcgcggtcagcggccccgatccgcagcccaggcccaggatctcgaacagcagcgtgaagacgaccagcttctggtacacgatgggctgcgtccaccagtcggcgatgcgcccgagcccgcccaggcccggcgtcagcgagatcaccgcggccgcgccggcgatatagccggcgatcttgaacacgtagaacaggtacaccgcatacggggagccgaagccgtgctcgacccagtgccgggtcatgatctgccgccgggtcgaccgcggcaggccggtccaggtttgggggtcgacgtcgggaaactccggggtcatgaatcccatgggcggcctcgctcctctgcaccgaacagctggcccatcgaatgtatcggcaccgccgggcgggtgtgtcgattcggtgggtgccggccggggccgcgcccgcaattggtcggcgactggtggcccggcggtggccgggtggtggcgaaaagcgctgcgggagcggcggtttcaggcccgccgggcgaatcgccggcgcagcttgtcgatcaggccgtccaccgcctgccgatcctgctcggcgatgcgggtcaggcgccgcaatccggccaccgcgtcggcgtcgccttttgcctcggctttcgcgatcttctgccgatacccgtccaggcgctggtcgatcaggccgcgcctcccggtgagcaggcgcatgaagtagtcggcctgctgctggtccgcggtgtccggcacggtgtgcggctgggtgatcggcacggcgtccggcttggtggccggccggcgcccgcgccggtcgggggtgccggccgtgcggtgcggagcgctcgagcgcgcgcggcgctcgggggacagaccggctacatccatcgcattccgtttctccggggggtcactcggggcgtcgtaacagtaacctcccggccggggccgcgccacgcgccggaacgaaaaaggcgaaacaccatgacagcggcccgccgccggtcgctaccatcgagggactcgacgcggccccggcggcctcgggcgagcgtcaagggaggaacgtgaccgacagcgacaacgccgacggcggggacatcggcaaattcgaccccgtcctgacccagcgcctgatgacggtgatgcgcccggtcctcaaggcctacttccggtcggaggtgcacggcctcgagtcgttcccgcccggcggggcgctggtggtcggcaaccactccggcggcatgttcccgatggacgtgccgatcttttccgtgcacttctacgacaaatacggctacgaccggccgatctacacgctcagccacgacatcctgatgaccgggcccaccggggacttcttccggcgcaccggctacatccgggccaaccgggagaacgcggccgcggcgttgcggtccggcggcgtggtgatcgtgttccccggcggcgactacgacgcctaccgtcccaccctggccgagaacgtcatcgacttcgacggccggaaggggtacgtgcgcaccgcgatcgaggccggcgtgccgatcgtgccggcggtgtccatcggcgggcaggagacccagctgtacctgacccgcggcacctggctggccgagcggctgggcatcaaacgcctactgcgcagcgcgatcctgccggtgtcgttcggcttcccgttcgggctgagcgcggtcatcccgcccaacctgccgctgccggccaagatcgtgacccgggtgctcgaccccatcgacatcgccaagcagttcggcgaggacccggacgtcgacgaggtcgacgagtacgtgcgctcggtgatgcagcaggcgctgaacgagctcgccgccgagcgccggttcccgatcctgggctgagccatgccgaatcctgtgcgcgagaccctgggcctgatcgccaccatgcgccgcgcccggctgctcgcacccatgcggccggaccgctatctgcggatcgccgcggccatgcgccgcgagggcatgggcatgacgtccggattcgccgccgccgcgcaacgctgcccggaccggcccgggctggtcgacgagcggggcagcctgacctggcggcagctcgacgagcggtgcgacgcgctggccgccgcgctgcaggcgctgcagtccggtgcgccggcggtgatcgggatcatgtgccgcaatcaccgcggcttcgtcgaggcgctggtggccgccgaccggatcggcgcggacatcgtgttgctcaacacctcgttcgccgggcccgcgctggccgacgtgatcacccgcgagggtgtgaacgccgtcatctacgacgaggagttcaccgcgacggtggaccgcgcgctggccggcaggcccgacgcgatccgcatcgtggcgtggaccgacaccgagcaccagcacaccgtcgacaagctgatcgcttcgaaggccggggcgcggcccatccgcaccggacgcaagggcaagatgattctgctcacctccggtaccaccggaactcccaagggcgccaagcaatccggcggcaacgccggcatcggcacgctcaaggcgatcctggaccgcacgccgtggcgggccgaggagcccgtcgtgatcgtggcgccgatgtttcacgcctggggcttttcccaactgctgctggccgcgtcgttcgcctgcccggtgatcacccggcgcaaattcgacccggaggccaccctggacctgatcgaccggcaccgggccaccggcctggtggtggtgccggtgatgttcgaccggatcatggatctgcccgccgaggtgcgccgccgttacgagtgccggtcgctgcgcttcgcggcggcctcggggtcgcggatgcgtcccgacgtcgtcgtcgcgttcatggacgagttcggcgacgtgatctacaacaactacaacgccaccgaggccggcatgatcgccaccgccaccccggccgacctgcgggccgcccccgacaccgccggccggcccgccggcggcaccgaaatccggatcctggacccggaattcaacgagctgcccgccggcgaagtgggcaccatctacgtccgcaacaacacccagttcgacggctacacctcgggcagcagcaaggacttccacgaaggcttcatgtcctcgggcgacctcgggtacctggactccgcgggccggttgttcgtggtcggccgcgacgacgagatgatcgtctccggcggcgagaacgtctacccgatcgaggtggagaagacgttggcgacacatcccgacgtggccgaggcggcggtgatcggcgtggacgacgaacagtacgggcagcggctggcggcgttcgtggtgctggcaccggaggcgcggacgacgcccgaggcgctcaagcaacacgtgcgcgacaacctggccaactacaaggtgccccgcgaaatttcggtcctcgacgagctgccccgcagcagcaccggcaagatcctgcgcgccgatttgcgggcccgggtgggcggctgatgcggctgatgcgaacgctccgcaagccccggccgctggcgcgcgccacactggaattggccaacgccgccaatggatttcggccattggcccgcaagggctacagcaccgtgctggtcttctggttcggctggccggcctccgaggtcccgggcatctacttctccgcctcgctgctcgatgcgctgcggcgcgggcgccgaggcgacttcgccggccggcgcggtaaggcggcgctggccctgaccgcggcgtcctgggcgatcctgggcgtgatcaagtatcggggcatcaccaccgcgggcccggtgctggaggcggggttgcgcgaccaactcggtgacgactacaccgaggcgctgaacaagctcccccagtcccgcccgacccgcagcgggcggcgcaccctgccgctcggcaacattgtggcccggcggcgctacgtcgagaagacgaacgtggtgtcctacggtccgcacggccgcgccaacctggccgacatctggcggcgccgtgacctgccgcgcgacggcaaggccccggtgctgctgcaggtgcccggcggtgcctgggcgatcggaatgcgccggccgcaggcctatccgctgatgagccatttggccgcccgcggttgggtgtgcgtgtcgatcggctaccgggtgtcgccgcggcacacctggcccgaccacatcgtcgacgtcaagcgtgcgctggcctgggtcaaggagaacatcgcccgctacggtggtgatccgaatttcgtggcaatcaccggcgggtcggccggcgggcatctgtgttcgctggcggcgctgacccccaacgacccgaagtaccagcccggcttcgaggatgccgacacctcggtggtggccgcggtgccggtgtacggccgctacgactggttcaccaccgaaggcgaggggcggcgcgaattcgtccagctgctcgaaaagttcgtcgtcaaaaagaaattcgccacccaccgcgacatctacgtcgacgcctcgccgatccggcggctgcgggccgacgcgccgccgttcttcgtcctgcacggccgcgacgattccctgatcccggtcggcgaagcgcaggagttcgtcgaggagctgcgcgcggtgtcgaagtcgccggtcgcctacgccgaattgccgcacgcccaacacgctttcgacatcttcagctcgccgcgggcgcatcggtccgccgaggccgtggcgcggtttttgtcctgggtgtacgcgacaaatccgcccgagcgcgactgagtctcgtcgccggggcatcgcacttgtcgccggcccggctttctctggggctcgagcgtcacgccagagtggctcccgggctcgagcgtcacgctggcgtgacgcccgggggtgtggacaggcaggccgtactgaactgtcgttcgttgcggtttatgcgacgctgccgcgatggtggagccattcatcggcagtgaggccgtcgcggacggagaagtagtcaagagcgcgttgcgaacgcgctacaagagattgttccgcgatgtgtatatccatcctggcgccgaactctcggcgctgactcgcgcccgcgcaggatggctgtggtcgcgtcggcgcggcgtcatcgctggccgtcggctgccgccgttcacggcgcccggtgggtggacgcgacggcaccgctggagattctgcatagcaacagaaacccgttgccgggattgcggattcacagtgaccgccttgaaagcgacgaatacgccctgatcgacggtgttcccgtgacgacgccggcccggacggctgtcgacctgggatgctggcatccggtcaacgacgcggtggccgtgatcgacgacctgcttcgcgcaaccgactgcaaggtagcggagtgtcagctgctcgccgatcggtatccgggccgacgcggcatgcagtcggcgcgcgcggcgattgggctcgcggatgcgggcgcgcagtcgccaaaggaaacgtggttgcgactgttgctgattcgggcggggcttccccgaccacaaacgcagatcccggtcagtgaggagtttggcggcgtgacgtactacctcgacatgggttgggaggatttcatggtcgctgccgagtacgacggtgagcaacatcgccgggaccgctggcaatacacgtgggacatcaggcgccgcgaaacgctcgagcgcctgggctggatcgtcattcaagtggtcgctggggatcgccccgccgacattgtcagccgggtcagcgccgccttggcccggcgcggcgtcacgctggcgtgacgctcgcttgcggcggtcacgctagcgtgacgctcgccgaagagacttcagctcgctgaagcagactcgcgctcagccggtctcgcccgcggcggccttctccagatcggtcagggccggctcgatccgatcggccatgtcgtcgatgtcattggccacctcgggggtggtgacgaaaccgaagtccaggtagtcggtgtaggagaagcaggtgatgttcagcgcgacgtccatgaccggcggccccagcgagtccagcttggcgccggccatgtacaacgggaacggcgggccgggcacgttggacacaaccaggttgatgggagccaggtttcgcgacaacccgctggccgtgtaggcccgcgcggccaggtgcaacagccccggcggggtggtctccgtcagccccatgatctggtgcgccgacaacgccttggccatcagcttggcgctctgcgtgctgtcgtggatggcccgcagccgctcgccgggatcctcgatgtgggtggccaacgacaccgtcatcgagctgaccttgttgccgatgtcgtccttgttctcgtcggtgcgggtggagaccgggatctgcgcgatgagcggcttggccggcagctcaccgcgcttctgcagatagtcgcggacggcgccggccaccagggccagcaccacgtcgttgagcttgacgtcgtaggcgtccttgatcgccttggcgcgggccagttccacccggcagccggtgacccggcggtgcggcgaaaccggcgcattgaagcgggttttcggcgcttcgaagtagcgtggcggccggctgcgcacgccgagcgtggcaacctgctggcgcacggtctgctccagcagccgcgcgatgcggaacggcgtcttgacgccgacgttgatcagcgcccccaccgcgcgccgctccagcccgggcagctggaacccgaccagcgatcccaccgtctcctgttgcggcggccggggttccggcgtggcgtccaacaggatctcgcccagcccggcgccggagacaccgtcgacgatggcgtgatgcatcttggtgagcgtcgcgaaccggccgcccgcgttgccgtccaggccctcgatcacccacatctcccacaacggccgcgagcgatccagcttgtaggacatcaaccggcccaccagctcctcgagctcgcggcgaccgcccggagccggaacaccgatgcggcggaggtggaaatcgacgtccagctcctcgtcttcgacgaaccacggccggtccagtcccagcggcgcgccggtgacccgccatcgcaactgcggcacctccggcagtcgctcgatcagtaattgacggagtcgttcaaagctgtactccgcggaccctttcgggtcgcagatcgccaacgcccccacatgcatatgccagccggcggtttccgccgaccaaaacgccgcatcgacactcgaaagccgtttcatcacccgaccgtagccccccaacccccgtcgcgaccagcaatggcaaacaaactacccgccgcctcggcgccggaagcgtccacatggccagcggtccgacgcggctaccggcgggcacccgtctgcgtcggtagcggtagcgggcgggtggctcactggctccgatcgaggggagccgccggcgaattcggcgacgccgggctcggcaccgatctggtccacgcccgtgggaccgacaagatcccgatcgccgcgccccgcccgacgctcacccggagcgccgcggaattcgtgccgccgcccccgcccggccgcggcgagcacatcaccgcggccctgcccagcgcggcggccttattgagggcactgaggtggttgagcgcgaagtccagcggcgccgacaacgaactcaacctggacagcgcccccgtcgccgacagcaaagacgtatcgaaggtggccagcggcgagacggacagcgcgccgagcgcgtcggagatggtcgagatcacttgtcggccagtcgttatgacctccggtgcggcggtcagagcccagttgcgcgacggtgaggtgaccccggcgggcgcggggtcggcggcgggtggcggcgaatcgaacggtgtcagcttccagacgccggccgaggcgcgggcgtaggcatacatggcggcggcgtcttgcgcccacatccgttcgtagtcggcgtcggcatcggcgaccgccgggctgagctgacccagacagttcgcctcggccagcgagatccgccgcagccggttggcagcgatcacatggggtgctaccaccgccgcgagcgccaagccgtaggcacccgcggccgccgtggcctgggtggccgtctgccgggcccgcgcggcggtggcgtccagccacgccagatagggcgcgacggcctgggtgatcgcggtggtcgacgcgcgctggtctcccagttccagctccgcgatcaccgcccggtaggtcagcgccgtgtccgcgagttgggcgcccagcacaccccaggccttggcggcgtccatcagcgatccggcgccggggcccgaatgcatccgccccgaattgctttccggcgcacgggtgccgaaatccatcactggccccagctcaagggcaggcgtttggtgctgcaacatcaggcttttcttttcaacggtgatggatacgccgcggcagtgggtgttgatcagccgccgcccttaccggcctcggcggactcgagttgacgtgggcagtacgacttcgccgatatcgtcgcgaactgggcggcgccgttggtggtcagtgcggggttgttgtcccgcaggtcgttgaggagttgaagaccggagacgccgcgagcgagcaagccgcacaccgcttttccggcgctcacggcttggcccgggtcctgaaagctgatccccaccttgtgcagatcggcgatgaagacctcattgttgtcatcggtggccgcctcgtcctctcccgggacggcctgcgcgggtaccgcggtgacgatgcccagcgctacaccgagaagcgctagcagcaatttcatgcatcctccttcgatgctctatggcggtgtgcggcggcggcgcggaaaccgttgcgctatcccagtttcgatgcgggcgatccgaccgcgacttgctctccgtccgtcacgtgcacggcgtgcacgcccggcgtcgtcctgagcctggcgaccaggtcgtcgaggccggcctcgtcgacgttccagtgctgcacctgctcgggcatctcctgcagttgagcgatgatgcggtcgagcttgaccggtccctgccggcgctcgccggtgatcgcgcgggttgggatgcccgttgtgctgacgacgcgcgccgccgggctgcccagcgcgccgcccgccagactgcccagggtcgcctcgttcaccaggcccgagaaatccgtcgccgcggccgcggccaggctggtggccggcagcgcggtggaggccagcctgatcgccggggcggccgtcgcccagccggccggcaccgacagcttgcccactgtcggcgcattacccagcacggccgatacgggctttgccgcgatgccggaagcgatgtggccgggcgacgccagcccggcgcccaacgacgatttggccatcgcggcactccacggcgcatagatgaagaagttcttccactgcgagaccccaaggccgatggtggcattgacgacgttggtccacgtcgcctgagtgccgacctgcgaaatgctcgaatacagcgtctcccagaacggtgctatctccgtgctccccgtggcaccgccgatcaagttctgccagaactgggtgtattggccggtgagcgaggtgatgtaggcctctagctgtttcagccaggacgacagcgacgtcgactccgccgcggccgcggcggccgcctgggtcgccggtccggcgtcattggtggtggccggcgcctgctcgaacggcgtcagctcaccggccgattccgacgcggcggcatagctgaacatggcggcgacgtcttgggcccacatctggccgtactcgtcctcggtcgccgcgatcgccgcgtcgttctgccccaggatgttggtctgcaacagcgtggcgagcaggctgcggttcgccgccaccaccgccggcggcacggtggccgcgacggccgcctcgtaggccgcggccgcggcccgggcctgagcggcagtctgctcggccaggccggccgtggccgacagccacgccacgtagggcgccgccgcggcggccatggaccccgacgacgagccctgccacgattcgacgaccagttccgagatcaccgaggcgtaggaagccgcggtgccgtgcaattcggcggccagcccgtcccatgccgccgcggcggccagcagcggaacggcgcccgggccgacatggatctgggtggagatgacctccggtggcagcgtcgcgaaatcgctgaaaaccattgctgtatctcctatttcgcgttcggcggaatgacgatgacggtggacgtggtcgcgaggtcgtcgacggccacggcaccgggcacacgcacggtcgacccggcgacggcgcgggtcgcggtcccgccgaccgcgcgtccggccaggctcgacagggccgtcgggccgaacatgccctgctgaccgttgacggccatcgccggggcggcgtccagcatggtctccggcagctcggcggccaccgtccggaccgccgggaccgccgaggcccaattcgccggcaccgacaacgatccaaccaacccggcacggcccgccgacgccgaaaccgtgcccgcactcgacagcgcggtcgagcccgtcagcagatcgctgcgcagcagcggcgccaacaccccggtgagcgctttggggtgcaacaggggtccgattccttggatgcccgtccccacactcgggatgctgagcgcgatctggtaccagttcttcgccagattggccacgccgagcggcgtgtacggcccggagatggtgcccatgacgctgttgaaggtcttcagaatcccggtgatgtccgtcaggctcagcgggagttgagccgccgccgtcaccgcggtcgcgttcacctgcgccgcgacggggacttgcgaaacaccttgtgacagtgcggattccacgctggatgcggtcgacaactgcagcgcggaggcagccgcggccgattggtctgccgccgcgttggcgtcggcgctctgtggtggtgcgccgaacggggtgagccgggtcgcgaccgccgacgcgccggcataggcgtacatcgcggcggcgtcttgggcccacatctcggcgtagtgggcctccgtggccgcgatcgccggggtgttctggcccagcacgttggtcgcgatcagcgacgccaacaacgcccggttggcggcgatcaccggcggcgggacggtggccgcgaaaaccgagtcataggccgccgccgccgtggcctgggcggcggtctgctcggcctgcgccgcggtgccgccgagccaggcgatgaagggcgccgccgcggcggccatcgccgtcgacgaaggcccatgccacaaggtgcgcagctccgcgatcgccgaaccgtacgacgctgcggccgaatgcatttcggccgccagcccgtgccaggccgccgccgctgccagcaacggcgccgaccccggtcctgagtagatcctgcccgagttgatctccggcggtaacgacccgaaatccatgcattcctccgcctccggccgtgtcgccacgtccggcccgatccgtgccgccgccagcgcatcaccatgagtttgctgggcggcggtcatgtccgcgtgtagccgagacactagccaggggttacggaatcgcccttcgacacgatcggccggcatcgccggcgccgccgggccgcgccgcgagcgctgggagtcggcgcttcggcgaacaagtcgccgatatacctctttacctcgggcaaatccggcacggcgaggcggtgaatgggtgtcgcaaagccggagcgggcgttcctcgggcggctatcggtgaataaaaatctcgataccacaaattgtgttggccgcggatttgtttagctaccgcacccgcacggcggcgcgcgaccgcccatcggaacgagcccgccagcgcgacgtcagcgggaaatgggtggtggagcaggtaatccgacgcggtgcagccgatatgcccgtgactcatatcgatttcaaagaaattatgtcatcgctatgaaatttgctacccaggagacgcgcctttaatcggcacttgaagggaacgtgccggggcgtggtgtaaatagtggcggcgtgtcggtactgatgtagagggccatcgcgtgagtctctgtggtgaaacgaccaaggatcactaccgagaggaacatcgcgatggccctggaccagtctgccttgctggaggtgctggacgcattacgcaatgccgatgccgctgatcggatcaagcaggccgccgagacgatttatcaggcactcatcgatgcggagctgacggcggtgatcggcgccggtccgcatgaacggagcgcatcacgaatcaaccagcgcaacgggtctcggccgcgcacactgtcgacgatcgctggcgatttggagttgcggattcccaagcttcggtcgggctcgttcttcccggcgctgctggagcggcgccgccgggtcgatcagtgcttgttcgcggtggtgatggaggcctatttgcacggcacctccacccgcaaagtcgacgatttggtcaaagccctcggcgcggacgccggcatctccaaaagcgaggtctcccggatttgcgccgatctggacaccgaggtaggcgcctttcgggaccggcctctatccgaacagcacttcccgtatgtgttcctcgacgccacttactgcaaggctcgggtcaaccatcgggtggtctcccaagcggtcgtcatcgccaccggtgtcgcggctgacggacgccgtgaagtgctcggcttcgacgtcggtgactccgaggacggcgcgttttggacggcgtttctgcgctcactgaaaacccgcggcctgtccggggtgcagctggtgatctctgatgcccacaccgggttgcgcagcgccatcgaggccatcctcatcggcgcatcttggcaacgatgccgggtgcacttcctgcgcaacgtgctcgcccaggtgcccaagggatcagccgagatggtcgccgcagcgatccgcaccatcttcgcccaacccgacgccgaacatgtgcgagagcaactcgacaccatcgccggcatgctcggccgccaactgcccaaggtcgaaacgatgctgcgcgaggccgccgacgacatcaccgcattcgccgatttccctgtcctgcactggaaaaagatctggagcaccaaccccctcgaacgactcaacaaggagatcaaacgccgcaccgacgtcgtcggcgtcttccccaaccccgccgcgctgctacggctggccggctccgttctcgtcgaagcccacgacgaatggcaagtcgccgaaaagcgctatctctccgagaccaccctggccctattacatccccgctccgattcagccgaccaatccgttgccgtccccgccgccatcacggcatagtggaaactcgcagagcctcaggcgaaacgccgatcggctttacaccacttcacggggcacaacccacttgaacggaccggcacgccaagttacgcgcgggaatttacccagtcagcacgctatcgaatacgccgacccatattcaattcatagaattcggcgcggcagggacacggcaggggcgaaagggtgactcgggacggcgtgcccgcggccacgcacgccgacattctcggcgaatcgggcgccgcgagcgagggcgccccacgactccgcgccgcgctccgggctttgccagcgcgacgacgcgccgtcggcgcgcatcgccaccgcgctaggcgtcctcgagcaggtccggcgtcaccgccgactcggtgtcgggaatgccctcgatcttggccttgcggtcggccatcgacaataaccgccgaatacggcccgccacagcgtctttcgtcatcggcgggtcggcgaggcggcccagctcctccagcgaggcctgccggtgctcgacgcgcagcttgccggccgaggccagatggtcgggcacggtgtcgccgaggatctccagcgcccgctccacccgggccgccgccgccaccgccgcccgcgccgagcggcgcaggttggcgtcgtcgaagttggccaaccggttggccgtcgcgcgcacctcgcgccgcatccggcgctcctcccagatgagccgggtgtcctgggcgcccatccgcgtcagcagcgcgccgatcgcctcgccgtcgcgcaccaccacccggtcggcgccgcgcacctcgcgggccttggcactgacccccagccggcgcgccgcgcccaccaacgccagcgcggcctccggcccggggcagctgacctccagcgccgacgagcggcccggctcggtcagcgacccgtgcgccaagaacgctccgcgccaggcggcttcggcgtcggcgatgctgccgcccaccacctgggcgggcagcccgcgcaccgggcggccccggttgtccaacaggccggtctggcgggccagcgcctcaccgtcgtttgccacccgcagcacgtaccgggtgctcttgcgaatcccgctggcggacaacacatgcacgaccgcgttgtagccgtagagctcgaaaatgtccttgcgcagccgccgcgccacgttgcccagatccacctcggcctcgaccacgacgcgaccgccgacgatgtgtaggccgccggcgaaccgcagcagggacgtgacctccgcccggcgcgcactgaccgatttcacgaccaggcggctcagttcgtccttgacttcggtcgtcatcgccacgcgtcgtcaccccttggtccgctgccggccggtccgttgccacctgccggtgggcttgcaccgtcaacccgaatatccgcggtggccgtgaccggggatgcgcccggggccttgcgggccgcccggaccccgtccagggccgccgcgagcttgcctggatcatgtaaaggtgtaccaggtctggccacgtcggcgaagtggacctcggccgaaagcagtgtggcggtgcggcgcaattgctcgcgttcccgctcgctgggcacccgttcggcgtcgatgatgatgtcgtgcacggtgaatcccggtgcgtgctggacgagtacgtgcagatgacgctcgacggagaagcccgccgtctcccccggctcggccaccaggttgagcaccagcgcgcggcgggcggtggtcgcccatagcgccgccgccagcccgggcaccatcacgtgcggaatgacgctggtgaaccacgagcccgggccgagcaccaccaggtcggcggccatgatggcgtcgacggcctgccgggtcgccggcgggttgtccggcagcagccgcacccgacgtaccttgccgggcgtggtcgcgatcgccacctgcccgcggatgacccggaacatccgcggatcggcctccaggcccgacacgtcggcctcgatctgcagcgcgatcgggcacatcggcagcacccggcccttgacgccgaggatgcggcccagctcgtcgagggcggccaccgggtcggccagcacctccgagagcccggccagcatcaggttgccgatcgggtgcccggccagcgcgccgctgccgccgaaccggtgctgcaggatggtcgcccacagtcggccgtgcgggctgtcagaagccaaggccgccaacgccattcgcagatcgcccggcggcaccacgcccagctcgctgcgcagccggcccgaagacccgccgtcgtcggcgacggtcaccacggcggtgacatagggggtgagccggcgggccgccgagagcgtcgcgtacaggccgtgtccgccgcccagcgcgacgatgccccggttgatcggctcgctcattcgcggcccagatcccggtgcaacacccgcaccgacagttgggcctcaccgtgctgggcctgcagccgttgcatcagcgcctcggcgatcgcgacgctgcgatgcttgccgccggtgcagccgatggcgaccgtcatgtagcgcttgccctcccggcggtagccgtcgacgaccagagacagcaaccgatggtaggcgtcgagaaactcggccgcgccgggctggcccaacacgtagtcgcgcacggcgggatcctgcccggtgcggggccgcaattcgtcgacccagtgcgggttcggcaggaagcgcacgtccatcaccatgtcggcgtccatcggcaggccgtacttgaagccgaacgactcgacggtgacgctgatggtcgcgttggcgccgccgccgaacgcccgctcgatggtctcgcgcagggcacgcaccgacagcgtcgaggtgtcgatgatcagatccgcggtggcccgcaccggcgccagcatccgccgctcggcggcgatgccctcggccagcgtctgatcgccctgcagcggatggctgcggcggttctgctcgtagcggcgcaccaacatgtcgtcggatgcttccatgaacaccacccgcggagcgatgttgcgggtggccagttcggtgcgcaccgagtccagatcgccggtgaaaccgcgcgaccgcacgtccatcaccaccgccagctgggtgatccgcgagccggcgtccatgcccaggtcgaccatccgggtgatcagctgcgggggcaggttgtcggccacataccagccgaggtcctcgagcaccttggccgcggtaccccgtccggcgccggacaatccggtcaccaggacgacgtcgatgccggccccgttttccaggtgcgcgtccaccggccggctccccgcgagctcacccgggcccgtcacggcgcggccttggactcgtcgggccgcaacgcctccaggacggcggtcgcggtggccaccccgatgccgggtacggcggtgatctggtcgacggtggcctccttgaggcgggctatcgatccgaaatggcttaccaacgccttgcggcgatgttctcccaatcctggcaccgaatccagcaccgatgccgtcattcgcttggatcgcttgctgcgatggtaggtgatggcgaaccggtgcgcctcgtcacggacgcgttgcagcaggtacaacccctcgctgttgcgcggcatgatgaccggatcgggctccgagggcacccacacctcttccagccgcttggccaggccgatcaccgcgacgtcggtgatgccgagctcctccagcaccgcgctggccgcattgacctgcggcgcgccgccgtcgaccacgtacaggttgggcgggtaggcgaaccggcgcgattttccttccggcgaaagcatattcgggtcgttctgctcgctcaggtgtcgcgcgaaccggcgccgggtcacctcggcgatggaggcgacgtcgtcggagcgcccctgcccggcggcttcccggatcgcgaagtggcggtagtccgatttgcgcggcaggccgtcctcgaacaccaccaacgaccccaccacgtcggtgccctgcacgtggctgatgtccacgcactcgatgcgtagcggcgcctcggacaggccgagggcctcctgaatgttctgcaacgcagccgatctggcgttgaagtcgccggcccgcttcagcttgtgttgctgcagagcctctttcgcgttgcgctgcacggtttcggcaagcgcccgcttgtcgccgcggcgcggcacccgcaacgccacccgcgacccgcgcaggccggacagccagctggtcagctcgtcggcgttggacggcaggcagggcaccagcacctcgcgcggcactgggttcaccgattcgtctgcggcgccacccaattcggcctgctcgccgtagaactgggtcaagaactgctccaccaactgttcctcgccggaatcgccggggtcggcggacttctccacgatccagccgcgctgaccgcgcacccggccgccccgcacatggaacacctgcaccgcggcctcgagttcgtcgtcggcgaaggccaccacgtcggcgtcggtgccgtcgccgagcaccacggcctgtttctccatcgcccgcttgagcgcgcccaggtcgtcgcgcagccgggcggcccgctcgaaatcgagttcggcggccgcggcgttcatctgctgttccagctcccgggcgaaccggtcggtcttgccggacaagaagtcgcagaagtcgtccacgatctggcggtgctgctcggcgctgacccggccgatgcacggcgccgagcacttgtcgatgtagccgagcaggcagggccggtcaatctgcttgtgccgcttgaacactcccgccgagcaggtgcgggccggaaacacccgggtgagcaggtccagcgtctcgcggatggcccaggcgtgcgagtacggcccgaaatagcgcacccccttgcggcgcgggccgcgatagaccatcagccgcgggaactcctcgttgagggtgacggccagcaccgggtaggacttgtcgtcgcggtagcggacgttgaagcgcgggtcgaattccttgatccagttgtattcgagctgcagcgcctcgacctcggtgttgaccaccgtccactcgaccttggccgcggtggtcaccatctgccgggtgcgcgggtgcaggttggcgacgtcggcgaagtaggacgtcagccggctgcgcaggctcttggccttgccgacgtagatgacccgcccgtgcggatcccggaatcggtacacgcccggctcgaccgggatggacccgggtgcggggcgataggtggcgggatctggcacagatccaggctagtagccggcggcgacgcggccggcacggtgcggcggccggtctactgtggggcataccgctcgccacgggcgactcgttgcgactgaggggttgggagggaattggccgtcgagtcctcgcttgcctggttgctgcggtcccttggggtcgacgccttcctgaacgagatctgggcgacccggcaccatcacatcgaccgatgccggcccggctacttcgacgggctgttgcccggaccctcggccgtcgacgggctgctggagcaggtgcggccggaccccgccgcggtgcggctggtcaaggacggcgaggaccgggatccggccggttaccgtcgcggcgacggcacgctgaacgccggcggcgcccgcgacggcctggccgacggttacaccctggtgctcaatgggctggagcggtatctgcgcacggtcgcctcgctgtcgcacgcgatcgaggtcgagctgaacttccccacccgggtcaacgcctacgtcactcccccgcactccaccgggttcgtcccgcactacgacccgcacgacgtgttggtgctgcagatcgagggctgcaagacgtggcgggtgtccgacgagccgcccgtgccaccgcagcagatccaaagccgcaagggcgtcggcgccgacggcccggcgtcgtggaccgatgtgtgcctgcgacccggcgacgtgctgtatctgccgcgcggccaagtgcattcggcccgaacacattccgagccgtcggtgcatctgaccgtggggctgcacgcaccgacggtgctcaccctcgtcaccagcgcgctgcacgcgctgagcctgcgcgatccccgggtgcacgaccggctgccgccgcgccatctggacgacgcacaggttcgcgccggcttgggcgaggcggtgcgcgacgcggtgcgggcgctggacgacgacgccgtcatcgccgacggtctcggcgcgatggaggaggtgttggtgcggcgcggccggtgcccaccggtcgggtcggtgcgcgacacggtcggggtggacggtcacacgctggtgcgcaaacaccagccgctgtatgcccgggtgatgcgcgccggcgacggcgtggtgctgcagttcgctcaactgtcggtgagcgccggatccgaccacgaggccgcgatgctgttcctggccggccgcgccgagccgttccgggtggccgagctgcccgggctgagcgccgcgcagcaggtcgggctggcgcagacgctgatcctgaacgggtttctggcccgactgtccgacgactgacagtcagcttcgcatttccggtgaatgcgccggaatctatccgtatctgcggatctactcgggttacgctccattacctacgggtcgcctcgttcgtcggggaggagcgcgtcatggcagcagggtccgccgcgggcaggcgccgatgaccatgccgatctgggccgccttcccgccggaggtgcattcggcggcgctgtccagcggacccggccccgggtcgttgctcgcggccgagcaggcctggcaggcgctgagcgccgaatacgcctcggccgccgccgaactcggcgatctgctggcggcggtgcaggccggcacctggcagggtcccagcgccgaggcgttcgtggccgcgcacgtgccatatctggcatggctgttgcagaacagcaccaacagcacggccgcggcccgggaggccgagacagtggccgcggcctacaccgccgcgctgtcggcgatgccgacgctggagcagctggccaccaaccacgccgtcttcgcgcagttggtggcgacgaacttctttggcgtcaatacgattccgatcgcgcagaacgagatcgagtatctgcagatgtggctgcaggcggccaccacgatggcgatctacgaggcggtgtcggagaccgcgatgacgtggaaaccgcccaccgcgccgccgccgcagatccagaaaaccggcgtcgccaaccaggacgccggcggcggccccacccagctgagctggtgggtgacgcgggtgcaggaggtggccagggccatcagcggcgacctgagccagtcgccgtcgaacccgtccgcgacgttgtcggacctgatgagcgatccgctgctggccaccgaggtgccgcactgggcgggcgagtcgctgctgtacttcaccccgcaggtgccgcagttgacccagctctcgttcggtctgatcgcgcccttcatccccgccgcgggggcgccgggggtggccgggctggccggactcgccgggttggccgggggcgcccccgcgcccgtcctgcccggggtggcggccgcgccctccggcggtggagccgctgccgtgctggcccccggcccgggcgcctccgccgcgaccgtgtcgccggccccggcgcccgcgggcatgccggccaccgcaccggccccggtcggaccacccacgccgccgccggccaccggcgttcccggcttcagcgccccgtacgcggtcggaccgcccggcctcgggggccggcggaaacctgtcggccgggacccgcgccggacagacgtcacccgatttcgcgacggcggcggcgccggccgcggcggaccggcgcgaacaggtccgccgccggcggcgcccgcggccgggtcggatcgaccccggataccgccacgaatacctcgacaccgaccccggcgggggccccgcgtccgtgaccgcctcggaccggggcgccggcccgatcgggttcgccggcaccaccggcgcgaccggttcggcacccgtggggttgaccacagtcgccggtgatgcgctggacgacggcccgcgaatgccgctgctgccaggcagctggagcgccgaaaccgaggatccggaaaacgggcaggtcgggggcggctgagcgggccgcggggcggggcggccggtttggccggcctcagttccggctaccaagcttctagctcaacgtagagtgggtgcgaagcgatggagggagtccgtaaatgatgaagcgctcgttggccaaactggccgtcaccgtcggcggcctggcattggcgtcgaccgctggggccggggtcgcgtcggccgaccccgattacggtccgatgatcaacaccacctgtagctacgaccaggcgatgcgcgcggtccacgcggaaaaccagatggccgcgcagtacctcgaccaatcgccgcccaaccagcagttcctgcagcagtatctggcgtcgtcgcccgatcagcgggtgaacctgctgcatgcgatcgagcacaaccagggcgcccagcaggcgctgccgatcttccagcagatgatgacggactgcacccggtactgagcgtccgctgacccggccccctgcgcggccgggtcagccctgcaggtcggggcgataacgcgccagcagtgaccgcacagtgtccatggcgtccacggcacggcccttgtcgacggcctggatggccatcaccgggatgtactcgtcgtcgggcaggtcgatgcgcgcccaccggtgacccaccgggaacgagacgccgacgacgtcgggccattcgatcagcttgtcgcccaacaggtttcggaccgacacaccggccggaccgatccgcagccggggccgcgcgaacaacagcaccacgccggcgatcaccaggcccaacaccgcgatggccacctggtcggaggtgcggaacaccacgccggtggatccgaccttgagcagcaggcccagggcgatgtgcgcagcggcgatgagaaccgctgccccgtagacgaataacggggtgcggtgcggacgcagcaccacatcccagcgttcgggttccggcggggtcacgaccgagcgcgcaactcacgcagggtgagcgcggcggacagcgccgccccggccgcctgcgaccccttgtcctcggccgattccggcagcccggcccggtccagcgcctgctgctcgttgtcggtggtcagcacgccgttggcgaccggcgtcgacgcgtccagcgaaacccgggtgatgccctgggtgacggcgtcgcagacgtactcgaaatgcggtgtctgcccgcggatcacgacgcccaacgcgacgaccgcgtcgtggttgcgggcgagttcctgtgcgaccaccgggatttcgatggcaccgagcacgcggaccaccgtggggttgtcgactcccgagtcggcggcgactttgcgggcaccggccagcagcgcgtcacagatccgactgtgccaggtgctcgccacgatgcccagccgcacgccggacgcgtcgagcgccggcatctccggcacgccggcggctggactcatgggcgccactcctcctcatcgcttcgctctgcatcgtcgccggcgcgactcacagggcgccgccgaattcgcctggcagatggaccgattcgtgaaaatcgtccaggccggccagatcgtggcccatcttatcgcgcttggtcatcaggtaacgaatgttctcggcgttggtgcgcaccggcagcggcacccgctcgatgatgtgcagaccgtagccgtccagccccacccgcttggcggggttgttggtcagcagccgcatcgaacgcacccccagatcgaccaggatctgcgcgccgattccgtaatcccttgcgtcagcaggcaatccgagtttgaggttggcgtcgacggtgtcctcgccggcgtcctgcagctggtaggcctgcagcttgtgcatcagcccgatgccgcggccctcgtgcccgcgcatgtacagcacgatgccgcgcccctcacgggccaccatggccatggcggcgtcgagctggggtccgcaatcgcaacggcgcgaaccgaacacgtcaccggtcaggcactccgagtgcacccgcaccagcacgtcgtcgccgtcggagttggggccggcgatctcgccgcgaaccagcgcgacgtgttcgacctcctcgtagatgctggtgtaaccgatggcgcgaaactcgccgtgccgagtcgggatccgggcctccgcgatgcgctcgatgtgcttctcgtgcttgcggcgccactcgatcaggtcggcgatggtgatcatggcgaggtcgtgttcgtcggcgaacacccgcagctcgtcggtctgcgccatcgagccctcgtccttctggctgacgatctcgcagatggcgccggccggctgcaggccggccatccgggccaggtccacggcggcctcggtgtgaccgggccggcgcagcacgccaccgtccttggcgcgcaacggaaccacatgaccgggccgggtgaaatcctcggcgatgctggtgggatcggccagcaggcgcatggtggtggcccggtccgaggccgaaatcccggtgcccacaccgtttctcgcgtcgaccgtgaccgtgtaagcggtcccgtgcttgtcctggttgaccgcatacatcggcagcaggcccaggcggtcgcagatcgccccgtccagcggcacacacaggtagcccgaggtgtagcgcaccatgaacgccaccatctccggcgtcgccttctcggcggcgaagatcagatcgccctcgttctcccggtcttcgtcgtcgatgacgatgacggccttgccggccgcaatgtcggcaaccgccctttcgacggagtccaacctcgtcatctctgctacctcgccgtccccgcttggccgcgggaacactgtagaaacggctcacacgagaagcccacgtgttgcattcagtatgaaccacggcggcgccgcggttattgccatggcttgatcagcgggacatcagccgctcgacgtacttggcgatcacgtcgacctcgagattgacctgcgtccccaccggggcgccgcccagcgtggtcagctcccgggtggtggggatcagcgacacctcgaaccagtcgcggggctcgccgcccagcccggacaccgtcagcgagatgccgtcgaccgtgatcgaccccttctccaccacgtagcgggccacctccggcggcacctcgatgcgcaccacctcccagtgctcggacggggtgcgcgccacgatccgcccggtgccgtcgacgtgaccctgcacgatgtgcccgcccagccggctgttgacggcggccgcgcgttccaggttcacccggctgccgacctgcagcgcgcccaggttggaccggttcagcgtctcgcccatcacatcggcgctgaaccggccgtcgggcagcagctcggcgacggtcaggcagacaccgttgacggcgatcgaatcgccgtgcccggcgtcggcggtcaccacggccccgcggatggtcagccgcgccgcatcggcgagcacgtcgcgggcggtcacctcgccgagctcctcgacaattccggtaaacatccccccaggctaattcgcccccgctcaggctggtgagcagggcaaacaccgccgcctgtgagacaccggccccccgcgttcaccagggcagtcaccggcaccctctacgatgctgggtatgcagacccgccgccgcctatcggccgttttcgcatccctgaccctcgccaccgccttgatcgccggctgctcgtcgggctccaagcagagcggtgcgccgctgcccgaccccaccagcctggtcaagcagtcggccgacgcgaccaagaacgtcaagagcgtgcacctggtgctcagcatccagggcaagatctccgggctgcccatcaagacgctgaccggtgacctcaccaccacgccggccaccgccgcgaagggcaacgccacgatcaccctgggcggctcggacatcgacgccaacttcgtcgtcgtcgacggcaccctgtacgccaccctcaccccgaacaagtggagcgacttcggcaaggcgtccgacatctacgacgtgtcggtgctgctcaaccccgacaacgggctgggcaacgcgctggcgaacttcagcaacgccaaggccgagggccgcgaaaccatcaacggtcagagcacgatccggatcagcgggaacgtctcggcggacgcggtgaacaagatcatgccgcagttcaacgccacccagccggtgccgagcaccgtgtgggtccaggagaccggcgaccaccagctggttcaggccaacctgcagaagagctccgggaattccgtgcaggtgacgctgtcgaattggggcgagcaggtccaggtcaccaagcccccggtgagctcgtgaccgctcaaaccgggcgtcgcgtcgcgatcagcgcgggcagtctggcggtgctgctgggcgccctggacgcctacgtggtcgtgacgatcatgcgcgacatcatgaccgacgtccacatcccgatcaatcagctgcagcgcatcacctggatcatcacgatgtacctgctgggctacatcgccgccatgccgctgctgggccgggcgtccgaccggttcggccgcaagctggtgctgcaggtcagcctggcgctgttcatggtcggctcggtggtcaccgcgctggccgggcactggggcgacttccacctgctgatcggcggccgcaccatccagggtgtggccagcggcgcgctgctgccggtcacgctcgcgctgggcgccgacctgtgggcgcagcgtaaccgggccggcgtgctcggcggcatcggcgccgcccaggaactcggcagcgtgctcggcccgctgtacgggatcttcatcgtcttcctgttccacgactggcgctacgtgttctggatcaacgtgccgctgaccctgatcgccatggtgatgatccagttcagcctgccctcgcacgaaaaggtggagcagcccgagaaggtcgacctggtcggcggggtgctgctggcggtcgcgctgggcctggcggtgatcggcctgtacaacccggagcccgacggcaagcagatcctgcccagctacgggttgccgctggtgctcggcgcggtcgtggtgggcatcctgtttctgctctgggagcgcttcgcccgcacccggctgatcgagccggccggggtgcacttccgcccgtttttggccgcgctgggcgcgtccctgttcgccggcgcggcgctgatggtgacgctggtggacgtggagctgttcggccagggcgtgctgggccaggaccagacgcaggccgccgggctgctgctgtggttcttgatcgcgctgccgatcggcgcggtgctgggcgggtggattgccacccgggtcggcgaccgggcgatgacgttcgtcgggctgctcatcgccgcctacggctactggctgatccactactggcgccaggacgtgttgagccagaagcacaacgtgctcgggctgttcagcgtccccgtgctgcacgccgacctgttggtggccggcgtcggcctgggcctggtgatcgggccgctgacctccgccgcgctgcgggtggtcccgtccgcccagcacggcatcgcctcggcggccgtggtggtggcccggatgaccggcatgctgatcggtgtggccgcgctgagcgcgtggggcctgtaccggttcaaccagatcgtggcgaacctgaccgccgcgatcccgcccaacgccagcctgctggagcgcatcgccgcgcagggaacgatgtacctcaaggcgttcgccatgatgtacggcgacatcttcgcggccaccgtggtgatctgcatcgccggtgcgctgctgggcctgttgatcggcggccgcaaggaacacgccgaggaaccggaaatcgttgagccgcaagcggtctcgctgggtgagcgttagccgctgcgcggtaccaggctgagcagcaggtcggggcccacccggtcgaccccgtcgaactgccagcgcagcgccttcgcgatcgtcggcaccccgacgtcgtcgaccgcggtgaccgggccacccagcagggtgggcgcgaggtagaccaggatccggttcaccagccccgcccgcacgaacgcgccggccagggtggggccgccctccagcaggacgtcggtgcggtccgacaccgccttgagcacctcggcgggatcatgcgtgcggatcaccatggtccgcgactcttcgttgagaacctttgcctccgaaagtatttcacgcatccccacgaccacccgcagcggctgccggtcggccagcgtgccgtcgggcagccgggcggtcaacgccgggtcgtcggccagcaccgtgccggtacccaccacgatcgcgtcggcggccgcgcggcggcggtgcaggtccagccgcgaggcctcgctggaaatccatcggctggacccgtcggcggccgcgctgcgcccgtcgacgctgctggcgtatttccaggtcagatgcggcagcccggtgcgctgcttgtgcagccactcccgcagcgggccgccggacacctcgtcggccagcagcccggagcgcaccgtcacgcccgcctcctggagccgaccggcgccgccggcggcctgcgggttcgggtcggcgacggcgtagaccaccgtgcccaccccggcctccagcagcgcgtccacgcacggcggcgtcttgccgtggtggttgcacggctcgagggtgacgacgacggttccgccggcggccaggtcgccggcgcggcgcagcgccaggatctcggcgtggtcgccaccggccggttcggtgccgccgacgccgaccacctcgccgcggccgtccaggacgaccgcgcccaccggcgggttgggataggtgttgcccttgacctgattggactgttcgatcgccaggtgcatcgcggcgtccaggcggtcgcccagcgacgcggtcatcgacgcaggtgctgggacgcgcccagggcctgccggcgcagcgcctcgaccgctgcggccgggtcgtcggcgccgtacacggccaacccggcgacgaagcagtcgacgccggcctcggcggcctgctcgatggtgtcggcgttgatgccgccgtcgatctcgaccaggatggtcagctcccccgcgtcgatcagcttgcgggcggtgcgcaccttgccgaggacttcggggatgaagctctggccgccgaagccgggctccaccgacatgatcagcagggtgtcgaactgcggcaggatctccaggtacggctccagcggggtgcccggcttcacgctgatccccgccttggcgccggcggcgcggatgtcgcgggcgacgccgatcgggttgtcggtggcctcggcgtggaaggtgacgttgtgggcgccggcctcggcgtagggcggcgcccagcggtccgggttctcgatcatcagatggcagtccatcgggatggtggtggtggccagcaggctctggaccaccggcagcccgatcgtgagattcggcacgaagtggttgtccatcacgtcgacgtgcaaccagtcggcgccggtcacggcggcggcttcgtcggccagccgggagaagtcggcggacaggatcgacggcgcgatcagcggtccccgcggctgtcccgtgttgcaaggcatgagcgccagactactgaagcgccgccgctctgttcacatccggagaccgccgccctaccccgcttcgcggcgcagggccgacgcggccaggtccatttgtgtcgcgtccgccctaccccgcttcgcggcgtagcgccgacgcgaacatggcgtcggtgccgtgccggtgcggccagagctgaacatgcggcccgtcgcccaggtcggcgaccggctcgaacagcggccgggcgtccagcgcgctgaccgggtggcggcgcaacgcgtcggcgaccacgccgaccgtctcggccaggtgcggcgagcaggtcgcgtagagcaccaccccgcccggccgggtcagcgcaatcgcggcgcccagcaactcgcgctgcagcttggtcagcgccggcacgtcgccgggctgccgccgccaccgcgcctccggccggcggcgcagcgcccccagcccggtgcacggcgcgtcgacgagcacccggtcgaacgccggctgcaggccggtgtgccgcccgtccacccgcagcacctcgaccggcaatccgcgggtgttctcgaccaccaggtccgcgcgacgcggcgccggctcgaccgcggtgacccggaactgtgactccgaaaaccgttgggcgccaagggaagccagcagagccgtcttgccgcccggcccggcgcacaagtccagccaccgtccgcagtcgccgtccaccggggccagcgtcagcgcccgggccaccaattggctgccctcgtcctggaccagggccagcccgtcgcgcaccggcgccagccggccggggtcgccgccggccagatacaccgcgaagggcgagtggcggccgaccgtgccgcccaccgcgtcggccagctcggcggcggtcagcacgcccggtcgcgccgccagatgcacctgcggtcgttcgtcgtcgcttgccagcaccgcgtcgagttcggccgcggcggcgcccagcgcgtcggcgaaggcctgggcgatccaccggggatgggcgtgcacgaacgcggcgtgtccgatcggatcgcgggccgggtccggggccagctcctgcacccaggaccgctcgtcgcggccggcgatcctgcgcagcaccccgttgacgaaacccgctcgcgccgagtcgaattcgatagccgcctgctccacggtggtggacaccgccgcgtgggcgtccaccctggtgcgcagcaactggtaggtgcccaggcgcagcaggtcgagcagcaccgggtcgatggcttccggcgggcgcccggccgccgcgccgatgaccgcgtccagcaggccccgggtgcggcaggtgccgtaggtcagctcggtggcgaatgcggcgtcacggccgatgatcccgcgctcgcgcagcagtgcgggcagcgccaggttcgcatacgcgtcgcgctcgctgaccgcccgcagcacctcgaacgcggcggcccgggccgggtccagcggccggcgcctgttggcgcgcccccgctgctgtggccggctcatgtggcccgcgccgcgggatcgagccgggcgccgcgcgcccagtccacggcgttcatgaatttctttccgggcggctggatctgacccaaccgcaccggatcggatccggtgcccacccagacgctcttgcggtcgacgtgaattgcgccgggcggcaacggttccggcggagcgggcaggtcggaggccgcgccgagccgcacgggtccgagtttgatgcgcaggtcgctgatcaccgtccatgcgcccgggttgggcgtgacggcgcggatgcggcgctccaccaccggggccggcaggtcccagcgcacccgggcctgctcgacggtgatcttgggcgcgatgctgacgccctcggcgggttgcggtcgcggcgtcagcgtcgagtcggcgatgccgtccagggtggcggacagcagctccgcacccgaaaccgccagtcgcgcaagcagttccccggcggtgtcggtggggcggatcgcctcggtcacgaccccgtagatcgggcccgagtccagggccggctcgatccggaacgtcgacgccccggtgatgatgtcccccgccgcgatggccgcctgcaccggcgccgcgccgcgccaggccggcagcagcgagaagtgcaggttgatccacccgtgcgggggaaccgccagcagctcgtcgcgcagcagcgcgccgtaggccaccaccgcgcagcagtccggcgccaactgcgccagttcggcgacgaattcgggcgagttcggccgcgccggccgcagcaccgggatcccgcggtcgagcgcctcgcgggccaccggcgacggctcgggcttgccgcgccgaccggaagcggcgtcgggccgggtcagcacggcgatcatctcgtggcgcggcgagtcgaggaggcgacgcagcgccggcagcgcgggttcgggcgtaccggcgaagacgaggcgcaccggcacagtctagaaagccccggcgaagcacggccgcggcgccgcccagaaattgcgtgcgtacactattgcttgtggctactattgctcagagcaattgtttgtccggggtgatcccacctcgcgacatcgcctttccgtcccaccaggaggccagatgaccctcgacaccaccaccgccgacgcttcggtggccgcccgccatcgcacggtgtgggcgctgggcgactacgccctgatggccgaggaggtgatggccccgctgggtcccaccctggtcgaggccgccgggatcgggccgggcgtgcgggtcctcgacgtcgccgccggctcgggcaacatcacgttgccggccgccgccggcgcgtccgtcgtctccaccgacctcacccccgaactgctgcagcggtcgcgggacagggccgccggcatggggctgacgatcgactaccgggaggccaatgcgcaggcgctgccgttcggcgacggcgagttcgacgcggtcgtctccgcgatcggcgtgcagttcgcccccgaccaccagcgcgccgccgacgagctggtccgggtgtgccggccgggcggacggatcgggctgatcagctggaccccggaaggcttcttcggccggatgctggccaccattcggccctaccgtcccagcctgtcgcatcccgtgccgccggcggcgctgtggggccgcccgggatatgtgcgcgcgctgctgggcgagcggatcggcgagatcaccaccgcgcggggcatgttgccggtgaaccggttcggcagcgccgaggacgtgcacgcctacttcaagcagcactacggcccgacgatcgaggcgtacgcgaacatcggccacaaccgggtgctggccgccgaactcgacgcccagctcgtcgaactcgccgcgcagcacctcagcgacggcaccatgggctgggagtacctgctcgtcaccgccgaaaagcgaagcggctgaacggtttacaggtcgatctcggcgtccaggtggacgtcgggctcgcccccggcagcggtgaaggcggtcagcgcgcgcaccaggccgtgccgctccgcgggcggcatcttcgccacgatggccgcgatctcggcgcgccggtgcgcggtgacctggtgcacgacgtcgcggccgcgggtggtcagcgcggcgagcagctcgcgccgtgaggtcgggtgcggcaggcggtcgatcagccccgcggccaccaaccggtccaccatccgcccggtggccgacggttgcacacccagcagcccggccagggtggccaggttgaccgggccgcggttggacaggatgaccagggtccggaactgcgggatggtgatggtctcgtcgacctgcccgaccgagcgggccgagatggccatcagcaaacgggaggccgtgagcaaagcgtcggtgatcgcgtccagcgactcgtcaaccgtggtgtggtccgcggccatatcgcccctctcgggatggtctccggcctatcggcggcgaaggaaagaaagtgtagcaaccttctaatgtcgtaaacagtgattattgcatgcgcatactatcgcctaggttaacggtttgtggcggtcagccgatgtgcagcgggtcgatctgcacccgggccggttcgtgggtttgccgggcgctgagcacgccgacgccgcggcgcagcgccgccgccagcgccaggccgtcgcggcgcggcacccgcaccagcatccgcgtcaccggggcgccgggcggggttcccgccgggcggcgcgccccgggcggcaggtccaccggcccgagcaggtcggcgtgcagggtttgcccgccggtcagtccggcctcatccagcagcgcgttcaccgcggccggggttccgtcgacggcggccatgtgcacgctgggcggcagcccgacctcggcccgggcggtcagctcggattccgcgtggcccaccggatcccagcggatcagcgattgcacggtgggaagcgacgattcggcgaccaccatcaccaccccgccgtccccgcggggccgcaccagcgcggcggcggtcatccagcgccacaacgcgtcctccgccgcgcgcaggtcctgccggcccagcagcgcccaggtgtccaacagcaacgccgccccgtagtcgccgcgcgcccgcggttcggcccccggcgtggcgaccaccagcgcgggcccgtcggcgacctcgggcacgacggcgtcgcccgacgaggtgatcaccgtcgtgcccgcaaacgcgcggccgagctcctcggcggtgcggcgggcgccgacgacgacggcgcgcaccgcgtcggagccgcaccgcgcgcaccgccgcgtcgggtcgacgcgcccgcaccagcggcagaccagccccccgccgccctcccccggcgactcggccagcgagagcggccccgtgcagtgccggcagcgggcgatggtgcggcagcgcgcgcaggccagcgacgggacgtagccccggcgcggcacctgcaccagcaccggcgccccgtcctgcagcgccgagcgggccgcgcgcagcgcgacggacgggatgcgcgcggtgcgcgccgccgggtcgcgctcgtcggcgtaacccgtgtcgtcgagcgcgatcacccgcggggtgcgggcccgcaccacgggccgggcggcgacgatgtcgtgcgcccagccgctgcgcaccagcgcctgggcctccgcggtccgcgcgtaaccgccgatcagcgccgcgcagcgggcctggtgcgcgcgcagcatcgccacctcgcgggcgtgcggatagggcgcccgcggctcggccaggctgtcgtcggcgtcggcccacaccatcaccaggcccaggtcgctcagcggcgcgaacaccgcgctgcgggtgccgatcaccacccgcgcgctgccgcgcagcgccgccagccagcgccggtaccgggcggccgggcccagcccggccgacagggcgaccacgccggtcgcgtcgatgcggctcgtcacggcgtggctcagcgcatccaggtcgcgctggtcggggacgatcgccagcaccgaccggccggtgcgcacggtctgggcggcggcctcggcgaatcggtcggtccacggctcgccgggcagcgcctgccagaccgcccgggcggcccgcgactcggccagcgcggccaggaactgggcgccgcggccgtagccgtcccagccggacgggtcgaccggcgccggcatcggtatgccggccgcagcccgggcctcccgctccaccctggcgtgccgggccggcaccgccaaccgcaacacgtcggggcgggtccccgcgtagcgggccgccaccgcgtcgaccagccggcggatctccgccgtcagcaccggctcaggcgacaccacccgatccagccagcccagcttgccctggtggtcggtgtcgtggcggcgctccagcaggaacccgtcgaccagccggccgtggaagcgcacccgcacccgcacgcccggctgggcgtcgtcggattgctcggccgacaccagatagtcgaattcgcggtccaggtgcggcaccgacagcatcggcagcacccgggcgatgggttccacctcgaccggcgtgcgcggacccgggctcacggccgccccgggccgcgaaacacgttgctactcaacaggttccgcggcatcaccggtcgcgtcgccggtcgcttcgccggccgcgtcgccggccgcttcgcgaccgaagaagaatcccgcggtgatcaggatctgggccgccgcgtacgcccaccagatcggcaccgccagcgcctcgttgcccaggatgaaccggccgatggcgatcattgagtccgacgccgcgaaacacaccgcgcccaccgccgtccagatcgtcggcagtttcgccagcagcgccgcgcacaccatggcggtcagcaccacgatgtacagcgtgaccggcagcgtcagcttgtccggacccagacgcggccagaaccagaccagcaacccgatcgacgccaggcacatcaggaccgccgcggcgatccgcggcgtcgacggccgaccgggcccggacgcgccggagggcagcgggaccagcggcagcaggacgccgatgaaacacatgggcgcgaacagaaacgccgccaggccgaccaggaaggacagcgtccaccacggcagggcgagcacccagtcgccgaccgccgacagcagcagcgccggcatcagccagcgccgctcccgcacctgtccgtgcccggcggcggccagcgtcagcagcaacgccatcgaggccttgaacgccggctgcaacacccagtgcccggtcagctccacccccggcggggagcgcagcgccagcacggtcagatagatgccgtaagccagggccacccagccggccaccacccaggcgccggcgaccagacggggtgcgtacggtacctccatgccccgcttggacaaccctgccgacgagaaacccgggatcgaccccatcctgcagaaggtactggatgcggttcccttccggctatccaccgaggacggaatcgacgcggcccggcagcggttccgcgacctgccgcgccggccgctgcatcccgagctgcgggtcgaggaccgcaccatccccggcccgcagggcgcgatcgcggtccggatctattggccgccaagccattccgagagttgcccggcgccggtggtgctgtacttccacggcggcggtttcgtcatcggcgacctggacacccacgacggcacggcccgccagcacgcggtcggcgccggggcgatcgtggtgtcggtggactaccggctggcccccgaacacccgtaccccgccgcggtcgaagatgcttgggccgcaacgctttgggcggccgagaacgcggccgggctgcacggcgacccgggccggatcgccgtggccggggattcggccggcggcaccctcgccgccgtgacggcgcagcgggcccgcgaccgcggcgggccgccggtgcggttccagctgctgtggtacccgtcgaccatgtgggacgcctcgctgccctccttcgccgaaaacgccaccgcgccgatccttgacgtcaaggccgtcgccgagttctcccggtggtacgcgggcgatgtcgacctgtccgacccgccggccgacatggcgccgggacgggcgacggacctgagcaatctgccaccggcctacatcggggtggccgggtatgacccgctgcgcgacgacggcatacgctacggcgagccgctggcggccgccggtgtcgccgcgcaggtgcacaacgccgagacgctggtgcacggctacctgggctatgccggtgtggtgccggcggccaccgccgcgatggagcgcggcctcgccgcgctgcgaaccgccctgcagggctgaggcccgggcgtacggtggatccatgacacagccaggcgggcaccgatgagctcaccagcagttcccgaccaccacacgctgatcatcggcgcgggattctccggcatcggcgcggccatcaagctggacaaggcggggctgcccgactaccgggtgatcgaggccggcgacggggtgggcggcacttggcactggaacacctatcccggtatcgccgtggacattccgtcgttctcctaccagttctccttcgagcagagccggcactggtcgcgcacctacgcgcccggccgcgagctcaaggcctacgccgagcactgcgccgacaagtacggcatccgctcgcgaatccggttcaacaccaaggtgttagccgccgagttcgacgacgaaccgcggctgtggcgggtgcacaccgatcccggcggcaccgtcaccgcccggttcctgatcagcgcctgcggcgtgctgaccgtgccgaatctgcccgacatcgacggggtggactcgttcggcggcatcacgatgcacaccgcgcggtgggaccacggccaggacctgtccggcaagcgcgtcgcggtgatcggcaccggggcctcggccgtgcaggtgatccccgagatcgcgccaatcgtcaagtcgctcaccgtgtttcagcgcaccccgatctggcgcttcccgaaactggacgtcccgctgccggcgccggcgcgctgggcgatgcgcattcccggcggcaagtccgtgcagcggctgctcagccaggcctacgtggaggtcaccttcccgatctcggcgcactatttcacggtgcttccgctggccaagcggatggccacgctggggaaatcgtatctgcgccaacaggttcgcgacccggaggtgcgcgaaaagctcaccccgaaatacgcggtcggctgcaagcgccccggcttccacaacggctacctggccaccttcaaccgggacaacgtgcggctggtcaccgaaccgatcgacaagatcacgcccgacgcggtggccaccaccgacggcgaacaccatcggatcgacgtgctgatcctggccaccggcttcaaggtgatggaccccgacaacgtgcccaccttcgcggtgaccgggcccggtgggcgctcgctcagccggttctgggacgagcaccggttgcaggcctacgaaggggtatcggttccgggttttcccaacctgttcacggtgttcgggccgtacggttacgtcggctcgtcgtatttcgcgctgatcgaggcgcagacccatcacatcgtgcgctgcctgaagcgggccgagcgcctcggcgcggcccgtgtcgaggtcagcgaggaagccaacgcccgctacttcgccgagatgatgcgccggcggcaccggcagatcttctggcaggacagctgcaagctggccaacagctactacttcgacaagaacggcgacgtgccgctgcgacccggcaccacacccgaagtgtattggcgcagtaggcgattcaacctcgacgactaccggttcagcgcttagcgtccggcgctcgaacgggcgtgccgtgctcgccttgctcgccgagcgtgaagttaagttcacgctcggcgccgagcgtgaagctagcttcacgctcggcacgacgcggcggcgcgacgcggcgcgactcggcggaagctcgagacgggtcagacggcgcgcttgagctcgtcgaccttgttcagctgctcccagggcagttcgacgtcggtgcggccgaagtgcccgtaggcggcggtctgcgcgtagatcgggcgcagcaggtccaggtcgcggatgatcgcgccgggccgcaggtcgaacacctcgggcacgatcttctcgatcttgaccgggtcgacggtcgcggtgccgaaggtctccacgaacaggcccaccggggcggccttgccgatggcgtaggccacctgcacctccacccgctccgccagcccggcggcgacgatgttcttggccacccagcgcatcgcgtacgccgcggaccggtccaccttcgacggatccttgccggagaaggcgccgccgccgtggcgggcccagccgccgtaggtgtcgacgatgatcttgcggccggtcagccccgcgtcgcccatcgggccgccgacgacgaacttgccggtcgggttgaccagcaaccgcgtcgaggaggtgtccagggtgtcgtgcgccaggtcgtcgagcacggtgttgagcaccttttcccggatgtcgggggtcagggtgttctccaggtcgatgtcggccgcgtgctgggtggacaccaccacggtgtccagccggacgggaacgtcgtcctcgtattcgatggtgacctgcgtcttgccgtccggacgcaggtagggcagcacgccgctcttgcggacctcggtcagccgccgcgacagccggtgcgccagcgcgatcggcagcggcatcatctccggggtgtccttgatggcgtagccgaacatcaggccctggtcgccggcgccctgggcgtccagcgggtcggccgcgccctcgacgcgggtctcgtgggcggtgtcaacgccctgggcgatgtcgggtgactgcgcgccgatgccgatgttcaccccgcaggaggcgccgtcgaagcccttgtccgaggagtcgtagccgatgtcgaggatgcgctcgcgcaccgtgttggtgatgtcggcgaacgcctccttggccgtcgtcgtcacctcgccgaccacgtgcacctgcccggtggtgaccagggtctcgaccgcgacacgtgagcgggggtcctgcgccagcagcgcgtcgagcaccgagtcgctgatcgcgtcacagatcttgtcgggatgtccctccgtcaccgactcactggtaaacaggcgacccttttcgctcacaatcccaatccttccaaatagttaggtagccgaattatatcggctggcgtcggcccggcccacagcggtcccggcgccgagaagcactcgaccgtgttatccgccgtccccgcgcaggaaggcggcgatcgcatccacgatacgactggccatcagcgtcttggagccgtgctgcagcgccgactcggtcccgtcggccgccagcagccagccgtcgttgctgtccacctcgaaggcccggccctcgcccaccgcgttgaccaccaacaggtcacagcccttgttgcgcagcttggcgcgggcgtgaaacagcacgtccccgttggcgtctccggtctcggcggcgaatcccacgatggcccgcaggttgggcagctcgccgtgggcgcgcgcccgcaccgcgccggccagcacgtcgtcgttgcggaccaactcgatcgtcggtgcctcgacaccctttttgatcttggcggcggcaacccgggcgggccggaagtcggcgacggcggcggccatcaccagcacgtcggcctcggccgcgtgcttggacaccgcgttgcccagctgctccgccgagctgacgtgcaccacctcgaccccggcggggtcgatcagtccggcggtgtgcccggcgatcagcgtgacctcggcgccgcgctgggcggccacccgggccaccgcgtagccctgcttgccggagctgcggttgccgatgaagcgcaccgggtcgacgggttcgcgggtgccgccggcggtgaccaccatcttgcagccggccaggtcgtagggcagcgcgtcgtggcgttccagcagcagctgggccagggtggtgatctcctcggcctcgggcagccggcccgacccgctgtcggtgccggtgagccgcccggcggcgggctcgagcaccaccgccccgcggcggcgcagcgtggccacgttgtcgacggtggccgggtgcaaccacatctcggtgtgcatcgccggcgcgaacagcaccggacatcgggcggtgagcagggtggcggtcagcaggtcgtcggcccggccgtgcaccgcacgggccagcaggtcggcggtggccggtgccaccaccaccaggtcggcctgcttgcccagctgcacgtgcggcacctcgggcacgtcgtcgaagacgccggtgtgcaccggctggccggacagcgcctcgaaggtggcggcgccgacgaagcgcagcgcggactcggtggggatgacccggaccgaatgaccggcctcagacagctggcggacgacggtgcacgccttgtaggcggcgatgccgccggagacgccgacgacgatcctcgcggcccgtgtggaagcccgattgcggtcgtacacagcgcgcccggcccggccccgttactcgccctcggtgtgctcgagcaggtcgccgtggatctcgcgcagcgcgatcgaaagcggtttctcctgcagccccggctcgaccagcgggcccacgtattcgaggatgccctcgccgagctggttgtagtagtcgttgatctggcgggcccgcttggccgcgtagatgaccagcgcgtacttgctcgagacgcggtccagcagctcgtcgatgggcgggttggtgatgcccagcggggtgtcgtaggcgcccgggcccccggcggacggatcgaaccggtcgaggacggcggccagcgccgcgtcggactgcgagttagtcacgtaggtcaatctcctggcggattggagcggctcgtcgctaccggaaagccactgaaaaatattgaggattcggtgctcaatcgggatgggaggtggtctggcgcccggtccggccagacgtatcgtgccggtccggcgcagttcccaccagcaaggataccaattcggcgcaggcagactccaatcgactgttgaccaccacccggtcgaagtcgtgttgggccgccatttcgacgcgggcggtctgcaggcgccgggcgatgacctccggggtttcggtgccccggccgatcagcctggcctccaggtcctcccagctgggcggggccaggaacacggtgagcgcctcgggcatcgccttcttcaccgcccgggcgccggccaggtcgacctcgatcagcaccgggcagccccgcgcgacggcggcccgcaccggcgcggccagggtgcccgaccggtgcagcccggagtggatttcggcccactccagcagcgcgccctcgtcgatgagctgctggaatcgggcggggctgacgaagtggtagtcgacgccgtcgacctcgcccggccgcggtgcccgcgtcgtggccgagacggagaaatgcaggttggggacccgctcgcgcaggcaccgaaccactgtcgatttgccgaccgcggagggaccggacagcacgaccacacgtccgtcacctgatggttcgggacgcgtcccatgccggacgtccggtcccccgtcggcagtcacgggcgctcccggtcggatgcgcccacggctcgggtccgatggcccgcctcctcaggccgtgcggcctgcatcgtcggcgggcgggttaggagccgaacttttccagcagagccttgcgctgacgatcgccgagaccgcgcaggcggcgggtgggggcgatctccaactcagtcatgatttcctgcgccttgaccttgcccaccttgggcaacgcctcgagaagcgccgaaaccttcatcttgcccaggacttcgtcggtctcggcgtccttgagcacctgactgaggttggtgccgccgcgcttcagccggtctttgagctcggctcgggctcgacgtgcggcagccgccttctccaacgcggccgcgcgctgctcgtcggtcaactggggaagggccacgattcctccgtatctgatcaatcaatctcaatcgatctctttgtgtctctgccgggtacttcagccagcggagacgaccgtactcaggcctcctgacgaaatctaacccgcccccctgcttaacggggcaaactcccagcatgtaccggcgtgtggggggccgcggcgacgtggcgtgcgacgtcgatcgaggttgcgcgcggcgccgccggggcggctcccgcatggtcgtttcgggccgccgccgcgcccgcgacctgcggctttgacgtttcccggcggcgtgggcccgcggcgccggggtggttgcgcgacgcggcacgggctgctgcgggcgcccggtgcgacggatcacgcattcgtcacggcgtgtcgcgcgtgtcgcactgctggtcgatagcgggtggatcgccggtcacggcgggtcacggcttcgcttgcggccgatcagggggccgcgatcggataccatcggggcgtgtcgaacctgcgaattcgccaggcggctgagctgctcggcgtcagcgacgacacggtgcgccgctggatcaaccagggcgcattggaggtcggtcacgacgccgccggccgcaaggtgatcgccagcgaggacctggcccatttctcccgcaccaacgcccccgccccgccggccgacccgctcagcatcggcagttcggcccgcaaccggttcgtgggcctcgtcacctcggtggtcagcgacaaggtgatgacccaggtcgagatgcagtgcggcccgttcaccgtggtgtcgctgatgagcaccgaggccgccgaggagctgcagctgcgccccggcagcgtcgcggtggccgtcgtcaaggccaccaccgtcatcgtggaaaccgcccggcccagcacgaccgtcgcgtcggactgaggccgctacgcgtccaggtaggcgacggcgtccagcatccggtcggccgccgcgcgcagctccgccacgtcggggccggcccgcagcacctcgcgggccaccgcgggcagcagctgcccgggttccgccccgcccagcccggccagcgcctcgggccgcccgccctgcacgccgagcccgggcaccagcaccgggccgcccagcgcgctcagatcgggcggctgcagcaccgtcgcccccaccacgacgccgacgtagccgggcccggccgggttcgtcgaccgattcaccaccgccgcctggtcgaccaccagctgggccaccgtgcggccgtcgaaggcggcccgctgcacggtggcgccctccgggttggaggtggccgccagcacgaacaccccgcggtcgtgcgcggcggcggcttccagcagcggccgcagcgagccgaaccccaggtagggcgaggccgtcaccgcgtcggcggccagcggcgagtcaccggcccaggcggcggcgtaggcggccatggtggtgccgatgtcgccgcgcttggcgtcggccagcaccagcaccccggccgaccgcagcgcggcgatggtgcgttcgagcaccgcgaatccggccgcgccgtaggcctcgaagaacgccacctgcggcttgacgaccgcgaatccggcgaacgcctcgacgcagatgtcgcagaaggcggccagcccgtcggcggtggtcggcaggtcccacgcgcgcagcagctcggggtgtgggtcgatgcccacgcacagcggcccgcgttgcgctttcgcggcggccagccgggcgccgaacccggtcaccgcggccccttgtccgaggcgatctggctgtgcagttcctgcaggctgcgcaccccgatgtcgccgcggatgccggcttcgatgccctgcacggcggccgaggcgccctgcacggtggtcacgcagggaatgttgaccgacactgcggcggaacggatttcgtagccgtcgatgcgcgggccggagttgccgtagggcgtgttgatcaccatgtcgacctcgccggccttgatcgcgtcgacggccgacatctcggggcggccgggctgcgggtcctcgaagtgcttgcgcacctcgtcgcagggaatcccgttgcggcgcaacatctccgcggtgccctcggtggccagcacccggaaacccaggtcggccagccgtttgaccgggaacaccagtgagcgcttgtcccggttggcgaccgacacgaacacggtgccctgggccggcagcgacccgtaggcggcggtctggctcttggcgaaggcgctgccgaagtcgcggtcgatccccatcacctcgccggtggacttcatctccgggccgagcagcgagtcgatgccggcgccctccacggtgcggaaccggtggaagggcagcaccgcctccttgaccgcgatcggggcgttcagcgccgcgtgcgcgccgtccccggacgcggccagcatgccctccgcgcgaagctgggatatggtggcgcccaacatgatccgcgcacacgccttggccagcgggatggcggtggccttcgacacgaacggcaccgtgcggctggcccgcgggttggcttccagcacgtagagcacgtcgtccttgagcgcgtactgcacgttgagcagccccaccaccccgatgccgtgagcgatggcctcggtggcgcggcgcaccttctcgatgtcgctgcggcccaacgtcaccggcggcagggcgcacgccgagtcgccggagtggatgccggcctcctcgatgtgctccatgatgccgccgatgtacacctcggtgccgtcgcacagcgcgtccacgtcgatctcgaccgcgtcctcgaggaagcggtcgaccagcaccgggtgctcgggtgagagctcggtggcgcgggtgatgtagtcgcgcagcgtctcctcgtcgtagacgatctccatgccccggccgcccagcacgtaggacggccgcaccagcaccgggtagccgatgtcctcggcgatccggcgggcctgggcgaaagtcgttgcggtgccgtacttcggcgcgggcaggccggccgcggtcagcacgtcgccgaaggagccgcggtcctcggccaggtcgatggcctccggcggggtgcccacgatcggcacgcccgcgtcggcgaggcgttgcgccagcccgagcggggtctgcccgccgagctgcacgatgacgcccaccacgcccgggccgccggcgccggactgctgctcggcccggaacacctcgaggacgtcctcgaaggtcagcggctcgaaatacagccggtcggcggtgtcgtagtcggtggacaccgtctcggggttgcagttgaccatcacggtctcgaaaccggcctggctcaacgtcgtcgcggcatgcacgcagctgtagtcgaattcgatgccctggccgatccggttggggcccgagccgaggatcagcaccttcggccgctgcgcctgcggggcgacctccgtctcggcggccgggtcgagttcgtagctgctgtaatggtagggggtcttggcctcgaactcggccgcgcaggtgtcgaccgtcttgtacaccgggtgcacgccgaggcgttcgcgcagcgaccgcaccccgttctcgccggccaattccggtcgcagcgcggcgatctggcggtccgacaggccgtgatgcttggcccgccgcagcaggtcggcatccagcacgggggcgccgatcagctcgccgcgcagcgcgacgagttcgccgatctgcgcgatgaaccacgggtccacgccgctggcctgcgcgacccgttccaccggtgcgcccagccgcagcgccagctcgaggtcgtagagccggccctcggtgggcgtctgcagccgggccagcacgtcgtcgaggccgccgtcggggtcgggcttggtccagaatccggcgcggctggtctccagcgagcgcatcaccttgcccagcgcctcgatgaagttgcggcccaacgacattgcctcgccgacggatttcatggtggtggtcagcgtggggtcggcgccggggaacttctcgaacgcgaaccgcggcgccttgaccaccacgtagtccagggtgggctcgaagcaggccggcgtctccttggtgatgtcgttgacgatctcgtccagggtgtaaccgatggccagcttggcggcgatcttggcgatcgggaacccggtagccttggaggccagcgcgctcgagcgcgacacccggggattcatctcgatgacgatcagccggccgtctttggggttcaccgcgaactggatgttgcagccgccggtgtccaccccgacctcgcgcaggatcgcgatgcccaggtcgcgcatccgctggtattcgcggtcggtgagcgtcatcgccggggcgacggtgaccgagtcgccggtgtgcacgcccatcgggtcgacgttctcgatcgagcacaccacgacgacgttgtcgttgccgtcgcgcatcagctcgagttcgaattccttccagccgtagatggattcctcgatcagcacgttggcgctggggctttcggccagcccggcgccggccatccggtcgacctcctcgacggagcgcgccatccccgagcccaggccgcccatggtgaagctgggccgcaccaccaccggcaggcccagttcggcgacggtctcgcgcacctcgtccatggtgaaacacactcggctgcgggcggattcaccgccgaccttggcgacgatgtccttgaaccgctgccggtcctcgccgcgctggatggcgtcgaagtcggcgccgatcagttccaccccgtagcggtccagcgccccgttctcgtacagcgcgacggcggtgttcagcgcggtctgcccgcccagggtggccagcagcgcgtcgatcttgttgccccgctcggcctgctgcgcgatcacccgttcgacgaaggccggcgtgatgggctcgacgtaggtgtggtcggcgtactccggatcggtcatgatggtggccgggttggagttgaccaggctgacctgcaggccctcggccttgagcacccggcaggcctgggtgccggaatagtcgaactcgcaggcctgcccgatcacgatcgggcccgagccgatcaccaggacgtggttgaggtcggtgcgccggggcactagcggtccccttccatcagctcgatgaattggtcgaagaggtagttcgcgtcgtgcgggccggcggccgcctccgggtggtactgcaccgaaaatgcccgtccgtcagcgagtttcacgccctccaccaccccgtcgttggcgcaggtgtggctgaccaccgccgcgccgaagggcgtgtcgaaggactggccggcctcgccctgcagcgcgaagccgtggttctgcgcggtcaccgccacccgcccggtggcgtggtcgatcaccggaatgttgatgccgcggtgaccgaacaccatcttgtaggtggacaggcccagcgcccggcccaggatctggttgccgaaacagatgccgaacaatgggattccggcgcccagcacctcgcgggtgaccgccacgatgtggtcggcggtggcggggtcgccgggcccgttggacaggaacacgccgtccggcctgaggtcggcgatctgctcgaaggtcgccgacgagggcagcacgtggctgcggatgccgcgacgggcgaagttgcgcggcgtgttggttttgatgcccaggtccagtgcggcgacggtaaaccgcggcggcccttcgggttccacaatgtaggcgtccggcgtgctgacctcaccggccaggtcggcgcccagcatggactgctggccgcgcacccgctgcaccagttcgtccggatcggccagggcgtcaccggagaacacccccgccttcatcgaaccgcgggtccgcaggtggcgcaccaccgcgcgggtgtcgatgcgagcgatgcccacgatgcgctggcggatcagctcgtcctccaggcttccggtggcgcgccagttggacacgcgcggcgacgggtcgcgcaccgcgtagccggccacccagatcttgtcgccgcggctctcggcgtcctcgccgttccagccggtattgccgatctgcggcgcggtggccaccacgatctggcggtggtagctggggtccgtcagcgtctcctgatagccggacatgccggtggaaaacacggcctcgcccagggtttggccgatcgctccgaacgccgtgccggtgaagacgcggccgtcctcgagcaccagttgcgccttgccactcacgaacgccgctcctcccgccccggctgcagccagccgtcgtattcgccccggttgttggcccggaagccggtgtcgatctccacgcccgacggcagccgccaccggatcgccagaatcgagttgcgggccgcgacctttccggccatgccccgctcggtgcggaccgcgctgatcgactgctggggaatccaaatcggggtggcgcgaatgcgttccagcaggatgccctccgggtagcgggtcagcgccgccttgctccggtagcccagatcgccggccgtcacccggtcgttccaggccggcgacagggtgcacccgacatagacgccctgcagggtggccgtcgcggtgccgaccttgtcgggcaccccgggcagctcgccgatcagctcggcctgccgccgggcgcggcgcatccagccgcgcatcatcagctggatcacgaccgcgatcaccaccaccagcacggccgcgaagatcagcgagcccaccagcgtgccggaattcattggccccgctcctcctcagtgccgccgctcatgcggcgcaccgcatcgtcgccggcgcggctcatgccgggcacttcccgtcgcgggcggtgaccttgccgcgcagcagggtcgcggtcacggtggccggcagcgtcatcgcctcgtagggggtgttggccgaccggctggccaggtccgacccggccaccgtccagctggcgtcggggtccaccaccgtcaggttggccggctcccccacctccagcgggcggccgtgatcgggcagatttgcgatgcgcgcggggttttcgctcatcaccttggcgatgtcccgccaggtcagcagcccggggcggaccatcgtgtggaccacgatcgacagcgccgtctgcagccccagcatgccggggcgggccgcggagaactccacgcacttctcgtgctcggcgtgcggcgcgtgatcggtggccacacagtcgatcacgccgtcggccagcgcccgccgcagcgcggccgcgtcggccgcctcgcgcagcggcgggttgacccggttgcgcccgtcgtaactggccagccgcgagtcgtccagcatcaggtggtgcggggtgacctcggcggtgatcgagataccttgctgcttggcccatttcacgatctcgacggtgcccgcggtggaggcgtggcagatgtgcacccgggcgccggcgtcgcgggccagcagcgcgtcgcgggcgacgatcgattcctcggccgcccgcggccagcccgcgagtcccagccgggcggcggtgggcccctcgtgggcgaccgcgccgacggtcagccgcggctcctcggcgtgctgggcgatgagcacgcccaggccggtggcgtattccagggcgcggcgcatcaccagcgggtcgtgcacgcagacgccgtcgtcggagaacatccgcacctgtgcggcccccgccgccatcatgcccatctcggtgagctccttgccggctagacccatggtgaccgcgcccaccgggtgcacgtcgaccaggccgacctgctggccccggtgccacacgtggtcggtgaccaccgggctgtcggcgaccgggttggtgttggccatcgcgaacaccgcggtgtagccacccaaagccgcagcggccgaaccggtttcgatgtcctcggcgtattcgcggcccggctcgcgcaggtgggtgtgcaggtcgacgaacccgggcagcagcacctggccggtggcgtcgatgacgtcggcggtgtcggggatgtcgagcccggcgccgatgtcggcgatctgcccgtcgtcgaccaggacatcgacccggtcgccctcgccgtacaaccggactccgcgcagcaacacgctcatgcggcgatctcctccgcgcccaccagcacgtggaacagcaccgccatccgcacgtgcacaccattggaaacctgttgcagcacagccgattgcgacgagtccgccaccgaggaggcgatctccatgccgcgcagcatcgggcccgggtgcagcaccacggcgtggccaggcagcatcgcctggcggcgatcggacagcccgtacagggacgagtactcgcgcaccgacgggaagaagccaccgttcatccgctcggcctgcacgcgcagcatgagcaccgcatcggcggcgggcagctcggcgtcgaagtcgttcgacacggtcaccggccagccctcgacgccgaccggcaacagcgtcggcggggcgaccagcaccacctcggcgcccagggtggacagcagcatcacgttggagcgggccacccggctgtgcaggacgtcgccgacgatcaccacgcgccggccctcgatgccgccgagccgctggcggatggtcagcgcgtccagcagcgcctgcgtcgggtgctcgtgggtgccgtcgccggcgttgatcaccgacggcccggcgtcgctggaatcgccgttgccgcaagtccattcggcaagcaggtgcgcggcgccggaggccgggtgccggatgatcagcgcgtcggcgccggccgcccgcagcgtcagggcggtgtcgcgcagcgactcccccttgcccaccgaggacccggcggcgctgacgttgatcacgtcggcgctcatccacttgccggccacctcgaaggacacccgggtgcgggtggagttctcgtagaacatggtgacgacggtgcggccacgcagcgtcggcagtttcttgatctcgcggcccaccagcgcctgggcgaaccggtcggcgtcgtcgaggatggcggtggcgtcgtcgcggctcaggtcgccggcggcgagcaggtggcgggtcatcgcgagatcaccaccccgtcggcgccgtcgtgctcggccagcagcacgtgcacgctctcactgcgcgaggtggggacgttcttgccgacgtagtcggcgcgcagcggcagctcgcggtgaccgcggtcgaccagcaccgccagttgcaccacccgcgggcggcccacgtcgcgcagcgcgtccagtgccgagcgcaccgagcggccggagtagagcacgtcgtcgaccaggatcaccagcgcgtcgtcgatgccgccggccgggatcgaggtggcctccagcggccgcggcggtttttgcatcaggtcgtcgcgatacagggtgatgtccagggcgccgtggccgacctcgaccccgctgtactcgccgatgttgcgggccagccggtcggccagggtgacgccgcgggtcgggatgcccagcagcaccacccgcggcccgtccggaccgtccagcgcggtcttttcgatgatctgatgcgcgatgcgggaaatggtgcggccgacgtcggccgccgacatcaactcccgggaatcaccggacgagccggtgttgcccgcagcacccatgcgaaacttgacctccttctccgcctcaccggacggatcgttaaaggatgtcgactgcacggcagcgtagcactaatttcgcgggcgaccgcgcgcggcggccgtggcggcccgcccgctaacctgaccaggtgaatcgcgtgaccctcgacgccaacagcgcctccatccgcgaagtgtgcgacgccggcctgctggccggggcggtgacgatggtctggcagcgcggagaactgctgcaggtcaacgagatcggctaccgggacgtggaggcggggctgccgatgcgccgcgacaccctgtttcgcatcgcgtcgatgaccaaaccggtgaccgtcgcggcggtgatgagcctggtcgacgcgggcaagctgagcctgaaggatccggtcacgcgctgggcgccggagctggccggcgtgcgggtcctcgacgacccgcacggcccgctggaccgcacccacccgctcgaccgcgccatcctgatcgaggacctgctcacccacaccagcgggctggcctacggattctcggtgtccgggccgatctccaaggcctacatgcggctgccgtttcagcacgggcccgacgcctggctggccgagctggccaagctgccgttggtgcaccaacccggcgagaaggtcacctacagccactccatcgacctgctgggcgtcatcgccgcccgcatcgaggacaagccgttccaccaggttctcgacgaacgggtgctgggcccggcgggcatgaccgacaccgggttcttcgtctcgccgcaggcgcggcaccgggcggcgaccatgtactccctcgacgagcacagccggctgcagcacggcgtgatgggcccgccgcacgtcacgccgcccgcgttctgcaacgccggcggcgggttgtggtcgagcgccgacgactacctgcgcttcgtgcgaatgttgctgggcgacgggacgatcgacggggtgcgggtgctctcggaagagtcagtccggctgatgcggaccgaccggctcaccgaggcgcagaagcggcacaatttcctgggcgcgccgtactgggtgggccgcggcttcgggctgaacctgtcggtggtcaccgacccggcaaggagcacaccgcttttcggcccgggcggggtcggcacgttcagctggcccggcgcctacgggacgtggtggcaggccgacccgacggccgagctgatcctgatctatctgatccagaaccttcccgacctcaccgtcgacgccgccaccgccgtcgccggcaacacgtcgctggccaaactgcgcaccgcccagccccggttcgtccgcaccacctaccgcgcgctcggcctttgaaccgcaccgccatgcccgaataccctcccgaccgcatcaccgggccccggctgtcgctgcggctgccggtgctcgacgacgccggcccgctgttccagcgggtcgcccgcgatccgcaggtcaccaaatacctgctgtgggcgccgcatccggacgtggcggccacccggcgggtgatcaccgagaagctcaacgccagcgcggacgagaagacctgggtgatcgagctgcggcaccgcggggaggtggtcgggctgctcagctgtcggcgcaccgcgccgcactcggtggagatcggctactgcctgggccggcggtggtggggcaagggcctgatgtcggaggtgctcggcatgctgctcaccgcgctggacgccgaccgtgaggtctatcgcgtgtgggccacctgcagcgtcgacaaccagcgctcggcgcgcctgctggagcacgccgggttcttcctggagggccggctggcccggcatgccgtctaccccaccatggggcccgaaccgcaggacagcctgctgtatgcaaagatcctgcgctgactagcttttcacagcccgctcggggtgttccagcgcccggcgcgcgtacgcgcgcacatcggcgtcggtgtccttgagcgcgatccccagggcgtcgcgggcggccggctcgccggcccaccgggtcagggcgagcaccgcggccttgcgcacgtccaggtgcgcgtcgcccagcgcctcgcccagcagcggcaccgcgacctcggcggccgcaccggccagcgcccgcgccgcgccttcgcgcacctgccacgccgacgcgcgcagcgcctgcgtgatggccccgtaatcgtctgggccgcagcccaattcgccgagcgcggccagcccggcggcacgcaccagcgggtcggggtcggcgaccagcgcgcgcaccgccccgccggccgggcccgtcccgtcgcgcagcgtcgccagcccggcggcggccgcgatgcgcacctcccggttctcgtcgccggcggcgtcgaccaccccgtccacgtcgtcgacggacaccagcgcccgcaccgcctcgatgcgcacccggtgatcgggatcgcccagggcgcgccggtaccgggcggcgtcgccggcgcggcgcgcggccagcacgtacagcgcggccgcccgcaccacccggtcggacgaatccagatgggcgcgaaccgattccggctcggacagcacctcgaccagctcccggacgccctcggcggcggcggcgcgcaccgcggcggcgtcgtcgcccagcgcggccagcagggcgggggcgtatccctcgggggtgttctcggtcagcgtcgccaccgcggtgcggcgcactcccggatccgggtcacccaggtagggcgccagctcggccacactcggctcgtcgagtgccagcaccgcggcgatgcgcggcgacggcggctcgaaacccgttgcgggggaagcgatgcgggagacagcgctggccggggcctggccgccgatcagcggcggctgctgcaccgggtgcacggtctggtcgaccggcggcagcccgtccagctccggaaccggcacgaaatacggtgccaccggccgcttgaggaacaccatccggccgtcgtcgcccttgcgcaggttgaggtgatagccccattgattgtcgtcgcggccgggcaggtcggcccggtcgtggtagaggccccagcgcgattctgtgcgggtgtgcgaggaccgggcggccatctcggcgcagtcccggatgaacgacacctccaccgcgcgcatcagctcgtgcgggttgcgggcgcccatctcggcgatctcggcgctcatccgctcgaaggtgcggatcgcgatggacagcttggccgccgtcttgggcggcgcgacgtagtcgttgacgaaccggcgcagcttgtactccacctgcggctgcggcggcccgtccgggtggcgcagcggccggtagatcagctcgtgcgcctcgcgcagctggtcggccggaagctgttgcggcacggccacatcggccagggtcgaggcggcatgggtgccggccaggtcgccgaacacgaacgccccgatcatgtagttgtgcgggacgcaggccaggtcgcccgcggcgtacagcccgggcaccgtggtgcgggcatgctcgtcgacccacacacccgacgcggaatgcccgctgcacaaaccgatttcggagatgtgcatctcgatgtcgtgggtgcggtagtcgtgcccgcggttggcgtggaaggtgccccgggtgggccgttccgtggtgtgcaggatgttctccaacgcggtcagcgtctcgtcgggcaggtgcgacaccttgagatagatcggtccgcgcgcggagtcgatctcgcgtttcacctcggccatcatctggccggaccagtagtcggagtccacgaaccgctcgccctgcgcgttgacctggtacccgccgaacggattggcgacgtaggcgcacgccgggccgttgtagtccttgatcagcgggttgacttggaagcactcgatgcccgagagctccgcgccggcgtggtaggccatcgagtagccgtcgccggcgttggtcgggttctcgtaggtgccgtacaggtagcccgacgcgggcagcccgagccggccgcacgccccggtggccaggatgaccgccttggcgccgaccgtgacgaattcgccggtgcgggtgtgcaacgcggcggcgccgacggcgcggccaccgctgtcggggtcgaccaacacccgcaccggcatcagccggttctcgatgcggatccgctcgcgcatcgagcgttgccgcagcacccggtacagcgccttcttgacgtccttgccctcgggcatgggcagcacgtacgacccggagcggtgcacgcggcgcacggcgtattcgccgtgctcgttcttttcgaacttcaccccgtagcgctccagccgctgcaccatggcgaagccgcgggtggcggtctgatagatggtgcgctggttgacgattccgtcgttggcgcgggtgatctcggcgacgtagtcctcgggttcggccttgcccgggatcaccgcgttgttgacgccgtccatgcccatcgccagcgcgccggagtgccgcacgtgcgccttctccagcagcagcacctgcgccccgtgctcggcggccgacagcgcggccatggtgcccgcggtgccgccgccgatcaccaggacgtcacagtccagccggagcggggcggtggggtcgggtatctgcatcaggcggcctccgcgtggttgagtgcgtcgatgatctgcgcccgcaactcggcgtgcgggcggtcgctgcgcggctcgggcacctcgaccgacgcacgcggcggctcgccggcgcggcccagcaccacgatgcggtcgcccagggccagcgcctcgtcgacgtcgtgggtgacgaacacgatggtggtcgggtgggtgcgccaggtgtcgatcagcagccgctgcatggccgcgcgggtccgggtgtccagcgcgccgaacggctcgtccatcatcaccgcgcgcggcgccccggccaggccgcgggcgagctggacgcgctggcgcatccccccggacaggctcttgggcaggtagtcgccgaacccggccagccccagctcggagatccaccgctcggcggccgcgcgccggccggcccgcggctggccgcgcagccgcagcgccagttcgatgttggaccgcaccgtgcgccacggcagtaaggcgttgtcctggaacaccattgcgcgatcacccgaggtaccggtgaccggcacgccgtcggccagcacccggccgccgtcgggggtcagcaggccggccagggcccgcagcaccgtcgacttgccgcagcccgacggcccggtcagcaccaggatctcccccgggcgcaccaccaggctcagctcgttgatcaccgcggggccgttgtaggacaaccgaactcggtccagctcgaggcgcatggcggtcatcgcgcaccgtcctgggcgcgcggcagccaccgggtcacccgccggcccaccagttcgacggccgccgacgtggcgaaccccagcacgccgatggtgatgatgccgacgaacacctgcgggtaggccagcacggtgtagtcctgccaggtgcggtaaccgaccccgagacggcccgagatcatctcggcggagatcacgcagatccaggccacgcccatgccgacggacaggccgccgaacacccccggcaggatgccgggcaacaccacctgggtcagcacctgccagcggccgccgcccagcgtgcgcaccgagtcctcccacagcgtgggcagcgcgcgcacggcgtgccgggtggagaccatgatcgggaagtaggccgccaggaacgtgatgaacacgatgccggcctcgtcggtggggaacaacaggatggccaccggcaccatcgcgatggccgggatgggccgggccagttcggccagcggcccgaacacgtcggcgaacaaccgcgaacggcccagcagcacaccggtcgccaccccgatgacggcggccagcccgaagccggtcaggatccgcagcagcgactgcgccagatccagccagtactcgccggccgccagccggcggtgcaacgcgccgacgatctcggtgacggtgggcagcgtgtcgaagcgcagcagcagccgcaccttgtcggcggtgagcagctgccacaacccgatggcggcggccaccgagaccacccgcagcacccgcgactgccaccgcagcgtgccgcggcgggggcgggccagcgggggcgccgaaatcacgccgcccaccacctgatcggccaccacttgggctgtcataccgaacctcccagtgcctgttggtaattcacggcgatgccgccggggtgcgcggccaggtagcggcccgccccggctgcggtgccgaacggcagatagttctgcccgtctttgacccagaacgccttgtcggcgaaccagcgggtgccgaactcggtgtcggggacgtaggccgcgcggacccgcgcgccgcggccgagcgcgtcgcgcaccgcccgcagcaggctcgccgggtcggcggtggtctgcgtcgtgtcggcgccgtccagccacagctcgccggctagcgccgggtcgccgcgcagcgtggacgggttggtggtgcgcgcccgggcggcttggtagtccagcccgcgcgcggtgaacaccgcccgcagtggctcgtccacgacgaacttgtccacgtccaggtcggcgaagtcgccgatcgacttcaggtagggcacatcgcttttcagcgcttcggtcagcgacggcttgagcgtggtgtcgaacgaggtgccgcccgggccgttgtagaggtacaccacctccgggggcagcccgctggcgtcggcgacgatgcgggcggcctgcagcgggtgcgcgttgaggaaatcggtggcgtccagttgcgcctgcaggaaggcggccagcacctccgggtgggccgccgcgtaggagcggcgcaccaccacaccgtgcagggtgggcaggttcagctcggccccgtcgtagagcagtttggccttgccctggaacaccagcagaccgggccaggccacgaactgcgaaagtgcttgcacctgaccggattccagcgccgacgccccgacctggggctgctggttgagcacctcgacaccgttgacgccggcccggctcagggcccgcaccagggtgccgtggccggccgagcccacgctggccgagaccttggcgccggccaggtcggccaggtcctggcccgcgaatccgggctgaccaccaccatgttcagcgcgcccttggggttgtagccggtgatggagaccatctcggtgcgggccagcgggttggcctgcgtcttggagccgttgatcagcatcgggtagtcgcccatcgagccgatgtcgatcttttcggcgagcatctgcgcggtgatcggcgccccggtgtcgtaatcctgccagcgcaccgcgtatttggtgccggtgcgggtggtgatgtcggccaggcggcgctccaggtagccctgggcgcgcagcagcgtgcccgcggtgacggtgttgatggtcttggactggtagcccaccaccacgttgaccaccccggccgactgggacagggattccagcgagcacccggtgcccagcgcggcgaccgcgatcagcaccgacgccagcagggcggcatgtcttctcatggaagttcctgggggtgaacgcttttcagcgaagcaggtagggcatgttgacggtgaccgcgccggtcgggcagcgggcggcgcacgggccgcagtaccagcattcgtcgacgtgcatgtaggccttgccggtgtcggggtcgatggccagggcatcgagcgggcagacctcgacgcacagcgtgcagccctcgatgcacagcgactcgtcgatggtcaccggcacgtcgacgcgggtgttgtggatcagcgtcatgagttgctcctcatcggctcggctctgaacaggttgccgcgcatggtgattcgatcgccccgcatccggatgtactcgaggtcgacgggagtgccgtcggccaggctggtgagccgctccagcatgagcagcgccgcgccgtcgggcacctgcagcgtggccgccgaatgcgcgtcggcggggatggcctcgagcgccagcgccgccgagcccagccgctgcccgctgacctgttcgatgagggcgaacacgtcgttggtctccagcgaatgctccagcacctggcggccgatcgcgggggccaggtacgtgaggtccaggctgagcggcagctcgccgaggtagcgcagccgctcgatgaacaccgcctgctcccccggcgccagccgcagtcggcgggccaccgacggcggcgccgtgaccggcatcgccgcgcgcacctcgttgcgcacctcgccgaggtccttgaacgtctccttcagccccagcagcgcgtccagggcgtggtcgtatttgcgctgcgcgacatgggtgcccaccctgggcccgcggtcgatcaggccttcgcgcttgagcacggccagcgcctcgcgaatcgtgttgcgcgacaccgagaattcgtcggccagctccagttcggcgggcaggccgtccgggtaggcgtcggcgtggatctgctggcgcaacacgtcggccacccgacgggcccggtcggcccgcggtcccccgatcggtactggatgcgccacgacggtcacgctaacgcagctcaggggcgttttccgggccggcgaccggggtcgcagccggcgaccgacggcattgcgccgggtggcgttcgggcccgaccagccaaaaccgcggcgcgccgggtcattgcgccacccgcggccaccgggcgggtttgtgatccggatgagcagaactgccggcccggtcacgctacggtgggcatgctgaacatcccgatgacggaggatgaccgcacatgagcgcagctgatggggtgtcgagccagacctggaccaaggtgcccgcgatcacgctcggcttctgggtgatcaaggtgttggcgacgacgctgggcgaaaccggcggcgacaccgtcacgatgacgctggattggggctacgcggccggggtggcgctcttcggtgtcacgctggtgctgctggtggcggcgcagatcctcgccgcgcgctttcaccccgtcctctactgggcgacgatcgtggcgtcgaccacgttcggcaccgtgctggccgacttcgccgaccgttcgctgggcatcggctacaccggcgggtcgctgctgctgttggcttgtctgctggccactttgggtctttggcgctggtcgcagggcacggtgtcggtcgcgaccgtgcacacgccgaaggtcgaggcgttctactgggcgaccatcacgttctcccagacgctgggcaccgcgctgggcgactggctggccgacacccgcgacttcggctaccggcgcggcgccctggtcttcgcggcgggcctgctcgtggtcgccggcctgtacttctggacgggcgtgtcgcgggtcgccctgttctgggtcgcgttcatcctcacccggccgctgggggcgaccgtcggcgatttcatcgacaagcccgtcgcccaggggggcctggcgtggagccgcccgctggccacggcggtgctggcggcgctgatcgccgtgctgctcatcgtgataccgcagcggccgggccggcaccccggaaggccggaagccggtgcggcgcaatcccccaccgcgacctgactctcaacgatttcacagcgaattctgcgtaccgtcgtcggcggcgagaccaaatcaggaccggacgaaggagcgggcatgccacccgtgccacggcagcgggtcggggcgccgctgatgatgcttcccccgatgggcttgcgggaacagccgatccacgaatgccccaccatgtggttcaaccgcgatttcttcgaatccccttggcccggctggacggtcgacgtcgatctgacccggccgacgacgttcgtcagccacaccgatcccggcgagacgctgcgcggccacccggtgcgcatcaggctggaggatccgggcgtgctgtgggtggcgacgaaccggttcgcccggatgggcggcccgttcgccgaggtgctcatcgaggcccgctggcccgactagcgggggtcgacgtagcgtgaacgcatgaaagtcctgctcgtcgaggacgagccccggctggcggcgacggtggcgcggggactcaaggcggagggattcgtggtggtgaccgtcggcaacggcgtcgacggcctggccgaggccaccgaaaaccctttcgacatcgtcattctcgacatcatgctgcccggccgcagcgggtacgaggtgctgcggcggatgcggtcgaacaacgtgtggacaccggtgctcatgctgaccgccaaggacggcgagtacgacgagaccgacgccttcgatttgggtgcggatgactatctgaccaaaccgttttcgttccgggtgctggtggcgcggctgcgggcgctggtgcgccgcggcgcgccggagcggccggtggtgctgacggccgggtcgctgtcgctggatccggcccggcacaccgtccagcgcggctccacgccgatcgcgctgacgccgcgcgagtacggggtgctggagttcctgatgcgcaacaaggacgtggtggtgaccaaggccgacatcctggcgaacgtgtgggacgcgcatcaccacgggccggacaacgtggtcgaggtgtacgtgggctacctgcgccgcaagatcgatgttccgttcggcaccaacaccattgagacgatccggggggtcggttaccggctgctgtgctgagccgggtgttgcggcagggccaccgtcagggtggtgcccccgcccggccggtcgccgatggtgacggtgccgccgtgcgcggcgaccacctcggcgacgatggccaggcccagcccggccccaccgccgctgcgcgcgcgatcggtgtccagccgcacgaaccgctcgaacacccggcttcgctgcgccggcggtatgcccgggccgtcatcgccgacggtgagcaccgccgtcccgtcacggctgccgacctcgatggcgacgcacgaaaccgcgtggcgcacagcgttatccaccaggttgcggatcatgcgcgtcatggccgtcgggtcggcgagcagccgcgccgggcggatgtcggtgtggaccgcgcagtcggcgtcgcggcgcacccgggcagcttccgcctcggcgaggtcgtcgagggccaccggctccttgcgccgcaacaggtttcgctcgtcggcgcgggccagcagcagcaggtcgtcgatcagggcgcgcatccggtgcgcctcgggcagcagggtgttgaccgccagctcggcgtcgagcagctcggggtgcgcctcggccacctccagcccggagatgatggtggtcagcgggctgcgcagctcgtgtgacgcgtcgccgacaaagcgttgctgcgcacggtgtcccgcttccagccgggacagcatctcgttcatggtgaccgccagggccgcgatctcgtcgcggccgtccgggaccggcacccgctcggccaggtccgacgccgagatgtcggccacccgggcgcggatggcgtccaccgacttcagcgatcggcgcaccagccagtacgtcgcgccggccgccaccgcgacgatgaccggtgcggtggtggccaacaggatcgccagggtgcgtgcggtcgcctcgaccgcctcgctgcccccgccgaccagcaccgtgtacacccccgaccgggtggcgaccttctggccgctgacccgcatgtcgtcgccggacaccgcgtcgtcgggcaggccgcgacgcagggtgaagtcgaaatcggcggtcggcaccaacggggtggccggcgcggagccggaccgcttgaccacgctgccgtccggaccgatcaactgggtggccaccacccgctggtcggtggtcagcagggcgttgtcgagttcctcgcgcgaatccgactgcagcgccttggcgatgtcgcgaacccgttcggccgcagcgtaatccacgccggacagcaacgaccggtacaggatggcgtccaatcccgcgccggccaccgtcagcgcgcagaagacgacgatcgccgcgaccgccgccgagcgggcggagatacccaggtgcacgccttcgattctgcaggcccgcgccccgccggagaacaccgagaacggtgcgcttctcagcggcctctcagcggccccgtcctaggctggcaccgacatggttggtactgcacgcccgccgcgcggtgagcatcgagcgatggcccggatgctggtcgccgccgtcgtcgcggtgggctccggggtgctggtggcggcgccggccggcgccgacccgagcccgttcggcacgctgagttcgagttgccgggaccaggccgcggccggccgggacgccctcatccagggcatccaccgcggtgtggccgactggccggtgagcgccccgcacacctcggcccgcaccacctgccccgccgggccgaccccggccaccggctgaaagctcagccgccgtcggcgaccgacggcaccgcgccggcgccgttgtgcgccccgttgccgccggaggcgtccgcgggcaactcgaaggccgcggtcaccgaacccaccgcggcggtcgcggcgttgcgctgcgcctccatccgcgccagcgcggtgtcggtgaacaccgacagccccaaatccgggttgtagccgtggatttccttcacgtcgagctgggccaggaagtagacgatctccttggacaccacctggccgggcaccagcaccgggaaacccggcgggtagggcaccacgaaggtggtcgacaccaggttcttgccctcggccagccgccgcccggccgtgccgatcagcacgtgctcgcggtcggactcctcgtacccggcgtagaacgccgaccgcatgtcgccgaagttgcattcgtcgaccggccggaaggcgacgtcaaattcgctgaagtcgggcaggtgcggaaggtcctcggtgatctcctcgacgtggcgtcgttgcagcgcccggtcggcggcactggcctccttctggatgcgatcgaaatccgttgccacccttcgtaacacgtcgagcagatagtggacgctggaccaggtgacgccgatggtgaagatcagcagcacgctgttgatcgaggtcttgttgatctggatgccgaagcgttccatcaggatcttctcccggaagtcgtacccgttcatgccggtggcgccgacgaacagggtgacccgggtggcgtccagcacgaactggtcggagcgccacgcctcgttccactcggccagcgccccctgccgaacctcgcggtaggagctcaccgacgacgcccggaactcctcgggcaccaggtcggactcgtcgaggatgcggaaccacttgctgatcaaccggtccttgcggacccggtgccggaacaccagcgccatgtcgtagacctgccggaccagctggaagccctcgatgtcgacctggcggcgggccagatccagcgacgccagcagctgctggttgggcgaggtcgaggtgtgggtcaaaaacgcctcaccgaacgcgtcgcgggtgagcgcgttgaaatcctggtcccgcacgtggatcatcgacgcctggcgcagcgccgagagcgacttgtgcgtggaatgggtggcgtagacccgcacccgggcggtggcggggtcgggcagcagctcccgctcgatccactccgaacggtccacgccctgcatcgacgcggcccatttccggtattgctcaacgtaatccggcgaggccagcatctgctcgagccgctcggcggccaccatcgcggtgcgctgcctggcccacggcacggcggtggcgaacgcgtaccacgcctcgtcccacaaaaagcagatgtccggcttgatcgccagcacctcctgcatgacctgcagcgggttgtagaccacgccgtcgaaggtgcagttggtcagcagcagcatccgcacccggtgcaactgcccggccgcctccaggtccagcagggtctgcttgatggtgcgcagcgacaccgccccgtagatcgcgaactgcggcaacggataggcgtccaggtacagcgggtacgccccggccagcaccagcccgtagtggtgcgacttgtggcagttgcggtcgatcagcacgatgtcgccgggccgggtcagtgactgcacgacgatcttgttggcggtcgacgtgccgttggtgacgaagtaggtgtggtcggcgttccaggtcttggccgccttgtccatcgccttcttgatgttgccgtgcgggtccagcagcgagtccaggccgccggaggtggtggaggtttcggccatgaagatgttgcggccgtagaactcccccatgtcctgcagcgagcgggagttgaagatgctggccccgcgcgccaccggcagcgcgtggaactggccgaccggggccgccgcgtacgcccgcagcgcgtcgaaaaacggtgtggcataacggttccgcagcccggcgagcaccgtgctgtgcaggtcggtgacgtcgttgagccggtagaaggtgcggtcgtagacgtcgggttcggtgtcgtcgcccgccgcgatcgattcgtcggtgagcagatacaggtcgatgtgcgggcgcagctcgcggatccactcgccgcactccacccagtcgttggcgcggtcggggatgacgccgtccgcgtcctcgttgggcccgagcagggtgttcatcagcggcagccggtcgcgggagcgcagcggcaggtcgtcgcggatgatcgcggcctggatctccccgttcagcgcgaccgcggtgatggcgtcctcgacgctgggcaccaccaggatctcgaactgcacgtcgtcggacgggttgcgcagcgcccgcaggcattcggccaggctgtccggtgcggtgctgggggcgtcgtcggccagcagcacggtgtagaaatgctgttgcttggcctgggccaccagctcctggtcgtccagcggcgccgacgtgtcgaaaagccctgcgcgatcgccgtattcgctcaacagccgcaccgccagggagacctcctcggtgagccgcaccgtggacaggctgtccaggtgggcgcggaagatcgccaggttctccgcgccggggtacagccagtagcgctcgtaggcggcgatgcggtccagcaggcgcttcacccgggccacgtcgtgcgtcttgtccagcccggccaggtcgacctcggcgaggtgccggcaggcgtcgtcgagcaggttccaggtgtccacccgggcgtacgacgggttggccacggccgccagcgcggacacccgcagccgtcgcggctgggtgctgtatcggatcatgacctcacctgctcttctcgcatcgccgccgctgcagtccagctcgtattgtcatcccgccgcgcccccgcccgtggtcgtttcacctcagcttggtcagcgatccggctcgtcgtcaccgtcgatcacccgccggttaccccggccgccgtccacccagcgcagcacgggcagctcccagcggcggaccggcagctcggtgacgtcggacagtgagcgcaccacgccctgggtcaggcccatgatcgcggccatcaccggcagcagcggccgcagcggcgtggccgccgagcgcacggtgctgatccggcgggccaccgccacccgttcgacgcagtgatacagccaggcgcccacgcccagggcgtggatcgccagcaccgaggcgacgatgctcaggtggtaggcggcgcacaccaccgcgcccaccaccaccgtcgccgccagcacggccgcgacgaccaggcgcagctccaaccgggtcacgtgtcccggggaccccgcaccgcccgggcggccgccctgatctgcggcgtcaccagcatgacctggcccagcacgccgttgacgaagcccggcgagtcgtcggtggacagctccttggccagctggacggcctcgtcgacggcgaccggctcgggcacgtcgtcggcgtacagcagctcccacaccgccacccgcaggatggcgcggtccacggcgggcagccggtccagcgtccagccctgcaggtgcgagctgatcaggtcgtcgatgtgggcggcgtggtcgcccaccccccgggccaccgcggccgtgtacggctgcaggggcgccacttcggggttggtgtcggccaggccggtccggacgtcgaccacctcggccgggctcaacccccgcgcctcggcctcgaacagcaggtcgaccgcgcgcttgcgggcctgatggcgtcccctcaggggtttgctcacgcgttgacgcgccccaggtagctgccgtcgcgggtgtccaccttgagcttgtcgccggtgttgatgaacagcggcacctggatctccgcgccggtttccacggtggcgggtttggtgcccgcgctggaccggtcgccctgcaggccgggctcggtgtgggtgacctccatctcgaccgacaccggcaactcgatgtacagcggcgacccgttgtggaacgccacctgcaccggcatgccctccagcaggaaccgggccgcgtcgcccaccagcgactcgggcagcgggtgctgctcgtagtcctggctgtccatgaagacgaagtcgctgccgtcgcggtacaggtaggtggtgtcgcggcggtcgacggtggcggtctccaccttcacccccgcgttgtaggtcttgtcgacgaccttgccggacagcacgttcttcagcttggtccgcacgaacgccgggcccttgccgggtttgacgtgctggaactcgacgatctgccacagctggccgtcgatcaccaggaccagtccattcttgaaatcggcagtgcttgccacggtgcgcctatatctcctcggggatggacggccggcggtgcggccgtcgtgggacttgtcggccagtttagagggcgccggcgggcgtcaggccaggacggccagctccttggggaacctggtcagcagctccgggggcttgccggcggtctccggcggcaccaccaacgtgtcctcgatgcgcacgccgccgcggccgggcagatagacgccgggctccacggtcaccaccgattcggcgcgcagcgtgccggtggaggtggcgccgatgcccggcgcctcgtggatctccaacccgacgccgtggcccaggctgtggctgaactgctcgccgtagccggcgtcggcgatcacccggcgggccgcggcgtccacctcgcgaaggtcggcgccggcccgcagcgcctcccggccggcccgctgcgcgtcggcgaccagccggtagatctccagctgccagtcggccgccttggtcagcacgaaggtgcgggtcatgtcggagtggtagccgccgaccagcgccccgaagtcgatcttgacgaagtcgccgtcggccagcaccgcgtcggtggggcggtgatgcgggatcgccgagttggcgccggtcgccacgatggtctcgaaggagatcccgtcggcgccgtggtcgagcatcagcgcctccagctcccggctgacctcgcgttcggtgcggccgggccgcagcccgccgccgtccaccagcgcggtgagcgcggcgtcggccgcctcgcaggccagccgcagcagcgcgacctcgccggcgtccttgacctcgcgcaacgcctcgacggtgccggcggccttgaccagctcggtggctgccttgcggccgtccagctcacccgtcagggcgtcgaatccgtcgacggtgaccacgttgctctcgaagcccagggtgcgtgcgcccgcctcggcggcgcggccggccagatagcggcccagcgcgcgttcgatggcgacgtcgaggtcgggggcctgctcggcggcctgggtccggtaccggccgtcggtcgccagcaccgggggccggtcgtcggcgaacaccagcaacgcgccgttggagccggtgaatccggacaggtagcggacgttgatcaggtccgtgaccagcagcgcatccagtccgtcggcctcgagtcgtgccctgagccggtcccggcgttgagaatgtgtcacgggtcttgacggtactcgctacgcttttgggccatgagtaactggatgctgcgcggattggtgtacgccgcggcgatggtcgtcgtccgattgttccagggtgcgctgatcaacgcgtggcagacgcaggccgggctgttcagcgtggtgctgctgctgttgtttgtcatcgcggtggcggtctggggcgtgttcgacggccgggccgacgcgatcgccaaccccgacccggaccgccgcggcgacctggcgatgacctggctgctggccgggctggtcgcgggcgtgctcagcggcgccgtctcctggctgatcgccctggtgtacaagggcctctacaccggcgggctgatcaacgaggtcacgacgttcgcggcgttcaccgcgctgtgcgtctttctgcccggcatcatcggcgtgaccatcggccgctggcgggtggaccgcaacccgccgccgcgccggcccggccacgacgacgagcgcgccgacaccgacgttttctccgcggtgcgcggcgacgacgcgcccaccggcgagattcccgcggccggcgcccagaccgaggcgcacaccgcggcggtcgccaccgccgagcgggaggccgaatcgcccaccgagacgatccccagcgccggggacgacccgaagactgaggtgatccgcaccgagcccgaaccgggcggcgaacccggcaaggcctaggcgggccggccggccaggtagcgcagggcgagcagatagccctgcacccccagcccgacgatcgccccggtggccaccgggctcaggtaggaatgccgccgaaactcttcgcgcgcatgcacattcgagatgtgcacctcgatcagcggggcgctcagctccgcgcacgcatcacgcaacgccaccgaggtgtgggtcagaccgccggcgttgaggatcaccggctggttcgcgtcggccgccccgtggatccagtccagtagttcggcttcgctgtcgctttgccgcacaatggctttcagccccagcgcggcggcctcggcctcgatcagcgcggccagctggtcgtgcgtggtgtcgccgtacacgtcgggctcgcgccggcccagccggcccaggttcgggccgttgatcacctgcacgatcatgaggcgtcctcgtcggccagggcggcatacgccgccgccagcagcgacgggtccgggccggccagccggcccggcttggccaatccgtccagcaccacgaaccgcagcaccccggcgcgggacttcttgtccccggccatgtattccagcagctgcggcagcgcgtcggcgtcgtagctgaccggcaggccgagcgcggacaagatggtgcggtgccgccgcgcggtggcgtcgtcgagccgcccggccaaccgggccagctcggcggcgaagaccaggcccaccgacactgccgcgccgtgccgccaccggtagcgctcgcggcgctcgatcgcatgccccaacgtgtgcccgtagttgaggatttcgcgcagctccgactccttctcgtcggcggcgacgacgtcggccttgaccgcgatggcgcgctggaccagctcggccagcacctcgccggacgggtccaccgcggctcgcggatcggcctcgatgaggtcgaggatcgccggatcggcgatgaagccggccttgacgacttcggccatgccggccaccaactcgttgggcggcaacgtgtgtagcgtcgcgaggtcgaccagcaccgcgagcggctggtggaaggcgccgaccaggttcttgccggcgtcggtgttgatgccggtcttgccgccgacggcggcgtcgaccatgccgagcagggtggtgggcacgtgcacgatgtcgacgccgcgcagccaggtggccgccgcgaaaccggcgacgtcggtggccgcaccaccgcccaggctgaccaacgcgtccttgcgcccgattccgatgcggcccaacacttcccacaggaagccgacgaccgggaggtccttgccgtcctcggcgtccgggatctcgatgcggtgcgcgtcaacacctttgtccgccaaccgctttcggatcacctcggcggtctcggcgagtacgggctggtgcacgacggcgaccttgtgccgggcgccgagcagttcgtccagctcgcccagcagcccggtgccgatgatcaccgggtagggcgggtcgacggccacctgcacggtcaccggttcgcgggtggttctcatgtggcggcccggcaggcatcggtggcgggcagccgcgacacgatgtagcgcaccaccgcgccggggttgcgccggttggtgtcgacccggatggtggcggcccgccggtacagcgggctgcgctcggccagcagcgcgcggtacttctcggcgcgatccggcccggccagcagcgggcgcaccgtgttgccgccggtgcgccgcaccccctcggtggcgctgatctccaggtagacgacggtgtggccggccagcgcctcgcgcaccccggggctggtgaccgcgccgccgcccagcgacagcacgccgtcgtgctcggtcagcgccgcgcgcaccacctcctcctcgatgcggcggaactcccgctcaccgtcggtggcgaagatctcggcgatgggccggccggtgcgctgctcgatggccgcatcggtgtccaggaaacccaccccgagcgccttggccagccgccgcccgatggtggacttgccggagcccggcagcccgatcagcaccgctttgggcgccatcacgcggttccccgggcggccggcgcctcgcgctcggcgaccgcccgccggtaggcgtcgatgttgcggcgggtctcggccagcgagtcgccgccgaacttctgcagcgtcgcgcgggccagcaccagcgccaccatggcctcgaccaccaccccggcggccggcaccgcgcacacgtccgagcgctggtggatggcgacggcctcgtcgccggtggccatgtcgacggtggccagcgcccgcggcacggtggagatcggcttcatcgcggcgcgcacccgcagcggctggccgttggtcatgccgccctccagcccgccggcccggttggtcgagcggaccacgccgtcggggccggggtacatctcgtcgtgggcctggctgccgcggcggcgggcggtggcgaaaccgtcgccgatctccacccccttgatcgcctggatgcccatcaccgcggcggccagctggccgtccagccggttgtcgccgctggtgaacgagcccagcccgacgggcagccccagcgccaccacctcgaccacgccgcccagggtgtcgccgtccttcttggcggcctcgatctcggcgatcatcgcctgttccgccgcctcgtcgtaggcgcgcaccgggctggcgtcgatcgcgggcaggtcgcccgggcccgggggcggcccttcgtacggcgccgacgggccgatcgcgatcacgtgcgagagcacctcgacgccgagcgcctggcgcaggaacgaccgggcgatggtgcccgcggccacccgcgccgcggtctcgcgggcgctggcccgctccagcaccggccgggcgtcgtcgaacccgtacttgagcatgccggcgtagtcggcgtggccgggccgcggccgggtgagcggggcgttgcgggcgctgtcggccagctgcgccgggtcgaccgggtcggtggccatcacggtttcccacttgggccattcggtgttgccgatctcgacggcgatcggtccgcccagggtgaggccgtgccgcaccccggacagcacgctcaccgcgtcccgctcgaagctcatccgggcgccgcggccgtacccgaggcggcgccgggccaactgttcggagatgtcggtggaggtgatctccaccccggcgaccatgccttccagcacggccaccagcgcgcggccatgcgactccccggcggtgatccaacgcaacacgggtcccatcttcccatgtcgagttccgaaaggccgattcgcgcaggccccccacgttcaggagggggacagcgccggatgcgccagccgccggcccgggaccgcgtcgagcagcgcgcgggtgtagtccgcggccggcgcggcgaacaccgccgcggtgtccccggtttccacgacgcgcccggcgcgcagcaccacgacgcggtgcgccagtcgccgcaccaccgacagatcgtgcgagacgaacagataggtcagccccagctgccgctgcagccgcagcagcaggccgacgatctggtcctgggtgacgacgtcgagcgcggacagcggttcgtcgagcaccacgatctgcgggcgcagcaccagggcgcgggcgatcgcgacccgctggcattcaccgccggagagctcgcccggccgccggtccagcttgtcgtcgctcaagccgacactggccagggcctcggcgatgcgctgcgcgcggcgggcccggtcgtgcacccggtaggaccgcagcgggccgtccaggatctggcgcaccgtccagcgcgggtccagcgccgaccccgggttctggtagacgaactggatgtcttgccagtgccggcgccggggccgcgccggcagcgcggcgacatcgcggcccagcacccgcaccgtgccgcgggtgggggtgagcaggccgacgaccattttcgccgtcgtcgacttgcccgacccggactcccccaccagcgccagcgtctcgccccgccggacggtgaaggcgacctccgccacggcggtgtgccgggcccgggcaccgagccggaattccttggcgacgccggcgacctcgatgacgtcctcggagccggcgggcgcggcggccggcgccggggccgtgagccggcggacgagatgcgcggcgtactcggtgcgaggggccgcgacgatggcctcggccggcgcgtcctcgacgacgacgccgccgcgcatcaccacgatgcgcgacgcgtgatcggtggccaccccgatgtcgtgggtgatgaagacgacggtggtgcgctgctcggcgaccagccgatcgaacacggccagcacgtgccgctggacggtcacgtcgagggcggacgtcggctcgtcggcgatcaacagcccggggttgagggcgaacgcgatcgcgatgagcacgcgctggcgcatgccgccggagagctcgcccggatactgtttcaggcgctgcgcggggcggtcgatctccacccggtccagcagctcgatgcagcgccgccgcgcctcgcgccgggacaaccgctcgcccttcagggggaagatctcggcgatctgggatccgatgctgcgcaccgggttcagcgacgtggcgggatcctgcggcaccaatcccacggtgctgccgcgcagccggcaccactgccgttcgctcaggcccagcacgtcgcgaccggcgatggtcaacgaccccgcggtgatcctcgcggccgccggcagcaatccggccaccgcgttggccaaagtcgttttgcccgaaccggattcaccgaccacggcgacgaattcgcccgacgacaccgccaggtcgacgcggtccagcgccaccctgggcaccgcaccgggataggtcacggtcagaccggacacgtcgagcagcggtggacccattgtgcgttctcttctcgttcagatgcggtgcgacgtcagcgcccggcggctgagcacgccgagcgccaggatcaccgacaggacgacggcgccgggcagggtggacagccaccacgcggtggccagatagcggcggccctcggcgaccagcagtccccactccggtgtcggcggcggggcgctgtagccgaggtaacccaacgccgagatcagtaggatcgcaccgctgagatcgatcaccgccagcgcgatcacggcgccggcggcgttgggaacgatgtggcggcggatgaccgaccagcgggtctcgccggacaggaaggcggcctcgacgtagtccagcgcccgcacccgcagcacttcggcgcgaaacacccgcgcgaagacggcgatcgatccgatgcccacaccgatgccgaccgacagcggtccggggccgtaggcggtgacgatccacaccgacgtcaggaaccccggcagcgccagcaacacgtcggacgctcgcatggcgacggcatcgaccacgggtccgctgacgccggcggcgatgccgacggcactgccgagcagcagccccaccgccaccgccaaccccgcggtggcgacggtgtgcgaggttccgtagatgacccgggtcagcacgtcgcggcccaggtggtcggtgccgaaccagtgcgccgcgctcggcggctggaacttgtcaaccggcctgcccttcaacgggtttcgatcggtgaacagccctggagccgccgcccaggcggcggtcaggatcagcaccgccgcggagatccgcaccggccaggacgccctgcgcgcgctcatccgaacctgcccagccgggtggtgaacccgcggcgctgcacccgggtgacccgcgggtcgagcagcggatggatcaggtccaccgccaggttggccgtcacgatcgccaccgccgtcagcagcaccaggccctggatcagcgagatgtcctggctggacaccgcctgcagcagcaccgcacccacgccggagcgggagaataccgtttcggtgaccaccgagccgcccagcagtgcaccgacggtcgtcgcggtcaccgtcagcgccggcccggcggcgttcttcacgacgtgcttgcggatcacccagcccggggtgccgcccttggcccgcgcggtgttgacgtgcggcagcgccagcgtggcgtcgatgttcttgcccagcacctgcgcgatcggcgccgaaacgggcaccgcgagcaccagcgcggcgaccagcagcgacgtcacggatccgtccgggaacaacgagatcaggcccagctgcaccgaaaacacttgcagcacaaccaatccgagtcaaaacgtggggaccgcgccgaacagcggcgggatcgcgcgcagcaccgaccgcaccggcgcgcaggtggtcgccagcgcggtgaccgacaccgcgaacagcaccgcgaacccggtggcggtggccgccagtttcagggtctcgccgatcaccccgccgatccggtcggtgacggcctgaccgctggacagcgagaagccgaaatgcccgtgcagcacctggttcagctgcgcgaagtactgcacccacagcggccggtcgtagccgtagaacgccttgacctgcgcgacgatgtcggggttgaagtagccctcccccttggccacgaagatcgccgccggatcggccggcaggatgctgacgccccagaacaccaggctgaagaccgccagcagcacgatggccgactggccgatccgggcgagaacgtagccgagcatccccctcacgccttccaggcgctctgcagcagcggctcggtgtagcgggtgaattccacgtgcacgttgggtgcggcggcgtgcacctgcacctcatcccacagcaccaacgccagctggtcgtcgatgatcctgcgctgctcgcgggcgacgacgtctttgagccgcgtcgggtcggtctgccgcagttcctcctcggacagcgcgagcaacgcgtcgttctgcgcgaacgtcaggttgcttttcgggcggccgaacagcaggcccagcccgatgttgtactgaatcctggtgccgaacaacggggttgacgattgactgctggaggcattgaagaacgtcgtgtcgcccgcccggttctgcagcaccacgcccagctcccgccactgctgttcgatgaactcgaacgccgggcggaacaccacgctctggttggacgccgccagcgtcagaacaagtttcttgccgtccttttcgcgcacgccgtcgccgcccggcttccacccggccgcatcgagcaggccggccgcccgctgcggctgatacccgatgtcggcgctcacatcggcgaacaacggatcgtcgtgtcccagcacggaatcggccgcgcgatagctgtcggagagcaccgtgtccaccaccgcccgacggtcgatgcccagttgcagcgcccggcgcacccggacgtcgtcgacgacctggttgttgatccggaacccgaccaggttcgcggtctcggcgggagccgccaccgggatcacctgcaggccaccctgtttgagcgcgggttcgtcggtgggctggattccgcgggccacgtccacctgatgggattggaccgcgcccgcgcgcaggcccggctcgccgatcacccggaagacgaccttgtcgacgtaggccggcccctggttgggccacgacgacggcggccacgcgtagtccgggcgcctggtgagcaccacctgctggtcggggatctgcgactggtacacgaaagggcctgagccgatgacgttttcaaccttggcctggcgctggtagtcgagcgccagcgtggccggtgcgcggatgcccgcgcggctgtaggacagcaccttgtagaagttggtgttgggccggtcgaggaaaacggtgacgacgttgccgctgacctcgctgtggtcgtagccgacgaaatcggcgaaggccggcatcttcttggccgggtcacccttgccgagctggtcgaaattcgccttgaccacctcggcggtcagcggtgtgtggtcgctgaagctcaccccgtcgcggatggtgaaggtgtaccgggtggcgttctggttgcgggagaaggttttcgccagccacccgcgcaccgcgtcggttttcgggtcgacgtagaccacccggtcgagcagctggaacatcaggttgttggcgctgtagttggcggccatggtgtcggtgacgaactgcacgtccgagtaggtcagggtgccgccgcgcaccggcggacccgtgggtccggtgctcgcggtgtgccgatggccggaacaccccgccgccaggacgcacagcaccgcgcccagcgtcgcggtgcgcgtcgctaccttcgccatgcaagcgggtcagaagaagctggtgtcgggcagggcggcgccgttgacggcgacatcgccgagcacccgcgccttgtagaccgtcgggttgtgcgagaacagcgtccgcagattacgccagtgccggtccagcagcgccgacgcctggacggcggacgcgccgccggcgtcgaacacgcgtgacgccgcccgcagcgcgggctcctggatcgccaccttgacacgggcggcggcgatcgatgccgcggcttccagttccggatcgatcccggtgtcgcgggcggcctgcagcgccggggcgagctcggccgccgcgttgcgcaccagggcgtgcgcggtgtaggccaccgcgtcgatctcgccgacgatctgcagcagttgcgggtcggcggtcggggtgtcggcgctggcgaacgtgtaggtccggcgccgcccgcgcaccagcgccgcggcgtcctcggtcaggctgcgcaggattccggcggccaccgcgtgcaggtacagctggaccagcgcgccgcgggcccggttgacgccgatggtcgaaccgagcgggaacacttcgtcgtcggcgaccgcaacgtcgttgaataccgttgtgccgcttcctgtctggcgctgaccgatgccgtcccagtcgtcgaggtgctcgaccccggcccggtcgaccggaatcaccacggcggtcggcgcgccgtcgtcgtcctgcgcggtgatccgcaggtagtcggagaactgcgcgccggtgctgtagaacttcctgccgcgcaaccgcaacccgtcgggagtggtgaccagccgggtgtcacggtggttgccgcccaccgacttctggctctgttcggcgttggcgccgccgatcagcccgccctcggcgaccaccgcgatccaccggtcgctgcccgggcgccgcggcgtgacttgcagctcctcgaccagtgcgtagtggatccgcaggatatgcgccaggtcggggtcggcggcggccagcgcgacgaggtagtcgaagaactccggcgccgtgtagccggcgccgcccagctcgcgggccaatcgcagcgcgccgagccgatggtcgcgaaccagtttgagcccacgcagcggcggttcggtgcccccgtcggccaaccgcaggcggtagtccgcggcgatctcggcgagcacgggctgcaccgccgccgcgcccgcgggtgtgtcctgccggtgaaatgcaacgggcatacgtgtcagagccttccggatgcgtccgcgccgcggcggtccgcggcaacagcgaccaaacctaggcgccgccgcacaatgccggcaacggtttaccgcgtcacaatttttaagcggaacacgctgtggtcagccatctttcggcccgcgacgatcgcgggagttgcatcgcgcaggcggccacgtagcgtcctggttcatggctgttgcgctgtccgtcgggatcgagctcgccggcgacggaatcggggaacgctcgcccgcttcgggtatcgccggtctgccgcaccgcctggagtccgccggtgtgcactactgggtgatcggcgccgaccgggccgaaccgcccgccgcgcccagcctcgacgcctcggtgatcgccaccgtcgcggcccggcacagcagccacctgggcctggtcgtcgcggcggcaccgcaccgcgaccacccctacaacctggcccgccggctggtctcggtcgaccacgcggcgcgcgggcgggtcgggtggttcgccctggacgccgaccggcgcatcgccctgggcgccggcgccgacacctggaccggcgccgccctgggtccgccgcacaccgcggaggcgattgcggcggtgcgaacactatggcgcacttggcctttcgcgtcggtgctgggcgaccgcccgaccggcgtcttcgccgacaccacccggctccgccgggccgacgtgcgcggtgcctatcgcatcgccgggccgctgaacgtgcccggctcgcggcagggcgacctgccggtgtggcagcacgccggtgcggccacagcggatgcggacgtggtcgtcgtcgaggacggcgccccggtgcccgacggcgccgtggtccgggtccgctcggtcgatcacgcggcgctcgagcgggtcgcgggcacgacgggcgccgccggcgtgctgctgcgggtgccggctgacgcgctgaccgcggtgctggacgacgtcgtggcggccgcgtaccgccgcggcctgctggccacgccgggtgcgggcacactgcggcaacgactttcactacccgtcccggccgcccccgacctgtcgcaccatccccgcgccttcgacgatgcgccgaacgcgggggcccggctgtgagcccgccgcgagcgcggcctgacgctcaacgtcaacgtgttgaacctgggcatccacaccgcgtcgtggcggcgatcggccgagccgccgaccgcgttcaccgatcccggctactacgtgcggatggcccggatcgccgaacgcggaacgctggatgcgctgtttttggccgacgggccggcggtgcgcgatcatccggcgctgcgcccgtcgcaggccctggagccgagcgtgatcctggcggccgtcgccgccgaaaccgagcatctcgggctgatcggcacgttctcgtcgacgttcaacgacccggtggagctggcgcaccggctgctcagcctcgaccagctctccggtggtcgcctggcgtggaacgtcgtcaccacgtattcggaggcggcgggcggcaacttcggcctggccgatctgccggaccgctcgacgcggtaccggcgcgccgcggagttcgtcgacgtggtgctggcgctgtggcgcgacgccgcgaccggcggcggcgtcgatcaccgcggcgaattcttcgccgtcaccggctcgttgccgcagagcccgtccccgcaggggcatccgctgctggtccaggccggcgggtcgccgcagggccgggaactggccggccgcgtcgccgacgccgtgttcagcgccgaattggacctggacgccgcgatcgagcactaccgctacgtcaaggacgccgccgcggcgcacggccgcggtcgcgacgcggtgcgcatcctgccgggactgatcaccaccatcggcagcagccgcgccgaggcgcagcggcgctacgaggagcagaacgcgctgctgcccgccggccacgacgtcgagcggttgtcacagaccctgggcgccgacctgtccgggctgccgctggacgaacccatccccgcccggctgctgggcagtgtgccggatccgtcgaaattcgttggctccctgggttttcgggagtcggtggtgcgcctggtcgtcagcggcgggctcacgctgcggcagacgctgcgggcgttcagcgggtcgggtcaccgggtgatcgtgggatcgccggtcgacgtggccgataccatcgagcagtggttcggcgccggcgccgcggacggcttcaatctgatgcccgacgtcttccccgacggtctggaggtgttcgtcgacgaggtggtgccgattctgcggtcgcgcgggctgtttcgcgcgtcgtacgccgaggcgacgctgcgcgaaaggctcaccggcgaccggcacgtcgtcgcggcatgaacgcaagaaggaaggtgcgcggtgcccgccgaggctagccgatttctctggtacatcccgaacaccgtcgagccgggccatcgtggtgacgacaccgtcgacggctggggcagcctggactactcggtggacctggcgtcgcgcgccgagcaacacggttgggagggcgcgctgatcggcaccggctggggacggccggacaccttcaccgtcgccaccgcgatcgccgcgcgcaccaccgccttcgcgccgctggtggcggtccggcccggctactggcatccggcgcatttcgccagcgcggccgccaccctggaccggctcaacggcggccggctgttggtcaacatcgtcagcggggccgacgacgtcgccgcctacggcgacaccgaggtcgacaagtcccgccggtacgaccgcacccgcgaattcatccggctgctccgccggttgtggacgcaggacgacgtcaccttccacggcgagttcttccgcgtcgagcactcgacgctgcggccgcgcccgctcggtgccgagcagggccggcacccgaagctgtatttcggtggggcctcgccggccgccgagcaggtcgccgcgaccgacgccgacgtccagctgttctggggcgagtcgctggacggcatcgccgaacgcatcgaccggctgaaggcgttgtcggacaggctcggtcgcgagcacccgccgctggagttcggcctgcgggtgaccaccctggtgcgcgacacctccgaggaggcctggcgcgacgccgaggcgaaggtcgccaagctggccggcacgccgaccatgatgctgctgcacgacccggcgggctccgaggggcagcggcggctcaacgacctggccgcgcgcggcgaggtgatcgattcctgcctgtacaccacgccgagcaagtacggcggcgagggcgccgggacgacctggctggtcggctcggccgccgaggtcgccgccgcgctgcgcgcctacgccgacctgggggtgagccatttcgtgctgtcggacaccccgtaccagtcggaggtggtccggctcggcgatcagctgttgccgctgctgcgccataccgccctggcgaactgaggcgatcagaacagggccagcccggcgccggccgcggcggccaggcacagcgagggcccgtgcggcaccgtcgggccggcccggcgcacccgggcgagcaccccgaccagcacggtgagcagcggcgcggccagggcagccagaaaccacacgcccaccccgccgcagccggtcagcgcgcccactccgagcgccagcttgacgtcccccgcacccatcccgcccggcgccaccgcatggaccagcagatagatcgcggccagcgcggcggctccggccagcgccgacggcccgcgcccggccagcccggcggccgccaggatcgcggcggccccggtcagggtcagtgcgttgggcagccggtgttgccggatgtcgtagcagctcaacaccgccagccaggtcagcaccgcgcccgcggccgcaattcgcatgcgcggcatgctaatccgcgtcggccgccgcgcaagtcatcgcttcgcgcggggcgggcagcccggtgaactgttccacctgggcgaaggcctggtgcagcagcatctgcatgccgctgatcacccggccgccggcggcgctcaccgcggcggccagcggggtgggccaggggtcgtagacggcgtcgagcagcacgccgacgcgcgccaaggtgccggcatagcgttcggccacctccgccggcagggtgctgaccagcacctcggccgcggccacctcgtcggccagcccagcgccgtccagggcgcagaaccgggtcggcacgcccagctcgtcgccgaggcgcaccagccgggccgccttgtcggggttgcgggccaccacggtgatgccggcgacgcccagctgggccaggcccgcgacggccgccggcgcggtgccgcccgatccacagaccagcgcccatcccgaagcggcgcccagcgcgccggcgacgccgtcgatgtcggtgttgtcggcccgccagcccgtcgcggtgcgcaccagggtgttggccgatcccacccgccgcgcctgctcggtgcgctcgtcggcgaagcgcagcgccgcgaatttgccgggcatggtcaccgacaccccgacccactcggggccgaacccgccgaccacgccgggcagctggtcggcgtcgcattcgatgcgctcgtaggtccagtcgtgcaggcccagcgcacggtaggcggccaggtgcagctgcggggatttcgagtggccgatcggcttgcccagcacggccgccctgcggggccccgcgctagcggggggtgctgtcgaggacaccgttgtgcttagccagctcgatgttggccaggtgctgctgatagtccttggtgaacagcgtcgtcccggcggcgtcgatggtgacgaagtagagccagtcccccggcgcggggtgctcggcggcgtgcagcgcgtcgatgccgggcgaacagatcgcggtggccggcaggccctgcgacacgtaggtgttccacggcgtcttctggccccggtcggcgtcgctggtggccacctcgcggcggtccagcgggtagttgaccgtcgagtcgaattccagcgtgtggtgggcgtgcagccggttgtagatcacctgcgcgaccttggcgaagtccggggtgttggattcctgctgcaccagcgacgccaccaccaggatgtcgtagggcgacaggcccatcgcctgggcggtgtccaccagcccggacttcaggtactcctcggccccggcgctgatcagcccggccaggatgctctccggggacgccgacgggtcgacgttgaaggtgcccggcgcgatcagcccctcgatccggcgatggtccctgcccagctcgttgaccggttccagcgcccacggcggcaccgacagcgccgcggtggtgctgttggtcgcggccgcgcgcagctgctgcaccggcacgcagcgccggttgccgtccaggtccacgcaggtggcctgggagatcagggtgaagatgccggggttgaccttgttggtcttcatgtcggtggtgtcgtcgagctgacggccctccgggatgaccagccggcccacccggctgttggggtcggccagccgggcgacggcgtcggaggccgggatctcggtgcgcatccggtagaagccgggctggatggagtcgatcttgctgttgccgtgcgcggcgttgacgaacgcccgcaccgtcttgaccacgtgctggttgtgcagcgtctcgccgaccatggtggtggagtcgccggcctggatctggatcaccaggtcgcgcttgccgctgccgctgtagtcgtcgcccggcccgaacacggtgtgccacagcttgccgccggcgaacaccccggccagcaccaccacgaccagcagcgccagggcggcgcgcagggcgaagcgccgccggcgccggccccgctcggccctgttccgggccatccggctggatctgcgccgcggcggccccaccgcctcgggctcggcgcgctcgcggcgggcgctgtcaaccatcgccggcctcccgggtcgccgcgcggcgctggtccagccagctctgcaggatggccaccgccgccgcctggtcgatcaccgcgcgctgttccttggcgcgcaccccggcggcgcgcagcgagcgctgcgcggccacggtggtcagccgctcgtcggccagccgcaccggggtgggcgcgatccgccgggccaactggtcggccaggtcgatggcgtccagcgccgacgtgccggtgcggtcggccagggtgcgcggcagcccgacgacgacctcgacggccccgagctcggtgaccagcgcggccagccggcgcaggtgtttgccggagcggtcgcggcgcacggtctcgaccggggtggccagcacggcgtcggggtcgctgcaggccaccccgatgcgcacgctgcccacgtcgatgccgagccgccggccccggccggggtcctggtcagggtcgccgggccggtcggggacgcggtgctgtgtcaagaccactcaaccgacccgcgctatcgcggcgatctcggaacgcacggcgtccagcgccgcgtcgatgccggccggatccttgcccgatccctgcgccaggtccgccttgccgccgccgcgcccgtcgaccggcgccgccagctgcttgaccaggtcgttggcccggatgccgagatcctgggcggcggggttggcggcgacggcgtacggcaccgacccgccctcaccctcggcgatcagcgcgaccaccgcgggatcgctgcccagcttgccgcggatgtcgccgaccagcgagcgcaggtcggccgccgtcatcccgccggacatccgctgcgccaccacgcggacgttaccgatccgctccgcgccggcggcggcgttgccggccgcggcgcgcgcggaggccagccgcatccgctcgagttccttctccgcggcccgcagccgctccaccaggttggccacccgggccggcacctcctccgacggcaccttcagcgacgacgccagccccgccatcagcgcgcgttccttggccaggtgccggaacgagtccagcccgacgtaggcctccacccggcgcaccccggagccgaccgaggattcgcccaggatggtcaccggcccgatctgcgcggagttgtgcacgtgcgtgccgccgcagagctccagcgagaacgggccgccgatctccaccacccgcacctgctcggggtagctctcgccgaacagcgcgatggcccccatcgccttggccttctccagctgctcggtgaaggtgtgcacctcgaagtcggcctgcacggcctggttggtcacctcttcgatctgggtgcgctgctcctcggtcagcgggccctgccagttgaagtcgaaacgcaggtagcccgggcggttcagggagcccgcctgaacggcgttgggccccagcacttgtcgcagcgcggcgtgcaccatgtgggtgcccgagtggccctgggtggcgccgcggcgccactgcgggtcgaccgcggcgatcacggtgtcgccctcgacgaattccccggactcgacgttgacccggtgcacccacagggttttggcgatcttctgcacgtcggtgacggcggcccgggcgctctcgccggcgccggtgccgctgatggtgccctcgtcggcgatctgcccgccggactcggcgtagagcggggtgcggtccagcaccagctcgacccggtccgcgccgtcgccgccgtgggtgaccaccggcacccgtttaccgtccacgaagatccccagaatccttgcctccgaggacaattcgtcgaaaccggtgaactcggtggggccggcgtcgaccagttcgcgatacgcggtcaggtcggcgtgcgcgtgcttgcgggcggcggcgtcggccttggcccggcggcgctgctcggccatcagctcgcggaagcccacctcgtccacctgcagcccggcctcggacgccatctccagcgtgagttcgatcgggaacccgtaggtgtcgtgcaacgtgaacgcgtcggagcccgaaatcgatttcgccccagtggctttggtggtgctggctacttcgtcgaacagtttggagccggccgccagggtgcggttgaacgcggtctcctcggcgacggcgatgcgggcgatccggtcgaagtcggtgaccagttcgggatacgacgggcccatcgcgtcgcgcacggtggccatcaggtcaccgacgatgggcccctcgatgtcgagcagccgggccgagcggatgacccggcgcagcagccggcgcagcacgtagccgcggccgtcgttgcccggggtgacgccgtcgccgatcaggatggccgcggtgcggctgtggtcggcgatgatccggtagcgcacgtcgtcgtcgtggttgccggcgtcgtagggccgcggggcgcgggcggcgaccgcgtcgatgacgggccgcagcaggtcggtctcgtagacgttgtgcacgccctgcagcacgaacgcgacccgctccacacccatgccggtgtcgatgttcttgcgcggcaacggccccaggatctcgaagtcggtcttggaggtgccctcgccgcgctcgctctgcatgaacaccaggttccacagctcgacgtagcggtcctcgttggcgatcggcccgccgcccacgccgaactcctcgccgcggtcgtagtagatctccgaggacgggccgcacgggccggggatgcccatcgaccagtagttgtcctccatgccgcggcgctggatgcgctccgcgggcagcccggcgatctcctgccacagccgcacggcctcgtcgtcgtcgaagtagaccgtcgtccagatgcgttcggggtcaaggccgtagccgccctgctcgacgctgcccgtcagcagcgtccacgccagttcgatggcctcgcgcttgaagtagtcgccgaacgagaagttgccggccatctggaagaaggtgttgtgccgggtggtgatgccgacctcgtcgatgtcgggggtgcggatgcacttctggatgctggtggccgtcgggtacggcggcgtgcgcgcgcccaggaagtagggcacgaactggaccatgcccgcgttgacgaacagcaggttggggtcgtcgaggatcaccgacgcgctcggcacctcggtgtggcccgccttcacgaagtgatcaagaaatcgcttcctgatctcgtgtgtctgcactttccagcccgcttcttcccgttgcttttctgcattgacgtgtaatcccagcctattcgctggaatattggaccaccgcgccgctagccctccaaaaagctcagccgcacggagcgttgcgggttgtcgcggttgaggtcgaccagcacgatgctctgccaggtgcccagcatcggctcccccgccgagaccgggaccgtcaccgacggcgcgaccagggccggcagcacgtggtcggcgccgtggcccggggagccgtgcgcgtgccggtaccggtcgtcgcggggcagcagccgctccagcgtgtcgaccaggtcgtcgtcggagccggcgcccatctcgatgacggccaccccggccgtcgcgtgcgggacgaacacgttgcacaggccgtcaccgcgggaccagcagaacccgcgcaccgcctcggtgagatcgacgatgcggcgacgggaggtgtccacgtccaacacatcggtatgcattcgaaccagcctacggcgcgggcgtcgcgaccagccaatcgtttgtgagcgcgaccacatttgggcattgcgggccgccaccggtgagaggaaggtaactggtgggaccggtggcgccaccggggtgccaccccgacacggaaggggtcgaccgtgtacgcacgctctaccaccatccaggcgcaacccctgtcgatcgacatcggaattgcgcacgctcgcgatgtcgtcatgcccgccctgaccgagatcgacgggtgcgtggggctgtcgctgttggtggaccggcagtccggcacctgcatcgcgaccagctcgtgggagtcgatcgacgccatgcggggcagcgccgcgcgggtggcgcccatccgggaccgggccgcgctgatgttcgacggcagcgcgcgggtcgaggagtgagacatcgcgctgctgcaccgcgaccacccgtcccgggacggcgcctgcgtgcgcgccacgtggctcaaggtggtgcccgaccagctcagccggtcgctggagttctaccggtcctcggtgctgcccgagctcgagcagctcgacgggttctgcagcgccagcctgatggtcgaccacccggcctgccgccgggccgtggcctgctcgacgttcgactcgatggacgcgatggcccgcaaccgcgaccgggccaccgagctgcgcagcaggcgggtgcgcgagctgggcgccgaggtgatcgacgtcgccgagttcgagctggcgatcgcccacctgcgggtgcccgagctggtctaggggcgcgctcgcgagcgtcacgccagcgtggcggcggcggtcgagcgtcacgccagcgtgacgctcggcgcgcttagggcaaggcgtcgccggggaacccgcggcaggcgtgcacctcgtagctgaagacgcccgccgcgaccccggggtcctcgctcatgatccgggtggtctcgtcgaccgtcgccgcgaacaccccgacgccgcagacgtcggacccgtcgctgaccggcagcaccaccgcgagcacgccatcgtcgcgcagcccgaaattgcgccggccgtgctcccagatcacgccggccgctgactcgtggccgaagccggggccgcgcttgaggatgacgacgctgtagggcttggcggtggtcagcagccggcccatctcctcgtcggtgaagactttcatgaccgtcccctcttgttgcggatgatcgcgcgcagccggtccagccgcccggccatctcccgctcggcgccgcggccggtgggccggtagtagtccacaccgaccagctcgtccggcggatactgttgtgccacaacaccatccgggtggtcgtgggagtactggtagccctgggcgtggcccagcgccgccgcacccgaatagtgtccgtcgcgcaggtgggcgggcaccaggccggccttgccggccttgatgtcgctcatcgccgcgcccagcgcggtggtgaccgcgttggacttcggcgcggtggccagatagacggtgcagtgcgccagggtgagctgcgcctcgggcatgccgatcagcgccaccgtctgcgcggccgccaccgccacctgcagcgcggccgggtcggccatgccgatgtcctcgctggccaggatcatcagccggcgcgcgatgaagcgcgggtcctcccccgctaccagcatgcgggccagatagtgcagcgcggcgtccacgtccgagccgcggaccgatttgatgaaggcgctgatcacgtcgtagtgctggtcgccgtcgcggtcgtagcgcaccgcggcctcgtccagggactgctcgacggtctgcacggtgaccgattcgccggcctcggcggccacctccagcgccgtcagcgcccgccgggcatcgcctgcggccagccgcaccagcaggtcgacggcctcgggcgcgaccgggacccgcccgcccaggccgcgcgggtcgtcgatcgcgcggcgcaccacggtgcggatgtcgtcggcgctcagcggccgcagctgcaagatcagcgaccgggacagcagcggcgccaccaccgagaaggacgggttctccgtggtggccgccaccagcagcaccacccggttctccaccgcggacagcagggcgtcctgctgggtcttggagaaccggtgcacctcgtcgatgaacagcacggtctgctcgccgcgcaacagcgcggtgcgcgcgctctcgatcaccgcgcgcacgtccttgacacccgccgacagcgccgagagcgcctcgaaccggcggccggtcgcctgggagatcagcgcggccagcgtggtcttgccgctgcccggcggcccgtacaggatggccgacgccacgcccgagccctccaccaggcggcgcagcggcgacccgggggccagcaggtggtcctgccctaccacctcgtccagcgacgccgggcgcatccggaccgccagcggcgcaccggccggcacgcccaggccgtggtcgcccggcggcggcgcgccgggcaggtcgaacagaccgtcggacacggcttcaggcataccacgagggggcgacgcgcgagccggcccgcggccgtcaacccgcgcgcgccggcgtcatctttgctaagttccggtttgccgaatccagtgcgcgttcgctcccggtaagtcgagccggcggaaatccaacagcaaggacggacatgagccagccccccgaatatccaggcacgccgcccgagccgccgccggggtacggcccgccaccgggctacggcacgccgccgggctacggcacgccacccccgccgccgccgggctatggcccgccgcccggctacggggcacccccgcccggctacggcccgcccccgggctacggccccccacccgggttcggcggcccgcccaagcccgcgttcagcgtgggcgaggcgttcggctgggcgtggaacgccttcaccaaaaaccctgtggcgctgatcgttccgacgctggtctacctggtggtgctgggcggtgcctccacgctgatcgggctgagccaggacgtcggcacctccggcggcggctccggcgacgactacttcaccttcaccccgaacctcaacggcggcgggatggcgctgctggtgctgggctacctggtcgcctacctggtgggtgcgttcgcccaatccgcctacctgtccggctgcctcgacctggccgacggccgcccggtgaccatcgggtcgttcttcaagccgcgcaacttcggcatggtgttcctggccgcgctgctggtcggcattctcacctcggtcgcctcggcgctgtgcttcctgcccggcctgatcctgggcctcttcgcccagttcaccatcccgtacgccatcgaccggtcggagtcggccgtcaaggcactcagctccagcttctccaccgtcaccgcgaacttcgccaacgccctgctggtgtggctggccgagttcgcgctggtggtggtcggcgccgtggcgtgtggcgtcgggctgctgctggccgcgccggtcgccgccctggtcgggatctacgcctaccgcaagctgtccggcggccaggtggcgccgccgccgggctaccagcccggcccgccgcccggctatcagcccggcccgccgccgggggccccgccggcgtagcggccggccgcggccactcccggcgcgccgggctcccccggccgcgccgcgtgcgtaccgtgcagctgtaatggggtttgcggacaagacattcggcaccggtggaccctcggcggccgccggcggctcctacgacgccgaccgcctgctggccgggtaccgggcggcgcgggcccagcaggcgctgttcgacctgcgacagggcccggcgagcggctacgacgaattcgtcggccccgacggcaaggtgcgcccggcctggaccgagctggccgacgccatcggcgaacgcggccgcgccgggctggaccggctgcgctcggtggtccgcggcctgatcgaccacgacggcatcacctacaccgacgtcgagcccggcggccgcggccaggagccgcggccctggcagctggacaccctgccgatcgtgctgtcggcggccgactgggagccgctggaggccgggctgctgcagcggtcgcgggtgctcgacgcggtgctggccgacctgtacgggccgcgcagcctgctcaccgagggcgtgctgcccccggagctgctgttcggccatcccggctacctgcgcgccgccaacggcatcgaaatcccgggccgtcaccagcttttcatgcacgcctgcgatgtcagccggcgcccggacggcggcttcgccgtcaacgccgaccgcacccaggcgccctcgggcgccggctacgcgctggccgatcggcgggtggtggcgcacgcgattcccgacctgtacgagcggatcgcgccgcggcccaccacaccgttcgcgcaggcgctgcggctggcgctgatcgacgcggcgcccgacgtcgcccaggacccggtggtggtggtgctgtcgccgggcatctactccgagacggcgttcgaccaggcctatctggccaccctgctgggtttcccgctggtggagagcgccgacctggtggtgcgcgacggcatggtgtggatgcgttcgctggggacgctgaaacgggtcgacgtggtgctgcgccgggtcgacgccgagtactgcgatccgctggacctgcgcgccgactcccggctcggggtggccggcctggtggaggcgcagcatcgcgggacggtgaccgtcgtcaacaccctgggcagcggaattctggaaaacccagggctgcaacgttttctgccggcgatggcgcggcacctgctgtccgaaacgctgctactgcccagcgcgccggtctactggggcggcatcgacaccgaacgttcacacctgctggccaatctggcgtcgctgctggtgaagtccacggtgggcgggaaaacgcttgttgggccggcgctttcgtcgctgcagctcgcccagctggctgcccggatcgagacggcgccgtggcagtggatcggccaggagctgccgcagttctcctcggcgccgaccgaccacgccggcgtgttgtcgtcggccggggtcggcatccggctgttcaccgtggcccagcgcggcggctacgccccgatgatcggcggcatcggctacctgctggccgccggcccggccgcgtacacgttgaaaagcgttgcggccaaggatgtctgggtgcgtccgaccgagcgggcccgggccgaggcggtcggcgtgcccgccgtggagccgccggcgaagacggccgcgggcacctgggccgtcagctccccgcgggtgctgtccgagctgttctggatcgggcggtacggcgagcgcgcggagagcatggcccggctgctcatcgtcacccgcgaccgcttccacgtctaccgccatcaccagcacagcgaggaaagcgagtgcgtgccggtgctgatggccgcgctaggccgcatcacgggcaccgacaccggcaccggcgccgcagccggtggcgatgcggccgagacgatcgccgtcgcgccctccacgctgtggtcgctgaccgtcgacccgcagcggcccggctcgctggtgcagtcggtggaggggctggcgctggccgcgcgggcggtgcgcgaccagatgtccaacgacacctggatggtgctggccggggtggagcgggcgctggcgctggacagcgaaccgccggactcgctggccgaggccgacgcgctgctcaccgcggcgcagacccagacgctggccgggatgctgaccctgtccggggtggccggcgagtcgatggtgcgcgacgtcggctggaccatgatggacatcggcaagcggatcgaacgcggcctgtggctgacggcgctgctgcgggccacgctcgccgtggtgcgcggcgcggccgccgaacagaccatcctcgagtcgacgctggtggcctgcgagtcctcggtcagctaccggcgccgcacggcgggcaaggtgagcgtggccgcgatggccgagctgatgctgttcgacgcgcagaacccgcggtcgctgctctaccaggtggagcggctgcgcgccgacctcaaggacctgcccggtgcatccgggtcgtcgcgcccggaacggctggtcgacgagatcggcacccggctgcgccggtcgcatcccgcggagctggaacgcatcagcgacgacgggcggcgcaccgagctcgccgagctgctcgattcggtgcacgccgagctgcgcagcctggccgaggtgctcaccaccacccagctggcgctgcccggcggcatgcagccgctgtggggtcccgacgtgcgccgcgtgatgccggcctaaccggccccgtcgaccacggcgtggatgaactgcatcttctccagcaccgcggccggcagcacgaatgggtacaggtcgtcgtggcccatggaccggttcaccatgttcagtgaccacgacaacggcagccacgtgtcgatgatcgtctgaaaagcgctgggccccaacgccggacgatcgatggtggccgacgccggggccagcccgcaccacgccgaggtgtcgagcgtgtcgcggatgtgcaggtagtgggcgaacgtctcggcccaatcctcgctggcgtgcatggtggcatatgacgagacgaagttctcctgccagccctccggcgcgccctcgctgtagtgccggtccagcgcctgctggtagtcggcgtcgggatcgccgaacagctcgttgaaccggcgcaggtggtcggggtgcggggcgatcagccggtagaagtagtagtgcccgatctcgtgccggaagtgcccgagcagcgtccggtacggctcgtccatctcgacccgcagctgttcgcggtgcacgtcgtcgccctcggccaaatccagtgtgatgaccccgttctggtgaccggtcagcacgttctcgtgcgcgctggacagcagccggaaggccaggccgtagtcggggtcctgatcacgcccgacgatcggcagccgcagctcgtgcagctcggcgatcagccggcgtttggccgcctcggcgcgggcgaactcggccagccccacggagtcggcgtcgttgggccgctcggtggtcagcacgcaggacgcgcacagcaaccgcggctcgttcaccgggaccagccaattgcattcggccagaagcagattggcgcacaactggtattcgctggcgggcacgaagccggcgtgcccgctcgtctcgtcctccgagatcaccagcagtgccatctgctcgatcgaaaaccccagcgcgctaccgcaattcaggcaggtggagttctcgaaggtcaggcgctggccgcacttggggcaggtgaagtcacgcatagggcaccacgtcgacggacacgtcgatcacgctgtgctgtgagttggtgtagatgatgccccgcagcggcgggacgtcggcgtagtcgcggccgcgtcccaccacgatgtagcgctcgtcgatcatctggtcgttggtgggatccactcccagccactcgaattgaccgggctcgtgcggggtccacacggcggcccaggcgtgggtggcgtcgatgccgatcatccggtcctttccgggaggggggtcggtggccagatacccggacacgtagctggccgccaacccgtgggcgcgcaggcaggcgatcgccagccgcgcaaagtcctggcataccccttcgcgggccgccagaacctcggcgaccccggtggagatcgtcgtcgacccggaccggtaggtggagtcggtgaagatccgcgacgccaggtcccgcagcacctcgatcagcggccgcccgggcgcgaaactgggtgcggcgtagtcgcgcacctcgtcggtgatctccggcgggtcgaggtccagggtgaattcggtggccagcgccccgcggcggccggccgggcgggccgcctcccagggctgcaccgccggcccggtggtgtacaggcccggcgccggcgggttgacgtcgacgatggaatcgctggtcaccgtcaggctgtggtgcggttcggtgacgtggaaataggagctgatgttgccgtagcagtcggtgctggtggagctgtcggccggggccgggtcgatggtcagccgatgggcgacgcagcgctgccgcagcgagtcccgcggcgtcaggaaaccccggccgtaggagctggtcaccacgtcggagtagcggtactcggtgcggtgggtgacgcggtggcggcgggcggccccgccgtcggcctgctgatcggcttcgggcacaaggctgatcacatcacaccggggccgccgccgcggtcgcgatgccgccgcgtttgccgatccggcggcggccgcgccgaaacgggagcacaatcgagagcgtggccacgtggtacgacgtcgcccgcatcgtgggtgagctggccctcacctccgagccgtcaccgcacgattggcgggtcggcaagaagttgctggcctgggagcgcccgctgcggccctccgagcgggaagcgctggcccgcaccggcgccgagcccgccccgggcaacgtcctcggtgtccgggtggccgacgagggcgtcaagttcgcgctgatcgacgacgcgccgcagaccttcttcaccaccccgcatttcgacggctatcccgcggtgctggtcaacctggacgccatctcggtgcgcgacctcgaggagctgatcaccgaggcgtggctgacccaggcgccgcggaaactggtgcaggagttcctggccgactcgcggtgagcccctcaccccggccgcaggtcgatcacccgttgcaggtcgtcgacgcaggcgccgacggcgtcggccagcgcgacgtgcggctcccggtcgccgccgtcgccggagcgcagccgcgccgcgtgccggcgcgccgacccgagatacacgcacgcgccggccggatcgcggtcggccagcgcggtcgccgccgccagcaccagcagtaccgtcgacaccggctgcccctgccggtcgccggggccgggggccaccgcgcgggccagctgcagcaccgagccggccagcagcgcgacgtgcacggcctgatggtcggcggcgcgcacggcgtcgcgcaggccccagcgtcgcggcgcgatggcgacgacgtgccaggcggtggtgcgcgcctccagcaggccgctgagctgttcgtgcacccggtcgacggcgctcagcggccagtcgggcggggccgcccggcggccggaggaaacgtcggcggcccgggacagcacgtcgtgcagcaccgccagcacgccggcccgggcggcgccaagcacggtgcgcgggtcggcggggaacagcagcacggcgacgacgatggccaccgcgccgccgatcagcgcgtcgaagatgcgttccggcccggcgccgccgcggtacagggccaacaccaacagcgccgagaccacggtctggttggcgaacatcatcccgtgcccgatgaagccgcccccgatgaacaccgcggcgcccagcgcgaccggcgcggcgaccgcgatgggcagcgcgccgggaccgagcatcccctgcaccacggtgcccagcccgatgcccagcgtcaccccgatcatcatctggacggcccgttgggcgcgcagcacgttgctggtcgacaacgacaccgcggcggcgatcggcgcgaagaacggttgcggatggtccagcacgtcgtgggccaggtaccaggacaggccggcggccagcgacgtctgcagcaggttgaaccacaccgcacccagccgcttgccgcccgcccgcacggcggtgcgcaccaacgagggcaccgccgagccgcgcatcggtcaggtccggatcagctcgaacagggggatcacccggctggtcttagcctggtactcggcaaagccggaggcggccgcggcgacctgggcgaacagcgcgtcgcgctcctcgcggggcagctcgcgcgcggtcacgtcgaagctgtcggtgccgatctccacccgcgcggcggggttggcccgcaggttgtgcacccaggccgggctgaccggggcgccggcgaacgagccgatcaccaggagcttgccgtcgatgcggaagtaggccagcggcgacacccggggctgacccgacttggcgccggtggtgtgcagcagcagcaggtcggcaccctcgaactggccgcccactttgccgtcgttggcccggaattcgtcgatgatgctctggttgaacgcgttgatggtgccggtgtccggaatatcagtcatgcctgctcaacccggtccggcttgacatctattccggacttcgtgctgctcgtttgttgctgttagctgtgatggctgcgcaagaaacaccctggtcaggatagttggttctgacgggtgcctaaagtgctgttgaatctactgcggactgactgcggaccgggactacaacggtacggtccgtcacttgtcggggcccgcgccggtaaacgtcgtggggaacggaatgtcgtccggggcaacgtcatgcgggagtacaccacgtccatggacttgattgagcggttacacgcgggccgttgaatggcctcggagaatccgctcgacccgatccagcagctcactcgggttatcgtcggtggcatctttccaggccgcgagggcgttgaggaggttaatcggctggacgctgagctgggggcccaacagtacagtgtggtcactgttggaatccgccgcgcgataggagatctcgacttggtatgaccggctgcccgcgccattctggatcttgggcacgatcgacagaacgcactcacgcgggattttgatgaactcggccctgggcgcggccaaacgcacggtcagcgccgacggggaaatacacaaaatgcatcggcgccacatccgaactgccgagtaaacgaacagcggtgtcggaatcagcaggatgatgcccgttacacgaagccataccggattgccgggggcaaaccccgcgccgacgctggcggcccctagcagggggaccagcacgttcaagacgtacgcatttccctcgtaccacgggagatacctgcacacgatctcgttccccgaccggttgactcccggccgaaaaatccggcgtctgccgaggacgaagaggagtgccgtgcagaatccgatcagcgacaagtaccaccgcactcccgccgacgttgccaccactgtgaccagaagtagggcgacgccgaacgcgtaccgcagtacccgcccccaccggccgctggcctcactgttgggcatcagtgacggtctcgcattgtggttgccggagcactgcggtggtgatcgtcggaagctggacctgccaccgccgcacgcttgtggacagccagccagatattcgcccgctccaccggtgaatcgcgtagcacggtcatcgtgagttgcgcgatcagcgtctcctcttcagccgtaatgatccgcgatcgtgacacgctctcgatcgcgcccagctcgtgggtaatctgcatcgcaagcaacccctgaactccgacagattcaccggcaaggccgagttcacgatttagttcgcaacacccaggcgccgtctgcaactgctgctcgaccagcatcgcgaacacgtcagcagggtccaaagcggcctggactcgatgcatcgtcaacacggcgttggcgccaaacacgtcgatgcacgggtcggtgcgacaaacccacacacggactccgacggccgaatcgaagggttcccagccccgcggtacccccacctccacgacaagcccggcaaaccgctcgaccggagacacagccaggccgtgcttctccgtgtattcatcgaatcgcatcgtcgccgtcctacccgaaaccgaagaccgattccacgccgtgcaccgcactaccgacggcatccgcgaccggctcccaggccacttcgaccaacttagatcccccccaggcggcgaccgctcccacaccggcgcccaccaccagaccaactgcggtcccggcacccggaatgaccgaaccgatcgctgcaccagctgccgcatccgcggcaagaccaccaaccgtcgcgccagcccatagcccggcagcagttcctgcagtctctcgggtgacggcctcggccgccgagttgccgtcatgcatgtcggacatgacggccggtatggcgctggccgcagcaaccaccccaccgatacgagagaaccccctcagctcgacaccgccgaccttggggtcctccaaccacttcaataagcccggatcagccttgccgggaccggtgccgggggactcagcgatcaagttggtcgtagcctgacgcacaccgtcggcggtaccaccggcgaccgcacccgcagccccgattgccacaatcccccgtcgtcggggtcaacgcgggccccccgccggggtggtcgaccggtgccgggacggttcccgcctggacgccggtggagtcatacccgtctgcgtgtagcgttcccagtgcattctgaaacgagcttgagtacccgtcgcgtgtcgcttgcagctgacccagcgcggctttggtatcgcggatggcgtcgtcttcgcgggcagtgatgaacgcatcaagcgcatgtcgatcttctgcagtgagtttgggatctttttccatctctaccgcttggccgatgaagccatccagttgctgcagccgactttccaacgctgcgatctgccccgccgcggttttttgcgcctcggccaggctcgcggcgatgttttccaggtccgcaccgatcttgggcaactgaagagattgcgccccctagggatttcgtcacccgctgcacttcagccgagtcgttgatcgggtggtctccgtcttgatgattccaagcagcgtcaaagcggtcgcgggcttgctcaaacgagtggttcgcctcggcggtacaccgcccggcagcatgaaaggcctccgcgagctgagaaatccgaaagggactaccggcctgcaagctccggtcgactgcccacgggtcaccaccggcttcagcgatcagcgcaggaatgctgatgtagcggagttgcatggaatcgtcaggtgttcttgatcagcccgggcccgagcacgcccaccatcggtgacgggtcgtcgacacaacgcggcagaccgagaccgacaagcatcgctactcttccgcgcacgggaaaagactaccgcccggcttgtcgatcaattcactttcggactgtgcgcggcgtaggtgctcaagccgcatacttcgtcaattcagttacggccatctgtggcctgatgccgccgaatccacccgcacggctatccgcgcggtgatcgcggagcggatgaacaccactgcggaccagctgcggcccacgagcacctgagcgagccgttcgctgaggtcaatggggtttgctgggctccggcttgacgtctattccggactccttgcgctgctgttcggtgatgggcgccggcgcgtcggtgagcgggtcgacaccgccgccggtcttggggaaggcgatcacctcgcggatggagtcgacccgggacagcagcgcgttgatccggtcccagccgaacgcgatcccgccgtgcgggggcgcgccaaaggtgaacgcctccaacaggaatccgaacttctcctgagcctcggcgtggtccaggcccatcaccgcgaacacccgctcctggatgtcgcggcggtggatacggatcgagccgccgccgatctcgttgccgttgcagacgatgtcgtacgcgtcggcgagcacgttgccggtgtcggtctcgatcgcgtcctcgtatcccggcttgggtgcggtgaacgcgtggtgcaccgcggtccacgccccggagccgacggcgacgtcaccggcggcggtggcgtcgtcggcgggctcgaacagcggcgggtccaccacccagacgaacgcccacgcctgcgggtcgatcaggcccagccggtgggcgatctcgctgcgggccgcgcccagcagcgcccgcgacggcttggccggcccggccgcgaagaagatgcagtcccccggtgcggcgccgacgtgcccggccagcccggcgcgctcggcctcggagaggttcttggccaccggcccgcccagctcgccgtcctcgccgaccagcacgtaggccaggcccttggcgccgcgctgcttggcccactcctgccagccgtccagggtgcggcgcggctgcgaggccccgccgggcatcaccaccgcacccacgtacggcgcctggaagacgcgaaatgtggtgtctttaaagaactccgagcactcgacgagctcgagtccgaaccgcaggtcgggcttgtcggagccgtagcgggccatcgcgtcggcgtagctgatccgcgggatcggccgggggatgtcatagccgatcagcgcccacagcgcggccaggatctcctcggagatcgcgatgacgtcctcggcgtcgacgaagctcatctccatgtcgagctgggtgaactcgggctggcggtcggcgcggaaatcctcgtcgcggtagcagcgggcgatctggtagtagcgctccatcccggccaccatcagcaactgcttgaacagctgcgggctctgcggcagcgcgtagaacgagccgggatgcagccgggccggcaccaggaagtcgcgcgccccctccggggtggagcgggtgatggtcggggtctcgatctcgacgaagtcgtgtcggtccagcacttcgcgcgcggcggcattcaccttggagcgcaaccggattgccgaggccggcgcgtcgcggcgcaggtccaggtaacggtatttcagccgcagctcctcgccggcgggctcgtcgagctggaacggcagcggcgcgctttcgcccagcacggtcagcgacgacgcgttgacctcgatgtcgccggtggcgatttcggggttggcgttgccttccgggcggatctcgaccaacccggtcaccgcgacgcagaactcggcgcgcagccggtgcgcctgcttgaggacgtccgggtcgcggaacaccacctgggtgattccggaggcgtcgcgcaggtcgatgaagatgacgccgccgtggtcgcgccggcgcgccacccagcccgccagcgtcacctgctgcccggcgtcgctacttctcagcgaaccggcggcgtggctgcgcagcacaaaaacactccccttggtctgaaacgaaagccaagtctagaggaggtaactttggtcctattgccaccaccatcgcactcgtcggtcccggcgccgtcggtacgacggcggccgcgctgctgcaccgggccggtcattcggtggtggtgtgcggccgcaccccgcgcgagcgcatcgagctgcgccccgacgacgccgacccgatcgtcgttcccggcccggtgcacaccgatcccggtcgggtgagcggcccggtggacgtggtgctgctggcggtcaaggccacccagaacgccggcgccgccggctggctggcccggctgtgcggcgaacacaccgtcgtggtggtgctacagaacggcgtcgagcaggtcgagcaggtgcggccgctctgcccggtctcgccggtgaccccgggcatcgtctggtattcggcgacgacccagccgcagggctgggtgcggctgcggaccgagcccgccctggtgctgcccagcgggccgtcggcgcaggcggtggccgccctgctgcgcgacgccggctgccgggtggactgcgaccccgacatcattaccgcggcctggcacaagctgctcaccaacgcgctggccgggttcatggcgctgtcgcggcgccggtccgggatgttccgccgcgacgacgtcgccgccctgtcccggcgctacgtcgccgaatgcctggcggtcgcgcgggccgagggtgcccggctgtccgacgacgtcgtcgacgagctggtcgacctgttccgcagggctcccgaggacatgggcacctcgatcctgtccgacgcggaggctcaccggccgatggagtgggacgtccgcaacggggtgatcgcccgcaagggacgcgcccacgggctgcccaccccgatcagcgacgtgctggtgccgttactggccgcggccagcgacggccccggctagattgatcccatgttcgattgcgagcgcgtcggcctcgacttcatcgactcggcgcccgtggtgttccgcaacagtgtcgatttggccatcacccccgagcagctgttcgaggtgctgtccgacgccgcggcctggccgcgctgggcgacggtgatcaccaaggtcacctggaccagccccgagccgcggggcgtgggcaccacccgggtcgtcgagatgcgcggcggtatcgtcggcaacgaggagttcctggcctgggaaccgttcacgcacatggcatttcggttcaacgagtgctcgacccggtcggtggctgcgttcgccgaggactaccgggtgcaggtcatccccggcggttgccggctgacctggaccatggcccagaaacccgccgggccggcgaaactggcgatggcggtggtcgggccgctgctgaacctggccctgcgccgctttctgcgcaacctgcgcagctacaccgactccctagcgacccggcaaccttaggagcgtgtcatgaccttcaacgagggcatgcagatcgacaccagcaccgcgtcctcgtccggcggcggcgggatgggaatggccgtcgggggcggcggcctcgggctgatcatccttctcggcgcgttgttcctcggcgtcgacccgggccgcgtcatgccccagcagcagaccaacaccggcggctactcggcgcccgggttcgacctgagccagtgcaagacgggcgccgacgccaacaagtacgtgcagtgccgcgtggtcgccaccgggaactcggtggacgcggtgtggcatcagctgatgccgcgctacacccgaccgcacgtgcggttgttcaccggccgggtgaacaccggctgcggcccggccaccaccgcggtcgggccgttctactgcccggtggaccagacggcgtacttcgacaccgacttcttccaggagctggtcgaccgattcggttccagcggtgggcctttcgcgcaggagtacgtggtggcccacgagtacggtcaccacgtgcagaacctgcagggcgtgttgggccgctcccagcagggcgcgcagggcgccggcggcaacggggtgcgcaccgagctgcaggccgactgctacgccggcatctgggcgcactacgcctccacggtcaagcaggagagcaccggtgtgccctacctggagccgttgagcgacaaggacatcgccgacgcgctgtcggccgccgcgtcggtgggcgacgaccgcatccagaagcaggcgaccggccgggtcaaccccgagtcctggacgcacggttcctccgagcagcgccagaagtggttcaccatcgggtaccagaccggcgacccgaagcagtgcgacaccttctccgcgcccgacttaggttaggccgcaagcagtttgcgcaactcggcgcggccctgctcgtcgagcggcagcaacggcgcgcgcgggtcgccgactttgaaatcgagcaactccaggccggccttgacggtggtggccagcccgccggccacgatgaaggtgagcagcggcttgaggtcgtcgtagagtcgctgcgcggcgtcgaggtcgttcgcgcgcaccgcgccgtacaggtcgatgcatggttgcggccgcaaacacggtgcggccgtgcaccatccggacgccccggccttcagcgcgtcgagcaccagcgggttgctgccgttgtagaagggcagccggttgccggacagctcggcgatgcgctgcatccgggtcaggtcgccggtggactccttgaccatggccacgttgtcgatggattcgaacatccgcaccagcagctccggcggcatgtccacgccgctggtggccgggttgttgtaggccatgatcggaatcgagatggcgtcgctgatgctgcggtagtgacggaagatctcccgctcggtgagcttccagtaggacaccggcaggatcatcaccgcgtccgccccggcccgctgcgcgtattgggcgcgccgaatcgtcttggcggtggtcacatccgacacccccacgatcaccggcacccggccggcgacggcgctcagggtggtgtcgatcacggcgtcgacttcgggctcctccaggtaggcgagctcgccggtgctgcccagcggcgcgatcgcgtgcacgccggcggacaccacccgctcgaccagcgcggccagccgctcggtgtcaatcccgttgtcggcgaagggcgtaaccggataggcgatgatgccgtggatcttgggttcggtcaagggttggctcctcagctggtcagcgcgtcgggatggcgggccagggcccggcgggcgtagtaggcgaagttggcccggctgcgctgcggtgacagcgtccagtcgtgggcctcgcgggccagctcctcgggcagctgcttgacggtgccggcagccatcgcggccagctgcagcttggcggcgcgctcgatgaggattcccaacgagcacgcctcctcgatgctggcgccggcgatgacgtggccgtggtgggccagcagcaccgccttcttgtcgcccagcgcggcggtgatgatctccccctcctcgttgccgacgggcacgcccggccagtccgccagaaacgcgcagtcgtcgtacagcggggtggtgtccatgtgggataccaccagcgggacctccagcatggacagggctgccacgtggaacgcgtgggtgtgcacgatgcactgcacgtcggggcgggcgcgatagatccagctgtgaaagcggttggcggggttggccattccgtcaccctcgaggacattgaggtcctcgtcgaccagcagcagattgccgtcggtgatctcgtcgaagcccaggccgagccgctgcgtgtagtaggtgccgtcggcctcggcgcgggcggtgatctgcccggccagccccgagtcgtgcccggcgtcgaacagcgcccggcaggtcagggccagcttctggcgggtggtcaacggcggttcggcggcgtcccggccctgcaacgccgtcaactgctcggcagcccggcgcatcaattccgatttcgaatcggtgaacgtgctggccatgtgacacaatgtagcaggttaggaaaccttgtgtcataggagcctcgtgacagcactgctgcgtcccgtccgcaggcaacgcggcctcaccctggaggcgctggctgcgcagaccggcctaaccaagagctacctgtccaaaatcgaacgcggccagagcaccccgtcgatcgcggtcgccctgaaggtcgcgcgagccctcgacgtcgacgtcgggcggctgttctccgacgagacggcccgggagaagatcgccgtcgagcgcgccggtggccccgggggccggcgctaccgggtactggcctcgtcgatgctgggaaagaccatgtcgccgttcgtgattcgccccaccgaacagctggccgacgacccgcaccccgagcacgccggccaggagttcctgttcgtgcacgccggcagggtcgaactcgactacggcgaccagacgttcacgctcgggcccggcgacagcgcgtatttcgacgcctcggtcagccacaaggtccgctcggtcgggccggaaccggccgaggtcgtcgcggtggcgcacgccgaaccgggaagcgcggcgttcgccggctgactagctgggccggcaggtgacggtggtcgttgcgtcctgctgcacgaccacctggccgtccacggcgatctcgcagtggaactgggcgaggccgttgccggagtccggccagtgcagcatgccgctggccgtgatgctggcgaactggttcgggtttgccagcgtagcggtgtaggtgaccggcgttccgccgctgagcggggcctgcacgctggtcgagaacttcgacgggtcggcgttgaaggcggcctggctgggcgggtcggcgttcacgtaggagacgttggcggtcacattgttggggctcgtcacggtgtaggtcacctggtggccgtccgcatgcgccgccgccggcgtgagcaccgccgccacggccatcgtcaccgctgagatcgcgctcgctgtcctgtgcacgttcgtcatatcgaaaacgctaccggattcgttagcgacggttcgctgtttaccggcggctgcgcccgcgctcacccggctcgggtatgaagcagacatgagcgatgagcccacccagcccccgaacccggccggcgccgacgcgcccggcgtcacccgccgccggttgctgaccaccggcgccgtgtcggcggcgttgggggtgggcatcggcgacggcgccacgctgctgtggtcgcagtccgcgcgcaagagagggccctggccgtggctgcagcccaaccgcaacgacgcaccgccggtggccgggctgcacctgcagttcggaaagaacgccgggaccgaggtggtggtgtcctggcacagcaccgacgccgtgcgcaatccgcgcgtcgtgttcggaactccggcgtccgggttcggccgcacggtggccgccgacacccgcacctaccgggatgcgaagtcgggcattgaagttcgggtcaaccatgcccggctgaccggcctgacgccggacaccgactacgtctacgccgcgctgcacgacggcgcgcagccccagcagggcaccgtgcggaccgcgccgatgggccgaaaacccttgcgcttcaccagcttcggtgatcagtcgacgcccgcgctggccaagatgcccaacgggcggtacgccacggacaacatcggctcaccggccgccgccgacaccaccatggccatcgagcggatcggcccgctgttcaacctggtcaacggcgacctgtgttacgccaacctggcgcaaaaccggatccgcacctggtccgactggttcgagaacaactcacgctcggcgcggtttcggccgtggatgccggcggcgggcaatcacgagaacgaattaggcaacggcccaatcggttacggcgcttaccagacgtatttcgcattgcccgactcggggtccagcccgcaaacccgcggcctgtggtattcgttcaccgccgggtcggtgcgggtgatcagcctcaacaacgacgacgtggcctttcaggacggcggcaactcctacgtacacggctattcgggcggggagcaaaagcgttggctggcaaccgaactcgccgcggcccggcgcgacccggacgtcgactggctggtggtgtgcatgcaccagacggcgatctccaccgcggaccggaccaacggcgccgatctgggcatccgcgaagaatggctgccgctgttcgaccagtatcaggtcgatctggtggtgtgcggccacgagcatcactacgagcgctcgcacccgttgcgcggcgcgctgggcaccgacacccgtaccccgataccggtggatacccgcagcgacctcatcgacgccacgcgcggcacggtgcacctggtcatcggcggcggcggcacgtcggcgccgagcaacgcgatgttcttccccgagccccgctgccgggtgctgaccggcgtgggcgcgttcgaccccgggctggggcgcaaggcgccgatctatgtcatcgaggacgcgccgtggtcggcgttccgtgaccgcgacaacccttacggcttcgtggctttcgacgtcgaccccggcccggccggcggcaatacctcgatcagcgcgacgcattacgcgctgaccggcccgctcggcgagatgtcggtgatcgaccgattcacgctgaccaagccgcgcggcgacggggcccgctgagttctcggagtttttcgggttttccggcttgtcagaacagcgtcggctgagcgggttcgggcgccggcgcggccgcaaccgctcgggagaacgggcggtgatcaccgcccagccggtacttggcgatcagcggggcggcgcggtgccgcagcatgtcgcgatagctcggcggcaggtaggcgccgcgacggtacagctcccggtagcggccgaccagctcgggatgcgagcgggccagccattccatgaaccagccccgcgtcgagccgcgcaggtgcaggccgaagaccgtgacgctgcccgcgccggcggccgcgatctggccgagcaggtcgtcgaggtgctcgacggaatcggtgaggtagggcagtaccggcgcgaccatcacgtggcagtccagcccggcggcgcggatcgcgctgatcagacccaggcgcgcctgcggcgtcggggtgcccggctcgacgtcgcggtgcaggtccgcgtcgcccaccgccagcgacaccgccaccgaaaccggaacctgcgcggcggcgttcgcgatcagcggcaggtcccggcgcagcagcgtgcccttggtcaggatcgacagcggggtgcccgattcggccagcgcgccgatgatgccgggcatcagcgcataccggccctcggcccgctggtagggatcggtgttggtgcccagcgcgacggtctcgcgccgccacgacggccgccgcagttcccggcgcagcacctgtgcgacgttggtcttgacgacgacctgggtgtcaaagtcattgccgcagttcaactccaggtattcgtggctgggccgggcgaagcagtaccggcaggcgtgcgagcagcctcggtagccgttgacggtgtagcggaacggcagcgccgaggcgttcggcaccttgttcagcgcggacttgcacagcacctcgtggaaggtgatgccctcgaactggggcgcgcgcacgctgcgcaccagaccgaggcgttgcagccccggcagcgccccgtcctcgacgggtttcccgttgaccgcgacggcctgactcgcccaccgcatgccagtaattcgaacaccagttcgagatcgagtcaagggcctctgcggtcagaagggtggcggctcgtcgtcggggtcgggtggtggtgcgggtccgggtgtcgcggggtgggtggtgagtcgggtgcggcggttgtggttgcgttcggtggtgatgcggtgggcgcggttgtgggcgcgggtatggcggcgcagcggcatcatggcggtgcgctcgccgcagcggtgctcggtgtcgggcttggccggcgacacggccccggtgggtgttcatagggtggggaacagcagcgcgctgcccggggtggtgacgtaggtgtcgccgtcgggcagggtccagatcaccgtgccgtcgggcagttgccggtcgcgccagccccagaacgttttcagcaaatgatggccacggcacaggcatttgaggttcgacgggtgggtgggcccgccctgggcgtacgggatcgtatggtccacatcgcagtcgacggcggggcgatcacacccgggcgcccgacaggtcaggtcccggcagcggatgaagtcggccagccgggccgacggggtgtagccgggttcgggcccgccctcgggcaccgccaccggcaccagccgcgccgaggcggccagctcggcgatgacctgcgccgggatcagcccgtcgagcccggccaccacagcgggcgtggcccctcggccggcgacggtggcctgttcggcgaccacgtggatcaccacagtgctgcgcggcgccggcgcggctgcgctcgggcagtccggtgatccgcagccacacgccagccgcccggcaccggcggccagcgcccccaacgcgtcggcgcgccgctgggcgcggctgcgcggatcccccgcacacactccactggccagctcgtcgagccggcgatccagggcatgcccgtcgggcccgaggacgttgccttccacccaggccatccccgactcgttggcccgcacatccagataccggccggtcaccgcgtcgcgtgcccggcgcaccgcatcggcatccacggccgccactacccgatccaccgcggcggccagcccaccgcgggtcagcgacggccgccgcgacaccaacacggccagcgtggcgtccacccgggccaacacctgcgcatcagtgatcaaatcggtgcgaaacaccagggtctgaaacgcccggtaatcgatgcccccggccgcgaacaccgccccgacctgcggcaaccgttcccgcatcgccatcgcataacgcagatagctgtgccccatcgccacgctgcagcccagcgccgcccccacctgcgcggccaccgcctcccaggcatcggcggcccaatccgcccgctcccccgtctcccggcaacgcaacaccaacaactcggcgatcgccaccagccgggccgcggccgcccgcgcctcggcccgggccgcctcccgcgcccgatccagcagcgccaccgcctccggcgtggaccgcgacgccaccacatactcgaacatgtgttcgaccatagcatcgtccaccgacgcatgctttttggcagttcgcgacgtgtggataactgcggcagctgaatgggtaaggagatgcgtcggtcgcggattccggccgaggagaaaacccaccgtgcccaccccgttttgcgactggtcggaagggacgcaatccgctgggctggggaatcctgggactgttcttctcgatcctgaccctgatcgtcgtcatcgtcatccccagcaagaaataacgcgacggccgcagctaaggctagcggcccagttgtgaaagaacttcggcgacaacggaatccagttccaccgacacctgcgagccggtctgcagatccttcacgcccaccgtgccggcgtcgatgtcgcggtcgccgagaaccagggcgatgcgggcaccggagcggtcggccgcgcgcatcgcgcccttgagcccccgcgcgccgtaggccatgtcgacgcgcacgccggcggcgcgcagcccggcggccagcacggccagccgcagcttggcctgatcgctcagcgggacgccgaagacgtcgcagcgcgccgccgagcccacgctcttgccctcggcgcgcagcgccagcagggtacggtccacgccgagcccaaatccgatgccggacaagtcttgtccgccgagctgacgcatcagcccgtcgtagcggccaccgccgccgatgccggactgggcgccgagaccgtcgtgcacgaactcgaacgtggtcttggtgtagtagtcgagcccgcgcaccatgcgcgggttgatcacgtagggcaccccgagcgcgtccaggtgcgccagcacggtgtcgaagtgctgcttggccgcatcggagaggtgatcgagcagcaccggcgcgtcggccgtcatcgcccgcacctcgggccgtttgtcgtcgaggacgcgcaatggattcagccgcgcgcgccgccgggtttcttcgtcgaggtcgagaccgaacaggaagtcctgcaacagttcccggtattgcggacggcagctgtcgtcgcccagcgaggtgatctccaagcggaacccgtccagccccagcgagcggaacccggcgtcggcgacggcgatcacctcggcgtccagcgccgggtcgtccaccccgatcgcctccacaccgacctgctgcagctggcggtagcgacccgcctgggggcgctcgtagcggaaaaacggtcccgcataacacaatttgaccggcagcgtgccccggtccaggccgtgctcgatcaccgcgcgcaccacgccggccgtaccctcgggccgcagcgtcaccgagcggtcgccgcggtcggcgaaggtgtacatctccttggacaccacgtcggtggattcgccgacgccgcgggcgaacagcgcggtgtcctcgaagatgggcaactcgatgtcgccgtacccggcgcggcgggcggcgtccagcaggccggagcggaccgcgacgaactgcgccgagtccggcggcacgtagtcgggcacacccttgggagcgctgaattccggcacgggctacaggccttcgaggaacgggttgaggcgccgttcggcgccgatggtggtggcgttgccgtgcccgggcagcaccacggtgtcgtcgtcgagcaccaggagtttgtcgacgatcgacgtcagcaggtcgcgtccgctgccgccgaacaggtcggtgcgtcccaccgaacgttcgaacagggtgtcgccggtgaacacgacctgcttgtccgacgacacccggaagcacatcgatccgcgagtgtgccccggcgtgtggtcgacgttgacggtgacgctgcccaggtcgagcttgtcgccgtcccggtccagctcgaccacctgcctgggctcccggaagaagacgcccgccgccagctgcgccagccgcggacccaggccgtagatggggtctttcagcatgaacctgtcctcgggatggatgtaggtcgggcagccgtaggtgtcggacaccttctgcgccgaccacatgtggtcgatgtgcccgtgggtcagcaacaccgccgccggggtcagccggtgccggtccaggatgcgccgcaacgggcccattgcccgctgccccgggtccacgatcacggcgtccgcccccggccgctgcgccagcacatagcagttgcacgccaacatgccggcgggaaatccggtgatcaacacggttcccagtttcccacggggcccacttgacacggctcgcggcgcccacattagcctgagctggccagctggggcagcaagattcaccgaccatggaggcatagcggccgtgccgaccaacgaacaacgacgcgccaacgccaaacgcaagctggaacggcagctggagcgccgcgccaagcaggccaggacgcgacggatcctgctgatcgcggccggctcgatcgtggcggtggcggtgatcgcggcggtggtcgtgacggtcctcaacaacaggaacgaacacaaggccagcaccgcggcaccgtccaccagcaccagcgcgccggagaccacgacgcccgggcagccgagccaggttccgccgctgccgccgttcaaaccgtcggccgacgtgggcgccaactgtcagtacccgccgtcgccggagccggcggccaagcaggtcaagccgccccgcaccggcaaggtgcccaccgaccccgcacaggtgagcgccagcatggtgaccaaccagggccacatcggcctgatgctggccaacaacgaatccccttgtaccgtaaacagtttcgcgagtctgatcggtcagaagtacttcgacaacaccaaatgccaccggctcaccacctcgccgtccctgggcgtcctgcagtgcggcgatcccaagggcgagggcacgggcggaccgggctaccagttcgccaacgaatacccgaccgaccagtacccgcccaacgaccccaaggcgcagcagcccgtcctctacccgcgcggcaccctggccatggccaacgccgggcccggcaccaacggcagccaattcttcatggtgtacaaggactcccaactgccgccgcagtacaccgttttcggcaagatccaggacgacgggctggccacgctggacaagatcgccaaagccggtgtcgccgggggcggcgaggacggggcccccgccaccgaggtcaccatcacctcggtgctgctcgactgattcgcgccgtcgacggcttatggtcatggggtgacgctggatccggactcgttcggtcactaccgaatcctggagttgctgggtcgcggcgggatggggcgggtgtaccgcgcctacgacgcgacgacggaccgggtggtcgcgctgaaggtgctgccgccgcatctggccgaagaccaggacttccagcagcgtttccgccgcgaggcacgcatcgccgccggtctcaacgacccgcacgtggtgccgatccacggctacggcgagatcgacggccggctctatgtcgacatgcggctgatcgagggccgggacctggcgcactacatcaccgaaaacggtggccggctcagcccgcagcgggccgtcgcggtgatcgaacaggttgcggcggcgctggatagcgcgcaccgggcggggttgatccaccgcgatgtcaagccgatgaacgtcttggtcaccaccgcacgcgatttcgtctatctgatcgacttcggcctggcccgcgcgcaggccgacacggcgctcactcagaccggcgccaccatgggcaccgtcgcctacatggcccccgagcgcttcaccggcaccaccgatcaccgcgccgacgtctactcgctggcctgcgtcttgcacgaatgcctgaccgggaagcgcccgttcgccggcgacagcctcgaagaacagctcaacgcgcatctgaacacggcgccgccgcggccgtcggcaaccgcgccggaggtgcctgcggccttcgacgcggtgatcgcccgcggcatggccaaggaccccgagcggcggtaccaatcggtgaccgagctggccgaggcggccagggccgccctggcgccgggggtggtcgaaaagccttccgcaccaacgccgcaaccccgggctgcgcggcgggtgcgggcggccgtcgtcggcgcgtcggccctgacgctggccgtggtggcggcggtggtcgtcgcgatggtgacgcacggccacggcccgcgcggggcggcgccgaagacgcccggctccccggcacccggccgacccgcgccgccgctgccggccttcgtggcgccgccggacctgggcgccaattgccaataccgggcggtgccggatccgtcctcgcggccggtcagcccgcccccgtcgggccgggtgccgaccacgccgggacagatcggcgcggtcatcgccaccaacctcggcgacatcggcatcagcctggccaactccgaatcaccctgcgcggtcaacagtttcatcagcctggcccggcagcggttcttcgacaacactcagtgcgcccggctggtcgactcccccgacggcggatcgctgttgtgcggcggccccgacgtggacggctccggcggccccggctacgaattcgccgacgagtatcccgccaaccagtaccggcccgacgaccccgcgctgcgggcgacactgctgtacccgcgcggcaccgtcgtgatggccaccgagggccccaacaccaacggcagccaattcgcgttgatcttccacgattccgagatggacccgcagagcacggttttgggcaccatagacccggccgggctggcgacgctggacaagattgcccgggccggcatcgccggtaaccggccgagcggcccgccggccaacccggtgaccatcacctcggtgcgaatcggctaggtgtactgaccacggacgttggtgacggcgtggtgaggtgacatgacgagaacctccgagtgaagtgcgagctgcttaggaaacgcactcacctcggaggtcctcatgtcccaccgtaatgctccattgtctgaaaccggtcggctgcggctggcccgttgcgtcgttgatgagggttggtcgctgcggcgagcagccgaacgcttccaggtctcggtaaccaccgcagagcgctgggccaggcgctaccgcgagctgggcgaggccggaatggccgaccgcagctcacgaccgcatcacagccccaaccgcacgcccacgcgcaccgagcggcgcatcatcaaagtccgggtgatccgccggtggggaccagcgcgcatcgggtatctgctggggatacatccctcgacggtccatcgggtattgacccgctacgcgctggccaaactgcgctggctggaccgatctactggccggattatccggcggatggaaccggctgggtgcggggatctagtgcacgtcgatgtcaagaagctcggcaaaatccctgccggcggcggctggcggatgctgggacgcgcgattggcggccacaactccaacgcggacaagagcagcggggtgttcagcaagcaccgcaacccaatacggggatatcactatctccacaccgccatcgatggatattcccggctggcctacagcgaggtactcgacgatgagatcaaagaaaccgccgccgagttctggacacgcgctaatgcctggttcgccgaatgtgggatcagcgtgcggaaagtgttgaccgacaacgggtcctgctaccgatcgcgcgtttttgcccaggccctgggcgatatcgaacaccgccgcacccgaccctaccgaccacagaccaacggcaaggtcgagagatttcaccgcaccttggcagacgaatgggcctacgcccgcctctaccgcagtgacactgagcgctgcgaagagttcaccacctggctgcacacctacaatcaccaccgcggccacaccgcacttggcggccaaccacccgccagccgcgtacctaacctctcaggtcagtacagctagggctcaggcggcggaggtcacccggtagacgtcgtagacgccttcgacgttgcgcaccacgttgagcaggtggccgaggtgcttggggtcgcccatctcaaaggtgaagcggctgatggcaacccggtcaccggaggtggtgaccgacgcggacaggatgttgaccttctcgtcggccagcacccgggtgacgtcggacaacagccggtgccggtcgagcgcctcgacctgaatggccaccaggaacaccgacgacggcgacggcgcccagtgcacctcgatgatgcgctcggactgctgctgcagcgaggcggcgttggtgcagtcggtgcggtgcacgctcaccccgccgccgcgggtgacgaatcccatgatctggtccccaggcaccggcgtgcagcatttggccagcttggtcagcacgcccggggcgccgggcaccgacacgccgacgtcgtcgctgctgcgcgggcggcgcagcatggtggtcggggtggaccgctcggcgaggtcctcctcggtctggtcgatgccgccgagctcggccagcagccgctgcaccacgtgccgggccgacacatgcccctcaccgatcgcggtgtagagggccgacacgtcggcgtagtgcagttcgcgggccaccgcgctcatggattcggcattgaccaagcgctgcaacggaagtccgccgcggcgcacctcgcgggccatcgcgtccttgccggcctccagggcctcctcgcgccgctccttggcgaaccactgccggatcttggccttggcccgcggcgacaccacgaactgctgccagtcccgcgacgggcccgcgttggccgccttggaggtgaaaacctcgacgacttccccgttttccagcttgcgttccagcgccaccagccggccgttgacccgggcgccgatgcagcggtgcccgacctcggtgtgcacggcataggcgaagtcgatcggcgtcgacccggtgggcagggtgatcacgtcgcccttgggggtgaacacgaagatctcttgtaccgcaaggtcatagcgcagcgactcgaggaattcgcccgggtcggcggcttcccgctgccagtcgagcagctggcgcatccaggccatgtcgtcgatctcggcggcggcgtgcgggtgcggaacgccgttgcggcccttggcttccttgtagcgccagtgcgcggcgatgccgtactcggcggtgcggtgcatgtcgcgggtgcggatctgcacctccagcggcttgccctccggcccgacgacggtggtgtgcagcgactggtagacgccgtagcgcggctgggcgatgtagtccttgaaccgcccggccatcggctgccacagcgaatgcaccacgcccacagcggcatagcagtcccggatctcgtcgcacaggatgcggatgccgaccaggtcgtggatgtcgtcgaagtcgcggcccttgacgatcatcttctggtagatcgaccagtagtgcttgggccggccctccaccgtcgccttgatcttcgacgcgttcagcgtgttgatgatctcggcccgcaccttggccaggtaggtgtcccgcgacggggcccggccggcgaccagccggacgatctcgtcgtacttcttgggatgcaggatggcgaacgacaggtcctccaactcccacttgacgctggccatgcccagccgatgggcgaggggcgcaatgacttccagcgtctcgcgggccttgcgggcctgcttctccggcggcaggaaccgcatggtgcgcatgttgtgcagccggtcggcgaccttgatcaccagcacccgcgggtcgcgggccatcgcggtgatcatcttgcggatggtctcgccctcggcggcgctgcccagcaccacccggtccagcttggtcaccccgtcgaccagatgaccgacctcttcgccgaattcctcggacagctgggccagggtgtagccggtgtcctcgacggtgtcgtgcaacagcgcggccaccaaagtggtggtgtccatgcccaattcggccaggatggtggcgacggccagcggatgggtgatgtaggggtcgccggagtggcgcaactggctggcgtgccgctggtcggcgacctcgaatgcgcgctgcagcagctgcacgttggccttggggtagatctcgcggtgcatcgccaccagcggctccagcaccgggttgagcgtgctgcgctgggcggtcatccgccgggccagccgggcccggacccggcgcgacgcgctgctggacgtcttgagcgattcggtcggcggctcgggagtctcgatcaccgggttgggcggcgactccgccggcgcgtcaagcgcttgcgccgcgctgttttcctccgccacgatgctcacctccgaattcgaggatatctccgatgtcgcggggctactggcaagtcaggctgtgcaccggcaacggcgccagcgccgcccgcccgcccagcgcaccgagttcgaacaccaccgccgccgcggtcacggtggcgccggtgcgccgcagcagtcgggccgccgcggccagggtaccgccggtggccagcacgtcgtcgatgatcacgatgcgccgcccacgcaggtcgatgccgtcggcggggatctccagggtggcgctgccgtattccaggtcgtagcgctcggcgtgcaccggcggcggcagtttgccgcccttgcggatggccagcaccccggtgtgcagccggtcggccacggccgccgcgaccaggaacccgcgcgagtcgatgccggccaccaggtcggcaccggacgcgtgccgggccagcgcgccggtgacggccgtcatcgccgtcgcttcggcgaacagcggggtgaggtccttgaactggatgccgggcttggggaaatcgggcacctgccgggtcagcgacgcgatgagctccgcgaccggcgtcgcttcgccggcgtccgtcatgccgacctcactgcaccagggcccatcggtccatgttccaccccgcgccccaccgggtggggttcttgctcaccgcgtacatcttcttggagatcagcagggtgcgctgctgccggtacagcggcagcgtgggcaggtcgccccacagcaccggggcggtctcggccagcagccggacccgctcggcggggtcggccgacaccgccagcgccccgatcgcgttgtccacctgcggattggagtagccggacaggttgttgccgttgccggtgtgcagggcgtaggcgtccatcgccgacgacccgctcgatccgctgccggtcgcgccgccggtgctggccagcagggcgtcgatcttgccgtcccgcagcgcctgcgggcccgcgctgtccagggtgaccccggagacggtgatgccggccggggcgcaggccttggtgatgacgccgacgttgaccgcgagccgggcgttgggcccctggtagccgatgcgcaccgcgagcggcgcgccgcccagcgcctcgcgggcggcgaccgggtcggccttgccgaacggggcggcctcggcggcgccgtcgtccgcggacacggcgtcgtcgacggccgggtccaggcgggagttggcgatcggcgtcccggcgtccttggccagcacgtcgcggggggtgcacagcgcgaacgcgcggcgggccttgggcgccgacagcggcccctgcggggcgaagatcagctgctcgatgccgtcggagggggcgtcggagcggtcgtagttgtccggcgtggccagcgtgcccgaggagccgacggccacgtcgaccacgtcgacgctgcggttgttgacccggtcctggatgtcggggccctgcggccacacggtgatccgcttggtgatggccttggggccccaccaccggtcgttggcgaccagcaccaccgcgccgccgtccaggacggcctgcagcttgtagggccccgacgacgggaagcgcttgacgatctcctcacccttcagcccgggtttgaggtcccagatggtgttccacagcctggcgatctgcgccaccagcggcgcgttgtggctgagcagggccgcggtgacgtcgacgttgagctggtcggcgatgacgtgcgacggcatcagcgtggtcgcggtgaacagctggttgtagtcgacgatgccgcggtcggggacgaaggacacccgggccttcttctgcccgggcatgcattcgacgttggcgatgtcgaggtagccggcctgggtggcggcgttgaactccgggtaccggccggactgggcggcccaggccagcacgatgtcgtcgcaggtcaccggcttgccgtcggagtagacggcgttgtcggcgatctggtagtcgagcaccagcggggtgccgccgaccaccgagacggtgccgaagtcgcggtcggggacggtttgcccgtcggggccgtgatagctgaacccgacgagggtgcgggcgaacgcctgcgctccggccgaggcggcgccgacgacggtgttggggttgtagctgctcagcggtccgtcgaccacgtagtcgatctcggccgcggcgctgcccgcgcagccggccagggcgacgcccgcgacgaccagcacggccataccgatgcccacccaccccgtcaggccgcgacggccgatgcggatggccacgtgtctaccgccggccgacgttccgcttgccggtcggacgccgggccccagtgggccgcaccggccgggcacccggcgccggcttgctcggcgcgggccgggacgaccgcgactcccgctcggcctcggtggcctcgtccccggacccggcgggaggctcggcggcgtcgtcggcggtgctctcggcgctcgcccgcgcgccgccggcgcgccgcttgagcacccggcgggtgtgggtgcgcaccagctcggtgcgctcgcgcagcgtgaccagcagcggggtggcgacgaagatcgacgagtaggtgcccaccaggatgccgaccagctgcaccagcgccaggtccttcagcgtgccgacgcccagcagccagaccgccaccaccatcagcgccagcaccggcagcacgccgatcaggctggtgttgatggagcgcatgaacgtctggttgatcgccaggttggcctgctcggcgaaggtgcgccggttggtgtgctggaagtcgcgggtgttctcctcgaccttgtcgaacacgatgacggtgtcgtagagcgagaagcccaggatcgtcagcaggccgatgacggtggccggggtgacctcgaagcccaccagcgagtacacgccggccgtcacggtcaggtcgaagaacatcgccgcgatggcggccagcgtcatgtaccgctcgtagcggaccgtgatgtagagcccgaccagcgccaggaagaccaccagcgcgatcagcgccttgtcggtgatctggtcgccccaggtctccgagacctgcgagtcgctgatggcctgcttgctgggcttgccgtcggcgcccttgggtccgaacgcgtcgaacagcgcgttgcgcagcttggtcgtctggtcgttggtcagcgtctcggagcggatctgcacggtggccgcggcgccgttgccgaccacgaccaccgactccgggtcggtgccgagggtcttgcggaacacctcctgcacctgcgcggtgtgcaccgtgccgtgcgtcccggcggcgggcatcgacaccgtggtgccgccgttgaagtcgatgccgaaggtgaagccgcgcagcgcgatggacaggatcgcgaccgcgacgatcgcgccgctgatgccgaaccacagccggcgccgcccgaccacctcgaacgcgccggtgccggtgtagaggcgggacaggaagctgtgccgcggcagcccggccgcggcggcgtcgctgtcggtcaattccgaagcgcccgaagaggtttcggtgatctcggtcgcgcccttggcggctttggaggccttggaggaagtcatcgctatccctgtcccgtgctcacgtgcgccgccgcccggcgttcgcgggcgacctgctgaacagcgcccaggccgttgtaggccggcttggccagcgtcggcgacttggacgccaggtataccagcggccaggtcaccaggaacaccaccaccaggtccaggatcgtggtgaggcccagcgtgaacgcgaagcccttcacctggccgatggccaggaagtacagcacggccgcggccaggaaggtgaccgcgttgcccgagacgatcgtcttacgcgcccgcgtccaaccgcggggcaccgccgagcggaaggtgcggccttcgcggatctcgtccttgatgcgctcgaagaagaccacgaaggagtcggcggtggtgccgatgccgatgatcagaccggcgatgccggccaggtccagcgtgtagttgatgtacctgcccagcaggatcaggatcgcgaaaaccattgcgcccgaagcggccaacgacagcgcggtgagcaggcccagcacccggtagtacagcagcgaatacagcaacaccagcagcaggccgatggcaccggcgatcagcccggcgcgcagcgacgtcaatcccagtgtggccgagacggtttgggcctccgatgactggaaggacagcggcaacgacccgtacttgaggacgttggccagctgcttggcggtggccgcggtgaagggcgggtcgccgccgctgatctgggtgcgcccgcccgggatcgcttcctggatcatcggggcgctgacgacctgggagtccagggtgaacgcggtctgggtgccgatgtgggcggcggtgaagtccgcccaggtgttggcggcggcgggtttgaactgcaggtcgacgacgaagccgatgccgcgctggttctggctcgcgctggcgtccttgatctggtcgccgctgatgatcgacgggccgagcaggtaggccaccttgtggtcggtcgagcaggtgatcaacggctgggcggggtcgtcgttgccggccaggatgtcgtccttgtcgcagcgggtggcctggaattgcagggccaggaactggatgccctgacgggtgctctgccgccacttcttctcctcggcgatgcgctcggcgaggtccttgcgcggatccggcggggcgggttgctcgccgggcggcgcctcccctggagagggggccggagcgggcgccggggccgggccgggcgccggggccggagcgggcgccgggctgggcgacggcggcgggtcctgcgggtagggccgcggctgagcgggtgcggcgcccggctgggcgggcgcaggtacgggctggccgggggccggctgccccggcgcgggcgcgggctggcccggtgcgggtgcgggctggcccggtgcgggctggccgggcgcgggttgcgcgggctggcgcggcgcgggcttgggctcgccgctttgcgccggcatcgagttgagcaccgggcggatgtagaggcgggcggtctggcccaggttgcgggcctcgttgccgtcgttgccggggaccgtgatgatcaggttgtcgccgtcgaccaccacctccgaccccgacacgcccagcccgttgacccgggcgctgatgatctgctgcgcctgggccagcgcctcacggctgggtgccgaaccgtcgggcgtgcgcgcggtcagcgtgacgcgggtgccgccctgcagatcgatgccgagcttgggcgcggcccgcttgtccccggtgaggaacaccagcaggtagacgcccacgagcagcagcaagaagaccgagaggtagcgggcggggtgcaccggcacggacgacgatgccacgttccttcaatctcctcgagaatcggttccttgccccggacagagcctagaaaagactacgtggccgcggcccgacggttgcgcgagcggtccgccggcgcggcattcggcgcgggatggccgtcaggaatccttgctgaccgagccctcgccggcggaatcgtcgccgtcgaccaggtcgtcctcgtcgtcgggcacgatccggtcgcggatcgccagcttcatccaggtggtcaccacacccggcgcgatctccaggtcgacggtgtcgtcggtgagcccgacgacggtggcctgcagcccggacgtggtgtgcacccggtcccccggccgcaacgactcgtgcagctcgatggtggcctgcatggcgcgccgctgccggcgcgacgcgaagtacatgaacccgcccatgatgagcaggaacggcaggaacaggatcagactctccatggacacgcctgtctttcgtcgggattctcggggcaatcgggggtccagtgtgcccgttcagtctggcaggccgcgggtcgcgcgcggccgcggtgcccgccggcgccaagctcgataggctttggacgcgacgtgacacgcgcgccgcggggaggagcaactggtggccaggctcgagcagactcgccggctggtcaccgagatccccggcccggcgtcgctggagctgagcaaacgccgcgcggcggcggtgtcgcacgcggtcaacgtgtcggtgccggtgttcgtcgcccgcgccggcggcggcatcgtcgaggacgtcgacggcaaccggctcatcgacctcggctccggcatcgcggtgaccaccatcggcaactcggcgccccgggtggtcgacgcggtgcgcgcccaggtggccgagttcacccacacctgcttcatggtgacgccgtacgagtcctacgtcgccgtcgccgaaatgctgaaccggatcacccccggtgccggtgacaagcgctcggtgctgttcaactccggcgccgaggccgtcgagaacgccgtcaaggtcgcccgcgcctacacccgtaagccggccgtggtggccttcgaccacgcctaccacggccgcaccaacctggcgatggcgctgaccgcgaagtcgatgccctacaagggcggcttcggcccgttcgcgccggagatctaccgggcgccgctgtcctacccctaccgggacgggctgctcgacaaggaactggccaccgacggggagaaggccgccgcgcgggccatcaacatcatcgacggccagatcggcgccgacagcctggccgcggtgatcatcgaaccgatccagggcgagggcgggttcatcgttcccgtcgaaggattcctgcccaccctgctggactggtgccgccgcaacgacgtgctgttcatcgccgacgaggtgcagaccgggttcgcgcggtccggcgccatgttcgcctgcgagcacgagggcccgaatggtttagagccggacctgatctgcaccgccaaggccatcgccgacgggctgccgctgtcggcggtcaccggccgcgcccagatcatggacgccccgcacgtcgggggcctgggcggcaccttcggcggcaacccgctggcgtgcgcggcggcgctggccaccatcgagacgatcgagagcgacggcctgatcgaacgggcccggcagctggaacgcctgatcaccgaaccgctgctgcgcctgcaggcccgcgacgaccggatcggcgacgtccgcggccggggcgccatgatcgccatcgaactggtgaagtccggcaccgccgagccggacaaggacctgacccagcggctgtccgtcgccgcgcacgcggccggcgtcatcgtgctcacctgcggcatgttcggcaacatcatccggctgctgccgccgctgaccatcagcgacgagctgctcgccgagggcatcgacattctcggcgggttgttggccgacctgtaaaccccgtcgggtctccggctcgggtgcgcaatctcacagacaccacggcggccggctcatggtggaataccgttactttagctaacgttctatacatcagcgccatgtcaatgccgacagcgcacatttgactcgttatttttcattcgcaagggatctgttatgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacagcgaagtagcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccacagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgcttgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtaggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaaactgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctatggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcgtcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctgacggtcaagaacgcaatcgcccagtcccgttgcgggactgggcgattgcgttgatcgacggataactctactgctgcgggtgcggccagcgcaggtacgcggcgttgccgccggcgcggttcttgcgccatccccgcttcggctcggggtcggccgaggtccgcggtttggtcagcgcccccgaggagacgtcggccgggtcgtaggccggatcccggtacggctcaacggccggcgccgccggggcgtcggacgccagtggctgcacgtcacgggccaggcgcgcgctggtgcgggccagcacgaccccgcccacgaagatgatcagcgcgcccaggcccgaaaaataggtgacctcgagcagcgcgcgcttgcgctcggtcgcggcgatcgggtcaccggccgagccgatgcccagcagcggggcgagctggccgcccaccacgaaccaggcgccggccagcacggccagccagccgcccagcatcgccgcgacccggttgccggcgacgatcagcaacagcccacccagcgcggtggccgcgcccggcgccacctccagccagccgcgggccgagctccaggcccagtctctgtccggcgtgtaggcgaaattgaagtgtggacccacaaacggtattaacgccccccaagctcccaggatcaccaggagcagtccgctgaccgcgccgcgcgagcggggcatgctcagcccgcgggtgtggccgtcctctgcgtatttcatgacatcccctcgttgaataccggcgtatttccggctggacatgggtacccggcggtttccactagtaacccacgcggcggggtcaaagccaccgcccccggtggccattgaggctggtgaggctgctgttactggtgaagtccggcgacccgcgaccctcgtcggggccgccccgcagccgcccggggacggtacggcccgcgccccgctccgcgcagacccaccggcggcaccgccgccgcggccctcgacccgacaccggcgcacacaccaatggccttgtgccccaagaggattgcgtcggttcccgaggcgccgacggcggccggggaacgggttggtggaagccgggcgccgcggtggtctcggtccccgccggcggtggcgccgacggcggcccgggcgcgcggcgaggtccaggccaacgattccatcacaaagatgtggaggggcagtaacaccgccgggtggtcgagccggtcagtcgaacagaccgggttgacccagcccggcggccccggccggggggaccatgcccaagtgtgtccaggcctgggcggtggccacccggccgcgcggcgtgcgggccaccatgccggcgcggaccaggaacggttcgcacacctcctcgaccgtggcggcctcctcgcccaccgccaccgccagcgtcgacaccccgaccgggccgccgccgaagctgcgagtcagcgcggtgagcacggcgcggtccagccggtccaggccgagttcgtcgacgtcgtagacggccagcgcggccttggcgacgtcacgggtgatcaccccgtcggcgcgcacctcggcgaagtcgcggacccggcgcagcagccggttggcgatccgcggtgtgccgcgcgagcgccgggcgatctcctcggccgcctcggcgcccagctcgatgcccaggatgccggccgagcgggccagcacctgctgcagctcggccggctcgtagaagtccatgtgcgcggtgaagccgaaccggtcccgcagcgggccggtcagcgcgccggaccgggtggtggcgccgaccagggtgaacggcgccacctccagcgggatcgacgtcgcccccgggcccttgccgaccaccacgtcgacgcggaagtcctccatcgccaggtagagcatctcctcggccggccgggcgatgcggtggatctcgtcgatgaacagcacgtcgtgctcgaccaggttggacagcatggccgccaggtcgccggcgcgttccagcgccgggccggacgtcacccgtagcgacgatcccagctcggcggcgatgatcatggccagcgacgtcttgcccagccccggcgggccggacagaaggatgtgatcgggggtgccgccgcggttcttggcgccctcgatgaccagctgcagctgttcgcgcacccgcggctggccgatgaattcgcgcagcgagcggggtcgcaggctgacgtcgatgtcgccttcgccgggtaccagggcgcccgagacgtcgcgatccgaccagtcggcgtcatgggcggtcatctgcgccgctcctcctcatcgcttcgctctgcatcgtcgtcggcggtcatcgggacttccccagcagcgacagggcggcgcgcagcgcgccggaggtgccggcttcgggctcggcggccagcaccttgtcggtggcctcctcggcctgcttggcggcgaagccgagaccgaccagcgcctcgaccaccgggccgcgcaccgcgtggccgttgcgggccgcgcccgccggcgcgcccgcggccccggccgcgccgatcttgtcgcgcagctccagcaccatccgctcggcgccgcgcttgccgatcccgggcacccgggtcagcgcggcgacgtcgccgtcgtgcagggcctggcgcagcgcgccggcgtcgtgcacggccagcgtcgccatcgccagccgcgggccgacgcccgacaccgacagcagggtcaggaacaaatcacgggtctcggcgtcggtgaagccgtacaacgtcatcgaatcctcgcggacgatcatcgcggtgatcagccgggcctgcgtcccggtgcgcagcgtggacagcgtcgagggcgtcgcgttgacccggtagccgaccccggcggcctcgatcacggcatggtcgagcgccacctcgagcacctcgccgcgcaccgaggcgatcatcgcgcggccctcagcgtcgcgtccaccttgtccttgtatttctgccgctgctgggccgccagcgcctcggcccgcgccatccgggcgatcatcggcgcccgccagcagtggcagatggccagcgccagcgcgtcggcggcgtcggcgggtgtcggtttggcttgcagcgcaaggattctggtgaccatcgcggtgacttgggccttgttggcggcgccgttgccggtcaccgcggccttgacctcgctgggggtgtggaagtgcacgccgatgccgcgtttggccgccgccagcgccactacgccgccggcctgggcggtgcccatcacggtcgtcacattcagctgggagaacacccgctcgatggccaccacgtccggctgatgggtggccagccaatgctcgaccgcgtcgctgatgctcagcagccgctcggccagcggcgcgtccgacggggtgcgcaccacgtcgacgtccagcgcgacgacggtgcgaccgcgcccgctttccaccaccgacagcccgcaccgggtcaggccggggtcgacgcccatcacccgcattacccgctcccacctagtagaacagctgttcgatagcctagcggccggcgccgaccggcccgggtaggacacgcggcgcgggcgccgattcccggtcgagacgttacggcgccgcggccaccgaaaagctgttagctttagcccacgttcgctcgagcaaggtggcaacggaggggttggcgtgggatctctgctggtcatgctcgccatcgtgctgttcatcgcgtcgatcgtggtgctcgtggtggctttgcgacggcccaagcaacccgcgcgcccggccgggcggcccgatccgctcgccgcggacgcgctgccgcagttcggtccgcgccaactcgggccgggcgccgtcgtcagctacggcggcaccgactacatcgtgcgcggctcggtcacctaccgcgagggcccgttcgtgtggtgggaacacctgttggaaggcggcgaccagccgctgtggttcagcgtcgaagaagacgacgggcggctgcaattggccctgtgggtgacccgcaaggacctctcgctgcggcccggcgacaactacgtggtcgacggcgtgacgtttcacgagtccgagcgcggccgcgcctcctacaccaccgagggcaccaccgggctgccggccggcggcgagatggaattcgtcgactgcaccaacgccgatgagacggcgctgctgtcgttcgagcgctgggccccggacatgccgtgggaggtgtcgacgggcaggccggtgtcgcccggcgagatcaccgtgtatgccgcgcccccaccgagttcggcctgacgcgcagaaggtcaacccggtgccccttcatcagctcgccgtgacccccgcggacgtgtccggggagaagctgggcctggcgctcaacgcgccggtgccggcgccgctggtcagccaccggctggaccatcccggcggcggcgcgctgttgctcggggtgctgggcgcgtcgcacgtcgtcgcggtcgagcatgcgttctccgaggagatctcttgcaccgcacgcagtttcggcgccgacctgcccgagcgcgccgaggcgcccggctaccgcctgcgctcccgctccgacgcccgtgacgaggcgagctttcgccggctcgccgacgaccttcgcgaccggtgcgcgcgccggccgggctggctgggcggcagcttccccggcgacggcgccgcgctgaccgtgctggccgcccggcccgacggcgccggctggcgctggcggacctggcacctgtatcccgacctccccgccggccgcggcgggaccgtcgttcgcaccgccagccggtggcatccgtgagccgcaaccgcctgttcgtcatcgccggcgccctggccgtcgccgcggtggtgtgcctggtgaccggaatcatcttgctgcagaagaacattgcgtcctatgtggccggccactaccacgagtacgcccgcgacgtgaacggcacccgctaccagtgcaccggctcgcccgagcaggtggccgacacgctgtccgagtacgccgagcccgcggcgcgggccgacgacaacaagaccgaatacctgcgctacagcaacgacatcgtgatcgtcggcccggacggcaactacccgtgcagcattcgcgtcgagccgctgagcgccggatacagccacggcgccttcgtcttcctcggcccgggcttcttccccgggtcgccgtccggcggcgccggaggcacccccggcgggccgggcggcaccaagtgacggcccggccgtagcagcggatccacaacgcaaaggagattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccggaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaagcctaaggccgacggccccgaacacccttcaagaaaggtaaggacaaccatgtacctcgccgtcgagatcggcaccgtcgacctcaatcccgtcctcaagggcgcggtcgcgaccatcctgtacttcgcggtcggcatggccgtgctgctggtcgggttctacgcggtcgacctgctgaccccgggcaagctgcgccaactggtgttcatcgaccgccggcccaacgccgtcgtcgtcgcgggcgcgatgtacatcgcgctgaccgtggtgatcatcaccgccatcgccaacagctacagccagctgggccagggcctggtcggggtggcggtgtacgggctgatgggcgtcatcctgcttggggtggcgctgctggcgatgcacctgctgatcccgggcagcttccacgagcacgtcgaggagccgcagctgcacccgggatcgttcgcggtggcgctgatcctgctcgcggtgggaggagtgaccgccgcggcggtgtcatgagcaccgtcgaggtcagcgcgcccgaggccgcgccgccatcgccggggcggtggcgggcgctgctgctggccgccgtcgcggcgtgcgcggcctgcggcatcatctacgaactcgcgctgctgacgctgtcggccagcctggacggcggcggcatcgtcgccacctcgctgatcgtggccggctacatcgccgcgctgggggtgggcgcgctgctggccaaaccgctgctggcgcgcgccgcgctcggcttcatcacggtcgaggcgctgctgggcgtggtgggcgggctgtcggcggccgcgctgtacgtggtgttcgcgttcctggacggctcggtcgggtcgacctgggtgctggcggtcagcacggcgctgatcggtggcctggtcggcgccgaggtgccgctgctgatgacgctgctgcagcgcggacgcacggccgggcccgccgatgccggccgcacgctggccaacctcgacgccgccgactacctcggcgcgttgctcggcgggctggtgtggccgttcctgctgctgccgcatctgggcatgatccggggcgcggccgccaccggcatgatcaacctggcggcggcggccgtggtggcgattttcctgctgcggcaagtggtttcggcgaggcaactggcgctggcgctgtgcgcgctggccgccgcgctggcgctgctggccggcctgctgctgcgctcggcggacgtcgaaaccaccagcaggcaaaggctttacgccgacccgatcatcgcctaccggcacacgccctaccaggagatcgtggtgacccgccgcggcgacgacacccggctgtacctggacggcgggctgcagttctccacccgcgacgagtaccgctacaccgagagcctggtctaccccgcactcggcaacggcgcccggtcggtgctggtgctcggcggcggcgacggcctggccgcgcgcgaattactgcgccagcccggcatttccaggatcgtgcaggtcgaactcgaccccgccgtcatcgagatcgcccgcagcacgctgcgcgccgccaacggcggttcgctggacaacccgcgggtgcgggtgctgaccggggacgcgatggcctggctgcgcggaccgaacccggaccggttcgacgcggtcatcgtcgacctgcccgaccccgacaccccggtgctggggcggctgtactccaccgagttctacgcgctggccgcccacgcgctggcgcccggcgggctgctggtggtgcaggcgggcagcccgttctccaccccgacggcgtactggcgcacggtgtcgaccatccgggcggccggctacgccgtcacgccctaccacgtgcacgtgcccacgttcggcgactggggcttcgtgctggcccagcgcggcgacaccccgcccgcgcccaaggtgccgcccgacgcgccgccgctgcgcttcctcgatcagcgggtgctgcaggccgcggtggtgttctccggcgacgtcgggccgcgcccgctggaaccctcgacgctggacaatccgcgcatcgtcggcgacatgcggcacggctacgactgatcggcctgcgtcactcctcgatctgggccaggatctcgtcgggaatgtcggcgttggtccacacgtcctggacgtcgtcgctgtcctcgagcgcgtcgaccagccgcatcaccttctgcgcgccgtcggcgttcagcggcaccgtcaccgacggctggaatcccgcctcggcggagtcgtagtcgatgcccgcgtcctgcagcgccgtccgcaccgcgacgagatcggttggctcgcagatgatttcgaagctgtcgccgaggtcctcgacctcttcggcgccggcatccagcacggccgccaggatgtcgtcctcggtcaggccgttcttctcacaggtgacgacgctcttgcgggagaacaggtaggacaccgaacccggatcggccatggtgccgccgttgcgagtcatcgccacccgcacctcgctggcggcgcggttgcggttgtcggtcaggcactcgatcagcaccgccacgccgttgggcgcatacccctcgtaggtgatggtctgccagtcggcgccgccggcctcctcgccggcgccgcgcttgcgcgcccgctcgatgttctcgttgggcaccgagctcttcttcgccttctggatcgcgtcgtagagcgtcgggttgcccgccggatcaccgccaccgacgcgggccgcgacctcgatgttcttgatcagccgggcgaacatcttgccgcggcgggcgtcgatgacggccttcttgtgcttggtggtggcccacttggaatggccgctcatcggtgtgtcgtacctcttctatctcgtcgaaagtcgccagacgagtctacgtgggcgccgaaagcgccgagcgtcacgccagcgtgaccgtcgtcgccgagcgtcacgccagcgtgacggccggcgctcagaccaccccggtgaccaggtcgacgaacagccggtggatgcgccggtncccggtnatntacggtngtagagatcgcngtggccagccngncgcctctggcgcatccgcgacgacgtgaccggcggcgcgggccagcacctcgacgccgtcgccggcgcgctccacccagggcgcgcggatgaacaccgcgcgcaccggcccgtccagtcccgcgaacgcgatgtcaccctcgaacgagtcgacctggcgtccaaaagcattgcggcgcaccgtcatatcgatcgcccgcagcggcagcgcctcccgcccgccggcgccggcgtccaggatctcgctggccagcaggatcatcccggcgcaggcgccgtaggcgggcagcccgtcggccagcagcccccgcagcggctccagcaggtcgaggtctttgagcaggtggctcatggtggtcgattccccgccgggaatgaccagcccgtcgaccgcctcgagctcgccgcggcggcgcaccggcatcgactcggccccggcctcgcgcagcgcggccagatgctcgcgggtgtcgccctgcagcgccagcaccccgatccgcggggcgctcactgccgatatccccgctggaagcgggtcagcccctcctgcatgaccgcggccaccatctcgccggactgggtgaagatcttgccctggcacagcgagcggccgccgttggccgacggcgaggactggtcgtagagcagccactcgtcggcgcggaacgcccgcatgaaccacatggcgtggtccagcgacgccacctgcaggtgctcgcgcacatcgaggtgggtgacctgcgccgagcccagcagcgtcaggtcgctcatgtaggccagcgcgcagatgtgcagcaccgggtcgtcgggcaacgggtcgcggtggcggaaccacacctgctgctgggacgccttgcccggggtcagctgcagcttctcccgcggcacgatgcagacgtcccactcctcgaactgcttgaacccggcgtcgtcgaacaccttgatcgagtccaggccgggcaggccgtccgggggcggcgcggccggcatggcgtcctggtggtggatgccctcctggtcggtctggaacgacgcgcccatggagaagatgatctcgccgtgctgaatcgcgttgacccgccgggtggcaaacgagccgccgtcgcgggtgcgctccacgatgaacaccgtgcgctccttggcgtccccaggccgcaggaagtacccgtgcagcgagtgcacctggtagcgcgggtcgaccgtgcgcaccgccgacaccagcgactggccggccacatggccgccgaaggtgcgctggaaatatccggaatccgggctgaagacgcccccgcggtagatgttgacctcgagttgctcgagatcaaggatctgctcgatcgacacggattgttcttaccagccgcgttccgccagccgttcgggctgcgcgatctgctcgacgttgatgccgaccatcgcctcgcccagcccgcgtgacaccttggccagcacgtcggggtcgtcgtagaaggtggtggccttgacgatcgcggcggcgcgctgggcggggtcgccggacttgaagatgccggagccgacgaacacgccctcggcgccgagctgcatcatcatcgccgcgtcggccggggtggcgatgccgccggcggtgaacagggtgaccggcagcttgccggcccgggccacctccacgaccagttcgtagggggcctgcaattcctttgcggcgacgtacaactcgtcttccgacagcgacatcaggcggcggatctcgccgccgatggcccgcatgtgggtggtggcgttggagacgtcgccggtgccggcctcacccttggagcggatcatcgccgcgccctcgttgatgcgtcttaacgcctcgcccaggttggtcgccccgcacacgaacggcacggtgaacttccacttgtcgatgtggtgggtgtagtcggcgggggtgagcacctcggactcgtcgatgtagtccacgcccaggctctgcaggatctgcgcctcgacgaaatgcccgatgcgggccttggccatcaccgggatggtgaccgcggagatgatgccctcgatcatgtccgggtcgctcatccgcgacaccccgccctgggcgcggatgtcggcgggcacccgctcgagggccatcacggcgacggcgccggcgccctcggcgatcttggcctgctcgggggtgacgacgtccatgatgacgccgcccttgagcatctcggccatgccgcgcttgacccgcgcggtcccggttcgcccgctgccgtccggtgaatgggcggtgttcactgctcgatctccttcaacgttgtcgacccagtctagcgaggcgacccggccccgcgttgaccggcggagtcagcggatcgacagcagcgggccgggggtgcggccgctggccagcgcggccgcgtcggtgagcagcccggacagctgcagcgggtacaccgtctcccccgccgcgacgagctgggcgatgtcggcagcgtcacaccagcggtggccgtggatgtagctgtgttccagttcggttcggcccgtccgggacggctcgaagcgctgcgtgcggtagacgaagtagaactcctcgctgtcgatcagcgagccgttgaactcgaacacctcgtcgcgccgccacaccggtccgaccagctcggacggcgcgacccgcaggccggtctcctcggccagctcccgcgcggcggcctcggccagccgttcgcccggctgcacctcgccgcccacggtgaaccaccacttgggtgcttgctggccggccagcgccgggtccgacccgcgcagcagcagcacggcgccgcggtcgtcgagcagcaccacccgggccgaggtgcggtggttgagcacgccgtgatcgccgtgcgccagcgcgtgcggccgctccacgatctcgaaatagctgggcagcgcggccgttccaccgagatgcagcagccgcaccaggcgccgttcggccagggccagcgtgtcgcggaccgcgtcgttgtggaagcggcgggccagcagcacccgggcctcggcgtcggccagctcggcgatcagcccggccggcagcgacgccgggtcgacggcggccagcgcggccgacagctcgttctcacgcgcctcgcgggcggcccggggcgcggcctcggcggcgtcggccagcgccgccagccggcgcccctcggaggcaccgccgtaggcgtcgatcgccacggcgcgcgccaccaccgcgcgccgggccagcgcgccatcgagcgcctgccaggacaggtcgtagcggacgtgcagccggtccagccgattggcggtccggtacgcccagacgccgaccaccgccagcaccgcgaccaggatcgcgatgccgaccatcagccatgtcatcaactggccacctcaaccttggcgcccgtcgcggcgaccgtctcgtacacccgcatgatctggctggccaccaccgaccagtcgtagcgctggacggccgcctgccccgcggccacgtagccgtcccgcagcccatcatcctccagcaccgcgatcagcgcatcggcgagcgcgtcgccgtcgccgacgggcaccagagcgcccacctcgccgtcgcgcagcacccgccggaaggcgtccaggtcgctggccaccaccggggtgccggcggccatcgcctcgaccagcacgatgccgaagctctccccgcccaggttgggtgcgcagtacacgtcggcgctgcgcatggccgacgccttgccggcgtcgtcgacctggccgaggaagcggatgtgcttcaccaattcgcctgcctgcgtgcgcaattggtcctcgtcgccgcgaccgaccaccagcagctgcacgtcggcgaaccgctcgaccagccgcggcagcgcgtcgagcagcaccgccatgcccttgcgcggctcgtcgtagcgccccaaaaacagcaccgtcttgccggcccgcgggtaaccgtccagccgcggcgccgaggcgaacgaggcgacgtcgacgccgttggggatctccacggcgtcggtgcccagcgcctccatctgccagcgccgggccaggtcggagaccgcgatccggccgacgatcttctcgtgcatcgggcgcaggatgccctggaacacggtcagggtcagcgatttggtggtcgaggtgtgaaacgtcgccacgatcggcccctcggcgatgttcagcgccagcatcgacaggctcggcgcgttgggctcgtgcaggtgcagcacgtcgaaatcgccgtccacaagccactttttcaccttgcggtgggtggccgggccgaaccgcagccgggccaccgagccgttgtagggaatcgggacggccttacccgccgagacgacgtagccgggcagcacggcgtgcggcgaggccggcgccagcacgctgacgtcgtgcccgcggcaccgcatcacctcggccagctgcaggacgtgcgactgcaccccgcccgggacgtcgaacgagtaggggcagaccatcccgatccgcatcagctgtccctcaaccgggcccgggtggagtcggggaggtcggccagccactgcggctgcatcatgtgccagtcctcgaggtgggcggcgatgttcttctcgaagtgatcggccagcacctgggtgatggcgccgacgtcgccgctgctgcagtccagcgccgggtagatcaaaaaccgccagccctcgccctcgaaatgcacgtgcaccggcagcagcgccgcgccggtcgcgatggccagcttcgcgggcccggccggcatccgggtggcctcgccgaagaagtcgacctgcacaccggtgcgggtcaggtcgcggtcggccatcaggcacaccacccggttggcccgcagccggtcgcacagcacctcgaagggcgaccgctcgcccccggacagcggcagcacctcgaacccgagccgttcgcggtaggcgatgaaccgccggtacagcgactcgggcttgagacgttcggcgacggtggtgaaggtgccgtgcgattgggccagccagacgccggccatgtcccagtttccgctgtgcggcaacgcgatcaccgcgccgcgtcccgcgcgcagcgcggcgtccaggttgtcctcgccgcgcaccgagtcctgtagccggcggcccagctcggtcaggtccatgctgggcagccggaaggcctcgcgccagtagcgggcgtaggaggccagcgaggcccgcatcagcgcgtcggggacgtcggcgggcggcacccgcagcacccgggccaggttcttgcgcagctggtcggggccgccgccgcgggccgcgtagcgcgcggcggcgtcaaaggcgttgcgggcggcgaactccggcatcgcccgcaccgccatccagcccgtcgcgtacgcccagtcggcgccgacgccgcccaccagccggccggccagccggcccggcgcggtgatcgccctcatccccggcggggtgggcatcacggcgcgtccgatcctcggtcggtggcgcccggcgaggtccgcacggtgtgcagccgctgcgcgcaggtaaccaggctggccgccgccagcgcccacatcgccaccggcagcgcccacggcagcgggtagccgggaaggtcggacagcccggcgccgaccagcacgatgatcagccgctcgggccgctcgatgatgccgccgtcgccgcgcagcccgctggcctcggcccgggccttgatgtaggagatcacctgggaggtgaccaggcagatcagcgtggccgccgccaacggttcgtcgtgcaggccgaaggccacccaccacagcagcccgccgaacaccgcgccgtcgctgacccggtcacaggtggcgtccagcaccgcgccgaaccgggtgcccccgccgcgctcccgcgccatcgccccgtcgagcatgtcgaacagcacgaagaaccagaccaccagcgtgccgacgaacagctcgccgatcgggaacaggatcagcgccccggccaccgccacgatggtgcccgcgacggtgacgacgtcgggggtcaggcccagccgcaggcaggcccgggcggtgggagtcgtcagccgcgcgaacgccgcgcgggacaaaaacggcaccttactcatggcggtgtgggctcacgactgcttggcccactcggtggccagcagctggcgggtttcgcgcagcaactgcgggatcaccttcgatccgccgatgatggtgatgaagttcgcgtccccaccccagcgcggcacgacgtgcacgtgcagatgctcggccagcgacccgccggccgaggtgcccaggttcaggccgacgttgaacccgtgcgggcgtgacacgttcttgatgacgcgaatcgccttctgtatgaacgacatcagctccgcgctctccgcgtcggtcaggtcctcgagctcggagacccgccggtagggcaccaccatcagatgccccgggttgtaggggtagaggttgagcacggcgtagaccagttcgccgcgcgcgaccaccaggccgtcctcgtcggtcagctgcggaatgtcggtgaacggctgctcgctcttgcccgacgagttgggtccgcgcttcatcggcgcctcggccagataggtcatccggtacggcgtccacaaccgctgcaggtggtcctgctcgccgacaccgcggtccaggatggtgcgctcggcgtcctgctcggcctgttcgggatcactcaccactggacactttcacgagttcggcgctggggacggaattctcgcggtcggcgatccacttgacgatcgcgtcgaccgcgctgtcgcggggcacgccgttgatctgggtgcggtcgccgaaccggaagctgaccgcccccgcggccacgtcccggtcgccggccagcagcatgaacggcaccttctgcgcggtgtggtgcacgatcttcttggccatccggtcgtcgctggcgtccacctccacccgcaccccgtacgacttcagctgtgcggcaacgctttccaggtacggcacgtgctcgtcggcgaccgggatgcccaccgcctgcaccggcgccagccaggccgggaacgcgcccgcgtagtgctcggtcaggatgccgaagaaccgctcgatcgacccgaacagcgcgcggtggatcatcaccggccgctgccgggtgccgtcggacgcggtgtattccagctcgaatcgttccgggaagttgaagtccacctgaatcgtcgacatctgccagctgcggcccagcgcgtcgcgggcctgcaccgagatcttcgggccgtagaacgccgccccgcccggatcgggcaccagctccaggccggactcggcggccacgtcggccagcgaagtggtggcctgctcccacacttcgtcggagccgacgaacttgtccgggtccttggtggacagctccaggtagaagtcggtcaacccgtagtcgcccagcagctcgagcacgaaccgcagcagcgacgccagctcgccgtgcagctgctcgcgggtgcagaagatgtgcgagtcgtccatggtgaacccgcgcgcccgggtcagcccgtgcaccacgccggacttctcgtagcggtacacggtgccgaattcgaagagccgcaacggcaattcgcggtaggaccggccgcgggaccggtagatcagcgtgtgcatcgggcagttcatcggcttgaggtagtagtcctgcccgggcttgcgcaccgtcccgtcgtcgtcgtattcggcgtcgaggtgcatgggcgggaacatcccgtcggcgtaccagtccaggtgcccggaggtgtggaacagctgcgccttggtgatgtgcggggtgttgacgaactcgtagccggcctcgatgtgcttgcgccgcgaatactcctccagctcccggcgcaccaccccgcccctggggtggaaaaccgccaagcccgaaccgatttcgtcggggaagctgaacaggtccagctcgctgcccagcttgcggtggtcgcgccgctgggcttcctcgatcagccgcaggtggtcgtccagcgcctcctgcgactcccacgcggtgccgtagatgcgttgcaggctggcgttgttctgatcgccccgccagtaggccgccgagctgcgggtcagcttgaaggccgggatgtggcgggtggtcgggatgtgcggcccgcggcacaaatcaccccaaacccgttcccgggtacggggattgaggttgtcgtaggcggtgagctcgtcgccgccgacctccatgatgtcggggtcaccggacttgtcgtcgaccagctccagcttgtagggctcgccggccagctcggcgcgcgcctgctccttggactcgtacacccgccgggagaacagctggccctccttgacgatctggcgcatccgcttttccagcttgtccagatcctccggcgtgaacggctcgggcacgtcgaagtcgtagtagaagccgtcggtgatgggcgggccgatgcccagcttggcctgcgggaacaactcctgcacggcctgggccagcacgtgtgccgccgagtgccggatgacgctgcggccctcgtcggtgttggcggcgacggggacgacctcggcgtcggtgtcgggcacccagctcaggtcgcgcagcgtgcccgaggcgtcgcgcaccaccacgacggcgtcgggcgctccccggcccggcagccccgcgtcgcgcaccgcggcggcggcggtggtcccggccggcacccggatcggggctggacaggaatcggttgcggggacggtcattgtggcggtctccaaggctcgcagggtcgacgaccatgctatcggggcggccgaacggcgagcagggccgtcgagtagccaccgtccggtccggcacaatgaggtcgatgggcgcgcagacggctttgaccttgctgctcgctgccatcgcggtcatcgtgctggtcgactggatcagcgagcgcacccgcctgcccagcgcgacgctgctggtcctggtcggcatcgggcaggcgctgctgccgggaccgaccatcggcctcgagcccgacgtcgtgatgacctgcatcctgccgcccctgctctaccacgcggcgctggaatcgtcgctggtcggcatccgccgcaatctacgcacggtggtcagcctgtcggtcgtcctcgtgctgctgaccgctgcgtcggtcggtgtcgcgttcagcctgctcgtgggcggcgcgacgctcgcggtgggcatggtgctgggcgcggcggtggcgccgaccgatccggtggccgcgctcgccgtcgcccgcaaggagggcctgccgctcaacatcgtcacgctgatcgagggcgagggactgctcaacgacgcgaccgcgctgaccacgctcgcggtcgccgtcaccgtggcgcgcggggccgcgttctcggcgccgtcggcgatccgggagttcgtgctggcggccgtcggcggcctggtggtgggccaggtgttcgcctacgcccggcgcctgctgcgccggtggcggcacgacgtgctgaccgccaacgccatctcgctggccacgccgtttctcacctatctggtcgccgaaaagctgtccgcctccggcgtgctggccgtcgtggtgtgcgggctgatcgtcggccacgactcgccgcgggtggaatccggggcgagccgcctgcagacccgcgccgtctggcggctggtcaacttcctgctcgagggcgtggtgttcctgctgatcggccatcaggtgccggtgatcctggacgagctgggcggctacgcgttgtcgacgatcctggtggcggtcggggtgaccgtcgcggtggttctgctggtccggccgctgtggctgctgctcacccaggcgctgccccggtcgctgcacacccggctcggcaacgttgacgattcggcgaccgacagcgccgagccgcggcccgagcgcacccgcgagcggctcagcggccgcgagatcgtcgtgctgagctgggccggcacccgcggcgtggtcagcctcgccgcgatcttcgcggtgccggtgctgaccgagggcaacgcgccgtttcccgaccgcgacctgctgctgttctgcaccctggtggtggtgctggtgacgctgatcggacagggtgtcaccttcggtccgctggtgcgcgccctgggcctgcgcgccaagaccaccgacgagctgcggctgcgcaaccgggcccgggcggccgcgctgcgggccgccctggaccggctcgactcgctggaccccgaggacggcgccgacgtcgatccccgggtaatcgacggtgtgcgccaacagttgtcggcgcagctggagcgctacgaacaccggctcaccctgttgtcggacgtcgacgagttgcccgccgcccccgcctacgaggccgccgtggggctgcgccgggtggccatcgacgcccagcgcgacgaactcgtgcgctggcgcgacgcgggcatgctgcccgaccagagcctgcgcgcgatcgaacgcgaactcgaccacgaggagagcatgctgccgatggggttgccgcgatccccccggcgcagtcaaaagcgttgagccccagttgatttcaggacccgctaggggccagccaggccagcgcggcgacggtcagcgcctcggtgccggtgtcgagggtgggctggatgacgggggcgaacctcccggagtggttgacggggacgtcctcggccagccgacctgccgcctcggcgcgccgatacgcgccggggtcggctcccccgaaaccccaatagctgtacagcgcgtcgagcccgttggcgatgtcgctgaagtcttcgcttccggtctgcgcgggaatctccgtcgcccggtcgccgaaatgctcggcgaacaccgcccgcacccgcgcggtgaccgccgggtcgttgtcggtggccgggaagtggttcatcagctcgaactcggggtcccgcggcgacccggacgcctggcattcggcggtgacgatgcgccggaccgcgtcgagcatccggtcgcgggtctggccgctgaaggtgcgcaggttcagctccagcaccgcgtggtcgccgatcacgttgctcttggcgcccgactcgatcctgccgatcgtcagcaccgcggtctcggtgggcgccacctcgcgcgagacgacggtctgcaaccggatcacgatcatggcggccagcacgacgggatcgacggtcgtctgcggcatcgacccgtggccgccccggccgtacacggtgacccgcatgctgtcggcggtggccatgaagggccccgatcgggtgacgatctggccggccggaaacggcagcacgtgctgggccagggcgacgtcgacgtgaccgaccagcctcgccagcccgtcgtcgtccatgcggcgcgcgccgtcgccgagctcctcggcgggctggaagaccgcgaccaggctgccgcgccagtgttcgcgcgccccggcgagcagcgacgcggcgcccagcaggcaggtgacgtggacgtcgtgcccgcaggcgtgcatgacgggccgttcgtcgccgtgcgggtcggtggcggtgacggcgctggcgtacggcaggcgggtgtcttcgcgcaccggcagcgcgtccatgtcggcgcgcagcaggacggccgggccggtgccgttgcgcagcaccccgaccacgccggtgcctccgacgccctcgtgcacgtcgtaaccgaagccgcgcagccgctcggccaccgccgccgcggtgcggtgttcctggtgtgatagttccggatgccggtgcaggtcgcggtacaggtcctcctgccagccacggatcccgggcaaacccgcgagcaccgggccgcagggcgatgcggagccagtcatgcggggtgggtacccactcccatcacggctggccgggtttgagccgcacgaacagcgcgtcggcctcggtcagcaaccgctcgccgtgggtcagccggccggacacgaagatcttgcgtccgtcgacccggtcgacgccggcgtcgaactgcagctcggtctcgatcgggacgatgctgcggtagtcgatcttgaggtaggcggtgcgctggcgccggctgccggtgagcaccgaggcggtcaggcccagcacggtgtcgaacagcatccccagcgacccgccgtgcacggccccgttgcggcccaagtgaaagcgggcgaagcgggcctggccgtgcatgcggccgtccgcacccttctgggccgacatcgggatggtcaggatgttgccgcgcatcggcagatccatccgccggcccgacggcgacgcccactcgtcggcgtcgaacggcgccagcagcgccgacaccttctccagctggtcggcggcctgggtgatcacctcgtcgggggcgtcgacggcgcgggcgtgatcctgcagcgcgcgcacggcgtcgatgaaccggccgtagtcgggcccgcccttggtggtcggttcgggcggattgaacccaccgccggggtgtcgttgatgttcggccaccaccacaccgtattgcccggcgggcgcggtttcgcgcgccggctacaccgtctgctgagtcccggccgtcgacagcgcctcgaattcctcgtcggacagcgtgatccgggcagcggcgacgttctcctccaggtgcgccaccttggaggtccccggaatgggcagcatcaccggcgagcgtttcagcaaccaggccaacgccagctgcgacggcgtcgcgtcgtgctcggcggcgatgcgctgcagcgggccgtcgggcgcggccagcggcccggccgccaacgggaaccacgggatgaaggcgatgccctgccgggtcgcggcgtccagcagcggctcggcgcgccgggccgtcacgttgtacatgttctgcaccgacacgatctcggtgatctgctgggccgcggcgagctgatcgggcgtgatctccgacagcccgatgtggcggatcttgccctcgttcttcagggtgagcagctcgcccacctgatcctgcagcgggaagttggggtcgatgcggtgcagctggaacaagtcgatggtgtcggtgcccagccggcgcaggctcatctcgcattcctggcgcagataactggggttgcccaacgggatccagatgtcggggccggtgcgcagcagccccgccttggtcgcgatcaccagtccgtcgtacgggtgcagcgcctcgcggatgatctcctcggacacgtacgggccgtaggagtcggcggtgtcgatgaagttcaccccgagttcgacggcccgccgcaacacccggacgcactcgtcgcggtccgcgggcgggccccacacccctgcgccggtcaaccgcatcgcgccgaagccgaggcggttgacggtcaggtcgccgccgagggtcaacgttccggatgcctgggcaatagtctgtggcgcgctcacccctccgaccgtacccgccgaacctcgccgcgcgccccggcgtggcaagctggccgggtggacctacgagcgctcgaggaacttccgctgacctattccgaggtgggggccacggcctccggcgacctgcccgccggatatcaccatcaacacgtcgagcgccaaatcggtacgggcgcagagcgtttcgagcaggccgccggggcggtgctgcgttggggcatgcagcgcggctcggggctgcgggtgcaggccagctccgaggtggccgtcgttgacgccgtggtggtggtgcggctggggtttgtgcccgccccctgccgcgtcgtctacgtcgtcgacgaacccgacatccgcggcttcggctacggcacgctgccgggccatccggagtccggcgaggaacgcttcgtggtccgccacgacccggccacgtccgcggtgtacgcggaggtgacggcgttctcccggcccgcaacctggtgggccagggccggcgggccggtgctgcgggtcggtcagcgcgtcatcgcccggcgctacctgcgcgcggtgtagccaccgcggtttcgccgccgagcgtcacgccagcgtggcgaccgcctccgagcgtcacgccagcgtgacgaccgccgccgagcgtcacgagccccagcgggacagcaattgctctgcgccgctgcacatttcgtcgatgacctcggcgaccgtcgcgtcgttgcggatcatccccaccccctggccggcatccaccggcgcgacccggcagtccccggcggcgatcgcggcggccaactcctcgcaggccccggcgtccagcgtttcctcccggccggtccaccgctcgacgaagtcgttggccagcacccgggacgggaaccgggccggccagggcaaccccttggcgacgtcgaaggcccgggtgacggcggtgtcggtctcggcggcctcgaccagggcccgccggttgccgtcggcggtcagcgcctccgggcaggccgacagccgggtgcccacccacgccccgctggcgccggcggccaacaccgcggccaggctgcgcgccgaggcgacgccgccgccggccagcaccggcaccgagacggcgtccagcgcggcgtcgagcagcggcagcagccccagcttgacctcgccgtccccgccgccctccgagccgcgcgccaccaggatgtcgacgccggcgtcgaccgcctgccgcgcgccgaggctgtcgtaaacctgtgtgacggtggggattccggcgtcgtgcgccttggcgacccaggaccagtcggtgccgaaactgaccgacagcagggcgggccgggcggccagcgcgtcctcgagcagtcccgcctcgttgcgcatcacccagtcgaccagcccgatcccgaaccggccgtcgacgtattgcaactgctcggccagcagccgccgggtggccacgctgcccatcccgaccatgcccaggccaccggcggctgtgaccgccgcggccagccggccgccggcgaccccgcccatcggggcgttgacgatgggtacccgcaggccgaaacccgcggaccagggtgtggacaacatggccggctagtgcgccgacgggatggttttcagcacggtcagcaggaccaccgagtcctccaccgcgtgcagggcgtgccgttcggccgggatggcgacatactcgccggccctgccctcccaggcgtcgccgccggtggtcagccgcacgtgaccctgcagcacctgcagcgtggcctcgcccgggctgtcgtgttcggacaggtcgtggtcggccagcagcgcgagcacggtttgccgcagctcgtgggtgtgcccgccgtggatggtgtgcgcggcacgcccgctgtgcgattgttttgcctcggcgagcttttcggccgcaaggtcggtcaacgagacggaatccataatcgggtccttcgaagtcgcaaggccttcgccttgagggttggccgtcaaccgctcagtagcagtatccccgccgcgatcagcgcgaccaccttgaccgcctccagcgcgacgtagccgtagtgggcccgggagcggggtccgtcgtccccggccagcacccggtcggaccggcgggtcagggcgggccggacggcgaccagctggacggccagggcggcgacggccacgccgatggccaccgcgacgcccgcccgggtggggccggccaccacgatcgcgccgatgacgagggcgaagaccacctcgacggtgttgagcgcgcgaaagaccaagcgcccgatgcccagcccgatctgcagggtcacgttgggcgcccggaacttcagcggcgcctccaggaacgagatggccagcaccatgccgagccagacgaaggtgagcgcgacggcgatcgcggttccggtgctcatctgcccgccccttgcagcgtcaggtgagccagacacaggtccggctcgacgaacgggtcgagccggtccaccgagaccggcgcgccccaggtttccatggccccctgcatcaggcccagatgcaccgggcacaccacattcgaggagttctcggccaattccaggaacgggcagtgccgcaggccgacctgctgctctccgtcgatcacccggcgctcgggtgcgaagccgagctcgtcgagcacgtcgaccagctgggcgatggcctgctcggcgccggccgcgtcccgcggcagccgacgccgttcggcgtccagctgctgcccccaggcccggccggcggccagcgccttgggcgcgggatcggtttcggcggcgaaggccttcgccaggatttcggccagcagccggtagtgccgcgtcccgccgcggtccatctgccgcaccgcccggaacatcagcggtgggcggccgggccccttgcggtccagctcgacgtgctcgacctggccgtcggcgacgaggctgtccagatggaagcgcaccgtgttggggtgcacgcccagcacgtcggcgatcccggcgatgctcatcggctcgggcgaggcgcgcagcaaccgcagcaccgcgcgccggcggccggccgattccccggccgagggggccagcaacttccgtgacttggtcaacgggtcccccacgctcctcgtcggtcaggagccgtccgaatgggcggcactgggctggcttgccaccagcggggtgtcgacgccgagcgggcccagcttggccgccccgcccggggatcccaggggcgcgtcgcggcccggcagcggttcggcgaagaacgcttcattgtcggccaggtgcggtttgaggtcctcgggcaggtcatcttcgtagtaaatcgcctccaccggacacaccggctcgcacgcgccgcagtcgacgcactcgtcgggatgaatgtagagcgcccggccgccctcgtaaatgcaatccaccggacactcgtcgacgcaagcgcggtccatcacatcgatgcatggcttcccgatcacgtaggtcatgcgctagagtttacacaatcaatattgtaaaaactagcctcagcgtcggagaatccatggccgccaacgaacttcgcacaggttccgaacctccgctccccgggtcgcaccgcgccgacgaggcggtggccgggcattggctgctggcgcggctcggcaaacgggtactgcggcccggcggtgtcgagctgacccgcaccctgctgtcccacgcccaactgaccggcgccgacgtcgtcgagctggcgccgggcctgggccgcaccgccaccgagatcgtggcccgggcgccgcgctcctacgtgggcgccgaggccgaccccgatgcggccaacgtggtgcgcggcgtgctcggcgatctcggtgcgcacaacgccgccgtgcgggtcgccgacgcggccgacaccggattgcccgacgccagcggcgatgtcgtcatcggcgaggcgatgctgaccatgcagggcgatgcggccaagcgggcgatcgtcgccgaggcggcgcgcgtgctgcgcccgggcggccgctacgccatccacgaactcgcgctgacgccggacaccgtctccgaggaggtcagcaccgacatccgtcgggcgctggcccgggccatcaaggtgaacgcccgtccgttgaccgtcgcggaatggtcggcgctgctggccgagcaaggattggtggtcgatcacgtcgcgaccgcgccgatggcgctgctgcagccgcgccggctggtctccgacgaggggttgttcggggcgctgcggttcgcccgcaacgtgctggtgcaccgcgacgcccgcaagcgggtgctgaccatgcgccgcacgttccgcaaacatcgcaggcaactggccgccgtcgcgatcgtcgcccacaagccgacggcgtcgcagaccggctgaccgcggccgactttgggccctttccgcaatcgcggcgtgacggattagtgacgccccctgacgtaacttggctgcggcggtcgcgggagaacaaaggagcatgccggttatgggggccagtccaatgacggagtccgacctcgatgcgttggcgtcggatttcctgcagtcgcactacctcggctcgacgtacgcggattggtcgcccgatcgccggctcgacatgttcttgcggcggcggggcctggcgcgggtggccaacgacggcgacctgtcgcacaacgtgttgcaacgcatcatggcccgagcgggccgtgcctcgttggcgcggcactgatcggcccgctcgtcgcgacgggagaaccaggtgggcgatcacgatgaccgaagagcggaaaaaatcgggatatttcacggccaaaacaacgaccggcgcaatggtacacacgtactattgtgctcgagagctggacgtgtcgccggagtcgaatgagtcgttgaggctagcggggaggggacgatgaattcaccgaaatggatggttcattggccgcagcgcaggccgacggccaccatctaccagctgaccgaccgactgcaccgcgggcatgtcgcccgggtgcccgcccaccagatcacggcgacggtgtcggcgtggctggccgatctgggcgccgacagcccgctggtcgacgaactcgaacgcgcggtgcgcggcggcgactgggcggccgcgcacgccctgggcgagtgcctgtccatcgagatcgcggtggccgactgagacgccggatcgctcaccgctcgggacgcacccgcgcggcgcggcgcagcgtctcgtcgatcacccggtcgacggcgccgaagtaggtcggtgacggtgcgccgccggccagctcggcgatcgcccgttgttcacccaaaacgtctgcggctgcgaggttttcggccatccgcgcggtgtgcacgctcagcccggccagcagttccgtgcactgggatgcggccacggcggtgcgccggcccaggatgcgcagcgtgtcccactcggcatgccaggcgccgtccgggcgttcgtcgccggccagcgcggcggcggtgtgcagcgtcgcggccagcggcgggcccgcgatggccgcccggcgaatcaggatggacaacaccgggtttcgcttgtgcggcatcgacgacgagccgccgcgggtggcggtcgccggctcaccgagttcgccgatctccggacgggccagggtgaccacgtccgcggcgatacggccccagctgtcggtgcagccgacgagagcgtcggcggccgcggtgatcggtgcgcgggcggtgtgccaggggggccgcggcgccaggcccagcgcggccgccgtgcagcgagcgagctcgacggagaccgccgccgggtcggcggtaccggtgcgcagcgccgcgagttcggtgctggcggccaatgttcctgccgcgccgccgatttggaccggggtgaccagggctatcacattgtcgaaggcgtcgatgaccccgttcagccagccggcggccttgccgccgaaggtggtgggggcggcgtgctgggtgagggtgcgggccaccatgggggtggcccggtgccggtcggtcagcgcggacagcacccggatctgctctcgcagttcggcgatcaggtcgtcggcgagcgcgcgcacgcccagcatcagggtggtgtccagcacgtcctggctggtgagcccgcggtgaatccacggcgcgacggccgggtcggcgcgctcccgcagcaggcgcaccagcccgatgacggggttgccgccgtcctcggcgccgaccgctagcgtctcgaagtcgttgtccgccaccaggttccgcaggtcggccgccgcgcagtcggccggtgccagtccggcgcccgtcagcgcggccagccacgccgattccaccgccaccatcgcatccagcagcgcggcgtcggtcatgtgctcaccggcgcggtgctcccccggccacaacaggttggtcatcgctcgtccgtccggtaggccaggaacaccgtctcgccaggtccctgcaggcggatatcgaatcggtaagcgcggccgccgttttcggcgacgcacagcagcgtggtgcggcgctcgggggcgacacgggccagcagcgggtcggtgtccggtccggcgccgggcaggtaggcgcgggtgaacagccggttcagcagcccgcgggcgaacacggtgagcgcgaagaacggcgtgcggccgtcgatcaccgatcccggcgcgagcgtggtgaacccgtatcccccgtcctcgccggtcgcgcaccggccccatccggtgaacaccgcgggatcgcggcgcagcgaaccggcttggcgcacaatgcgtcccgcgccgtcgggctgccacagctccaccagcgcgtcgggaacggccgcgccgacgccgtcgtacaccgtgccgtgcagccggacggcccgcggatcgccgtcgtcgaccaaccgggcgtcgccgggatacggcaatcccaggtccaaaaaggggccgacggtttgccctggcgtgcaggctgtttcagtcattcccggccccggtcggggttcgcccgccgccggccagcacgatgtcccaccggtatccggtggcgtattccggctgggtgaggtcgtggtcgtagtgggcgatcagccgccggcgcgccgcggggtccaggatggactgaaagatcggatccagctcgaacatcgggtcgccgggaaaatacatctgggtgatcagccgctgggtgaaggcggttccgaagaccgagaaatggatgtgggcgggccgccaggcgttgtggtggttgcgccacgggtaggggccgggcttgatggtcaggaagcgataccagccgtccggcccggtcaaacagcgcccggcgccggtgaagttggggtccagcggggcggagtggcggtcgcgctggtggcggtagcggccggcggcgttggcctgccagatctcgaccagctgaccggccaccggccggccggcctcgtcgacgacccgcccggcgacgacgacccgctccccgatcggctcgccgcgatggccggcggtcaggtcggcgtccagcgggtcgacgtcgtcgcggccgaagcacggcgcccacagctcggccgcctcgggatcgaccgcgacgagcggctgcttggggtggcgcaggatggtggcccggtacggcggatagtccagcagcggctggccggcgcccccgtcgtcggcgcggtattgcgctgcgatgcgggcgatctccgcggtgatgtcgccctgagaagcgacacactcggggtccatgagccgtgaggctactcccgatccgtcgccgaatccggcaggcgggcggtgtggtcgaccgtcggcctcagagcgaacgcaccagcgccgcgcgtcccttggtgcgcatcttgtacagcgccgagccgcggtactgctccatcttggcggccatcttgttgcccagctcctcgagctccgcgtcggtgatgtgcacctgcggcggggccgggatcatgtcgcgttcctcctcgtcggcgtgcgcctcgagcaccgtcttgaaggagttccattcgtcctcgtagttcggcgcgctctgcggggtgcgcagcagcaccgaaagctggtcgacgacctggcgatgctcggcatgggcgacggcgatcagcttgctggcctccttgagggccgggtaatacaggtcgtcctcgatgcggaagtggatgtcgagctcgatcagcaggtcgtcgaaaagggcatggcgctcttcggaattcaccggcgcctcgctgatcttgcggccgaggcccttgatcacgatgtggtgttccttcaagacgtcgtaggcgttcaactggctcctccttttgcgattccgaccgcgccgccgggagcgggctgctgctcgccgcggacctcgaccactccgtcgaccactcgggcctggtagcacggcagcggcgccgccgccggcccgcgcaccacctcgccggactcggccgcgaaccacgagccgtgccacgggcagaccaagcggccccggtccagccagccgtcggccatcggggcggccaggtgcggacagaactccccgtacgcggcgacctcgcccggcttggtctggcagacgaccagcccgacgccgtcgacctcgacgcgcaccggtttgccgttgagcgaactggccggcagcaccggcgtccaggccgaggtgcgcagccgcgggccggactggtcgatgccgatgccggactcgaagaccagcgccccgcccaggtagctgccggccaccgtgatgccgtagcccagcgcggtgagcaggatgccgcgtccgtgccggccccggcgccggtcgaaccacgactgcacgtacagcgcggtggcggccacgttgagcaggccgtgcacagcgccgacccggcggtcctcctcgtgggtgtgctgccagtcggtgacgccggtgacggccgaacccaggctggccaggatgcccaccccgagcgcgcgggtggcgaaccgggaggcgccgacgacctcggaggcgggttgcccgggcagcacgctcagcgcgtccagcgccaccgtggtgccgagcgcgccgctggtcagcgacgccagcggcgggtgcaccgggtgaccgagccagaccccgttgagcgcgttggtgacggtgttgcgggcgctgcccagcccgttgtaggcgaagctgagcaggtgttcgaaccggtagctcggccggtccatccactcctggcggccgatcgccgccaccaccttcgatccgaccttctgcaatcgacccgctcgtggtcgacccaccatgacaccagtcctttctcacgccggcaggcagacggcgatcatcacgccgaaccgaacggataccccttaacgcgccgcgctcacatgcgcgggatggctgacgtgaacaaccgtaactgcggcgttgcggctttcgattgcgtgcaacctgtgaattagcaccaagcattctggcggaaacctggtgacgcgggggcccggagattgaccagcgctaccgactgcgggattctactgagcggaaagtatttctgcagaacagaggcagcgatggcggggccggacggcggattgcccggggtgctcgagaacgtgcgccgcgggatgatccccgcgcacatctacaacgaccccgaactgttcgcgctggagaagcggcggctgttcgcccgggcgtggacgttcgtggggcacgagtccgagattccgcacgacggcgactacatggtgcgccgggtgctcgacgattcgttcatcatcacccgcggatccgacggccgggtgcgggccgtgttcaacatgtgcctgcaccgcgggatgcaggtatgccgcgcggagctgggcaatgcctccaatttccgctgcccgtatcacggctggacctaccgcaacgacggccggctcaccgggttaccgttccaccgggaggcctacggcggcgacgacgggttcgtcaaggaccaaacccttttgcccgcaccgaatttcgccggctacgacgggctgctgttcatcagcctggatccggccgcaccaccgctgcaggattttctcggcgacttccggttctacctggactactacacccgccaaagcgcgggcggcgtggagctgcgcgggccgcagcgctggcggatccgggcgaactggaagatcggggcggagaatttcgctggcgacatgtaccacaccccgcacacccacgcctcgatcgtcgacatcgggctgttccgcgagccgaaggcccagaagcgcaaggacggcgccacctattgggcgcaccgcggcggcggcaccacctacaagctgccgccgggcggcttcgaggagcggatgcgctacgtcggctaccccgacgagatgatcgggcggatcaaacaggtgtggacaccgcggcagcagcgggtggtcggcgaggacgggttcatggtctcggcggcgacctgctttcccaacctgagtttcgtgcacaactggcccaaggtgcgcgacgggcgcgacgacgagacgctgccgttcatctcgatccggttgtggcagccgatcagcgagaacgagaccgaggtgtgttcgtggttcgcggtggactccgcggctcccgcgcagtacaaacaggattcgtacaaggcgtatctgatgtgcttcgggtccaccggcatgttcgagcaggatgatgtggagaactgggtgtcgctgaccaccaccgcgggcgggtcgatggcgcggcggctgctgctgaacagccggatgggcctgtacgacgacggccgcccggtcgtcgaggcgctggcgcccagcgctttccacggccccggacgcgcgcaggtcggctacaacgagcacaaccagcgggcgctgctggccatgtgggccgactatctgcaggaaggcgacgcatgcgaaaaccgttgacctgcctgccctttgacgatgctcggcacctgcaggcgcaccagttcctggtggacgaggcctacctgctcgacgcccagcactaccaggcgtggctggacacgctgaccgacgacgtccgctacgtcatgccggtgcgggtgaccaccgcgcgcggcgcggggttcgacaccagcccggggatggcgcacttcgacgaggacaagtactcgctgagccagcgggtcgcgcggttcgccaccgagcacgcctggaccgaggatccgccgtcgcggctgcggcatttcgtcaccaacgtgcgcaccttcgttgaggacgaccggcacctgctggtcgagtccgccgagctgctgttccgcagccgcggcgacgtcaacgagagcgccctggtgtcctgcggccgcgaggacgtgctgcgctggtctgaggatcgctggaagttggcccgccgcagcatcttcgtcgacgagtcggtgctgcggatgcagaacctggcggtgtttttgtgaatcccgccggcgaacccatcatcctcggcaatgaattcaccgaggtgcgggtgcagcgggtcgagactcgcaacgggtcacggctgctgatcagcgcccccaagaccgggcgctcgatcaccctggacccgctggaggtcgaggcgctgacctggcagaacccccgcacgctggccgccatggtgggcaacggccaggcgccgctgctgcccgacgaaccggaggacggcgatgaccggctggcttgacggcaagcgcgccctcgtcgtcggcgcggggtcgggaatcgggcgcgccgtcgtcgacgccttcgccgccgagggcgcgaaagtcgctgcgctggaacgcgatagcgacaagtgcgaccggctgcgccggcagctgcccgaggtggccgtcgccgagggcgacgccaccacccgccaggccaacgaacgggccgtggcgctcgcggtggacaccttcggcgggctggacaccctggtcaactgcgtcggggtgttcgacttctaccgcggggtggccgacatcgacgcgggcgcgctcgccgacgcgttcgacgagatgtttcgcaccaacgtgctgagccacctgcagtcggttaaggcggcgctgcccgcgctgcgggccgccggtgcttcctcgatcgtgctgaccgagtccgcatcgtcgttctatccgggccgcggcggggtgctctacgtgtcgtcgaaattcgcggtgcgcgggctggtttcggcgttggcgcacgagctggcgccggggatccgggtcaacggcgtggccccgggcggcacgctgggcaccgacctgcgcggcctggccagcctggggctgcagggcacccgcctggacgacgccccggaccgggcggccgaggtggccgcccgcactcccctgcgggtcgcgctgtccggcgccgaccatgcctggagtttcgtgttcctggcctccgaccggtcccgcggcatcaccggcgaaaccgtaaggcccgacggcggattcgggctggggacgccccggtgagcggccggctggacgagcagcgcgccctggtggcgcagggctgccggatggcggcggcccgcggcctggtcgacggcatcctcgggcatgtgagcctgcggatcgacgacgagcgcctgctggtgcgctgccgcagcgacaccgacgacggggtggcgttcacccggcccggcgacatccggctggtccggttcgacggaaccgccggcgccccaggcgaactcgacggctaccgggtgcccaacgaactgccgatccacgtcgagaccatgctggccgacccgcggcacaccgccgtcgcgcacctgcacccaccggccgtggtcgccgccgacctggccggcatcaccctgcggccgatctacggcgcccacgacattcccggcgcccggctggcccgcggcggcgtgccggtgtacgaacgcgccgtgctgatccgcgattcgcggctggccggggacatggtggcggcgatgcgcggccggccggtggtggtctgccgcgggcacggcatcaccagcgccgccgccaccgtgccccaggcggtgctgcaggcgatcagcgtcgacgcgctggcccggatgtcgttgcgggtgcgcgcggccggcggcacgctgcgcgacatcgccgacgtcgactgggacgacctgccggacctggggccggcgttcaccgccgaggcggcctggcgacacgaggtggcgcggatcgaaggctagccgagctgatcgccgatctccttggcggcggccacaagtgcggcggccaccgcggggtagcgggcggcgtccagccggttctgcggggcggcggcgttcagggccagccgcagcccgggcgcccgggtcgggatcggcacggcgaccgacgcgacaccctcctcgctctcctcccggttggtggcgtagccgcgctcgcggatcgcggccagctcggcctccagcgcggcgcggctgccgatggaatgcgcggtgatgcgcttgagccgctcgcgcggcagcagcgcccgcagttcggccgcggacaactgtgccagcatcaccttgcccgtcgaggtgcaatgcgccggcaaggcgcggcccagccgggaggccacccgcaccgcggccgggccctcgacggcggcgacgaaccgcacgctggccccgtcgagcatgccgacgtgcaccgtctcgcgcagctgctcgctgagcgcgcgcatgaggggcgcggccgatcgcgcgatgtcgaggcggccgaagatggcgaacgccacaccggtcagcgacgggccgggcagatacgccttggacaccgggtcctgccggacgaatccgcggtaggccagcatcgccagcagccggtgcgccgtcgaggacgccacacccagatagcgggtcgcctcgctcaaccggatctcgggttgctcacccagcagcagcaacagcttgagcgcgttgtcgaccgattcgattggatactgcggcgcaagcgcatcggcggccggcgcggccgcggctggcccggcgactcgcgcacgcttggctggcatggctccacggtaaccagtcgccggcccggcttcgcgttattctcggcttcgtgagcggggccattcaccctggataccgccgttacgtcgccatcggcgacagccagaccgagggcctgtgggacggcgacgacggcacgggcctgctcggattcgccgaccgcctcgccgcgatgctcgattcggcgtatcccgggctgcaatacgccaacctcgcgatccgcggcaaacggatcggccacgtgctggccgagcaggtcccggcggccctggcgatgcggccggacctgatcacggtgtgcgccggcatgaacgacgtcatccagcccgggcgctcgttcggcccggccctgaccgacctggaccacatctacgccgcgctggccggatcgggcgcgacggtggtgacgacgacctttccgaacgtcgcgcagttcctgccgctgggccggctggtagccgggcggctgacccggatcaacgcggtcatccgggcggccgcgaaccggcacgggttccggctggtcgacctgtacagcgcaccgtcgatgcgggagttgaacacctgggccgtcgaccgggtgcacgcctcgaccaaggggcacatcttgttcgcggccgcggccgccgaggcgctgaatctgcctgaaagcagccatgattgggccctgggcgggcagcagcgggcccggcgttcggtcgcggccggcgcctacgagcagtggcgctggacgcaggacagcttcgtcccgtgggtctggcggcggctgcgcgggctctcgtcgtacgacgggcgcgaacccaaacgtccgcggctgcagggtgtgggcagcgcatcaggcatccttgacgcatgaacgtggagcccttgctgcactcgatcccgccgctcgcggtttatctggtggtcggcggtgtggtcgggatcgagagcctgggcattccgctgccaggcgagatcgtgctggtcaccgcggcgttgatgtcgtcgcatcacgacctggccgtcaatccgctcggtgtcggcgtcgccgcggtgatcggggcggtgatcggcgattcgatcggctacgcggtggggcggcggttcggcatgccgctgttcgagcggctcggccggcggtttcccaaacacttcggtcccggacacgtcgcgctcgccgagaagttgttcaaccggtggggcgcgcgggccgtcttcctgggccgcttcatcgcgctgctgcggatcctggccgggccgctggccggcgcgctgaagatgcactacccgcggttcctgacggccaacgtctccggcgccatctgctgggcgggcggcaccaccgcgctggtctatttcgccggggtggccgccgagcgctggctggagcggttctcctggatcgggctggtggtcgccgtggtggccgggctgacggcggcaatcctgttgcgggagcgcacctcccgggcgatcgccgagctggaggccgagcattaccgcaagaccggcaacaccgcgaccgacccggtctgactacaccgcctcgccggtgtcggacaccagcggcggccggtgttcctcgatcagggtgcgggccatccggcgggcgcgccgcgcggcgtcgaggtcgccgacggcggccagcacgatggcgcccttcatcaggatgtgccaggacgacgcgaagtcctcgacgtcggtcaaacccgccgccaccgcgcggcggcgcacgatgtcgcggacgcggtcgatgtgggcgatgcaggccttcccggccggatgctccggacccagctcgagcagcacgttgatgaacgagcagccctcgtaccggtcgccctgccggaaccactcgtccatcacgtcgaagatcgccagcagctgctcctcgggcgtggcgccgcgcagccgggactgctcctcgatcagcccgtacgtccacagctcctcgcgacgctgcagcacggccagcaccaggtcgttcttcgtcgcgaaatggcggtacagcgtcgcccgggcgacaccggcccgggcgatcacttcgtcggtgcccaccgcgcggatcccacgccggctgaacagctcatatgccgcggtcaggacgcgttcacgtgccgaggcgccggacgatccggcatccggagttgtcatatgagccttaccgtactcttaggtcaggacccgtagacagaccgccctgtctcgttatacaaagaaattcgcctaggcgaacagtctgtcttcagacagaaggacgggcatccattcgaggcgctcccgcgcctgtcgattagggggtccatcatgaattcagtcattgtggaaccgatgtccgccacgcacctgacgctgagcaccaaactcgtctacgaactgggcgaccccaacagcacactgcgggcgacgaccgcgcgcagcggctccgcggtgctgatctatgcgggcggcgagatcgacgcgtgcaacgaggacacctggcgccacctggtcagcgaggccgccggcgtcgtcaccacgcctgggccgttcgtggtcgacgtcaccggcctggagttcatggggtgctgcgcgttcgccgtgctcaccgacgaggcgaaacgctgccgacagcgcggcatcgacctgcggctggtgagctgcgagccgatcgtcggccgcatcatcgacgcgtgcgggctgtcggacatcctgccgatctaccccacggtcgactccgcgctgtccggcgccgaccgctggtgagcaccgggtagcaccaaaacctttgctgcagcggctgtttcgtcatgccaccgcgagcagtcggtagagcccgatcagccccaccacaacgatgatggcccgcagcgcgccgccggacagccggcgcccgtaccgggcgccgagcagcccgccgaccagcgagcccgccgcgatcagcccggccgccgcccagctgatccggccgaacgccaccgacgtataggcaaccgccgcaaccacattcaccaccagggccagcagattcttggcggcgttcatccgctgcaccgattcgggcagcagtgcccccatcaggccgaccagcaaaatgccctgggcggcagtgaaatagccgccatagacgccgacggcgaaggtgccgaacaccagcgtcgccatccgcccgggtggcacgtgttcgggtgagcggcccgcctgctcggcgcgccgggccgtccacgcctggatccgcggtccggtcaccaccaggaccagcgccgccaccagcagcaccggcacgatctcggcgaacaccttctccggcagatgcagcagcagataggcgcccagcccggcgccggccagcgaggccggcagctgccagcgcagccggtcccactgaccgcgcagctcggcgcgatagccccaggtgcccgagacgctgccggcgaccaggccggtggcgttggacatggtggccgtcaccggcggatagccgagcgccaccagcgtcgggaaggtgatcagggtgccggacccgaccagcgcgttgatcgcaccggcggccagcccggccaggcatatgacgaacatctgaaatggcgacaccggagaaaaaccttagcctgccgccgatttcggcgcagaccaaggggccaaggtcacaccggcggggcttgcgcgccgcgatccaccccggtccgcaacttgaccgacgccgagtacaccagggtccggaaccgcagcaccggatcgtcggagggctcgatgccgtcggtgacgcgcatcgggtcgaagacgacgatgtcgccgccgtgctcgcgttcggtgtcggggccggtgatcgtcacggtgccgacggtgacgatctgcgtgctctgccaggccgacgaggggtccaccgtcgagtccgtgggcccggcgatctgcacccggaagtcgaaccgcaccggcccgtcctgcagtcgcgccgccagctcgtcggtgagaaagtccgggtccttgccgcgggcgtcggaggccgacaggtattcctcggccgcggtcggaaccaggtgatagcgaacgaatctcgcgctgccgtcggcggcgatccagcggaaggcgtgcaggccgtggtactcggtggtggcgtagctggccgggatccggttggcctcccgcagcaggggcagcgccccgagcagccgcggatgggtgagcaggtgggtggccaaccgcagcggcgtggtcaggccgggccgcatcgccttgagcagatcgataaacccctccggggtgctggagactaacagccgcgcggtctgcgccgagacgtcggtggtggagccgtccggcagggtgaacttgaccgccatcccgcgcaccccgggcgcgccgtcgcgttgcttcgggttgcccgatccgttggagaagcggatcagcgccgggaccgtcgagccgtcgagatgcggtgcggccgaaagcatcaccgcatcccgggtggcggtgaacgtgccgcggtacagcgtgcccttggcgtgcagtgcgcggcagccgggctgggctcccccggtcccccggatcgcgtcgatcgcctggtcgggagttaatccaccgctcatggacggatcttagtggtaattgaatccaattggtatcagctgggaaagccgaacagttccaccacgccgtgatcgcggccggcggtgtagccgccgtcgacggcgatggcctggccgctgacgaacgaggcgtcggtggacagcaggaaggcggccatcgcggcgatctcttcgggccgccccagccgctgcagggcgtgctccctggtgatcgaggccagcggcgcctccataccgggaatgctgaacacgttgtgcgccatgggcgtttcgatgaagccggggcagatgacgttggcgcggatcccgctgggcccgtagtcgagcgcgatgttcttggtcagcagcacgacaccgcccttggccgcgttgtaggagctgcccccggcggtgccctccaggccctcgacgctggcgaccgtgacgagcgaaccgcgctcgccgtcgacgcgggattggtcgatcatccgcgccagggccgccttggccaccaggaaggtgccggtgaggttgaccccgatcacccggtcccattcggctcggtccagcaggtgcaccgggcctcccccggcgacaccggcggcgtggaagacgccgtcgaggcggcccggcacagcggccagcaccgcggcgacggcggattcgtcggtcacgtcggcgggcacgaaggtgaaccgggggcccaggccgccgggcgggtcggccaggtcggcgccgaccacggtgccgccctcggccagcagccgccgcgcggtggccaggccgatgccggaggcggcgccggtcacgacgaaggtgcgggaacgggcacggtcggggttcaccatgcccgtcatggtggcacaccgcgccggtcccggggttgccgatggctggtttctgctgaaatacgttggcgcactgaggtttaccagaccagcgtcggcgccctatcgagcgtccgtggacatcgaggcccgggccgggcacgatgaggccatcggtgaaacccgcaccgcccgagcgagttaggaacaacgatgtcatcgactcgacctctccgcgccccgtcgcgccccggcggacggcggctcgctaccgccggcctcgccgcactggccgtggccgtcgtctgggccggcgccgcgcctcccggcgcgcccagggtggcgctggtttccggcgaggcgatcgccatcgcccagggcgtctcggtcacccccgcgcccggctggacgctgggcaaccgcggcccgaactgggtggcgctgaacaactccgacaccaccgcgcagcggcaattcgggccaccaatgcgagcagacgcccgtcaccaggccggcgccggccagcgccgggatcagcgtccaggtccgcatcgggcgggccggccgggcgacggccatcaaccggttgaagaccaatcccaccgcgagcgccaccggcgccagcaacagcccgtgcgcggtcaacaggtaggtggactcttcgaccggccatcgcaggttgggctggtcgccggtgacggccgagccgacggccaccgccaccccggaggacaggaacgccgcgcccaccgcccgcagccgccaggtgcgcagcaggatccggaccgcgaacagcgcaccggccagcggcaccgcaggggat

SEQ ID NO: 1356 - protein, 509 aa, Mycobacterium paratuberculosis
LADDPGSSFTTVWNAVVSELNGEPVADGGAANRTTLVTPLTPQQRAWLNLVRPLTIVEGFALLSVPSSFVQNEIERHLRAPITDALSRRLGQQIQLGVRIAPPPDDVEDAPIPPAEPFPDTDAALSADDGADGEPVENGEPVTDTQPGWPNYFTERPHAIDPAVAAGTSLNRRYTFDTFVIGASNRFAHAAALAIAEAPARAYNPLFIWGESGLGKTHLLHAAGNYAQRLFPGMRVKYVSTEEFTNDFINSLRDDRKVAFKRSYRDVDVLLVDDIQFIEGKEGIQEEFFHTFNTLHNANKQIVISSDRPPKQLATLEDRLRTRFEWGLITDVQPPELETRIAILRKKAQMERLAVPDDVLELIASSIERNIRELEGALIRVTAFASLNKTPIDKSLAEIVLRDLIADASTMQISAATIMAATAEYFDTTVEELRGPGKTRALAQSRQIAMYLCRELTDLSLPKIGQAFGRDHTTVMYAQRKILSEMAERREVFDHVKELTTRIRQRSKR

SEQ ID NO: 1357 - protein, 399 aa, Mycobacterium paratuberculosis
MDAATTTAGLSDLKFRLVRESFADAVSWVAKSLPSRPAVPVLSGVLLSGTDEGLTISGFDYEVSAEAQVAAEIASPGSVLVSGRLLSDIVRALPNKPIDFYVDGNRVALNCGSARFSLPTMAVEDYPTLPTLPEETGTLPADLFAEAIGQVAIAAGRDDTLPMLTGIRVEISGDTVVLAATDRFRLAVRELTWSAASPDIEAAVLVPAKTLAEAARTGIDGSDVRLSLGAGAGVGKDGLLGISGNGKRSTTRLLDAEFPKFRQLLPAEHTAVATINVAELTEAIKLVALVADRGAQVRMEFSEGSLRLSAGADDVGRAEEDLAVDFAGEPLTIAFNPTYLTDGLGSVRSERVSFGFTTPGKPALLRPASDDDSPPSGSGPFSALPTDYVYLLMPVRLPG

SEQ ID NO: 1358 - protein, 385 aa, Mycobacterium paratuberculosis
VYVRHLGLRDFRSWAHADLELQPGRTVFIGSNGFGKTNLLEALWYSSTLGSHRVGTDAPLIRAGADRAVVSTIVVNDGRECAVDLEIAAGRANKARLNRSPVRSTREVLGVLRAVLFAPEDLALVRGDPSERRRYLDDLATLRRPAIAAVRADYDKVLRQRTALLKSLSGARHRGDRGALDTLDVWDSRLAEYGAQLMAARIDLVNQLAPEVEKAYQLLAPGSRAASIGYRSSLGAAASAEVNAGDRDYLEAALLAGLAAHRDAELERGMCLVGPHRDDLELWLGEQVAKGFASHGESWSLALSLRLAAFELLRADESDPVLLLDDVFAELDAARRRALAAVAESAEQVLVTAAVLEDIPTGWQARRLFVELRDTDAGRVSELRP

SEQ ID NO: 1359 - protein, 166 aa, Mycobacterium paratuberculosis
MDLVRRTLEEARAAARAQGKDAGRGRAAAPTPRRVAGQRRSWSGPGPDARDPQPLGRLARDLARKRGWSAQVAEGTVLGNWTAVVGHQIADHAVPTGLRDGVLSVSAESTAWATQLRMMQAQLLAKIAAAVGNGVVTSLKITGPAAPSWRKGPRHIAGRGPRDTYG

SEQ ID NO: 1360 - protein, 677 aa, Mycobacterium paratuberculosis
VAAQKKKAQDEYGASAITVLEGLEAVRKRPGMYIGSTGERGLHHLIWEVVDNSVDEAMAGYADRVDVRILDDGSVEVADNGRGIPVAMHATGAPTVDVVMTQLHAGGKFGGENSGYNVSGGLHGVGVSVVNALSTRLEVNIARDGYEWSQYYDHAVPGTLKQGEATKRTGTTIRFWADPDIFETTEYDFETVARRLQEMAFLNKGLTINLTDERVTNEEVVDEVVSDTADAPKSAQEKAAESAAPHKVKHRTFHYPGGLVDFVKHINRTKNPIHQSIIDFGGKGPGHEVEIAMQWNGGYSESVHTFANTINTHEGGTHEEGFRSALTSVVNKYAKDKKLLKDKDPNLTGDDIREGLAAVISVKVSEPQFEGQTKTKLGNTEVKSFVQKVCNEQLTHWFEANPADAKVIVNKAVSSAQARIAARKARELVRRKSATDLGGLPGKLADCRSTDPRKSELYVVEGDSAGGSAKSGRDSMFQAILPLRGKIINVEKARIDRVLKNTEVQAIITALGTGIHDEFDITKLRYHKIVLMADADVDGQHISTLLLTLLFRFMRPLIEHGHVFLAQPPLYKLKWQRSDPEFAYSDRERDGLLEAGLKAGKKINKDDGIQRYKGLGEMDAKELWETTMDPTVRVLRQVTLDDAAAADELFSILMGEDVDARRSFITRNAKDVRFLDV

SEQ ID NO: 1361 - protein, 839 aa, Mycobacterium paratuberculosis
MTDTTLPPGGDAADRVEPVDIQQEMQRSYIDYAMSVIVGRALPEVRDGLKPVHRRVLYAMYDSGFRPDRSHAKSARSVAETMGNYHPHGDASIYDTLVRMAQPWSLRYPLVDGQGNFGSPGNDPPAAMRYTEARLTPLAMEMLREIDEETVDFIPNYDGRVQEPTVLPSRFPNLLANGSGGIAVGMATNIPPHNLGELAEAVFWALDNYEADEEATLAAVMERVKGPDFPTSGLIVGTQGIADAYKTGRGSIRMRGVVEVEEDSRGRTSLVITELPYQVNHDNFITSIAEQVRDGKLAGISNIEDQSSDRVGLRIVIELKRDAVAKVVLNNLYKHTQLQTSFGANMLAIVDGVPRTLRLDQLIRHYVDHQLDVIVRRTTYRLRKANERAHILRGLVKALDALDEVIALIRASETVDIARQGLIELLDIDEIQAQAILDMQLRRLAALERQRIIDDLAKIEAEIADLEDILAKPERQRGIVRDELAEIVEKHGDARRTRIVAADGDVSDEDLIAREDVVVTITETGYAKRTKTDLYRSQKRGGKGVQGAGLNQDDIVRHFFVCSTHDWILFFTTQGRVYRAKAYELPEASRTARGQHVANLLAFQPEERIAQVIQIRSYEDAPYLVLATRNGLVKKTKLTDFDSNRSGGIVAINLRDNDELVGAVLCSAEDDLLLVSANGQSIRFSATDEALRPMGRATSGVQGMRFNADDYLLSLNVVREGTYLLVATSGGYAKRTAIEEYPVQGRGGKGVLTVMYDRRRGRLVGALIVDEDSELYAITSGGGVIRTAAGQVRKAGRQTKGVRLMNLGEGDTLLAIARNAEEAADEAVDESDGAAGSDG

SEQ ID NO: 1362 - protein, 283 aa, Mycobacterium paratuberculosis
VSSPNEPGAPKKGETPNGDGSAERAGVRRATPPAPGGRAPEAGDGPPWQRGSTRPQQPPPRQNEPPTEKRADGGGAEARLNRFISGTASHAKEPERGEGPPAEAYASELPDLSGPVPRGPHRKPAAERGAETTGGQGGGRPVSGESREGRDNRDRVQVSRRTRGPVRASMQIRRIDPWSTLKVSLLLSVALFFVWMIAVAFLYLVLGGMGVWSKLNSNVGDLLNNTSGSSGELVSSGTIFGGAVLIGLVNIVLLTAMATIAAFIYNLATDLIGGIEVTLADRD

SEQ ID NO: 1363 - protein, 192 aa, Mycobacterium paratuberculosis
MARDDWLVGRDRRSAAAERIYAAAADLIARRGYDGFTIEALAARVHCSPATIYRHAGGKATIRDAVVGIQAARIVDTTREAIKDLRGPERVVTATIMALERLRSDPLAQLMRSIHAAPVSDWVINSPTVTALAAEMLGPGHDDPLAAQWLIRVFLALWGWPLKDPAAERALVHRFLGASYRPGGERDSICGA

SEQ ID NO: 1364 - protein, 441 aa, Mycobacterium paratuberculosis
LLATGHPHPQAPSPAVVAPQLRRGPLTPRDGASSLKRMAVLDSATRFFGSEAIQDPYPLYERMHAEAPMHRIGDSVFYAVCGWDAVHEAIERVEDFSSNLTATMVFHEDGTVTPFDMGAPGAPMHALATADDPVHAVHRKILLPHLSAKRIRIIEEFATQTADRLWDENLSDGRIEWMSAIANRLPMMVVCRLLGLPDDDVDKLIRLGYATTTLLDGIVAPEQLEQAGMAAIELSGYVLEHFEKASEKPESSLMADLAARCAAGELEQLPALGIMLTLFSAAGESTASLLGSAAWILADRPAIQRQLRENPELLSTFIEETLRFEAPFRGHYRHVWRDTTLGGIELPEGAHLLLMWGAANRDPTHFKDPNEFRLDRAAAKSHLSFGKGVHFCVGAALARLEAHIVLRRLLERTSWIDATDVGDWLPSILVRRRERLGLAVR

SEQ ID NO: 1365 - protein, 144 aa, Mycobacterium paratuberculosis
MRAKAEDRLTPRERLARGLTYSTLGPLDLTRGVAGLSVQSARSTAEQLRRRYREGRLARDLAAAQETLAQELAAAQEVVTGLPQALQDARRAQRRGKRPWVIAGVAVAVLAGGAAAFSIVRRSVREKPQEPQSRPPSVDVQPRP

SEQ ID NO: 1366 - protein, 182 aa, Mycobacterium paratuberculosis
VADSDAVTNSPFQTATATLHTNRGDIKVALFGNHAPKTVANFVGLAQGTKEYSTQNASGGSSGPFYDGAVFHRVIRGFMIQGGDPTGTGRGGPGYKFADEFHPELQFDRPYLLAMANAGPGTNGSQFLITVDKTPHLNRRHTIFGEVVDPESQKVVDAISTTSTDGNDRPSEPVVIESITIS

SEQ ID NO: 1367 - protein, 141 aa, Mycobacterium paratuberculosis
MQQTRWEPHPAGIAGCGVAGVLMAIAAVTVVTDPPGRVLAGVAAAGLLVFAGMSWRARPKLAITPDGLAVRGWYRTQVLQRPDIKIIRIIEFRRYGRKVRLLEVESADGDLVVLSRWDLGADPLQVLDALTAAGYAGPRQR

SEQ ID NO: 1368 - protein, 93 aa, Mycobacterium paratuberculosis
MPKSKVRKKNDFTVSAVSRTPVKVKVGPSSVWFVALFIGLMLIGLVWLMVFQLAAVGSQAPTALNWMAQLGPWNYAIAFAFMITGLLLTMRWH

SEQ ID NO: 1369 - protein, 247 aa, Mycobacterium paratuberculosis
MVQTRQSPWRFGVPLVCLLAGLLLAATHGVSGGAEIRRSDAPRLVDLVRETQASVNRLSAQREQLAAKIDAAHGRSSDAALAAMLRRSAQLAGEAGMSPVHGPGLVVTLQDAQRDANGRFPRDASPDDLVVHQQDIQAVLNALWSAGAEAIQMQDQRIIATSVPRCVGNTLLLNGRTYSPPYTITAIGNAAAMQAALAAAPLVTLYKQYAVRFGLGYQEEVRSDVQVVGHFEPDRLHFAQPNGPIGY

SEQ ID NO: 1370 - protein, 228 aa, Mycobacterium paratuberculosis
MRILVVDNYDSFVFNLVQYLGQLGVDADVWRNDDSRLADHNAEARRFDGVLLSPGPGTPERAGASIAMVRACAAEHTPLLGVCLGHQAIGVAFGATVDRAPELLHGKTSSVRHTNAGVLQGLPDPFTATRYHSLTILPESLPPVLEVTAHTDSGVIMGVRHTQLPIHGVQFHPESILTEGGHRMLANWLTECGWVRDDTLVRRLENDVHAAVRPYLPADPAATDRTSA

SEQ ID NO: 1371 - protein, 626 aa, Mycobacterium paratuberculosis
MTTPQHLSDRYELGEILGFGGMSEVHLARDVRLHRDVAVKVLRADLARDPSFYLRFRREAQNAAALNHPSIVAVYDTGEAETPSGPLPYIVMEYVDGVTLRDIVHTDGPLPPRRAIEIIADACQALNFSHQNGIIHRDVKPANIMISTTNAVKVMDFGIARAIADSGNSVTQTAAVIGTAQYLSPEQARGDAVDARSDVYSLGCVLYEILTGEPPFTGDSPVAVAYQHVREDPVPPSQRHEGISADLDAVVLKALAKNPDNRYQTAVEMRADLVRVHNGEKPEAPKVLTDAERSSLLSSGAGAAGPSRTDPLPRQVLADSGEDRTVGSVGRWIVAVAALAVLTIIVVIAFNTFGGGARDVQVPDVRGQVSADAIAALQNRGFKTRTLQKPDSAIPPDHVIGTDPGANASVSAGDEITINVSTGPEQREVPDVSSLSYSDAVTKLKAAGFSKFKQANSPSTPELLGKVIGTNPPANQTSAITNVITLIVGSGPETKQVPDIAGQTVDIAQKNLTVYGFTKITQVQVDSPRPAGEVIGTNPPKGQTVPVDSVIELQVSKGNQFIMPDLSGMFWTDAEPRLRALGWTGILDKGPDVDAGGAQSHRVVYQNPPAGAGVNRDGIITLKFGQ

SEQ ID NO: 1372 - protein, 169 aa, Mycobacterium paratuberculosis
MRYRSGGPFADAVAAVRAGRRPPRPSQSPPPGRASPAAIPSSPTTRAAAVSSGRTAAPRRTRPATGGHRPPPARRTFSSGQRALLWAAGVLGALAIIIAVLIVINSRADQQQQPPTVTDTGTPPASAPPPTKTPSGSGAHPGLRLDWPDDGTIGASGFRDGPARHWTSQ

SEQ ID NO: 1373 - protein, 253 aa, Mycobacterium paratuberculosis
MSPRVGVTLSGRYRLQRLIATGGMGQVWEAVDNRLGRRVAVKVLKQEFSQDPEFIERFRAEARTTAMLNHPGIAAVHDYGESQLDGEGRTAYLVMELVNGEPLNSVLKRTGRLSLRHALDMLEQTGRALQVAHAAGLVHRDVKPGNILITPTGQVKITDFGIAKAVDAAPVTQTGMVMGTAQYIAPEQALGHDATPASDVYSLGVVGYEVVSGKRPFSGDGALTVAMKHIKEPPPPLPAELPPNVRELIEITL

SEQ ID NO: 1374 - protein, 492 aa, Mycobacterium paratuberculosis
MNASLRRISVTVMALIVLLLLNATMTQVFAADSLRADPRNQRVLLDEYSRQRGQIVAGGQLLAYSVATDNRFRFLRVYPNPAQYAPVTGFYSLRYSSTGLERAEDPLLNGSDERLFGRRLADFFTGRDPRGANVDTTIRPRVQQAAWDGMQQGCGGPPCKGAVVALEPSTGKILAMVSSPSYDPNLLSSHDPEVQAQAWQRLRDDPDNPMTNRAISETYPPGSTFKVITTAAALQAGASDTEQLTAAPSIPLPNSTATLENYGGQACGNDPTVSLQQAFALSCNTAFVQLGILTGADALRSMARSFGLDSTPSVIPLQVAESTIGIIPDAAALGMSSIGQKDVALTPLQNAEIAATIANGGVTMQPYLVDSLKGPDLTTISTTTPYEQRRAVSPQVAAKLTELMVGAEKVAQQKGAIPGVQIASKTGTAEHGSDPRHTPPHAWYIAFAPAQTPKVAVAVLVENGADRLSATGGALAAPIGRAVIEAALQGGP

SEQ ID NO: 1375 - protein, 469 aa, Mycobacterium paratuberculosis
MTTQLQPPVAVTPPLPTRRNAELLLLGFAATITVAALLIVEANQQHDLRWNAVSYGLVFLVVFGSAHMAIRRFAPYTDPLLLPIVALLNGLGLVMIHRLDLVTSQLSGRHHPSATQQMLWTLIGVVTFALVVTFLKDHRQLARYGYICGLVGLVFLVIPALLPASLSEQNGAKIWIRFPGFSIQPAEFSKILLLIFFSAVLIAKRGLFTSVGKHFMGLTLPRPRDLAPLLAAWVISVGVMAFEKDLGTSLLLYTSFLVVVYLATQRFSWVAIGLVLFVAGSVVAYYIFAHVRVRVQMWWDPFSDPDGSGYQIVQSLFSFATGGIFGTGLGNGQPDTVPAASTDFIIAAFGEELGLVGLAAILMLYTIVIVRGLRTAIATRDSFGKLLAAGLASTLAIQLFIVVGGVTQLIPLTGLTTPWMSYGGSSLLANYVLLAILARISHSARRPLRTRARTEPSIAAASTEVIEKV

SEQ ID NO: 1376 - protein, 499 aa, Mycobacterium paratuberculosis
VTLVLRYAARSDRGLVRSNNEDSVYAGARLLALADGMGGHAAGEVASQLVIAALAHLDDDEPGGDLLAKLDEAVRAGNAAIAAQVEAEPELEGMGTTLTAILFAGDRIGLVHIGDSRGYLLRDGELTQITKDDTFVQTLVDEGRITREEAHSHPQRSLIMRALTGHEVEPTLTMREARAGDRYLLCSDGLSDPVSDETILEALQIPDVAEAAYRLIELALRGGGPDNVTVVVADVVDYDYGQTQPILAGAVSGDEDQLTLPNTSAGRASAIRPRDESAKRVAPQPETPSRPRWSRRRLFVVIALAVMLVLAGLTVGWWVIQRNYYVAEYNGRISIVRGIQGSLLGVPLQQPYLVGCLNARNELSLISYGQSGGSNCQLMTLQDLRRPGQVQVQTGLPGGSLDQAESQLRQLLAEYLLPLCPPPRATSPPGAQATRSPVPETGGPASPAPPTTSASPTPSTNATPGPASSSPAGPTTTSQTLTALPGPPLQPGIDCRTVA

SEQ ID NO: 1377 - protein, 155 aa, Mycobacterium paratuberculosis
MQGLVLQLTRAGFLMLLWVFIWSVLRILRTDIYAPTGAVMVRRGLALRSTLLPSRQRRHAARYLVVTEGALAGGRITLSGQPVLIGRADDSTLVLTDDYASARHARLTQRGSEWYVEDLGSTNGTYLDRAKVTTAVRVPIGTPIRIGKTAIELRP

SEQ ID NO: 1378 - protein, 544 aa, Mycobacterium paratuberculosis
MSSQRGLVARIERKLEATVDNAFARVFGGPIVPQEVEALLCREARDGVQKLHGNRLLAPNEYIITLGMHDFEKVSADPDLTSSAFARYLADYIHEQGWQTYGEVVVRFEQSSSLRTGQYRACGAVNPDVQPRPTVDDPVRPQSNNAFGEERGVAPMTDNSSYRGAQGPGRPGDEYYDERYGRPQDDARGGSEPQGAPDQRGGYPPEQAGYPPQQGYPPPRHPEQGGYPEQGGYPPPQSYQEHGGYPDQRGGYPEPGQGGYPPQQHGYPDQRGYPEPAQGGYPQSYEQRPPAPPGYSGQGYDQGYRPPGGYPPPGGQPAGGPQGYGGYGDYGRGPARPDEGGYAPPEQRPAYPEQGGGYDQGYPQGGGYGRQDYGSAEYTQYAEHAQGATYAPPGGGYPEAPGSEYEYGQPADYGQQPEYAQPAEYGQPADYGQQAGGYGGYGQGGYGSTGTTVTLQLDDGSGRTYQLREGSNIIGRGQDAQFRLPDTGVSRRHLEIRWDGQVALLSDLNSTNGTTVNNAPVQEWQLADGDVIRLGHSEIIVRIH

SEQ ID NO: 1379 - protein, 221 aa, Mycobacterium paratuberculosis
VVCVTANHDSARRPSPRPRPRPAQTGVTCPRRQPLRKRSAAHGARTPGDPVCHHVLVTDPCRECGFAYDLRQAATAGDDVRARVAEVVTILCDNTIDVRSRPRDGVWSPLEYGCHLRDVLLVQRERVLAARRTNGADCVSMGREDRAVHDGYNEQEPGTVARQLADAALLFGNVLARLTTADWDRTVVYHYPVTAERSLRWVAVHTAHEAQHHLLDIRRQL

SEQ ID NO: 1380 - protein, 87 aa, Mycobacterium paratuberculosis
MTSSNPPLPRAVDDRLVSILRDDLDLKFESLSPTTRLIDDLGMDSVAFAVSLVAIEERFGTQLSEEDLLYCTTVGDLQSAIAARVNA

SEQ ID NO: 1381 - protein, 518 aa, Mycobacterium paratuberculosis
MNALAAAMRDAMTRSPHDLVVLDKDSDTWRSCPWPEVHGMAESIAARLLQRDRLGAVGLVGEPTVELIAAIQGAWLAGVAVSLLPRPRRGADPSEWAHSTLQRFGGIGVDTVLSHGGVLRTLAAADSAVSVCDLAQAARTPTSTGLEYQDDSGVAILQGTAGSTGNPRTAVLSPAAVLSNMRGLIERLRLDGASDRACSWLPLYHDMGLAFLLTSALSGMPLWQAPTGAFSAAPLRWAEWLSDSQATFTAGPNFGYSMIGRYSGRVRDVDLGALRIAINGGEPVDCEGFQRFATAMAPFGFRAAAATPAYGMAEATCAVTMPGCGEGLQIDERTESGVRQRYALLGGPIAGMELRIAATDEPSGEGVGEVEIRGSSTMTGYLGDTTGRSDGDWFPTGDIGYLVDGALVICGRSKEVITVAGRNIFPTEIEQVAAQVDGVRHGGVVAVGSKSGAAQSRLLIAAEFVGADRDVTRSAVIKRVISVCGVTPADVVLMPPGSLPRTSSGKLRRLEVRRQLLG

SEQ ID NO: 1382 - protein, 632 aa, Mycobacterium paratuberculosis
MGLPYIDKQALIAEAGGDPWAINASLQAGSPSQISNLAGAFHRAGRCTQEADNAFQQARSRFDAAWNHQDGDHPINDSEEVQRVTKALGAQSLQLPKIGADLEGIAAALAEAQKAGAARIATLDAQLKNISDLVVEAVALLNDKSLSPADRDALHALINTCENDALRHTKAALADLQAIRNGYADGLQKSLNSLHAEGYDGAPLHGVDADGVAPASPAQQAALDDIRRATNQAVLDQMAKVRAAQRALDKAMADVYAHGPGSPEGEAASAQLPKLKADLAHALDDLGKIPDYTGIDPASVNVTPDGHFMFTYNVNGQPVQVVGQLKHGTGEFFDQATGTYYTFNGGKLTGMRTPDPGKVEATSEPLWTAITTAVGGYGLKVGGTAAWQGLKTLFSREMLDGLTSENVISRAMTGAEVRAALAEAEYPRGIGGEAVPSTHPLEPPPVEHTPPADAPVEHAPGGPHVAVPDSPPPLPPEQPPPPPLASDHPLFEGYHPIDPGPEFTNADGSLRYPDDTLPTKPYAVPGTVVPDAQLSAGTVLSRFGFPGGGYLAPEGTPFAELALPPGSAGKPYFQYVVDDPTRLPPGWHIEQSEVAPWFHQPGGGQQYRIINEEGETGDVAELVRWGYLRRIN

SEQ ID NO: 1383 - protein, 411 aa, Mycobacterium paratuberculosis
MALDQSALLEVLDALRNADAADRIKQAAETIYQALIDAELTAVIGAGPHERSASRINQRNGSRPRTLSTIAGDLELRIPKLRSGSFFPALLERRRRVDQCLFAVVMEAYLHGTSTRKVDDLVKALGADAGISKSEVSRICADLDTEVGAFRDRPLSEQHFPYVFLDATYCKARVNHRVVSQAVVIATGVAADGRREVLGFDVGDSEDGAFWTAFLRSLKTRGLSGVQLVISDAHTGLRSAIEAILIGASWQRCRVHFLRNVLAQVPKGSAEMVAAAIRTIFAQPDAEHVREQLDTIAGMLGRQLPKVETMLREAADDITAFADFPVLHWKKIWSTNPLERLNKEIKRRTDVVGVFPNPAALLRLAGSVLVEAHDEWQVAEKRYLSETTLALLHPRSDSADQSVAVPAAITA

SEQ ID NO: 1384 - protein, 414 aa, Mycobacterium paratuberculosis
MSSSVLAAEVEVRPCDRLAVLFDELAELTGQRNAIDGRIVEIVAQIEREQLWGATGARSLGALVAWKTGCSPGNAETIAAVARRLDSFPRCAAGLREGRLSLDQLGVIAQRAGAGSDAHYAQLATVATVNQLRTAVKLEPRPQPEAKPAPQPGLTKTSDEELSCWRIKLDRLDAATFDAALAAHREALISEWKRDHNHRAGESVPPLPGTLEAFIRLIETGWDAEAHRRPHGHHTTVVVHLDAAQRIAGLHLGPLLSDAERRYLTCDATCEVWVERDGQPIGAGRSTRVINRRLRRALEHRHRGCAIPGCGATRGLQAHHLRHWEDGGPTELSNLVLVCPYHHRAHHRGEITITGPADTLLVTDSSGRHLKPGSLARKPTRPPPAVPPCPGPLGQRADWWWYDPFQPQPPPTTN

SEQ ID NO: 1385 - protein, 109 aa, Mycobacterium paratuberculosis
MTTDKTGAQTTVSLQDGKYTIAVEGKPVGLADFKDRGDQRVFYHTEIDPAYGGRGLATILVEEALNEARNEGKRIVPVCSMIGTVLKKHPEFDDITDPVTPEITRWVHS

SEQ ID NO: 1386 - protein, 330 aa, Mycobacterium paratuberculosis
MSNLEAAPAEVACAASRDRDASPAVQILRPREVPLGGPRALRVQRTLPQRERSLIGAWCFIDHYGPAHTRMDVPPRPHTGLQTVSWLFSGEVEHRDSAGVHAAVRPGELNLMTAGAGICHSEVSVGSGALHGVQLWVALPDSDRDTARDFAHYAPPPISLPGAQARVFLGELHGSRSPVRTFTPLVGAQIDLGAGAQLDLDIDPNFEHGLLCDAGAVHVDEKPLSVAELAYLGPGRAAVQLRNAGDTPARVLLLGGTPFPEQLVMWWNFVGRSHEDIVGYRRLWEDGDERFGAVRGYRGALSRLPAPPLPTARLRPRPIPERKGSTNDNR

SEQ ID NO: 1387 - protein, 460 aa, Mycobacterium paratuberculosis
MTFDLTPTAAQHDLARRTHEFAESVIRPVALEYDQRQEFPWPVLEEAARRGFYSPLFYRDLIGDPTGISLPMFMEELFWGCAGIGLAIVMPALALSAIGQAASPEQMLEWAPECFGTPGDLKLAALAISEPEGGSDVRNLRTRARRDGDDWIIDGHKMWIGNGGIANVHVVNAVVDEELGHRGQALFVVPGGTPGLKMVRKLDKLGCRASHTAELLFEGVRVPAANLLGGQEKLEHKLAKAREVVAGGKRSGSATLGTFEQTRPMVAAQAIGIARAALEYATSYATEREAFGAPIIDNQGIAFPLAELATQIDAARLLTWRASWMAANNVPFERGEGSMSKMAASEVAVKATERAVQTLGGWGYITDHPVEKWYRDAKLYTIFEGTSEIQRMVVSNALGAAVGTPPLHVVLEPSGGALNRVFGRGTPLRSRAAEAALSMQDRIPEPVMRLAMKVLRPPGR

SEQ ID NO: 1388 - protein, 139 aa, Mycobacterium paratuberculosis
DMGHPCAANPELWFGYPDDDGGDGAAKARAYERSATEARIQCLRRCPLAQQRRCAQHAVAHREEYGAWAGVKLPGGQYRKREQLAHAHEVLRRIASGEINSRQLPENAALLARHEHETVAAPAVVLHLPLAKVGPRSAA

SEQ ID NO: 1389 - protein, 401 aa, Mycobacterium paratuberculosis
VVVAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFPALERAFDYNKSRAALILLTGYQTPDALRSAGGARVAAFLRKRKARNADTVAATALQAANAQHSIVPGQQLAATVVARLAKEVMALDTEIGDTDAMIEERFRRHRHAEIILSMPGFGVILGAEFLAATGGDMAAFASADRLAGVAGLAPVPRDSGRISGNLKRPRRYDRRLLRACYLSALVSIRTDPSSRTYYDRKRTEGKRHTQAVLALARRRLNVLWAMLRDHAVYHPATTTAAA

SEQ ID NO: 1390 - protein, 262 aa, Mycobacterium paratuberculosis
VSRESAGAAIRALRESRDWSLADLAAATGVSIMGLSYLERGARKPHKSTVQKIENGLGLPPGTYSRLLVAADPEAELARLMAAQPAAEMPARRTGPVVVDRHSDTEVLEGYAEAQLDALKSAIDRLPATTSNEYETYILSVIAQCVKAELLAASSWRVAVNAGADSTGRLMEHLQALEATRVALLKRMPTSLSARFDRACAQSSLPETIIAALVGVDVDEMWDIRNRGVISPSALPRVRAFTDAVESASRNGASRGDDEEGS

SEQ ID NO: 1391 - protein, 274 aa, Mycobacterium paratuberculosis
VSHSELEALSRAHQLFAGGTRPASLDTGSGHYRDLLGRAARLSDGFAHGGYRLAVQHSRQRLASTSDTDAAVTDLLAGAHRDRAQARELTGAVLDAGRADAANPTTPLAQREAMRRRVMRLRTQHAHVVSAAARARHHHARLLALRYRLRHGVGLAGLRGPGSDRAALAVRAALSRLGRPYVWGATGPDQFDCSGLVQWSYAQAGIHLDRTTYQQINEGIPVPRSQVRPGDLVFPHAGHVQLAIGNNLVVEAPYSGASVRISRLGNNVAIRRPI

SEQ ID NO: 1392 - protein, 120 aa, Mycobacterium paratuberculosis
MPEQPEYSLEAVEARRSALADQHGAASEADRVLAEVLASAHAAAQESARRLDASAEQIDRAVAHQADLAIDTPLGAREFHKFLLAKQHEIASVVTEAQELGRAKRVVLENLRAQYSAGNR

SEQ ID NO: 1393 - protein, 483 aa, Mycobacterium paratuberculosis
MSAYDDLLAAVKDVRDRTGDPNAWQTGLAPAEVSAVITPSTRPEQLQAILAKIRRQHAEVFGAAPTGVARPPADAGPAPDRESGAAADAIASAEAALAQQNSVSSQLDMQVVTAILNAHLKAVDGREALTKLQQETEAAVRTRSDLDTPAGARDFQRFLIGKLRDIRAVVLNASLDDTSKSALMAAWTSLYDAAKSDRPGDHASSAGAAADAAAAGTSDQPDEDLDDEWDPLLDSLLADDDGSPIDPAAALDPLGGNTIPPAPPPAMAPALPSFGGGSLPGLGATPASMSGWETPGGLPLSGLQAGDASDPALQDLGDEDLPEDQGQQHDSPADGSAEQADDENASADEPPAGPTSVTLPDGETVAAASPQLAAAIKAAVGGTPIAEAFQQQGMTLPTPGTAVANPVDVVRVSPGDIGMFTDRHALALGPGKALLDGQIQHIATVSGPGFLGWEHPPAAAASVTAPAKPDPPTPTRPASSSTT

SEQ ID NO: 1394 - protein, 105 aa, Mycobacterium paratuberculosis
MADSIHVVPAHLRQAAAHHQDTSEYLRTVPSSHAAIQESLDSLGPIFSELRDAGRELLELRRQCYEQQAADHADLADQLTVSAAMWEQHEQEAADKFGSIVDRGR

SEQ ID NO: 1395 - protein, 103 aa, Mycobacterium paratuberculosis
MTDANPAFDTVHPSGHILVRSCGGGYMHSVALSEEAMETDAETLAQGILLTADVSCLKALLEIRDEIVAAGHTPSAEVPTPRDLDAAIEKLLAHKLRRRTHAK

SEQ ID NO: 1396 - protein, 544 aa, Mycobacterium paratuberculosis
VAIFGRMTARQRLRRATRESLSIPAFSSPVDCTPWVTGGLWPAELSTVTPETATLAEYLKADLQRIADGANDELRKLKRAGMTDTARQAAEARVIEQARTRAVRRVESTIRYLHAVQSGARPPAPPRPTLDAPGADLERTQVLPAVGDAEHTAGPPAQQTPEARPRPTRRRAAEDEPAQLEETRVLPAIRDDAAAADASVPETPASEAPVPEAPETPAPEAPAAEAPVPEPLGEPTTRGRHHAPVPEPVPEHVEPDIAAPAEAADLEQTQVIPVVRRDEPVPEPPVVAPPEPAEEPADSGRHHAPADRDEPATESRPAVADTETAQPRVEKPAPTTAFDNNRLNRLLEFVVRQEPRLNWAIGDRADGTTILVTDLAHGWIPSGIALPAGVRLLEPERRSGDVVALIGETVRRVTYTPGDTLRRSADFAATQSSSQPRELPPIDDLATAISRAIRGRADLPKIVPRLADAAAAGAVIVDQEVDVLRVHLDTARYQLLVQYPNVNPALLLKCLLMAATEGIASGDPVSANYHLAWYRTLAAPSPGG

SEQ ID NO: 1397 - protein, 107 aa, Mycobacterium paratuberculosis
VQVSDSGSRANLSDKDLVESVLRELSEAADKWEALVAQAEAVTYSVDLGDIYAVANSDGRLLKLTLHPGVMTGYGHGELADRLNLAITALREEAEAENRASYGGPLH

SEQ ID NO: 1398 - protein, 257 aa, Mycobacterium paratuberculosis
MTGPAPIVADLRAESDALDALVAPLPPGRWADPTPAAGWTIAHQIGHLLWTDRVALIAVTDEPGFAEVLAGAAADPAGFVDKGAEELAAVAPAELLADWRATRDRLHRALLGVPAGRKLPWFGPPMSAASMATARLMETWAHGLDVADALGVTRPATDRLRSIAHLGVRTRDYAFAVNNLTPPAEPFLVELCGPGGDTWSWGPPEAAQRVTGSAEDFCFLVTQRRPLSALDITAFGADAQRWLEIAQAFAGPPGPGR

SEQ ID NO: 1399 - protein, 428 aa, Mycobacterium paratuberculosis
VIPTRMQSSAPVEIWRSVRALPDFWRLLQVRVASQFGDGLFQAALAGALLFNPDRAADPLAIARAFTVLFLPYSLLGPFAGALMDRWDRRLVLVGANVGRLVLIAAIGTILAVRAGDLPLLLGALFANGLARFVGSGLSASLPHVVPREQVVTMNAVATAAGVVAAFLGANFMLVPRFLFGAGDRGAAAIVFLTVVPVSIALLLSWRFAPRALGPDDTWRAIHGPVLYAVITGWLHGARTVAQRPTVAATLSGLAAHRMVVGINSLLVLLLVHHLPGLEGGGFGTALLFFGAAGLGAFLANVLTPPAIRRWGRYASANGALAASAIVEVAGAELLLPVMVVCGFLLGVTGQMVKLCADSAMQMDVDDALRGHVFAVQDALFWVSFIVAITVAGMVIPDDGHAPVFALFGSVLYLVGLAVHGIVGRRGE

SEQ ID NO: 1400 - protein, 201 aa, Mycobacterium paratuberculosis
VPPPEDPEDYVAPAAQRVRAGTLLLANTDLLEPTFRRSVIYIVEHNDGGTLGVVLNRPSDTAVYNVLPQWTTLAAKPKTMFIGGPVKRDAALCLATLRVGADPQGAPGLRHVDGRVVMVDLDADPDAIAPLVEGVRIFAGYSGWTIGQLEGEIERDDWIVLSALPSDVLVGPRSDLWGQVLRRQPLPLSLLATHPIDISRN

SEQ ID NO: 1401 - protein, 113 aa, Mycobacterium paratuberculosis
MLIAGVLCICAAVASAGFGTWSLAHNRNYGATALALRAMAPTQLAAAVMLAAGGTVALAAVPHTALVVLIVCVAGALGTLAAGSWQSARFAVRQQSAAPACAGSCTGCTQSCA

SEQ ID NO: 1402 - protein, 407 aa, Mycobacterium paratuberculosis
LVSVALRTDQGFIPAVFRACSPPLTCSYSQPLSTASGRQPWEGPTQMIEIVPGHRALLGGMVAGLIGLAVAAGGTASADPLPPAPAPVPAPAPANLGPELVPPSRYLAAPQATTAATQVTPATPGTPGPAPAPAPAPAPAPAPATSGTIREFLQSKGVKFEAQKPQGFKALDITLPMPARWTQVPDPNVPDAFAVIADRHGSSIYSSNAQVVVYKLVGNFDPREAITHGYVDSQKLPAWQPTNASMADFGGFPSSIVEGTYRDGDLTLNTSRRHVIATSGPDKYLVSLAVTTDRAVAVADAPATDAIVNGFRVTVPGASAPAPTAAPVALPAQAPAVAPVAPAPVAPAAPTAPAPAAAAPLVPLAQTAPAAPAGLPAQPLPNQQHTPSLLAMVPGLPPLPNFSFLQH

SEQ ID NO: 1403 - protein, 992 aa, Mycobacterium paratuberculosis
VRNATETNLWPANPPRRPLYPVQVTESPTTSPATGSGAAAPDSDAPPYRYTAALAGRIEGSWQDTWAKLGTFNVPNPVGSLAPTDGTPVPEDKLFVQDMFPYPSGEGLHVGHPLGYIATDVYARYFRMTGRNVLHALGFDAFGLPAEQYAVQTGTHPRTRTEANVVNFRRQLGRLGLGHDSRRSFSTTDVEFYKWTQWIFLQIYNAWFDPAANKARPIAELVAEFDSGARSLDDGRNWSELSAGERADVIDSHRLVYRADSMVNWCPGLGTVLANEEVTADGRSDRGNFPVFRKRLRQWMMRITAYSDRLLDDLDLLDWPEPVKTMQRNWIGRSTGAKALFAATGADGAALDIEVFTTRPDTLFGATYMVLAPEHELVDELVAPAWPDGTDPRWTYGAATPGESVAAYRRAIASKSDLERQESKAKTGVFLGSYATNPTNGKPVPIFIADYVLAGYGTGAIMAVPGHDQRDWDFAHEFGLPIVEVIAGGDISEGAYAGDGVLVNSGYLDGLDVAAAKEAITARLEAEGRGCARVEYKLRDWLFARQRYWGEPFPIVYDSDGRPHALDEAALPVELPDVPDYSPVLFDPDDADSEPSPPLAKATDWVHVELDLGDGLKPYSRDTNVMPQWAGSSWYELRYTDPHNSERFCAKENEAYWMGPRPAEHGPQDPGGVDLYVGGAEHAVLHLLYARFWHKVLYDLGHVSSREPYRRLVNQGYIQAFAYTDSRGSYVPAEEVVERDGRFFYRGPDGEIEVFQEFGKIGKSLKNSISPDEICDDYGADTLRVYEMSMGPLEASRPWATKDVVGAHRFLQRVWRLVVDEQTGETRVVDGAGRDLPTGTLRLLHRTIAGVSEDYAALRNNTAVAKLIEYTNHLTKEHRDAVPRAAVEPLVLMLAPLAPHMAEELWLRLGHTTSLAHGPFPVADPAYLVEDTVEYPVQVNGKVRGRVTVAADADRDTLEAAALADEKVLAFLAGAQPRKVIVVPGRLVNLVV

SEQ ID NO: 1404 - protein, 223 aa, Mycobacterium paratuberculosis
MPNALITGAGGGIGSAIATALAPTHTLLLAGRPSDRLDAVAQRLGATTFPLDLTDGGDIEAACEVVEELDVLVHNAGLSIPGNVADSNVDEWRATFAVNVFGPVELTLALLPALRRARGQVVFINSGAGRNASPGMASYSASKFALRAFADSLRNDEPELRVTTVYPGRTDTGMQRELIAFEGGSYDPDRFLKPETVAAAVANVVATPPDGHVHEVVLRPARR

SEQ ID NO: 1405 - protein, 182 aa, Mycobacterium paratuberculosis
MAPLYASDIGLDSRFMADSESNAAEVAELAEGLHRALSKLFAMLRRGDPSGAAAGDLTLAQLSILVTLLDQGPIRMTDLAAHERVRTPTTTVAIRRLEKVGLVKRSRDPSDLRAVLVDITPRGRAVHGESLANRRAALAAMLSQLPESDLDTLMKALAPLERLASGDPTSGPAGVPPARKEA

SEQ ID NO: 1406 - protein, 248 aa, Mycobacterium paratuberculosis
VSNPASRASVSLACKDIHQTLNGNAVLRGVDLDTPAGSTVAVIGPSGSGKSTLLRTLNRLYEPDRGDILLDGRSVLHDDPDQLRQRIGMVFQHFNLFPHRTVLDNVALAPRKLRRLPAEAARELALTQLDRVGLKHKAGARPATLSGGQQQRVAIARALAMSPQVMFFDEATSALDPEMVKGILQLIADLGDEGMTMVVVTHEMGFARSASDAVIFMDHGKVVESGPPEQIFEAAETERLQRFLSQVL

SEQ ID NO: 1407 - protein, 579 aa, Mycobacterium paratuberculosis
MVCGSSALLAPPAAADRNQCAPAGPKSAAVLPENLTRGGSMSQPDEHTTPTVEPLSSVRIDTLGLGTPGVLTVGTLSGAPPNVCITPTGQYSGFDNQLLRAIAGKLGLQVRFVGTDFAGLLAQVASRRFDVGSSSIKATDERRQTVAFTNGYDFGYYALVVPPGSAIKEFTDLAAGQRIGVVQGTVEESYVVDTLHLQPVKYPDFATVYASLKTRQIDAWVAPAGQAATTIQPGDPAVVVANTISPGNFVAYAVAKDNKPLVDALNSGLDAVIADGTWSNLYSQWVPRTLPPGWKPGSQAAAPPKLPDFAAIAASQHHKAVGPAAPKSTLAQLRDSFFDWDMYRQAIPTLLRTGLPNTLILTFSASVIGLVLGMVLAVAGISHARWLRWPARVYTDVFRGLPEVVIILLIGLGIGPIVGGLTNNNPYPLGIAALGMMAAAYIGEILRSGIQSVDPGQLEASRALGFSYATAMRLVVVPQGVRRVLPALVNQFIALLKASALVYFLGLVADQRELFQVGRDLNAETGNLSPLVAAGACYLILTVPLTHLVNMIDARLRRGRATVDPEEPADMLTFGQEIT

SEQ ID NO: 1408 - protein, 246 aa, Mycobacterium paratuberculosis
MPKKYGVKEKDLVVSHILHLLLTGKLRTGDRVDRNEIAVGLGVSRVPIQEALVQLEHDGIVSTRYHRGAFVERFDEATVLEHHELDGLLNGIASARAATSPTPRILGELDTLLRSLRTAKDSRAFTDIAADYRRTVNDEYAGPGLHATIRASQNLIPRLFWTTYQGGRDDLLPFYEDETSAIHRRDPEAARAACVERSYRMAQTMLGELFRRRVFTPPDDAGRVVAGPLPVLADADTICGGASLAL

SEQ ID NO: 1409 - protein, 262 aa, Mycobacterium paratuberculosis
VDVMTHPIRIGVQLQPQHTPQYNQIRDAVRRCEDIGVDIAFNWDHFFPLYGDPDGAHFECWTMLGAWAEQTSRIQIGALVTCNSYRNPELLADMARTVDHISEGRLILGIGSGWKQKDYDEYGYEFGTAGSRLDDLAGALPRIEARLAKLNPAPTRDIPVLIGGGGERKTLRLVAQHADIWHSFTSAEEYPAKSEVLARHCADVGRDPDRIERSAAVKGGAELLANAEALVGLGVTLLTVGCDGPYYDLRDAEALCKWRDGR

SEQ ID NO: 1410 - protein, 304 aa, Mycobacterium paratuberculosis
VTDVSEDELAGLSEFALLHENAEQAGVSGPLPEVARVESGSGDAKVSALRWGSTDARIVFVHGGGQNAHTWDTVIVGVGEPALAVDLPGHGHSAWRADGDYSPQLNADALLPMLREHAAGADLVVGMSLGGLTAIRLGAVAPDLVKELVLIDVTPSALQRHSEMTKEQQGTVALMHGEREFDSFQAMLDLTIAAAPHREVKALRRGVFHNSRKLDNGKWTWRYDAIRKFPDFDGLWADVDALSAPVTLVRGGSSGFVSDEDAAELSRRAKHFRTAHVVANSGHSVQSDQPRALIDILRGVLDAR

SEQ ID NO: 1411 - protein, 411 aa, Mycobacterium paratuberculosis
MAFGDGPHDAALRAAWTEFCARLQRAGERAFKDHNPASGPHRVDAFRFLTQNLGQAFDLALETRDANYPVLHSFCGPTRKLGGDCADFTYQQAWIDGRSTYRITGTRGTSRFFNVTVQGRRTPGEGVLHEPFGDAPQANLFGQQLRVGADGRFELYVGGAERGHNWLPTTPESRKLFIRQGFDRWDETPAQLRIERVDMAVPKPLPTPGEMVEAMQWAGDFVTGLMSDCLEYRFSQDWPEYPFRHGGVDAESPNTFPRAAATDADGKRGRAAANMYWELAPDEALIVEFDAHPGLWMFTNMGVFFNSMDYLYRPVSYTPSRTTVDGDGRIRLVMAHRDPGVHNWLDTQGFERGNLTYRHMLEGEPAVLDTRVVGHEELLDALPKDTVMVTPSQRADAMWERFRGIRRRYVL

SEQ ID NO: 1412 - protein, 267 aa, Mycobacterium paratuberculosis
MTGAHKRLSVHNVTFYGAPPAELQAHWAALGVSRLSILDNQLLDPQFPMLLRRNDYTVEAVYHLFAGGHLTSDPGAAREALIAVIDAAASVGAHTVYLLTGGRTGLTWPQAAERFAAMVAPCAVRAKAAGVVLAVENASSLYADIHIAHTLRDTVALAEMSDLGICIDLFHCWAEGDFEAQLPRALPRTALIQLSDYVLGDRALPGRAVPGDGAIPIEAFVAQALAAGYAHGFDLELIGPRIEREGRLESARRACDVVGAMLDKLGG

SEQ ID NO: 1413 - protein, 380 aa, Mycobacterium paratuberculosis
MLAAAEAETGLHDYGDPTLPQRFTVAVEHLNALGLDADGRFEAAQVCRWLLTSRLELIEDRNRYPIGAEVIDAPMFVTGEPRSGTTLMHALMSVDPHARALRFWEVMYPSPPPGLAGPDDDRRARADADWREINAKMPKWLHSHPYNDMLGDGLPEDERTWAFDFRVMTPTAWWRVPMQSLVAGLPTDPAAQYRLHKAMLQQLQYNRPRKYWVLKGFHGFRLKELFDTYPDARMVWLHRDPVQVAASRTMMMADIAEGMVGPVDLHAEAKKHLEMTRASIANTMTNPLVDDPRILHLRYTDFIADHVGAVRRYYAFCGRELTAEAESAMRAYLADNPGDRYGKFRYSTQLLTDIGEDLDALHAEFRPFRERFGVPIENRG

SEQ ID NO: 1414 - protein, 375 aa, Mycobacterium paratuberculosis
MTVQPAAFLRTTLPLDLSRLDEFDSGRYHSVWLPDHMVSFWPDSIWAPEFTDLATASPSPHRHLDGLAVAAAVAVLTERAPLVSAVVDTVRRHPALLAQTALTLDHLSKGRFILGLGSGESENTVPYGFDFARPVSRFEEALRVIRLLWDTDGPVDFDGEFYSLHQARLDTEPYHGRLPPIWIGASGPRMLDIAGRYADGWWPAGAWTPEHYAQMLGAVRVSAERAGRDPMAITPCFIQVCLIGEDDDALAEILRAPLVKAFLLQVSAKTLGEFGFEHPMGDGWRGFQDIDPAALGRDRIVEFLHRVRPEMVLAVVPHGTPKQVAKIVKSYVDAGLRVPKILDYGAMAGLSHAQSSAANVRATEDELMRLCGDGS

SEQ ID NO: 1415 - protein, 368 aa, Mycobacterium paratuberculosis
MSDHQPPQAEDAQSEVRVAIVGVGNCASSLVQGVQYYFDADENSTVPGLMHVKFGQYHVRDVKFVAAFDVDAKKVGFDLSEAIFASENNTIKIADVPPTNVTVQRGPTLDGIGKYYADTIEVSDAEPVDVVQALKEAKVDVLVSYLPVGSEEADKFYAQCAIDAGVAFVNALPVFIASDPVWAKKFTDAGVPIVGDDIKSQIGATITHRVMAKLFEDRGVQLDRTMQLNVGGNMDFLNMLERERLESKKISKTQAVTSNLQREFKTKDVHIGPSDHVSWLDDRKWAYVRLEGRAFGDVPLNLEYKLEVWDSPNSAGVIIDAVRAAKIAKDRGIGGPVIPASAYLMKSPPQQLPDDVARTQLEEFIIGG

SEQ ID NO: 1416 - protein, 180 aa, Mycobacterium paratuberculosis
LLELAILGLLIESPMHGYELRKRLTGLLGAFRAFSYGSLYPALRRMQAEGLIAEDAAPAGTPVRRARRVYQLTDEGRRRFGELVADTGPHNYTDDGFGVHLAFFNRTPAEARMRILEGRRRQVEERREGLREAVARASSSFDRYTRQLHQLGLESSEREVKWLNELIAAERAMPGLSEQT

SEQ ID NO: 1417 - protein, 294 aa, Mycobacterium paratuberculosis
VAKWLGTPPAGTAPPSGRASTRAKDSDRQSTCTILDNALTDGELSAEEHRERVSAATKAVTLGDLQTLVCDLQTGPQPPALDPSPPSGRVRGWGTLAAAFVVSVLLGIGIGWGLYGNTSSPLDFTSDPGAKPDGVNAVVLTPPTQLHSVGGLTGLLEQMRKRFGSTLGYRLVIYPTYAALDRPDPSDDRRVLAYTYRGGWGDPTSSAKSSSDGPVPVDLSKFDVTAAVGIMRGAPETLRMKPSDVKTSYLIVEPATDPTTPGALSLSVYVSSDYGGGYIAFTGDGTVKQMNLPT

SEQ ID NO: 1418 - protein, 138 aa, Mycobacterium paratuberculosis
VDYALRRRSLLAEVYSGRTGVSEVCDANPYLLRAAKFHGKPSQIMCPICRKEQLTLVSWVFGEHLGPVSGSARTAEELVMLATRFEEFAVHVVEVCRTCSWNHLVKSYVLGAARPAPPPRGTRTTTRTARNGARTATE

SEQ ID NO: 1419 - protein, 877 aa, Mycobacterium paratuberculosis
MSSNNEGRHSQSSGDQRGPAAEQGAGERRETARPDADPQRRHGPSTSSRRRQAPPDDRLTTILPPVDDDRAPRRSDPIEEVKAALAGPPSTPLRRDALDEVKAALDSRGPASGRQQRAGLGGRPPAGPPPPPPSRGWSGGPGGPGGRGSGPWRDWSWTQQINWLWVRRAAYLCAAVLVLLPIVTFAMAYFIVDIPKPGDLRTNQVSTILASDGSEIAKLIPPEGNRVDVNLNQVPVHVRQAVIAAEDRNFYSNPGFDFSGFARAVNNNLFGNGDLQGGSTITQQYVKNALVGSAQHGVSGLMRKAKELVIATKMSGEWSKDEVLQSYLNIIYFGRGAYGISAAAKAYFDKPVEQLTVSEGALLAALIRRPSTLDPAVDPKGALARWNWVLDGMVETKALPAKDRAAQVFPQTVPPDQARAQNQTTGPNGLIERQVTKELMELFNIDERTLNTQGLQVTTTIDPKAQQAAEKAVSKYLDGQDPDMRAAVVSVDPHDGAIRAYYGGSDANGFDFAQAGLQTGSSFKVFCLIAALEQGIGLGYQVDSSPLTVDGIKITNVEGESCGTCNIAQALKMSLNTSYYRLMLKLKGGPQAVADAAHQAGVATSFPGVDHTLSEDGKGGPPNNGIVLGQYQTRVIDMASAYATLAASGVYHRPHFVQKVVNSDGQVLFDAGKSDNNGEQRIPKAVADNVTAAMEPIAGYSRGHALAGGRPSAAKTGTTQLGDTTSNKDAWMVGYTPSLSTAVWLGTAKGDQPLVTASGGPVYGSGLPSDIWKATMDGALKGTPNESFPKPAEVGGYAGVPAPPPPPKAPPSETVIQPTIEVAPGITIPVGPPTTVTLAPAPPAGGPPGGPEPGGGVPPGPGGGVPPGGPQAPPPPP

SEQ ID NO: 1420 - protein, 545 aa, Mycobacterium paratuberculosis
VTGAAEPSATISPGPLAADRRSADNRDCPSRNDFLGAAFAEVIGGPVGRHALIGRARIMTPLRVMFLIALVFLALGWSTKAACLQSTGTGTGDQRVANWDNQRAYYELCYSDTVPLYGAELLSQGKFPYKSSWIETDSTGAQQIRYDGQPAVRYMEYPVLTGMYQYVSMALAKTYTALSKLAPLPVVAEVVMFFNIAAFGLALAWLATVWASAGLAGRRIWDAALVAGSPLLIFQIFTNFDALATAFAMAGLLAWARRRPVLAGVLVGLGAAAKLYPLLFLGPMLLLGIRTGRLGAWARTAVAAVATWLLVNLPVLVFFPRGWSEFFRLNTRRAEDMDSLYNVVKSFTGWRGFDPKLGFWQPPTVLNTVVAVLFVTCCAAIAFIALTAPRRPRATQLVFLVVAAFLLTNKVWSPQFSLWLVPLAVLALPHRRVLLAWMTVDALVWVPRMYYLYGNPNRSLPEQVFTTTVLLRDIAVITLCALVIRQIYRPDEDLVRWGGRVDDPAGGPFDRAPDAPPGWLPDWLRPAGSRRGQAAEPEPALAGAT

SEQ ID NO: 1421 - protein, 213 aa, Mycobacterium paratuberculosis
MTLIAIPLFPRVTTLDAVGPYEVLQRIPSVQVVFVGQRRGEVRTENGMLGLACDATFDEVSAPDVVVFPGGIGTRQLIHDEAVRAWLQAVHPHTRFTTSVCTGALLLAAAGLLDGLTATTHWRAADLLNGLGARYVEQRVVEHLPQRIITAAGVSSGIDMALRLVELLVDRQAAQAAQLLIEYDPQPPFDSGAFGKADAATVARAEEYLTGRR

SEQ ID NO: 1422 - protein, 96 aa, Mycobacterium paratuberculosis
MRPYEIMVILDPTLDERTVAPSLETFLNVVRKDGGSVEKVDIWGRRRLAYEIAKHAEGIYVVIDLKAEPATVSELDRQLSLNESVLRTKVMRTDKH

SEQ ID NO: 1423 - protein, 168 aa, Mycobacterium paratuberculosis
VAGDTTITVVGNLTADPELRFTPSGAAVANFTVASTPRIYDRQSGEWKDGEALFLRCNIWREAAENVAESLTRGSRVIVTGRLKQRSFETREGEKRTVVEVEVDEIGPSLRYATAKVNKASRSGGGGGGFGGGSRQQPAPASSAPADDPWGSAPASGSFGGGDDEPPF

SEQ ID NO: 1424 - protein, 84 aa, Mycobacterium paratuberculosis
MAKSNKRRPAPEKPVKARKCVFCAKKDQAIDYKDTALLRTYISERGKIRARRVTGNCVQHQRDIAIAVKNAREVALLPFTSSAR

SEQ ID NO: 1425 - protein, 152 aa, Mycobacterium paratuberculosis
MKLILTADVDHLGAVGDTVEVKDGYGRNFLLPRGLAIVASRGAQKQADDIRRARETKAVRDLDHANEFKTAIEALGPVTLPVKTAGDSGKLFGSVTAGDVVAAIKKAGGPNLDKRIVRLPKAHIKALGTHPVAVHLHPEVDVEVPLEVVPQS

SEQ ID NO: 1426 - protein, 875 aa, Mycobacterium paratuberculosis
VAVVDDLTSGMDSSSPSEDFGRQPPQDLAAEQAVLGGMLLSKDAIADVLERLRPGDFYRPAHQNVYDAILDLYGRGEPADAVTVAAELDRRNLLRRIGGAPYLHTLISTVPTAANAGYYATIVAEKALLRRLVEAGTRVVQYGYAGAEGADVAEVVDRAQAEIYEVAERRTTEDFVPLEDLLQPTMDEIDAIASNGGVARGVPTGFTELDEVTNGLHAGQMIIVAARPGVGKALALDTPLPTPTGWTTMGDVAVGDELLGDDGRPTRVVAATDVMLGRPCYEVEFSDGTVIVADAAHQWLTETRASRKSAQAAAVGYNRHKNQRTFAAVRTTAEIAETLRCPTQDRRLNHSVVNARALELPDREFLVPPYTLGAWLGDGTSAAAQITAADPEIIMRIEADGVVAVPSGSAPYRYQLRLPPGAEQAPRRCVVCGKSFIPQTSQVRTCGRSCGGRARFMSDPVPSPTCVRCGGPSAGMRLCLKCHSTVGTLQARLRTIGVLGNKHIPTEYLRGSEAQRRALLAGLLDTDGTVTVGGAVQFSVTNQRLARDVNELIVSLGYRCQTSTKRVQGRSETSSIAYTLTFSTEDKVFALERKAIAHKERRAVTGTSRCGSRFIVDVRPIESVAVRCVEVDNDSHMYLASRAMVPTHNSTLGLDFLRSCSIKHRMASVIFSLEMSKSEIVMRLLSAEAKIKLSDMRSGRMSDEDWTRLARRMSEISEAPLYIDDSPNLTMMEIRAKARRLRQKADLRLVVVDYLQLMSSGKKVESRQLEVSEFSRQLKLLAKELEVPVVAISQLNRGPEQRTDKKPMLSDLRESGSLEQDADMVILLNRPDAFERDDPRGGEADFILAKHRNGPTKTVTVAHQLHLSRFANMAR

SEQ ID NO: 1427 - protein, 295 aa, Mycobacterium paratuberculosis
MNSPARQLLSATADDQRTRRQAAIERAIFGLARQWDRVRPVYKPYVDGLENLPSDGRFLLVANHSYTPSSEILLLLYEVQRHLGRRVRALMDRRFGRFAGLAADVLAAGGGIVGTREGTAELMRANEPILVFPGGAREIGKGKDQLNTLQWGDRAGFARLAIEHNYPIVTAAVVGGDDMYKILTTSDGTWAQLSKKVSRWLGSDADLLLPLSRGIGPTLLPRPQRLYARFSRTIDTTRPKGTSHGEWLTTVRETAKTDLESNLAALLAIRATDPFRNLAPWAWRKAVMPHPAEDR

SEQ ID NO: 1428 - protein, 269 aa, Mycobacterium paratuberculosis
MSEALTVDPAIASMPRGGPDASWLDRRLQTEKLEYTDRYDIPDEVKQTVVAALDRMGTRAGYHERNARTALDIVADIANPRILELGAGHGKLSAEILTSHPTATVTVSDLDPTSVANIAAGPLGADPRARTQVVDATAIDAPDDSYDLVVFAQAFHHLPPATAVRAIAEATHAGKRFLVIDLPRPRSVQLLLTPLILAPFAAVLALVRPSLKHVMHDAYISALRAYSRSAFIALGKAADPRMGVEFLPLSACRLRPGHVGIVFTRPRAS

SEQ ID NO: 1429 - protein, 189 aa, Mycobacterium paratuberculosis
VRTATELRGQILQAAGAEFAQYGLAGARIDRIARVAQASKERLYAHFRDKETLFREVVAAGNREFFSAVTLRPDAVPDFVGGIYDLAREHPEHHRMISWAQLEGIALDEPHAEGQPAFAQHVAAIEAAQADGHVDGAWQPDDLLIVLFGIALAWANSPHPDAATNDPDANARRRAAAVEAARRIIAPSK

SEQ ID NO: 1430 - protein, 140 aa, Mycobacterium paratuberculosis
VTFLKRGWVLLVVVVALIVGGVAVVRLNGVFPGPGLPKPDPRDATPPYASKTAIYEILGPPGTTGVVNWMDAESLPQRASFTTLPWSKTIVAEMPGIFAYVVAQGDGPFIGCRITVDGRPVDQQESHNRDAQVSCLDKSA

SEQ ID NO: 1431 - protein, 973 aa, Mycobacterium paratuberculosis
MSDTDEIPVAHRTRVEHKPRLARTIRVLALPIVLGWLVLAVGVNVFVPQLEKVAEEVSVPLSPSDAPSVTGMKHIGEKFKEYDSDNLVLVTLVGDKPLGEDAHRFYDGLVEKLKRDPHVEHALNFWGQRFTSSGVESYDHKSAYVQVNLRGDQGGAVGDKSVAAIRKIVADSKPPAGVKAYVAGQGALTADTIVVGDASLAKMTIITIIIIAIMLMFVYRSIGTVLLTMVILFVGLATGRGVVALLGETGIMGLSTFAVNLLTALAIAAGTDYAIFMVGRYQEGRERGLDREAAYYDTFAGVTKVVLGSGLTIVGALACLKFTRLPYFSSLAFPCAVGLLVVVAAGVTLTPALIALASGFGLFDPKRKFNYTRWRRLATAIVRWPAPILATSVILAIVGAIGLMGFTPRYNDLYYLPQSASSVQAYNAADRHFTQARLNPDLLMIESDHDLRNPRDMLVLDKVAGAIFRVPGIERVQSITRPLGPPIQDGSVPFQLSVQSAPIRSNLDYLKARVGDIKKITGFLDTQIALLERQYAVTQKLANAADDSSKTTGETAAITDQIRDHIADFDDFWRPIRSYFYWEKHCYDIPICWSLRSLFDALDGFDQLAEKFHALTSDLTDTAKATRELLAIIPENIAVSKSIRDTTLTIYSSFDSLIAQFDRLTDTNAVMGKSFNDSQVESLFYLPPEIFQNPDFQLGLSLMVSPDGKAARFIITHATDPATVKGIASVDQERQAAKEALKLTSLENADIYLGGTAATFYDIANGAKYDLMIAAVASIVLIFIIMVIVTRALVAAGVIVGTIVLSLGAAFGFSTLIWQHLADFQLHWVATEFALIVLLAVGSDYNLMLVSRIEEEIGAGLKTGLIRGMGVTGPVVTAAGVVFAVTMGAMITSDLRAIGQFGTTIGIGLLFDTFVVRSLITPSIMTAMGRWFWWPKRVRVRPASQMLRSVGPRPLVRALLHQPRHAVPPPPTT

SEQ ID NO: 1432 - protein, 368 aa, Mycobacterium paratuberculosis
LLRSVGGRRKDAIDMSIDNESTASRQFVASAAAFSSKWTKGIRYWQAGYTAVFIAFVVFIAVKMLGTLKIVNLRTPHIGAAAVYALPIGLVVVGAAIGGYLWWRSRRTYLLTVAGDRLTIGRRRPEVYPLADAQLGLWVDNGVALHLHSGRRRFVLGGRDRRIGPGTPLAAPPVPLVDASLGAADFDELLALGGWSAARGPATGEPIRCLLFPNPLETQRMGSFALRKKQRLIRSLSQPQLLIDLDADSIRVIDPNNDAVMAMTWVARVTATPATYRLSAGHAVPSAQHIASDAVGQYFSTMPALRIDIAGMPPLTVGCRAFDGLKQRCSWSPDVPTTHEPPTYAVSAADWQSLIEKLGLAARLADTA

SEQ ID NO: 1433 - protein, 91 aa, Mycobacterium paratuberculosis
VTVIAAIGALATAAFLGYHVGRRAGSRRPTWAKRTSRPALGRLAITLIAMIAARRIQQRLRAERGRAATHASRLVAPLGILRAGVTRIRCY

SEQ ID NO: 1434 - protein, 246 aa, Mycobacterium paratuberculosis
MAALQDKVALVTGASSGLGAETAKLFSSQGATVFGIGRDTVRLAEVFAGIERGGFASVDIASPQACTEAVAQCVRDFGGLDVLVNVAGIHRMRRTESMTDEDWEHDLAVNLNGPFFLCRAALPELLERGGNIVNVSSIAGVEGQAYSAGYCAAKHGLIGLTRALAVEYTADRLRVNAVCPGGMLTPQIERFSAPDDPNYDLILRTAAPRGMMRPLDVANVIAFLASDAAAAVHGAVYRVDNGKGAG

SEQ ID NO: 1435 - protein, 211 aa, Mycobacterium paratuberculosis
MIGELTVRWAVTALFGASLAAYTYLAVSQRDRWSCAVNHLLHLAMSAAMILMVWRVGLGLPAVAPTLFFLLAGAWFVFLAVRASAESRERLKTCYYAAMMAAMAWMYALMSSGTTVAHAHGHSASDSVGANMPGMRLPEHPASPGAGGFSWVAAANWLGALGFAALAVYWLYRFVGQRRLARVPARLARMEPLYQAFTAAGTALMFDTLLW

SEQ ID NO: 1436 - protein, 438 aa, Mycobacterium paratuberculosis
LSTALGGKVLLPDSPQFAGAKQVFNTNYNGSTPAAVVTPTSAADVQKAMAFAAAHNLKVVPRSGGHSYTGASTANGTMVLDLRQLPGDANFDAATGQVTVTPATSLYTMHRTLAAVGRGVPTGTCPSVGAAGHALGGGMGAQSRHAGLLCDQLTSASVVLPSGQAVTASAASNPDLFWALRGGGGGNFGVTTSLTFATFPTKDVDAVNLNFPPQSFAQVLVGWQNWLRTADPNSWALADATVDAMGVHCRILATCPAGSGNSAAAAITQAVGIQPSGVETHTFNYMDLVNYLAVGNLNPQPLGYVGGSDVFPTVNAAVAQGIAAAVNAFPRNAGRMLAIMHALDGALATVAPAATAFPWRRQSALVQWYVETSGDPAAATNWLASAHQAVQQYSVGGYVNYLEANQSPARYFGPNLSRLSAVRQKYDPGRVMFSGLNY

SEQ ID NO: 1437 - protein, 225 aa, Mycobacterium paratuberculosis
VDDILAQATIFQGIDPEAVAALSRHLQHVSFPRRRTVFVEGEPGDDLYVIVSGAVKIRHQTADGRETVFAVLGPGDVFGELALFDPGPRTSTVITLTEVEALRMDRNALRTWIIERPEIAEQLLRVLARRLRHTNNTLCDLIFTDVPARVAKQILDLAMRFGTDSGGPVRVEHHLTQKELAQLVGSSRETVNKALADFAQRGWIRQQGKALIIDQPAKLARRARA

SEQ ID NO: 1438 - protein, 147 aa, Mycobacterium paratuberculosis
MVEPSTGAWPAQLPAVQVRFARPTAQLDRIVEFYRDVLHLPQLHSAGDDEWSVVMFGLPGDQYHLEFVAHRDGIDGTAPTRENLLVFYFESAAQQQSVAARCREAGAEEVVLDNPWWRRNGADAFLDPDGWTIVLMPRPVPLPAPTA

SEQ ID NO: 1439 - protein, 291 aa, Mycobacterium paratuberculosis
MPATPSWFTAALDQKPERCDVEVGGCRIRMRVWGAADQPPVVLVHGGGAHSGWWDHIAPFFSHTHRVIAPDLSGHGDSDPRDSYDLRIWAGEVMAAAAAAGPAGRPTIVGHSMGGWVVSTAAMHYSSKINSMLVIDSPLWERAPEEGRLRRRKHTEYRTRNEILARFTAVPSQELILPYVREHIAAESIRKTSAGWVWKFDPAIFGGEFLQPTPADEESLESMLTAMRCRVGYLRCEAGLVPPAMAERIRSLLQLRGPFVELAQAGHHPMLDQPLPLVATLRTLLEFWSIT

SEQ ID NO: 1440 - protein, 280 aa, Mycobacterium paratuberculosis
VLDIAPLRSLVAVADCGGFHRAAAALHLSQSAVSQHLRRIEAVVGEPIVQRSGRGVVFTEVGQKALRHARTILAAHDTALDDLGATENKVLTIGATEHGADVMLAGLSGALRDRLPDLRVRFRLDRNVSLADSIDRGLVDVAIMLDGAGLDRANASGLVRLQWVSARTLTIAPKGPLPLVIFSEPCTLREPAFAILDSHRIDYEIAAECGDLSGLYAAVRSGLGVALLPMIGKFPDGLGPAEGLPPANNASILVRGRTGIDAALLSTVDTAVRDLLATAT

SEQ ID NO: 1441 - protein, 310 aa, Mycobacterium paratuberculosis
MTRPRMPLTTASAVTFFYALGYPIGTLAVVAMTPMAALVLRFGLAAMVLAVWTVIAKAGWPRGARLGHVIVAGLLTQGVQFCCLYEAVQLGAPAVLCAVMIAMNPVATAILAATFLREPLGVQRTVALVLGVLAVLAACSQRLMSTHGVDPVIVLLFVALLGLSAGGVYQQRFCGGVDFRAMSALQNGVALLPAAGLAMLTPFGVHDGRKALVAVAAMVLLNATLAVSLYVRAINAHGAAAVAMLFAVIPAVAAALSWIILGQRPDQGVAAGLVLGGLACWINTRAASRPRTQRDGVPAAAPAELQSVSR

SEQ ID NO: 1442 - protein, 238 aa, Mycobacterium paratuberculosis
VHSDGGRAGSRPITALWAVLASGAVLCCPAPAHADTQLCDPSSVDSTQMCHYETPSPDVRMVFPANYPDEQTMIGYLTKVDNDFRNARSAGQTSTSPTALKVTGTRYSSGSQAAGTQSVVTEIYQNLGAAHPMVWYKSFNYNLASQQPVTFDALFRPGTQPLQEILPIVQKTLADRYRATVSIPPATGLDPANYQSFAITDDAIVFFFDQNALQPAMEATRVSVLRSAIAPLISPGIA

SEQ ID NO: 1443 - protein, 151 aa, Mycobacterium paratuberculosis
ATWGRLMTSGHNRSDEDAIRALIDRQEKAWAAGDPEGYASVFTMDADYVTFLGSHHKGRKAIAASYVPLFRKLLRNTRLEVDVTRVRFLTPDVALIHAHAAVVKTPRQRNRRNARVNTSVAVRTDNGWLLAASQNTTRRRVAEMLLAKLFS

SEQ ID NO: 1444 - protein, 192 aa, Mycobacterium paratuberculosis
MTLRMATSDDAAGVAAVYLPYVRDTAISFETQQPSVEEMRSRLTTTLATLPWLVITDGPRVKGYAYASPHRAREAYRWSVDVSLYLDASIHRQGQGRRLYTALLNLLGAQGYINAYAAITLPNAASVGLHEALAFRRVGVFPRVGFKQQRWWDVGWWHRRLADPPAVPEEPRPWTRLPAPTINSALAVHPAQ

SEQ ID NO: 1445 - protein, 212 aa, Mycobacterium paratuberculosis
LVRRFRVAAEGIADVEVAPTAADEPDVAEASPDQSEQTDKAAEGEGGPPRPRKRRRLKLVRAIAAGILAAVLATAGYEGWLLFEQHQKDVAAAQALDAAKKYILALTSVDTNAIDKNFAEVLDGSTGEFKDMYTKSGAQLRQTLIDNNAAAHGNVVDAAVRSATEDKVEVVLFVDQSVSNGAAPAPQLDRSRVKMTMEKVDGRWLASKVELP

SEQ ID NO: 1446 - protein, 227 aa, Mycobacterium paratuberculosis
MLMMICRICRCFDIRWPDDIVFLGEGGMFLTRLRRAGSGLAGAALAAAVVLSGHAHADPGQPPPPLPAFTPAPSDWSPNFDIWPYNTFTSRVTPEMISGMSDSCQWFKSQFDPLMGQINDFNTYLGDQHDDYAAAAVQRNADAVVGNIDRSTAFLTPRVKPLIITNQPDNFGPYSPVYGGESMTHLAFQLSRISDSIKRKDPSGVTHANIVSATGWANALRDSGACN

SEQ ID NO: 1447 - protein, 289 aa, Mycobacterium paratuberculosis
MTAQDERALDEDRAPDSVATIQEWSAGYVVRHPLASLNTLGEQYILAVRTVEYCVVDLFTGRFQWAEFVRQGAFMAATAVLPTVLVALPIGVTLSIQFALLANQVGATSLAGAASGLAVIRQAASLVAAVLTASAVGSAITADLGSRTMREETDAMEVMGVSVIRRLVVPRFAAAIMVGVALTGITCFVGFLASYLFNVYFQRGAPGSFVATFSSFATTEDMIVALLKAVIYGAIVAVIACQKGLFTKGGPAGVANSVNAAVVESILVLMIVNVGISELYNTLFPRTGL

SEQ ID NO: 1448 - protein, 175 aa, Mycobacterium paratuberculosis
MTASTYIPGLARPFVGAYRVAAAPTMRLGHMLVFFVRAVLAVPTVLRQYRTEFLRLLSNIAWGNGSIVVGGGTAGVAVVLGFTAGALVAVEGYNFLNLLGLGPATGIISSLVNTRELAPIMASLAFAMQAGCRFTAQLGAMRIAEEIDALESLAIIGNWRYWNRPNSGFGEISQY

SEQ ID NO: 1449 - protein, 94 aa, Mycobacterium paratuberculosis
VTSALESRRHPELVAADHGLVAGRRRFLSWALTDALDTGELSSKPTLPRLWRCCWQRCWGWHCRPAISISTWVPATSRTRSDSCCPLSRGDPRR

SEQ ID NO: 1450 - protein, 175 aa, Mycobacterium paratuberculosis
MFTFLKLIAGFRVTFSAMFKKPVTEGYPEKPGPVAPRYHGRHQLNRWPDGLEKCIGCELCAWACPADAIFVESADNTEAERFSPGERYGRVYQINYLRCIGCGFCIEACPTRALTMINDYEMADDNRADLIYGKDQLLAPLQPGMAAPPHPMAPGSTERDYYLLDNIAAANREAR

SEQ ID NO: 1451 - protein, 193 aa, Mycobacterium paratuberculosis
MPTTTATALVQKVACQAGKDYLIFPALSLRRWRRTLTANAAANLLRNVWAYVVICCGHLGEDTQKFAPDALNDESKSEWYLRQMLGTANFRAGPVLAFLSGNLCYQIEHHLFPDLPSNRYAQIAPQVRSICARFDLPYTTGPLARQYLGTVRTIFKLALPDRLPAPDADGMDAHKPDHLDDAHQTMKVGSTAI

SEQ ID NO: 1452 - protein, 195 aa, Mycobacterium paratuberculosis
MAITDAAEYAHLREADLEALGVALEAIRRDIENSRGEHDRTYIQRAIAFQRGLDLAARLVIAASRSGPGWALGTAALATAKSIENMELGHNICHGQWDWMNDPEIHSSTWEWDMVGVSSQWRYAHNYRHRLGAESGVPGRQGLSDLSRAESSAMAPHAHRERGRQPAAKCVGLRGDLLRTPRRGHTEVRARRTER

SEQ ID NO: 1453 - protein, 257 aa, Mycobacterium paratuberculosis
MTQPPAGLASSAPESRNNEADGESRPITRAAVLASALEIIDRDGVDGLSMRRLGEAVGRDPMALYRHVPNKAAVLDGVVEMVFERLSLDTTTPDWAAALRKLGHEFRDLARAHPNVVPLLVTRPLATPLGMRPPGILRHLEEVLTLLIGAGFTGEDALHVYRALFGFLYGHVLTELQEIVERPEETDHVLRLGLHRLPIDQFGHLRELAPVWASYDPLAELDRGLDILLSGLAVRLTIPGAAPADTTEPQQGDHERT

SEQ ID NO: 1454 - protein, 57 aa, Mycobacterium paratuberculosis
MRVAAKIAHKFEAAKGSAKKVFGRATGNTGMRAEGRAGQVKGNAKQAGDKLNDAFKH

SEQ ID NO: 1455 - protein, 165 aa, Mycobacterium paratuberculosis
LTLSTMPRTVGIEEEFHLVDLTTRRLAPRAPELLGLLSDGYVAELQSCVVETNGSVVSTLAELRADLTERRRVLVDTAATLGLGVVAAGAVPLSVPSEMHVTQTSRYQQILADYQLLAREQLICGTQIHVGIDDRDECPGGRSGSRLCSHSACLEREFAVLVRRI

SEQ ID NO: 1456 - protein, 244 aa, Mycobacterium paratuberculosis
VAGRVAAYVPTLLALSASSPFWSDGSDTGYSSVRTLVWQRWPTTGLAPPATSAAEYDTLISNLIATGVITDAGMSYFDVRPALRTPTLELRVCDSCPRADTIVLITALFRALVEREIQGLRTGVPAAIVVPPLGRAALWRAARSGLEGDLVDLIHPASRPAGDVVTDLVQMLRPQLEASGDWQAVEGLARKALTQGSSAARQRRAMRTRNDLFDVVDHLIAETAAVAPGAHGTLATRRNGSDGG

SEQ ID NO: 1457 - protein, 167 aa, Mycobacterium paratuberculosis
VPARTPRLRLKPKAPQSGYVDGAWWPRSDDLSAELPDLLAVLSVRLGRIDRVLYHLNAWADAPRKLATGGRAVRLDGYRLQPINTIEVLGLEGDRLTLLVIPPDTDANDAHRTMMTAAQPRNAATVDGLLTISQRDRDSRTQASTAQERWESEGGTTASPRPAQLPG

SEQ ID NO: 1458 - protein, 183 aa, Mycobacterium paratuberculosis
MTLRAVENPQRKQGPFRTPRFRLKPTAPQSGYVDGAWWPRSDDLSAELPDLLAVLSVRLGRIERVLYRLSDWRSAPRKLDAGGGPVKLDGYERQPISTVSLLGSGFRRLDLLVVAVCADASDAHATMMRAAHPSDETCVDRLLGIQPRVRISLDRAGVAQQRWASGISKPRSAFPNSHPGEGF

SEQ ID NO: 1459 - protein, 411 aa, Mycobacterium paratuberculosis
MALDQSALLEVLDALRNADAADRIKQAAETIYQALIDAELTAVIGAGPHERSASRTNQRNGSRPRTLSTIAGDLELRIPKLRSGSFFPALLERRRRVDQCLFAVVMEAYLHGTSTRKVDDLVKALGADAGISKSEVSRICADLDTEVGAFRDRPLSEQHFPYVFLDATYCKARVNHRVVSQAVVIATGVAADGRREVLGFDVGDSEDGAFWTAFLRSLKTRGLSGVQLVISDAHTGLRSAIEAILIGASWQRCRVHFLRNVLAQVPKGSAEMVAAAIRTIFAQPDAEHVREQLDTIAGMLGRQLPKVETMLREAADDITAFADFPVLHWKKIWSTNPLERLNKEIKRRTDVVGVFPNPAALLRLAGSVLVEAHDEWQVAEKRYLSETTLALLHPRSDSADQSVAVPAAITA

SEQ ID NO: 1460 - protein, 958 aa, Mycobacterium paratuberculosis
LERDTNDRRLPLASAQADGRTRTVQHDSVAATAGRTRGAAVGQPGLPARDRETGTVEPAHPGGTGGHFEVCDGRVDRDRARHSCLGEEGRGRTGAQQTGQDAGTWWPPPRPGQDRRRGFLGRRMRGNRSEFVTVIVTAVGAIEPHLSHDDVRTAIEGMGLSAAQLQRLSRTLRRDGSVLTGPGGSDCAADIEQLILCLRQLGAMRVRAPRCAQCGRNDSETYSRKLKKRICRACSMQGWQPAVGECPGCGAVDKLIYRPRHGDGLLCRRCKPEPDVDHAAKVRDGIAQLRTGLSATEIDRVASVFGTAVAQRELNWILQDTPGVFRGEIAHRSAVSVRLAELLVAAGADNVRLPQCPLCLRTVKLGSQIDGLRCCHTCWGHHFSRGTCARCGCQRHLINYHGAGERLCHRCFEHDPVNHEPCTRCGRVDFINHHDGQAKLCRRCYPAPTAVCSSCGRTRPCTRTRTGKPICGTCSAKQRPPQPCSVCGNIRSVHTRTDAGEPVCNPCARSREPCARCGKTLGVSARLAGVGPLCSACLQREPAYFTDCVQCGAHGRTYHRGLCPACACPGELRELFAKNGELSGAASRIVEALLQCDAMPVLRWVRRMRSNSELPAQLAELGDTLSHHDLDDLPASKSVEWLRNILVTAEGLPDRDPYLHRTEQYIAARLATISNRDDRAAVRAFTEWNHLRKLRARADKGPLKRNHGLAAQIMAAAITDFVSELNAHGLALASCQQAFVDDWLVRNPTRRQIHQFLAWAVHRGYAHDVAAPVPQTRRTRHTLPGDDERWRLIQYLIEHPDLETRDRVAGLLVLLYSQPAARLVTLKVADVTITDDAVQLTLGAVPLTVPSPVDRLLADLVQQRRGYAAVTVGTNPWLFPGGRSGGHLSANQVGLRLKRIGISPRIARNTALIDLAGELPAVVLAKLLGFSIKRAVTWSEEAGNTRPRYAAEVARRNS

SEQ ID NO: 1461 - protein, 343 aa, Mycobacterium paratuberculosis
MVRAMLSGWAKQQLGGRLCAENTVKVRASCVGEFIEFSGAYPWEWTARMMDEWSAHLVGSLSRAKSTIRQKQGAVRLFCSFITSPFYDWPAQCELWFGDHPTQICHEWNTSAHLVDYEGDPGRRPFTRKELQDFLDCADAQVEKARRSRRKGTLAAYRDTTMFKVMYGWGLRISELCRLDLADMYRNPHAPELGQCGFLHVRYGKASRGSPPKRRTVPTLMPWAAEALLDYVNNIRPLYEPGQKQALWLTERRSQVKVRTLTGTFDDIRDEVGLDRKLTPHCFRHSFISHMTEDGVDPRFLQEISGHRFASTTGIYTHVTGEFMNKMLTDALGRVSSFGEGHQ

SEQ ID NO: 1462 - protein, 119 aa, Mycobacterium paratuberculosis
MASVIAVIPLYIACLAVTYLTCQVVANIISGGSIGPYLHYFTMMLSAKDIAYSVLKCVVFVWLSSTVQCYYGFYAAGGPEGVGVAAGHAMRASITVVIMVNMLLTMALWSIDAGARFGG

SEQ ID NO: 1463 - protein, 507 aa, Mycobacterium paratuberculosis
LLALGATVLLIAGLITGGLLLKSTGRLNDYVRVVAELTNVGDGLPARSDVKYHGLLVGAVDNVIPAAYGKPNYVHINLKPEYAQDIPSAVTARVVPSNVFAVSSVQLVDGAPGPSIRNGARIPEDLQLSTVIFQTTISKLRDILAATGRGREDHTVGILAAVAAATNNRRGPLLTAGAQLTRVLDELNAIVATDPGPSTVSALLDATRGLQSTAPDLVDVLHDAVRPMQTLVEKREQFRSLVTGSYHTFSVNRQAFDNHTDQLIEMTQNLTPVLGFFAMNSDKFVPIFTRLNRLSDKFFQEVWDPELDTGNMRVNLALTPTYTYTRADCPRYGQLQGPSCFTAPTIAVRPDLPEVLLPQNYHPPTDLAPPPGTQIGPDGNLVATGPPLYNPNPSLADPNPPLPWWPWQIGPAPRVPGTADPDDAPPPPPPSPAPPGPPPSPAPPGAVAPAAYGGNVGPVGSQRERDQLGLITGQGRPASVATQLLLGPVARGSAVSLQPRAATGGPT

SEQ ID NO: 1464 - protein, 359 aa, Mycobacterium paratuberculosis
MRVRGPLIGLSLFMAIAIAVTWMVYATLRRDVAGPTTPYAAMFTDVYGLRVGDDVRMAGVRVGRVEKVELAGKLAKVSFIVENDQRLYGNTVASVTYQNIIGQRYLGLSLGETGSRTTLSAGSVIPVQQTDPSFDVGKLLNGFEPLFTLLNPKDADDLTKGVLQSLQGDQASIPLLVEQTSTITKTLSARDQSLGDLISSLTRVTDTVARQNDDLDQALNQTRDAVANFDDRRAALQDDVGSIARVTRRLSAIADDVDPSLNELITREPGFSKHLVGIEPQLAFTGDNLPLLLKGFARAVSEGSYGNAYACDLNATGFFPGLNDITTFIVNAATPGNAYPITTKNLGWHTPRCRNMANG

SEQ ID NO: 1465 - protein, 348 aa, Mycobacterium paratuberculosis
MADTRKLRWLRRRPLESYNRTWLGLAGLVVVAVLVAVSLGIKLLGVGYTHYTAEFLQAATLRPGNPITVAGIEVGHVTSMKLAGDHVEAGLSVRDNVPLGKDTRAVIKVMTILGSRYLELVPDGPGSLPANTIPLAHTEVPYDLQSLLEDATTTFEQVDSDQFAQSLAVLGKQLGGVPPLVPQAVANLQTLSTITADRRGQLGALLKSTQRVVNTLRNQQSNIGHLMDQGQDLLGHLVARQATFHAMFAALTELVDQLDKIVVNNRPMLDELFANLHQLTNMVGQHDDLVRNILQVAPVTLRGLTNATGYGPVVEFNLPNGLAIDSWMCAISGRAKEFNMIQYFKDCK

SEQ ID NO: 1466 - protein, 371 aa, Mycobacterium paratuberculosis
MTSRRRKLIALAAAAAALAAVAIGVVGHYVKARLDTMTVTAQFDSAAGLYEGNVVAVLGMPVGKVSKVTSKGSYVEAELTVDKKVKIPAAVRAVTISTSILTDRQVELTPPYRGGPVLKNHDTIGLTRTKTPVAFDRVLDMLDKVSKSLKGDGKGGGPIADVSDAAVAITDGNGKKILAALDELSKALRLSSERGVTTREQLTTIITDLSSITEAAARNDAKVREFGSTTRQLSQILADEKFGTGATGRTINRILEEVTTLMENNRDNLKQAVRNGDTAAKTLVDDQRGVAELLDVLPLTLENLYNTVDQNNGAIRVHGLLDKALTDSQSAKELCNLMHLRQLGCSTGTLQDYGPDFGLTYILDGLSAMGQ

SEQ ID NO: 1467 - protein, 410 aa, Mycobacterium paratuberculosis
MKAGKRKALAVACSAVMASSGCATNGLASLPLPAPGIGSGGYLLNAVFSNALNLPAHAKVKLAGADVGQLESMVARNYTAVTTLRIMDGVRVPVGSTAELRSATPLGDVFVAIKPPVPADPSAPLLKAGDTIGLPATRAAATVESVLSSAALLVNGGAVRNFTNIVNGAGKATGDQGRAFGDLINRTNSLLTKLNARSDQIDAAVTETAALADRLDAKNQAITDVLRAVGPATDVLSGNADEIADVVDELGATTRQLSKFPSIAGTDKTGRSVIKDANAIAAAWNDVVLSPDTSLAGLNRLIPPFVKATPSQAISVRGSFDRLVLGSRPGTGAETGGFKGDPAFHGPMRRDWNYLIGSIKYVLWRLQERVVGRGPQTPMGQSPWTPSGPPLPPAPAGQAPPDPMVPEPPR

SEQ ID NO: 1468 - protein, 416 aa, Mycobacterium paratuberculosis
VIDTLGRLVVGVVKAGHRQRTWLSGLALLVALVVGAAYLALGALRVNPLESTYQVTIRLPESGGLLANQDVSVRGIRVGRIRSLRPIPSGVEVVANINAHTRIPASSPVRVSGLSPAGEQYIDFEPTSNTGPFLSDGSVIGPQHTTTPIPLSQVLADADGLLAQTDPKKLEIVKRELSLSNQGPQKLTDIIDGSTFLLSTMDPVLPQTVSMLKTSRVALTTLSDKNAGLSVAARNVGDLMAGVNKMDRGYRRLVDQTPHALSTVDNLFDDNSDTMVGLLANLVTTARVVYLRVPALNAVFPNYRGSTLEALMTTMHEHGLWATADIYPRYTCDYGTPRRPSSSADYPEPFLYTYCRDDDPQVLVRGAKNAPRPGGDDTAGPPPGADLGQTTDPTPKGRFTIPTPYGGPVLPIEPPH

SEQ ID NO: 1469 - protein, 198 aa, Mycobacterium paratuberculosis
VTVTADQERATADDVEQPPDDDRKTTADRTESQPKTAARQWKRYGRAALVVAVYAGAFGLAAGLGWKLWDQRAVAQAGQAAQRTAVDYAQVLTSIDANQVDQNFAAVLGGATGEFKDTYTKASAQLRQLLIDNKATAHGTVVDSAIQSQSRNRVVVLLMVDQTVSNTVRPDGRVDRSRMKITMENVGGRWLASKVELP

SEQ ID NO: 1470 - protein, 261 aa, Mycobacterium paratuberculosis
MRIFQFSAGAAAVTMAALTAPVASASAQSFCGDLGGDWDGQYCHTSVLSERKAVRDIKMAMPGDLIDNPTSGPPIRQYLRTLMTNWRSKGASMVQDSWGEENFQVFGHGPAQSVVFHEDYHADGPAFNNAYRTFTFDMANGRQLQLADITKPGVDPLAAIPPLAEPFIQEALDRAAWQHSPGTYPFTVDRWTPDKVFSGGYKAWALTPDELILYLPDYPVGHDSPIQYGQSEQWSMDGGTAQPHIPLGVLAPVLRPEFGGA

SEQ ID NO: 1471 - protein, 448 aa, Mycobacterium paratuberculosis
VRSVHRLRPAGRPPIARSAAAAATVICMPSASRASADPVKRRPKDRKVQIARAATDAFSELGYHAVSMENIAARVGISAAALYRHSQGKYDLFREVFLALGQQLVDATAFADDLPADADPGETLSALTTALIDTTIVNRTAGGLYRWEGRYLRGDDQRKLAEQIKVINRRLQRPLIKLRPKLTSRQRWILSAATLSVIGSITDHRSRLGNAEIRATLSDIAAAVLKAELPTQRGRGAEPARAPTLTSAAGSYELLLHESMRLFNERGYRETGMEDIAAAVGIPVASIYQYFPGKAAILAVYYRRAADQLSADLSSILATSSDPEQALARLIEAYVTRSFANPELACVYYTERHNLPETDAVLLYNIQRSTVESWARLAVAARPELTLGRARYAVHAAFALAVDIGRLVYPNTGAPASTTVRRLMEVTVLGRPAAASRDGLRGAGRQRR

SEQ ID NO: 1472 - protein, 74 aa, Mycobacterium paratuberculosis
MLSTIRKVLDYQLTIAELLGLGILLGTPYLIVGVIWSSTHTAHLHDMHGVDLVVSFLGSIVSWPVLLFANVCMT

SEQ ID NO: 1473 - protein, 122 aa, Mycobacterium paratuberculosis
VHDLGGGVMHRGPLIVFAAVVCLAGGLLALRFPVFIDAYDQFGLQVKCGSGFTTELTQAASVVGPAGTNYVDQCGSALMVRRLWAIPTAVLGGMALTWQAAAALAHDHRRPAPSQSAAQSPS

SEQ ID NO: 1474 - protein, 262 aa, Mycobacterium paratuberculosis
MTGRAALADVDLLIGIDDTDNPYTPGTGRRARALLHELRAAGLGSPAGATRHQLLVDDRIPYTSHNSSACLAWRSPDGDPHAARTGIIELAGRFLERVCPPDADPGLAVVVPGELAGAAPRLIEFGRRAKREVLHPNEGRELAAAVGVHLSGHGGTREGMTGALAAVGLHLSGNDGLFITLPGIRELPDRATVETVFATAPIDLVRDAMYRQPRSGEVIELGDWVRPVLLDGLAVLLLEPPRQQNNGGRTWRTAPRAVVKQY

SEQ ID NO: 1475 - protein, 140 aa, Mycobacterium paratuberculosis
MRRNRRVARVVAVLVVSAGLVACGGSGGLQLVVQENQHVLQRFTISQLQQLPQVEVETPQSHGAQIQKGPSVRSILNAAGATGVVRVRVEGRDPAQSLTAAELDDRTILGFTKRDTLKLTGAKLGRDQWVRDVTDLVINP

SEQ ID NO: 1476 - protein, 186 aa, Mycobacterium paratuberculosis
MTVMQRPAGGLTGVREVAFPLLAVGIIVACTDVRIPLALPGHRGLVWLTMLAAVALVTARRETVLAVGAASSIAALPVHGLTDPLWSSRYVAAAVLLYAVASLPAVRTRRWILAVAAAPVHLVALASSVLTWHSGANLSAWASHGMLERGGWHLVFGFVAGLLAWVVALGLGRPPSVRVGAYGSRY

SEQ ID NO: 1477 - protein, 101 aa, Mycobacterium paratuberculosis
MTLRVIPEGLAATSAAVDAITAQLAAVHAAAAPVVSVVVPPAADPVSLAAAAVFSERGSQHSAAATKGVEVLGRAGLGVSLAGVNYVAGDAASASTYLSAG

SEQ ID NO: 1478 - protein, 301 aa, Mycobacterium paratuberculosis
MTAPVWMALPPEVHSTLLSSGPGPGPLLAAAATWTGLSTQYDSAATELTAVLTGSMPVWDGPTADRYVAAHMPYLAWLQLAGALSAEAAAQHQGVATAYTAALAAMPTLPELAAMPTLPELAANHATHAALVATNFFGVNTIPIAVNEADYARMWTQAATTMTTYQATTEAVQMSSVAGSGTGGRPAAAAGPERERARGPERAPALGPEPAPVREPEVAPAVGPAPAAAAVRVPFSCPPQKRSGRCCSGPTVSRSPVRASRTGARRSTCRISGISSTATLRPWPGSSRTFRACSTRPSSRR

SEQ ID NO: 1479 - protein, 236 aa, Mycobacterium paratuberculosis
LPLLLQVGLSLSITSLGGMAGLAGLAGLAGLAAPASAPAPAAMPQPAAMGAQPPVVSAAPAMAPMAPTSPVAPATSAASTPAPVASAIAPPATPPVPPAPVTGAEGFGYMVGSFGLGMDSKAQTRARSALAAGRPAASSAGAAAVEQEQGRTRRRPRSVIDPGYRYEFIEGDDEVVAVASAAQDRYRPSDSGGSIQGFAGTLPKSGVRASGLNTLAGNESGDGARIPMLPESWEGP

SEQ ID NO: 1480 - protein, 231 aa, Mycobacterium paratuberculosis
VGMSQPTHEMFEAAYRGESPEMGEGARPPWSIGEPQPEIAALIEAGKFHGDVLDAGCGEAAVSLYLAERGFTTVGLDQSPTAIKLAREKAARRGLTSASFEVADISDFTGYDGRFGTIVDSTLFHSMPVELREGYQRSIVRAAAPGASYFVLVFDRNAMPAEGPVNAVTEDELREVVGKYWVIDEIRPARIHANVPENFLAGFEAFAGADIRDEDNGRKSVGAWLLSAHLG

SEQ ID NO: 1481 - protein, 140 aa, Mycobacterium paratuberculosis
MADDIELSPTDWVREQTERILRQGTTDGVEVFDRPVVLVTMTGAKSGKRRYVPLMRVEHDGRYAVVASKGGAPEHPAWYFNLKAHPEVTLQDGDKVVTLRARELAGAEREQWWRRAVQAYPPYAEYQTKTARQIPVFVLE

SEQ ID NO: 1482 - protein, 521 aa, Mycobacterium paratuberculosis
LTNSGEGPMQRAGSPERQGVSTSRSERLREVLRYDLPASLVVFLVALPLSLGIAIASDAPVLAGLIAAIVGGIVGGWLGGSPLQVSGPAAGLTVVVADVVAEFGWGVTCFITVVAGVLQVLLGFSRIARAALAISPVVVHAMLAGIGITIALQQVHVLLGGSSKSSAWSNVTGLPAQILGAHRPGLVLGLLVIAILVAWRWVPARLAIVPGPLVAIVVVTIISMVLPFKVSRIELDGSVLDAVRLPSLPHGNWGAVAIAVITVTLITSVQSLLTAVSIDRMHTGPRTDFNRELIGQGAANIASGALGGLPIAGVIVRSSANVNAGAKTRASTIMHGFWVLVFAVPFAGLVEKIPTAALAGLLIVIGIELLKPAHIETALRNGDLAIYLVTVTSVIFLNLLHGVLIGLLLAVVVTGWRVVRARIEAEPVGDGWHVVIEGACTFLALPRLTGVLASIPERTSVTVHLLTNYLDHAAHQAIGDWQRRHCATGGTVEVRDTAEPAARRRNSHLSLVEQVSSPGGA

SEQ ID NO: 1483 - protein, 285 aa, Mycobacterium paratuberculosis
MRIGVVFPQTEIGSDPAVLRSYAQRVEELGFTHILAYDHVVGADPRVHRGWRGPYDIDSTFHEPFVLFGYLAAITSLELVTGVIILPQRQSVLVAKQAAEVDLLTGGRFRLGIGLGWNAVEYEALGETFTNRGKRSEEQVELMRRLWTERSVTFDGKYHTVTAAGLAPLPVQRPIPVWFGAASDRAFERAGRLGDGWFPMTEPGPGLDHALEQVTRAAEAAGRDPTSIGMEGRVSWTDDRDKLAGDIAAWKAAGATHLSVNTMKAGFAGVDDHLAALERVAADLR

SEQ ID NO: 1484 - protein, 276 aa, Mycobacterium paratuberculosis
MRIRGSTASRRDSFPHRRVGDDGGVAVTKLSGVFRVGELEPAFAEELAARYDVPRLPDGAARDRFLAEHAAEVRALLTWGRPGVDAALIAALPNLEVIVNNGAGVDLIDTAAADRRGIGVSNTPDVLSDTVADTALGLILMTLRRLGAADRYVRAGRWAREGPFPYGRDVSGLQVGILGLGRIGSAIATRLRGFDCAIAYHNRRRIDGSPYRYAASAVELAESVDVLGGRHHRRPPGPQTRRPRRAARPGPRGLPDQHRPGQRRRPGGAGGDAGRR

SEQ ID NO: 1485 - protein, 200 aa, Mycobacterium paratuberculosis
MCGPGGGRARGRSRTAGTSAGSRSASWAWGASARRSLPGCADSTAPSPITTAAASTAPRIAMPPPPSSSPNRSTCWVVATTGDHQAHKLVDRAVLRALGPEGYLINIARGSVVDQEALVEMLAGGELAGAGLDVFADEPHVPAELVGLDNVVLLPHVGSATARTRRAMASLALRNLDSYLATGQLVTPVLRPRRRIPDRN

SEQ ID NO: 1486 - protein, 152 aa, Mycobacterium paratuberculosis
MSPLPSQTATPVRLTLAGSARPDTVTAWRRALHRWLQHEVRAPDDVRDDVVLGVNEALANCVEHAYRSHRGTGAMKLQASYDPGAESIRVCVSDRGRWQSPSCRLSSDPRASRGIMLMHNLAEHCTIHARPDGTSVYLDYALDPNPVGAQRV

SEQ ID NO: 1487 - protein, 451 aa, Mycobacterium paratuberculosis
MEPISPTDALFLIGESREHPMHVGSLQLFEPPPDAGPHFVRESYQAMLECTDVQPTFRKHPAFFGGVTNLAWSVDKEIELDYHLRRSALPEPGRVRDLLELASRLHGSLLDRHRPLWEAHLVEGLQDGRYAVYTKYHHSLMDGVSALRLVQRAFTPDPDDDEVRVPWSLAPRQRGSRRRPSLLERAARIAGSALALAPSTLKLARAALLEQQLTLPFQAPRSMFNVRIGGARRVAAQSWPLERINAVKAATGATVNDVILAMSSGALRAYLLDQNALPDAPLTAMVPVNLRKPDDDRGGNLVGTFLCNLATDLDDPAKRLEIISASIRDTKEVFWQLPPVQQLALSAFNIGGLFFGLIPGYLSTASPPFNIVISNVSTGRSERLYWRGARLDGNYPLSIPLDGQAVNITVTNNADNLDFGLVGCRRSVPHLQRMLGHLEASLKELELAAGV

SEQ ID NO: 1488 - protein, 211 aa, Mycobacterium paratuberculosis
MRSGFHRRLCLLNARLAEMCAMAADAIAQATHALLDADLLTAEGVITRQHSIAALGLQAEETAFALLALQAPVATDLRAVVSALRIAADAQRMVELAVHVAEIARRRHPDSAVPAEVRPIIAAMGEAAEALAAGAREVLLSQDPRRAAQIRRDDDTMDELHRRLLSVLMDPAWTPGVAAAVDATLLGRFYERFADHAVEIARRVIFQATGR

SEQ ID NO: 1489 - protein, 502 aa, Mycobacterium paratuberculosis
VSPEVAERLRPGPVAARSPLLAHPRWFVPGKFRVSHQSMGIRRRRRKWARKEIRVADPAMRQTIMGTAIGNFMEWYDFGVYGYIATTLAEVFYPGKSVSGLHLIATFSTLAAAFVVRPLGGFIFGPLGDRIGRHRVLVVTILMMTVSTTTTGLLPTYSSIGIWAPILLVIARIFQGLSTGGEYVGAMTYLVEQAPDHKRGMMVGFLPMGNLVGFVLAGMLVTGLQTWLPDQDMLSYGWRIPLLLGLPFGLVALYLRLRLEESSAYQSANDSPHTPGGQGRQQIRRTVAQQWRPMLICAALVLTSQVADFMLTGYLPTYLRLFVRVGHTAGLVMIVTTLAILMATVVAVASLSDRIGVKPIMWTGCALLIGASVPAFLLIRFGGVYPVIFIGVLLIGLMELCFDSTGPAMLPALFPTNVRYGALAISYNISISLVGGVTPLIAQALVSATGNVMVPAYMLIFGGAVGAVTLLFTPEVAGKPLPGSGPAVETEREARALADDVR

SEQ ID NO: 1490 - protein, 186 aa, Mycobacterium paratuberculosis
MLILADHDWFREQFARLDYLQAQAADDRDALQRVWRPLADKLDVHAYIEEKIFYPQLLKRGSADAEGETLDAIGDHNDIRDGVRAANAAQPGTEQWWAAVGRTREANDDHMAEEEREGLSDFRRTAPIGLREALGRQYAEFMAEHPTTEGLPIIDRDPAGYVQQLQDAQPPKPADFSLRIGSLKGQ

SEQ ID NO: 1491 - protein, 294 aa, Mycobacterium paratuberculosis
LSENTGDAVNLQPHFDDVQAHYDLSDEFFALFLDPTRTYSCAYFERDDMTLEEAQIAKVDLSLGKLGLQPGMTLLDIGCGWGTTIVRALERYDVNVVGLTLSRNQQAHVQRRLDNHPSPRSKRVLLQGWEQFDEKVDRIVSIGAFEHFGRDRYDDFFKMAYAALPDDGVMLLHTIIKPSDEEFAERGLPITMTKLRFMKFIMDEIFPGGDLPQAKGVIEHAQRAGFGVQRVQALRPHYARTLDTWAAALRARRDEAIAIQSEEVYDRYMKYLTGCADLFREGYTDVAQFTLTKG

SEQ ID NO: 1492 - protein, 140 aa, Mycobacterium paratuberculosis
LAESSCATGVSITLIADPATGGAMSEHEAKMIILSTDDLDESIRFYSETLGMPLKFRDGAHFAALDAGPVTLALATAVDHPIPGQVVVGIKTADVDGAARAVEASGGGIVKGPYDDAHERRAVVYDNKGNGLVFYKPLGR

SEQ ID NO: 1493 - protein, 88 aa, Mycobacterium paratuberculosis
MSGRPLPGGVVHKLPADLRESLIGNATALAAWNDITPLARNEFICWVEDAKQQATRERRIRRTVEELEEGKRRPCCWPGCKHRERTGK

SEQ ID NO: 1494 - protein, 297 aa, Mycobacterium paratuberculosis
MRRQPLLARRFFDRYEPVHAVTYFAPEARAALDALGYRGFWMGYFAARSAPLGAVPREVVAAIFYNFAPERVAKALPAAWEIAGPQAALRARQESAVAALGRYGLHPDENVAVAAELAAKAARGAPLDGRPLFAANLALPWPEDPLAALWHATTLLREQRGDAHVAVLAAAGISGRESNVLHAAAGNVSRDYIARTRDYDEASWRRHEQRLAERGLLDGDGALTAAGRQCKDHIEATTDALALSALSALTDDEVETLFEALTPITRAVIAGGDIPAATPMTLRRDELHDDSAHLVAR

SEQ ID NO: 1495 - protein, 211 aa, Mycobacterium paratuberculosis
VWLYDRPVSLRDAVLAALLEGESSGYDLAKDFDASVANFWPATPQQLYRELDRLAGQGLIRARVVHQQRRPNKRMFSLTAAGRAAIRRFTATAPRPSVIRDELLIKVQAADAGDMRAVRDAIRERRDWATAKLARYQRLRARLLDGRSEEDYLARAERIGPYLTLIRGISFEEDNIRWAEHALAVIARRLPTTDADSDAGDSRLVGPATNG

SEQ ID NO: 1496 - protein, 140 aa, Mycobacterium paratuberculosis
MHPFRRAVEERDEQAIQALLADTVVFTSPVAFKPYVGKPITAAILRGVMRIFEDFRYLREIGDPGGRDHALVFETGIAGAPGIRITGCDFLHCDDDGLIDDFMVMVRPLSGATALSEAMGAQFARIQQEAVELANRFGTA

SEQ ID NO: 1497 - protein, 347 aa, Mycobacterium paratuberculosis
VTMRIGLSINYAGGFKDVAAEVADLENAGLDIVFVPEAYSFDAVSALGYLAASTQRVELASGILQLYTRTPTLTAMTAAGLDYVSDGRFTLGLGASGPQVIEGFHGVPYDAPIGRTREVIEICRQVWRREPVQHRGKHYTIPLPADRGTGLGKPLKLINSPVRERIPILVAALGPKNVEMAAEIAEGWQPIFYLPEKARDVWGESLAAGRAKRAAELGELEIYAGPVLAIGENVEPLREFVKPHLALYIGGMGAKGKNFYHALATKYGYGPQADRIQELYLAGDKDGAAKVVPDDLVRDVNLIGSREFVKERVAAFREAGVTTLNVAPMASTPAERVKLIEALRQLV

SEQ ID NO: 1498 - protein, 405 aa, Mycobacterium paratuberculosis
VMSSNVRAARNRPGRTDPQPPTGAPLFVGVLGLLLATGWVANHFVGLMPAISDRDHLATTTLDGIFGIYALGLLPGLLVGGRTSDALGRRPVALTGSAAALVGTVAMLLSQHSPALFAGRLIVGLGVGLAISAGTAWASDLRGPAGAATAGAVLTAGFAVGPFAGGVRAWAGPSGVRASFALAAAILALAAFAVVAAPQPSPVTAPADPDGEETADAAPQGISRALSWAMPLAPWVFASATLGFVTIPGRLHTALAAPVAAGTATLIVNGVSGAVQVLARALRWGPQAGTAGAVLAALGYAVAAAAPPTLTPALGVPLFVVLGCASGLCLREGLIDLGGRRAATPARRPDGLFYVVTYIGFGLPLILASVRPGVATAILSGMAVLAMTAAVGRAARLRRDDHRQN

SEQ ID NO: 1499 - protein, 105 aa, Mycobacterium paratuberculosis
VYRYHYSSRGRQMMKYIAAAAIALSVLLSSACSASQVINTGGDTKCKDFTTQDEKKQNDEVSKMLKDKSGTDPSNVEISATRLSAMTYCQTVGKPDTKISEAPHG

SEQ ID NO: 1500 - protein, 262 aa, Mycobacterium paratuberculosis
VVSTNPAPARVTLRHVDRTFGTHTVLRDVDVEIEPGAVVALLGASGSGKSTLLRLVAGLDRPSGGRIEIDGKAVRGIDPRCAVVFQEPRLLPWRSLAANVAFGLPRGIERSERLAAVQRWLDVVGLREFAGHYPRQVSGGMAQRAGLARALARQPSVLLLDEPLAALDALTRLRMQDLLDAVQQRAGTTTILVTHDVEEAVLLADRVLILRGEEGGAATHDVAIPKPRDRGDPRIAALREQLLEEVGVPRRGYAVEQEAKTS

SEQ ID NO: 1501 - protein, 321 aa, Mycobacterium paratuberculosis
VRPRHLTALAVVAAVTAVSGCGSSSGTTTTKDLHLDYAYYNPLSLVIRDQQLLEKKGYHVTWVLSQGSNKANEGLRSKALDFGSTGGSPALLARANGTPIKTVDVYARGEWTALVVAKNSPINAVADLKGKKVAVTKGTDPYFFLLQSLATAGLSPADIEIVNLQHADGKTALERGDVDAWSGLDPFMAETIQQQGSRIIYRNPDFNSGGVLNAREDFITAHPDSVQLVVDTYEEARKWAKTHPAELAALLASQATVSQSVAQEELGRTALDIDPVPGDWLRAVLTRIEPLAVADGDIKSDDAGRNALNTLIEPKYARQAR

SEQ ID NO: 1502 - protein, 233 aa, Mycobacterium paratuberculosis
VAWQLATAVTGFFAPSQLPPPGDVVAALSDLARHGELWTHLRASGWRVLAGYASGAAAGLALGSLVGLSATARRLLAPTVAAFRTVPSLAWVPLLLLWFGIDETPKILMVAIGAFFPVYTTTASALSHIDAHLVEVGRAYGRHGVSLLTAVLLPAAAPELVNGLRLGLANAWLFVVAAELIASSKGLGFLLIDSQNSGRTDVMLLAIVLLAGLGKLSDAALGAVETRIARRRG

SEQ ID NO: 1503 - protein, 389 aa, Mycobacterium paratuberculosis
VTAHRGWRCRGDRRAGRRRCRRRGAGRRAARRHHVARPRRGRAGPGPRSGGAGARRSAVRGARGAARRVLLLMIVVIGAGVCGLAAAHELSRRGHDDVVVLEKGQPFGEQSAGLARIFRIAHRRESLCRLAFAARAGWQRWEAEFGVGRLLGSEGFIAAGAAADGVAQAMERAGAAFSRLDRDGIAERIPFADVPWETGIFDPLGGSLRIRRALTTLARRVVIRRGEVVSVADNGSTVLADGTVLRADRVLICAGVATPKLFGPLGVDFVPHTRFTYRGADATGAACLSAPEGYGLPLGGTGRWAFGQEVADPATVRALFPSLVAVDRVDCVSVRAPWLDSGGDGWTVARRGRVLAFVGANLMKFGPLLGELLARAALSDDIPAELLLD

SEQ ID NO: 1504 - protein, 61 aa, Mycobacterium paratuberculosis
VTDGPADVDVDVEGLAAVLLGGTTWRDLAVAGLARARDPGALALADRLFAVPEAPHAGFFF

SEQ ID NO: 1505 - protein, 334 aa, Mycobacterium paratuberculosis
MAIEIRVLEDEDDLIAAANVFRTAMVGFAPLAGLAPGQIGTLLEPGRTIGAYAGGQLVGTADAVTSRLTLPGGALVGHAAVTHIGVLPSFTRQGIATALVRHQLRDFAARNEVVATLRASEATIYGRYGYGVASSSQSVTVHTARAALRRDVGPGGPVRLLDTAQAWEVLPRIYAEHRPARPGTIDRPRVWWQGVRLRTESAPGPTYVAVHGAPGSETGFVRYRPIDTERWFVSDERTIVVEDFFAPTAEAYLGLLRFLLGLDLVDRVQFWMLPLDDPLPWLLADRRSVRVTAVHDETWLRVVDARAALAARGYCGDETLTVAVNDPLLQDNSV

SEQ ID NO: 1506 - protein, 403 aa, Mycobacterium paratuberculosis
VTFSLQLSDDVIEVRDWVHQFAADVVRPAAAEWDEREETPWPVIQEAAKVGLYSPDLFAQQAAEPTGLGMLTVFEELFWGDAGIALSIMGTGLAAAALAGNGTPEQLGRWLPEMFGTADEPKLGAFCSSEPDAGSDVGAIRTRARYDEATGEWVLNGTKTWATNGGIANVHIVVASVYPELGARGQATFVVPAGVKGLAQGQKFKKHGIRASHTAEVVLDDVRLPADHILGGREKFEERIARVKSGASARGQAALKTFERTRPTVGAMAVGVARAAYEYALEYACQREQFGRKIGEFQAVAFKLADMKCRIDAARMLVWRAGWMARNNQAFDAAEGSMAKLVASETAVYVTDEAIQILGGNGYTRDYPVERMHRDAKIFTIFEGTSEIQRLVISRALTGLPIR

SEQ ID NO: 1507 - protein, 150 aa, Mycobacterium paratuberculosis
VTAREQYDAGQPGSVEQAVRTAGQLIWNNLKQSEDLLKVMLREPDELGDLDEKTWQVITDNAYQRFADELAASNRAGRTSIPDPEAAAAVAIGSLSYAATLQALTGRLPGNTDEDRYFEAWVNQTVSVLAQYTNRRKPLNDNDNDSGAQT

SEQ ID NO: 1508 - protein, 73 aa, Mycobacterium paratuberculosis
MVSEYSLTMLSSGRDRLLSAALRLFAAKGYAATSVADIQRESGLAPGSGALYKHFGSKRELLEARSRTGSRAS

SEQ ID NO: 1509 - protein, 442 aa, Mycobacterium paratuberculosis
MRVLSLRTIVIVAAISVMTLVVLLGTWVWVGVTNDQYNQLDRRLDSVSSLGDISSLLTNPQHNSPDRATPDGNLVRTARIGGVTVSVPSNIVLPQLPDGYANTTINGVQYRVRTFTAGPASIALAAPLAEAQHRINELHLRVLLICASVIGGTVVVGWVISLIMVNPFLLLAQQARAINAQSSPDEVQVRGVREAVEIAEAVEGMLARIGKEQQRTKAALESARDFAAVASHELRTPLTAMRTNLEVLSTLDLPHEQRQEVIGDVIRTQSRIEATLTALERLAQGELTTVDDFVPFDITELLDRAAHDALRVYPDVEVSLVPSPTVLMIGLPTGLRLVIDNAIANAVKHGNAGKIQLTVSSSGEGVEIAIDDDGSGIPESERATVFERFARGSTAARSGSGLGLALVAQQAELHGGTAELQNSPLGGTRLLLRLAGDGRGPA

SEQ ID NO: 1510 - protein, 260 aa, Mycobacterium paratuberculosis
MNASAEHIRYEKRGRIATITLDRPASRNAIDPAMDRRLRDIWAEFRDDDGVDVAILTGAGEAFCAGADRNTWFHQWLDADAAVVRRNAKGVGFGGITRGLHRITKPVIGAVNGWALGAGLELALACDIRIASERAMFGVPLVGLGFHHGDGGISRLVDTCGLAVALDLELSGEPIDAQRALQVNLVTRVVAHDDLMTAAHALAERIAGYHQAAVRSAKDTVLDVVGRPLDEQLEREAMSAYSIDRHSAREIIAAVGMRGH

SEQ ID NO: 1511 - protein, 192 aa, Mycobacterium paratuberculosis
MATATRERFLTAATGLFRRQGYSGTGLKQIVAESRAPLGSLYHFFPGGKQDLAVQAIAHTAERYRELLDRVFARSTDIGQATVTWFNWAARALQETDYADGCPIGTVACEVASSNEALRQATQAVFASWQSRVAAELIGAGVPTAQARRLATFAVASLEGAILLARAHRSTRPLRDTGRVVADTLRAATDRG

SEQ ID NO: 1512 - protein, 132 aa, Mycobacterium paratuberculosis
MLGHLGINVPDLSVAKRYYDALMPLVGFEPFFAADDEFSYRPAGNKPGTYLFFYPAAEPHEYSAQRTGLQHLAFMVRGRSAVHEVDTHVIRIGGTVIYPPRHFPQYPGHYYATFWYDPFGIKLEAVCHHDRD

SEQ ID NO: 1513 - protein, 103 aa, Mycobacterium paratuberculosis
MVVSVQSEMVLASAGAESAISAETEAAASAASPALLGVMPMGGDPDSAMFAAALNACGASYLGVVSEHAAQRGLFAGAQGMASGVYTTTEAMRSLAMGISSVL

SEQ ID NO: 1514 - protein, 396 aa, Mycobacterium paratuberculosis
MADPGWAARTPEDNDMLLKAGVGVGTHVANQTAWTTLAATHHASGVASAINTAATSASWLGAGSAASAANVTMLNASLHGLAGWVDVKPAVVATAISAYQMAYGSMRPAPECIANRTETATDYGINPLVLGALTPRIASLELEYYGSMWPNNSAVGASYGAVLTALAESLAIAPPIASMGASPAAPAEAVSAIGESAANVAAGDGMRAAYQGVQTGTQGAGQAASSGQDLGGQMSSLMQPVQELMGAVPQAMQAPMQMMQAPMQMMQPLQSMMGMFANPGAMGMGGAAPGVSAVSATTGLSAAEAGAGGAGSLGSAGVPATSFTRPVSAFEPATSGRPVGLRPAGALGAEALRPQTTTMSGAPMGGMPVGHGAGGQRGSRDKAEEPATVRVVDDRV

SEQ ID NO: 1515 - protein, 406 aa, Mycobacterium paratuberculosis
MTVTEVVVAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFPALERAFDYNKSRAALILLTGYQTPDALRSAGGARVAAFLRKRKARNADTVAATALQAANAQHSIVPGQQLAATVVARLAKEVMALDTEIGDTDAMIEERFRRHRHAEIILSMPGFGVILGAEFLAATGGDMAAFASADRLAGVAGLAPVPRDSGRISGNLKRPRRYDRRLLRACYLSALVSIRTDPSSRTYYDRKRTEGKRHTQAVLALARRRLNVLWAMLRDHAVYHPATTTAAA

SEQ ID NO: 1516 - protein, 100 aa, Mycobacterium paratuberculosis
VTPQMLRDTSNAIQANMEHAIGIGQGYVANQENVMNPATWSGDAVAASHATAIEVQNDLNKVLTGGTRLAEGLTKAAALMEGHEADSSHAFSALFGGHGS

SEQ ID NO: 1517 - protein, 95 aa, Mycobacterium paratuberculosis
MSDPITYNPGAVADFATDVASRAGQLQSIFDDTSNRTHALQEFFAGHGASGFFEAQAQMLSGLQGLIDTIRQHGQTTSHVLDSAISTDQHIAGLF

SEQ ID NO: 1518 - protein, 276 aa, Mycobacterium paratuberculosis
MLTTTVDGLWVLQAVTGIEQTCPELGLRPLLPRLDTPERALRHPAAAELVAAGALDEAGNVDPMIREWLTVLLRRDLGLLVMIAVPGREPSRASICRFATWWVVLERHDQLVRLYPAGTASSEAAASEIVVGQIERLCGVAEAAPLRPITLDTEQLLASVHDTASLRAFLLEQRLDADQLQTVLTAADSARSAHANIVALQAGVGPDELARVAVGDSSVSIVDTPGGRVCIESVVSGQRRYQILSPGSRSDIGGAVQRLIRRLPAGDEWYSYRRVV

SEQ ID NO: 1519 - protein, 341 aa, Mycobacterium paratuberculosis
VTSPWNDPNMSDEGALRRGDPSGGSNFPDSVSDTMRITDLAAPRKIPPGSGWRKFIYTISFHKINPGESPRERHYRDLQNRIRRHIRRQYVITVVSGKGGVGVTTLVACIGGVFRECRPQNVIAIDAVPGFGTLADRIDESPPGDYTAIINDTDVQGYADIREHLGQNAVGLDVLAGNRTSDQPRPLVPAMFSGVLSRLRRTHTVMIVDTSPDLEHEVMKPVLENTDTLVFVSGITADRSRPVLRAVDYLRSQGYHELVSRSTVIVNHTDQITDKDALAYLTERFTKVGATVEALPFDPHLAKGGIIDTVHELKKKTRLRLFEITAGLADKYIPDAERAVP

SEQ ID NO: 1520 - protein, 509 aa, Mycobacterium paratuberculosis
VTSPHKVAFPARCAVNISYEKHLCSQVFPAGIPVEGFFEGMVELFDADLKRKGFDGIALPAGSYELHKINGVRLDINKSLDELGVQDGDTLVLVPRVDGESFEPQYESLSSGLAAMGKWLGREGGDRMFAPVTPLTAAHTAVAVIAMAVAVVVGLCLRARTFTDGPIPAAVAGGIGALLLIATLVVRSGWRERRDLFSGFAWLAVVALAVAGACAPPGVLGAAHALIGVVVVILGAIAIGVTARNRWQTAVVTAVVTVCGVLAAVAAVRMFRPASVQVLAICVLVGLLVLVRMTPLIALWVARVRPPHFGSITGRDLFARREGMPVDTVAPVSEDESEEQDNELTDITARGAAIAASARLVNAVQVGLCVGVSIVLPAAVWGVLTPGRPWAWLALVVAGLVVGIFITQGRGFAAKYQAVALVCGASAAVCTGVVKFALAAPHDAMTGLLWPVVAVATFAAFGLAAALLVPTMRFRPFIRLTVEWVEVLAFIVLLPAAAALGGLFTWIRH

SEQ ID NO: 1521 - protein, 553 aa, Mycobacterium paratuberculosis
VDSPLRRAAALVAALTLVALSANVTVAQAITPPSVDPGMVPPDGPPRPDQPMRRANSCSAPITVRNPDVAQLAPGFNLLNIAKAWQYSTGNGVPVAVIDTGVSPNPRLPVVPGGDYIMGEDGLSDCDAHGTIVSSIIGAAPQGILPMPRPMPATPAFPPPAGPPPAVGAPPPPVEVPPPVAPPPPPPPVTITQVLPPPPPPPPPPPEGGGATAASNGPPDPQTEDEPAVPPLPPGAPDGVVGVAPHATIISIRQSSRAFEPVNPPPGDPNSDEKVKAGTLNSVARAVVHAANMGAKVINISVTACLPAAAPADQRALGAALWYAATVKDAVVVAAAGNDGEAGCNNNPMFDLLDPSDPRDWHQVKVVSAPSWFSDYVLSVGAVDASGAALDKSMSGPWVGVAAPGTHIMGLSPQGGGPVNAYPPSRPGEKNMPFWGTSFSAAYVSGVAALVRAKFPELSAHQVINRIVQSAHNPPAGVDNKVGYGLVDPVAALTFNIPPGDRMAPGSQSRIITPAPPPPPPDHRARNIAIGFLGTVAAGVLVLAIAARLRRAR

SEQ ID NO: 1522 - protein, 534 aa, Mycobacterium paratuberculosis
MRPNLTGFSRGSNRRVVGVWVVFVLALASWLLGGYIAAAVAVLVGVALVFVRWWGQPAWSWAVLWRRGRRPIDWSAPITVANNRSGGGVRVQDGVAVVAVQLLGRAHRATLVTGSVTVETENVLDVVELAPMLHQALGLQLDSISVVTVGSRHGNVGDYPRVYDSEIGTPPVRRPARDLADHAVGGDRQRAGPALAHNRWRGGDFGCPADRRAAALPGAAGEGGQRHRPGRAGPTARLGCGVRHRAALEGHPRGSRLDDHLRLSAAGDHLTQPVPGVDAARRRGDPERDRLSRRALQRDDHGAHPDPRPHAAQRDPAPAQRRTGRRGGRQHVRPPTTPGRAAAQPAARRADHRDRPVGRADRQAAQRRSAADAGHRRRRTVARLRRRRRPDRQTHRDPHGRRRRTGLRAHPRHVALGQRADAGDQRRQQLPPGPADHRQRGGVRPAPWRGRRGRDLAHPAAGDRDHRRPRRHHPVRGAAARLRGDHRTSQPRGGERQCGGEELACRDGHVPRRAPLRQPGAGQHVRRHVATPVL

SEQ ID NO: 1523 - protein, 613 aa, Mycobacterium paratuberculosis
VMGDLQTARRHFDRAMAIMSRQGRAAALPEFVAATDADPSMADAWLGRIACGDSELASLRKLYATSEWLHRETTRIGQTLAAEIQLGPYIGITVTDASQVGLALSSALTIAGEYAEADKLLANRDLLDSWTNYQWHQLARTFLMYRTQRWPDVLLTAAEELPPQAIIMSAVTASICALAAHAAAHLGQGRVALDWLDRVDVIGQTQASSRFDADVLTASIGPADIPLLVADLAYVRGMVHRQLGEEDKAQIWLSKATINGVLTEPAKEALADPNLHLVITDEQTIDSRTDRWDASSAKSRDELDDDAAAERRAELLAEGRRLLAKQVGLAAVKQAVAALEDQLEVRMMRLEHGLPVEGQTNHMLLVGPPGTGKTTTAEALGKIYAGMGIVRHPEIREVRRSDFCGHFIGESGPKTNELIEKSLGRIIFMEEFYSLIERHQDGTPDMIGMEAVNQLLVALEAHRFDFCFIGAGYEDQVDQFLTVNPGLAGRFNRKLRFESYSPAEIVEIAHRYATPRASLLDEAARETLLDAATTIRNYTTPGGRHGIDAMQNGRFARSVVERAEGFRDTRVVAQKRAGQPVTVDDLKIITAADIEAAVRSVCSDNRDMAAIVW

SEQ ID NO: 1524 - protein, 146 aa, Mycobacterium paratuberculosis
MTALRPPRYLRPMNKVMMAVQRLGIPTGPAMVLTVPGRKSGQPRSTPMTPFEFRGGLYVVAGYPGADWAANARAAGTGTLRRGRRSRRVRIVELSADEARPVLREFPAKVPVGVGFAKRSGLVRDGTADEFEALAGQLAVFRFDPA

SEQ ID NO: 1525 - protein, 286 aa, Mycobacterium paratuberculosis
MTIVVTGATGNVGRPLVTALLAAGAPVRAVTRRSGPAGFPAQVELFDTAADALPGASAVFLNARALGGQLEDVVARCARGGVTKLVALSAINADDDFSRQPSRFRGDRNRQVEQLAVGSGLAWVSLRPTVFATNFAGMWSAQLREGDVVAGPYAAASSAPIVETDIADVAAHALLTDDLVGQRIPLTGPQALSNAQLVEVIGTVLGRSLRYQEIPAAAVRQRFVGLGLGAGFADAYLAMLAETLDKPALVTHDVEKILGRPALPFAHWVATHRDLFDRRNERKEGV

SEQ ID NO: 1526 - protein, 285 aa, Mycobacterium paratuberculosis
MNRSPSADDQVAEAWRRHRPYLVNLAYQMLGDIGDAEDVAQEAFLRLSAAGDIDDVRGWLTVVASRLCLDQLRSARARHERPGDVGEQPAPPRFDPADRITLDDEVRTALLEVLRRLSPGERVSFVLHDVFGVPFEAIAQTVGRPVGTCRQLARRARAKFVAAQPKLNTVGAAEHQLVTEKFITACANGDLAGLAAVLDPTVWGVGTVLADPAPPPQVNHGPDAVATNLLRYLWPDVTLVGGPAGAPVLLAFSRRRLFAVIVLSIRDARVVKIEAIADPAARSAG

SEQ ID NO: 1527 - protein, 384 aa, Mycobacterium paratuberculosis
MNERDEFLRDRLQPERPSARPAPEAPPPPVAPRPAPPPRPPTPAPTPPTRPPAPPTFRPHPPAAAPAPAAPPTPRPQPSATPQLPDRGWRRALRLATFGLIDLGPSPAQRREAQFEQAIQARLYGNYKVGVLGKGGVGKTSVAASVGSLFAELRRQDHVVAIDADTAFGRLGSRIDPASTGSFWELTADQNLRSFDDVVARLGRNAAGLHVLGGEPASGPRRVLDPAIYREATRRLDRHFTISVIDCGSTMDAPLTQEVLRDLDALIVVSSPWADGASAAARTLEWLADHGLTTLLAHSLVVLNDSDGHADKRTRALLAREFIDHGRPVIEVPFDPHLRPGGVIDVNAEMAPATRRKFLEVTATIAGYFARRPDRSADRRPPEH

SEQ ID NO: 1528 - protein, 1527 aa, Mycobacterium paratuberculosis
MTPKRAGLYNPAFEHDACGVAMVVDMHGRRSRDIVDKAITALLNLEHRGAQGAEPRSGDGAGILIQVPDAFLREVVDFELPPEGSYATGIAFLPQSSKDAATACAAVEKIAEAEGLTVLGWRNVPTDDSSLGALSRDAMPTFRQVFMAGASGMTLERRAYLMRKRAEHELGTKGPGQDGPGRETVYFPSLSGQTFVYKGMLTTPQLKAFYLDLQDDRLTSALGIVHSRFSTNTFPSWPLAHPFRRIAHNGEINTVTGNENWMRAREALIKTDVFGTEADVEKLFPICTPGASDTARFDEVLELLHLGGRSLAHAVLMMIPEAWERHESMDPARRAFYQYHASLMEPWDGPASMTFTDGTVIGAVLDRNGLRPSRIWVTEDGLVVMASEAGVLDLDPATVVRRMRLQPGRMFLVDTAQGRIVSDEEIKAELAAEHPYQEWLDRNLVPLDDLPQGDYKRMPHDRLVKRQQTFGYTYEELNLLVAPMVRTGAEPIGSMGTDTPVAVLSQRPRMLYDYFQQLFAQVTNPPLDAIREEVVTSLQGTTGGERDLLTPTELSCHQIVLSQPILRNRELAKLVNLNPDDEVNGRPHGMRSKVIRCLYPVAEGGAGLAAALEDVRAQASAAIADGARVIILSDRESDEKMAPIPSLLAVAGVHHHLVRDRTRTHVGLVVESGDAREVHHMAALVGFGAAAINPYMVFESIEDMLDRGVIEGIDRNTALNNYVKAAGKGVLKVMSKMGISTLASYTGAQLFQAVGISEDVLDEYFTGLSCPIGGITLDDIAADVAARHALAYLDRPNERAHRELEVGGEYQWRREGEYHLFNPETVFKLQHATRTGQYKIFKDYTRLVDDQSERMASLRGLLKFRAGVRPPVPLEEVEPASEIVKRFSTGAMSYGSISAEAHETLAIAMNRLGGRSNSGEGGEDVKRFDRDPDGSWRRSAIKQVASGRFGVTSHYLTNCTDIQIKMAQGAKPGEGGQLPGHKVYPWVAEVRHSTPGVGLISPPPHHDIYSIEDLAQLIHDLKNANPAARVHVKLVSENGVGTVAAGVSKAHADVVLISGHDGGTGATPLTSMKHAGAPWELGLAETQQTLLLNGLRDRIVVQVDGQLKTGRDVMIAALLGAEEFGFATAPLVVSGCIMMRVCHLDTCPVGVATQNPVLRERFTGKPEFVENFFMFIAEEVREYMAQLGFRTLNEAVGQVKSLDTTLARAHWKAHRLDLGPVLHEPESAFMNQDLYCSSRQDHGLDKALDQQLIVMSREALDSGKPVRFSTTISNVNRTVGTMLGHEVTKAYGGQGLPDGTIDITFDGSAGNSFGAFVPRGITLRVYGDANDYVGKGLSGGRIVVRPSDNAPADYVAEDNIIGGNVILFGATSGEAYLRGVVGERFAVRNSGAHAVVEGVGDHGCEYMTGGKVVVLGRTGRNFAAGMSGGVAYIYDPPGEFPQHLNAEMVELESLDDDDIEWLHGMIQAHVDATDSAVGQRILGDWAQQQRHLVKVMPRDYKRVLQAIAEAERDGGDVDKAIMAAAHG

SEQ ID NO: 1529 - protein, 491 aa, Mycobacterium paratuberculosis
MADPSGFLKYTHRELPKRRPVPLRLRDWREVYEEFDHGTLREQATRCMDCGIPFCHNGCPLGNLIPEWNDLVRTGRWRDAIERLHATNNFPDFTGRLCPAPCEPACVLGINQDPVTIKQIELEIIDNAFDEGWVQPLPPDKLTGKKVAVVGSGPAGLAAAQQLTRAGHSVTVFERSDKIGGLLRYGIPEFKMEKRVLDRRLDQMRAEGTEFRAGVNVGVDITADQLRADFDAVVLAGGATAWRDLPIPGRELDGIHQAMEFLPWGNRQASGDLDEADMDADGQPPITAKGKKVIIIGGGDTGADCLGTVHRQGATEVHQFEIMPRPPDTRAPSTPWPTYPLMYRVSSAHEEGGERVFSVNTEEFVGENGRVTALKAHEVTMEDGKFVKVEGSEFELEADLVLLAMGFVGPEKEGLLTDLGVKFTERGNVARGADFDTSIPGVFVAGDMGRGQSLIVWAIAEGRAAAAAADRFLMGATALPAPVKPTAVPLQ

SEQ ID NO: 1530 - protein, 49 aa, Mycobacterium paratuberculosis
VFVVHINPVPRSRMGRIAWSWLRHPVKSREFPAKHERLVTAQDLLLFGV

SEQ ID NO: 1531 - protein, 283 aa, Mycobacterium paratuberculosis
MRFAFKTSPQNTTWAQMLAVWQAADDIDVYESGWTFDHFYPIFSDSSGPCLEGWTTLTALAQATKRLRLGTLVTGIHYRHPAVLANMAAAVDIISSGRLELGIGAGWNEEESGAYGIELGSIRERFDRFEEACAVLTSLLSQETTDFDGKFYQLKGARNEPKGPQRPHPPICIGGSGEKRTLRITARYAQHWNFVGGPPDVFAHKRDVLASHCADIGRDPKEILLSAHLRLEPDLDYGKVIDDAAALAAEGLDLGIVYLPPPHDPAVLEPLAEAIRDSGLLRS

SEQ ID NO: 1532 - protein, 146 aa, Mycobacterium paratuberculosis
MTFGCGSLGLDTKITLLAAGLIFLLALILGVWKYREMMTSQNHLAHPYVDIAHRAALLYSFATLLIAVFVQLSAWPVWVNLAAAGVLVFFFLAAILAYIGHGARRDTVNQFERPTAGLRWSMAALIVGEIGGFGVLFAGFVAGQLW

SEQ ID NO: 1533 - protein, 334 aa, Mycobacterium paratuberculosis
MDPVVALRQIAYYKDRSRHDPRRVMAYRNAADVIEGLDEATRERHGQANSWQSLPGIGPKTAKVIAQAWSGREPDMLVELRSAAEDLGGGDIRSALRGDLHVHSNWSDGSAPIEEMMAAAAALGHEYCALTDHSPRLTIANGLSPERLRKQLDVIDRLQDTVAPMRILTGIEVDILEDGGLDQEPELLERLDVVVASVHSELSMDSAAMTRRMLRAVQNPHADVLGHCTGRLVSGNRGIRPESKFDAEAVFTACREHGTAVEINSRPERRDPPTRLLNLALEMGCVFSIDTDAHAPGQLEFLGYGAQRALDAGVPVDRIVNTWPAERLLEWTAG

SEQ ID NO: 1534 - protein, 400 aa, Mycobacterium paratuberculosis
MFVRCDASILHADLDSFYASVEQRDDPTLRGRPVIVGGGVVLAASYEAKAYGVRTAMGGAQARRLCPHAVVVPPRMHAYSRASDAVFRVFRECTPLVEPLSVDEAFLDVGGLRRVSGTPVAIAQRLRADVRDRVGLPITVGIARTKFLAKVASQQAKPDGLLLVPPDQELAFLRPLPVRRLWGVGAVTAEKLRAHGIATVADVAELSESTLGSMVGAAMGRQLYALSRNIDRRRVSTGVRRRSVGAQRALGRAGNTMSDSEIDAVVVNLIDRVTGRMRAAGRTGRTVVLRLRFDDFTRATRSHTLPWATSSTAPILAAARRLVAGAAPMIARRGLTLVGFAVSGIDRDGAQQLMLPFQGRPPDAIDAAIDRVRRRYGKAALTPAVLLGRDPGLEMPHLPD

SEQ ID NO: 1535 - protein, 213 aa, Mycobacterium paratuberculosis
VTTAGQTRALRGRRAIRPTGDEREQAILATAERLLETRPFAGISVDDLAKGAGLSRPTFYFYFKSKEAVVLSLLEPVIARADAEFDGAVQRLPTDPRRVWRNGIKAFFTAFSSHRALARAATEALATSSELRAVWSGFMQKWIDQTAAMITAERERGAAPDTIPAADLATSLNQMNERTMMAALSAETPAVAEDRVVDTLTHIWVSSIYGESG

SEQ ID NO: 1536 - protein, 489 aa, Mycobacterium paratuberculosis
MTEHLDVLIVGAGISGVSAAWHLQNRCPTKSYAILERRADLGGTWDLFKYPGIRSDSDMFTLGFRFKPWRSAKSIADGASIKAYIKEAAVENRIEPHIRYRHRVVAADWSDADNRWTVTVEHDGQRSEITCSFLFACTGYYNYDEGYSPTFPGAEDFGGTIVHPQHWPEDLDYASKRIVVIGSGATAITLIPALVNSGAGHVTMLQRSPTYIGSLPGVDPFAERANRLLPDRLAHMANRWKAIAFSTFQYQLSRKAPAYMRKTLMTMAKRRLPEGYDVEKHFGPRYNVWDERLCLAPDGDFFRTIRHGKADVVTDTIDRFTTTGIRLNSGEELPADIIVTATGLNMQLLGGVTPTRNGEPVDLTSLMTYKGLMFSGMPNFAITFGYTNASWTLKADLVSEFVCRLLNYMDAKGFDFVEPQHPGEDVDELPFMDFTPGYFRRSMHLLPKSGSRAPWRLKQNYFFDMRTIRRGRVDDEGLKFAKKRAPVAV

SEQ ID NO: 1537 - protein, 160 aa, Mycobacterium paratuberculosis
VTVSFRPTADLVDDIGPDVRSCDLQFRQLGGRTEFAGPISTVRCFQDNALLKSVLSEPGGGGVLVVDGGGSLHTALVGDVIAELARANGWAGLIVNGAVRDSAALRGMDIGVKALGTNPRKSTKTGAGERDVDITLGGVTFTPGDIAYSDDDGIVVAVGD

SEQ ID NO: 1538 - protein, 136 aa, Mycobacterium paratuberculosis
MADPQDPTNSAADGAGDPPEKKPPAKAAKKTAKAPAKKAPAKKAPAKKAPAKKAPAKKAPAKNTPTGGGQRADTNGDLTAAAKDAAAQAKSTVEAADNPVAPAVVGPAAGQSPVPLIVAVAVSLLAILLIRQLRRR

SEQ ID NO: 1539 - protein, 210 aa, Mycobacterium paratuberculosis
MPPRKRRAPRLLVAVAALCLGSVAWSPMASAHVHAGSDNPVRGAMAVVTFQVPNESNTGAATTALTVALPNVAAAHTETMPGWTARLDRDAASGTVRSVTWTAAAGGGIGPDQFALFRLSVKLPDADTVSFPATQTYADGTVVKWDQPPLPDGGEPEHPAPTLALAAGPAAGHQHPGGPAAADNAARWLGGAALVLAALGIAIALVRRRA

SEQ ID NO: 1540 - protein, 229 aa, Mycobacterium paratuberculosis
LPAKLPGSGEGMGLFRKRKSRATRRAEARAIKARAKLEAKLAAKNEARRAKSALRAQDKALKAQIKAQRDSDRNALKVAEAELKAAREGKILSPTRIRRILTVSRLLAPILTPLVYRAAVSARALIDQRRADRLGVPLAQIGQFSGHGAQLSARIAGAEKSLRLVQERKPKDGETKQFVAAISERLTDLAAAVTAAENMPAARRRAAHAAISSQLDGIEADLMARLGLS

SEQ ID NO: 1541 - protein, 132 aa, Mycobacterium paratuberculosis
MSTTFAARLNRLFDTVYPPGRGPHTSAEVIAALKAEGITMSAPYLSQLRSGNRTNPSSATMAALANFFRIKPAYFTDDEYYEKLDAELSWLAMSRDDNVRRIAMRTAELSPEAQREVMDRVNELRRAEHLDA

SEQ ID NO: 1542 - protein, 177 aa, Mycobacterium paratuberculosis
METGSDRPIGVSPFHSRGALKGFVISGRWPDSTKEWAQLLMVAVRVASLPGLLSTTTVFGAREELPDEPEPGTVGLVLAEGTVFGESAIPPGHFADHQPPALLMLHPPSETMPSLPECTGAASGCVLLPGLPYLGLEHRAAWVEAEADGTITSMVSRVGVDPISHPDTAILAMLLAA

SEQ ID NO: 1543 - protein, 207 aa, Mycobacterium paratuberculosis
VAEYTLPDLDWDYAALEPHISGQINEIHHTKHHATYVKGVNDALAKLEEARANEDHAAIFLNEKNLAFHLGGHVNHSIWWKNLSPDGGDKPTGELAAAIDDAFGSFDKFRAQFSAAANGLQGSGWAVLGYDTVGSRLLTFQLYDQQANVPLGIIPLLQVDMWEHAFYLQYKNVKADYVKAFWNVVNWADVQKRYAAATSKAQGLIFG

SEQ ID NO: 1544 - protein, 59 aa, Mycobacterium paratuberculosis
VTGGERRLMATHSFGPGSPAPSKSYGGSPAWNHSYSVAALRAGLIALALLAVLALIVLS

SEQ ID NO: 1545 - protein, 334 aa, Mycobacterium paratuberculosis
VIQVCSQCGTRWNVRDRQREWCPRCRGALMAPLPDAPPAGPARAPGWQRTPPRLPPGYRWIALRPGAAPPPRRGRRPLGPTPRYAVIPRWGLADRVEPPAVAAASAHPGPPAQLVRTTSFVGVLVLGIAALVYVVRYLLLVINRDTLLYSWVAIGADWLGVLASVGAVGAVIASGVALIRWMIARRAAVFAHHGLPDPRSARALWAGCVVPLANLLWAPVFVIELALLEEHYHRLKGPILQWWITWVCSYAVSVSAIATSFVTDAQGIANNTILMVFGYLFAAATLAAATRIFEGFQRKPVARPAHRWVMVPDDGPPPPAPGAPVEFKGQEPAA

SEQ ID NO: 1546 - protein, 272 aa, Mycobacterium paratuberculosis
MTWADEVLAGHPFVVAHRGASAARPEHTLAAYDLALKEGADGVECDVRLTRDGHLVCVHDRRLDRTSTGAGLVSTMTLAQLRELEYGAWHDSWREDGAHGDTSLLTLDALVSLVLDWRRPVKLFIETKHPVRYGSLVETKLLALLHRFGIAAPASADRSRAVVMSFSASAVWRIRRAAPLLPTVLLGKTARYLISGAPTAVGATAVGPSLPTLREYPQLADRAIAQGRAVYCWNVDDYQDIDFCRDVGVAWLATHHPGRTKAWLQGHRDGSG

SEQ ID NO: 1547 - protein, 401 aa, Mycobacterium paratuberculosis
VNGDFPPRGRRPGRQGPPRQPGPEPSPVIPRPGGPAPSPHAPTQPLHRPPPAPPARPAPPARPAPPASAIRPARPRRKRRWVRTVASALLVVLLLAGGGLGAGVAWFDTKLHREPVLADYPGRPEPGRGSNWLIVGSDSRQGLSAEQQQQLATGGDIGDGRTDTILLVHLPGVGSGVAPTMVSIPRDSYVPIPEHGKDKINAAFAMGGATLLVRTVEQATGLRIAHYAEIGFGGFTALVDALGGVRVCSQAPMHDPLAGLDLPAGCQTLDGRNALGYVRSRDTPRADLDRMVNQRQFVAALLHRAASPTVWLNPWRWYAAPRAVADALTVDRADHAWDLARLGWALHGSPATVTVPIGEFTSGDAGSVVVWDHARAARLFDALSSDGQLPAGSTDEQQPSS

SEQ ID NO: 1548 - protein, 264 aa, Mycobacterium paratuberculosis
VLPQTCPAPSTAERIRSACVRAGGALLAIEHDDPVPTPVHHLIGTGPFAGSFALALPVAREHRLRPVAGAPALLELTDYAPLPLREPVRSLVWVRGRLHEVDPAQILETLDVIAAECPNPALLGVDTPRRADGTEPRYVLRRLEIASVVVTDATGAEPVDVADLLAARPDPFCALESDLLWHLDTAHGDVVSRLVSRLPAPLRRGQVRPLGLDRYGVRFRVEGNDRDHDVRLPFHKPVDDMTGLSQAIRVLMGCPFINGLRARG

SEQ ID NO: 1549 - protein, 315 aa, Mycobacterium paratuberculosis
VARIAYLGPEGTFTEAALRQITAAGLVPGQGADGVRPTPVDGTPAALDAVRDGAADYACVPIENSIDGSVTPTLDSLAIGSPLQVFAETTLDVAFSIVVKPGLSAADVRTLAAIGVAAAQVRQWVAANLAGAQLRPAYSNADAAQQVAEGRADAAVTSPLAAARWGLDTLADGVVDEPNARTRFVLVGPPAPPPARTGADRTSVVLRIDNAPGALLAALAEFGIRGIDLTRIESRPTRTGLGIYRFFADCVGHIDDEPVAEALKALHRRCADVRYLGSWPTGTPAGALPPSTEEAVRWLAAVRDGKPEPPGESRR

SEQ ID NO: 1550 - protein, 231 aa, Mycobacterium paratuberculosis
VSGRLILVRHGQSYGNVERRLDTRPPGAELTPLGRDQAREFARRSGRPAMLAHSVATRASQTAAVIGGQLALPPVELGGIHEVQVGRLENRNDDEAVAEFNAIYERWHRGELEVPLPGGETGSEVLDRYLPVLTELRLRYLDDHDFHGDIVVVSHGAAIRLAAAVLAGVEADFALDHHLDNAQSVALTPITDGRWSCVRWGTLTPPFYPEAAEIPATPVADAVRSTTDPMG

SEQ ID NO: 1551 - protein, 116 aa, Mycobacterium paratuberculosis
VPVRMDPQRFDELVSDALDLIPPELAAAMDNVVVLVDDRHPEEPDLLGLYEGVALTERDSDYSGALPDAITIYRAALLDVCESEQQVIEEVAVTVIHEIAHHFGIDDERLHQLGWA

SEQ ID NO: 1552 - protein, 450 aa, Mycobacterium paratuberculosis
MSQAPEKDLPEAGEAPAVETTAASAFLWPRSLQARATRRALLLTALGGLLIAGLVTALPVGGTGSGRLLDASPVRSTGAKSDAAFNRAASGECLMWPDTTPESAKIVNCGDDHKFEVAESIDMRTFPGSEYGPNAAPPTPARIQQITQEQCEAAVRNYLGPKFDPNSKFTVSLLWPGDRAWRQGGDRRMLCGLQLPGANNQQQVFKGKVADVDQSKIWPAGTCLGIDSATNQPTDVPVDCAAPHAMEVTGTVNLAEKFPGALPAEPDQDAFIKDSCTKMTDAYLAPVKLRTTTLTLIYPTVPLASWTAGSREVACSIGATLGNGGWATLLNSAKGQLLINGQPPVPPPDIPEERLSMPPIPLQAPAQSPSTQSGSAAAPEMPRNNQHLPGQQPVVTQPPQAPPPPVDNGAPPPANPAPEAPPAPVPPPAAPPPPPPPAPEAPPGGPPPAG

SEQ ID NO: 1553 - protein, 425 aa, Mycobacterium paratuberculosis
VIDLKLLREDPDAVRRSQQSRGEDPSLVDALLAADAARRAAISTADTLRAEQKSASKSVGAASPEQRPALLARAKELAEQVKAAETAQAEAEAAFTAAHLAISNVVIDGVPAGGEDDFAVLDVVGEPTALENPRDHLELGETLGLIDMARGAKVSGSRFYFLTGKGALLQLGLLQLALRLAVENGFVPMIPPVLVRPEVMAGTGFLGAHAEEVYRIEADDLYLVGTSEVPLAGYHADEILDLSAGPLRYAGWSSCFRREAGSYGKDTRGVIRVHQFDKVEGFVYCTPADAEAEHQRLLGWQREMLARIEVPYRVIDVAAGDLGSSAARKFDCEAWVPTQQTYRELTSTSNCTTFQARRLSTRYRDGGDAKGKPQIAATLNGTLGTTRWLVAILENHQQPDGSVRVPEALVPFVGTELLEPVGPRG

SEQ ID NO: 1554 - protein, 249 aa, Mycobacterium paratuberculosis
MSEIGQHGLATSAQTLPPGARIARHRHPLHQIVYPSTGAVSVTTPAGTWITPANRAIWIPAGCWHEHKFHGHTNFHGVALDPARYRRGPAAPAVLAVTPLMRELIIACSRARDTDAGAHQRMLAVLHDQLQATSVAEPLWIPTAVDGRLRAACALLADNLRKPLTLRQIGERIGVGQRTLSRLFRDELAMTFPQWRTQVRLQHALVLLAERRDVTSVAAECGWATPSAFIDTYRRAFGHTPGRLAPRPS

SEQ ID NO: 1555 - protein, 190 aa, Mycobacterium paratuberculosis
MAMNLLHRHRCSSAGWAKEVADELLPWALDGVELGSRTLEIGPGYGATLSAPLDRTASLTAVELDPVMADRLQRRYGDRARVIQASGTETGLPANHFTSVVCFTMLHHVPSPQLQDQLFAEALRVLQPGGTFAGSDGVPSWAFRLLHVADTYNPIAPKDLPGRLAAAGFADIHADARGGRQRWRAVKPID

SEQ ID NO: 1556 - protein, 161 aa, Mycobacterium paratuberculosis
MVSLLVHAVLGFSVIAWIVASNAKVFARPAGGPLFSPMEVVYYLVGIASVALGWYFNITFVQQYSHGSTNPLWGEHGSWAEYIRLMFTNPAASSASQDYTIANVVLLPLFTIVDGYRRGLRRPWLYFVSSLFTSFAFAFAFYFATMERQRRHEQARETVPA

SEQ ID NO: 1557 - protein, 212 aa, Mycobacterium paratuberculosis
MVRPAQTARSERTREALRQAALVRFLAQGVEDTSAEQIAADAGVSLRTFYRHFRSKHDLLFADYTGLHWFRAALDARPADEPIIDSVQAAIFSFPYDVDAVTKIAALRHEELDPGRIVRHIRDVQADFAEAIAAQLQRRGRGAGAPTADQRVRAAVTARCIAAAVFGAMEVWMVGDERSLGELARLCHAALESLRAGITDSWSTATAPQVSS

SEQ ID NO: 1558 - protein, 524 aa, Mycobacterium paratuberculosis
MNDYDAIVIGAGHNGLTAAVLLQKAGLRTLCLDAKLYAGGMASTVELFDGYRFEIAGSVQFPTSQAVVDELGLDTIPTIDLDVMSVAVRGVGDDPLVQYSDPVKLFTHLNEVHGADAVNGMAGLMAWAQAPTRALGRFEAGTPPKSLDEMYACATNEFERSAIDDMLFGSVTDILDRYLPDREKHGALRGSMTVLAVNTLYRGPATPGSAAALAFGLGVPDGDTMQMKKLRGGIGVLTSHLCDVLERHGGELRLRTKVTEILVEHAGSGGRVTGVRTESGETLSAPIVVSGIAPDVTLNELLDPAALPADLRARYARIDHRGSYLQMHFALQEAPVFAAPYQVLNEPVMQASIGLFCTPEEVQQQWEQARRGVVPADPTVVLQIPSQNDPGLAPEGKHAASAFALWFPIEGEVDYGRAKIEMGQRVIDKITRLAPNFEDSIIRHTTFTPRHMGVMFGAPGGDYCHGLLNANQVGPNRPGPRGFLGQPIPIEGLYLGSAGCHGGPGITFIPGYNAARQALTDRSG

SEQ ID NO: 1559 - protein, 111 aa, Mycobacterium paratuberculosis
VNETYDDGLVQLDRAAITLRRYHFPSGTSKVIALDAIRGYKAEPLGIFMHRFRVWGSSDLRRWLPLDIGRPFKSTLITLDVPGTRPAPAFTPARPDEFTALLDELLARRGS

SEQ ID NO: 1560 - protein, 512 aa, Mycobacterium paratuberculosis
VQVTSVGHAGFLIRTQAGSILCDPWVNPAYFASWFPFPDNSTLDWDQLGDCDYLYVSHLHKDHFDAKNLAEHVNKDAVVLLPEFPVPDLRNALQELGFHRFFETADSVKHRVGGLDVMIIALRAPADGPIGDSALVVSDGSTTLFNMNDARPVELDMLASEFGHIDVHLLQYSGAIWYPMVYDMPARAKESFGIQKRQRQMDRARQYLAQVGATWVVPSAGPPCFLDPELRHLNDDHGDPANIFPDQMVFLEQLRAHGQGGGLLMIPGSTADFSGSTLNSLHHPLPTAEVEAIFATGKADYIAAYAERMAPVIAAERAGWAPATGEPLLEPLRALFEPIMSQSDEICDGIGYPVELVLGPERVILDFPKRTVREPIPDEKVRYGFAIAPELVRTVLRDREPDWVNTIFLSTRFKAWRVGGYNEYLYTFFKCLTDERIAYADGWFAETHDNSASITLDGWEIQRRCPHLKADLSKFGVVEGNTLTCNLHGWQWRLDDGRCLTAKGHQLRSSRA

SEQ ID NO: 1561 - protein, 252 aa, Mycobacterium paratuberculosis
VYGTVIQLARLIWRVQGLKITITGVENLPKSGGAVIAINHTGYLDFTFAGLPAYKQGLGRKVRFMAKQEVFDHKITGPIMRSLRHISVNRQDGAASYEAAVRNLKDGELVGVYPEATISRSFEIKEFKSGAARMAVEAGVPIVPHIVWGAQRIWTKDHPKKLWRPKVPIIVLVGEPIQPTLGVEELKGLLHSRMQHLLERAQEMYGPHPAGEFWVPHRLGGGAPSLAEAARLDAEEAAARAARRGQSAGAPE

SEQ ID NO: 1562 - protein, 259 aa, Mycobacterium paratuberculosis
MVEPTFRALELLAALAVKATGTEITYHGEENIPERGGAVVAINHTSYVDFLPAGLAVHRRGRRLRFMIKAEMQQVKVVNFLIKHTRTIPVDRGAGGGAYAVAVQRLREGELVGVYPEATISRSFELKEFKTGAARMAIDAGVPIIPLIVWGAHRIWTKDHPRTLGRAKIPITVQVGAPLRAREDIAQTDAALRDAMTTLLHQAQQHYPMQPGAYWVPRPLGGTAPTPAEAARMEADEAAARAAAAAAKKAANRAGRPGR

SEQ ID NO: 1563 - protein, 261 aa, Mycobacterium paratuberculosis
MAEGFYRLGEWVVPPLVAMQGTKFTYQGLENIPAQGGALLAQNHTSYLDWLPTLMAVRERHRRAYFMIKAEMADVKAVNYVIKHARLIPVDRRSGHDAFDVAVQRMREGELIGMHPEATISRSFELREFKTGAARMALAAQVPIVPIIVWGAHRIWPKDHPKKVFRNKVPITVAAGRPLPPRGTPEQLNAALREAMNALLYRVQEEYPHPKDEFWVPRRLGGGAPTQEDSRALRLSELQERMRKYGTDGVTRPGQRQSGLH

SEQ ID NO: 1564 - protein, 272 aa, Mycobacterium paratuberculosis
MTLPRLIACDVDGTLFDDDDERITPRTRAAVRAAVAGGARFVVATGRPPRWIRPVVDALGFAPIAVCANGAVIYDPAKDRVLSARTLDVDTLAELAELATRVIPGAGLAVERIGERAHDTATPQFISSPGYEHAWLNPDNTEVSIEDLLSAPAIKLLIRRAGARSSDMAAELAKHVGLEGDITYSTDNGLVEIVPLGISKATGIEEIARPLEIAREEVVAFGDMPNDLPMLRWAGHGVAMGNAHPEVQAAADEITAANNDDGVGRVLERWWL

SEQ ID NO: 1565 - protein, 536 aa, Mycobacterium paratuberculosis
LLTAIAATVVLVSWVGDATRDRGAAAAPPARGTQLTEQPLIGLGAGVTVREISQQSPFSLVALTGDLAGTSTRVRARRRDGSWGPWYQTEYETAAPDPGHAGGATEGPRGTDPVFVGTTTTVQIAVTRPLDAPVTQPPPAPPRPADDLGYRPASREQPFGQNISAVLISPPQAPSETHWTPPSGVVMPGQAPPIISRAEWGADESLRCGSPQYDNGIRAAVVHHTAGSNDYSPLESAGIVKAIYTYHSKTLGWCDIAYNALVDKYGQVFEGSAGGLTKAVEAFHTGGFNRNTWGVAMIGNFDDVPPTPVQLRAVGRLLGWRLGMDGVDPKGTVQLESAGSHYTTYAAGTVATLPTIFTHRDVGNTDCPGNAAYALMDEIRDIAAHVNDPPEELIKALQGGAIYAHWQEIGGMNSVLGAPTAPEDSAADDARFVTFVRGAMYWSPQTGAQPVTGAIYDAWGSQSYERGPLGLPTSAEIQEPLQITQNFQHGTLNYERLTGNVTEVLDGITTPLATQLPSGPTVPAEHFSLPTHPAAT

SEQ ID NO: 1566 - protein, 336 aa, Mycobacterium paratuberculosis
VPNRRRRKLSTAMSAVAALAVASPCAYFLVYESTAGNKAPEHHEFKQAAVMSDLPGELMGALSQGLSQFGINLPPVPALSGGATSTPGLASPGLGSPGLGTPGLGTPGLTNPGLTSPGATSPGLTSPGLTSPGLTSPGLTSPGAAPTTPGLTAPGALPTTPGGGVATPGAGLNPALSNPGLTSPAGTAPGLGSPTVAPSEVPIDSGAGLDPGAGGTYPILGDPSTFGNASPIGGGGTGLGGGSSSGGSGGLVNDVMQAANQLGAGQAIDLLKGLVMPAITQGMHGGAAAGALPGAAGALPGAAGALPGAAGALPGAAGAAGALPAAAGAAPALPPV

SEQ ID NO: 1567 - protein, 402 aa, Mycobacterium paratuberculosis
MTARFDLFVVGSGFFGLTIAERVATQLGKRVLVVERRPHIGGNAYSEPEPHTGIEVHKYGAHLFHTSNKRVWDYVRQFTDFTDYRHRVFAMHNGQAYQFPMGLGLVSQFFGKYFSPEEARKLIAEQAAEIDTADAQNLEEKAISLIGRPLYEAFVKGYTAKQWQTDPKELPASNITRLPVRYTFDNRYFSDTYEGLPVDGYTAWLQNMAAHENIEVRLNTDWFDVRDGLRAGSPEAPVVYTGPLDRYFDYAEGRLGWRTLDFEVEVLPIGDFQGTPVMNYNDLDVPYTRIHEFRHFHTERDYPTDKTVIMREYSRFAEDDDEPYYPINTEADRALLAAYRARAKAETASAKVLFGGRLGTYQYLDMHMAIASALNMYDNVLAPHLRDGASLTEAQSKQESGA

SEQ ID NO: 1568 - protein, 628 aa, Mycobacterium paratuberculosis
MSAVSLLSRIILPRPGEPLDVRKLYLEESTTNARRAHATSRTSLEIGKESEVSFATYFNAFPASYWRRWSICESVVLKVELTGTGRVDVYRTKATGVRISVQGRQFVGTDDQPAVVEIEVPLKPFEDGGWIWFDITTDTEVNLISGGWYATEPAPGTANIAVGIPTFNRPADCVNALADLTADPLVDKVIGAVIVPDQGTRKVRDHPDFPAAAAGLGNRLSIHDQPNLGGSGGYSRVMYEALKNTDCQQILFMDDDIRIEPDSILRVLALHRFAKTPMLIGGQMLNLQEPSHLHIMGEVVDQSNFMWTAAPHAEYDHDFAQFPLNDKNPRSALLHRRIDVDFNGWWTCMIPRQVAEELGQPLPLLIKWDDAEYGLRAGEHGYPTVTLPGAAIWHMAWSDKDDAIDWQAYFHLRNRLVVAALHWDGDITGLVRSHLKATLKHLACLEYSTVAIQNRAIDDFLAGPEHIFSILESALPEVHRLRKEYPDAVVLPAASELPPPRYQSKAMKPPVNPLSIGYRLARGIAHNATKADPEAHRRPQYNVPTQDARWFRLCTVDGVTVTTADGCGVVYRQRDRRKMFSLLFASLRRQRKLLTRFDEMRRVYRGALPVLSSKQKWETALLPAAEHA

SEQ ID NO: 1569 - protein, 166 aa, Mycobacterium paratuberculosis
VAALVAVQAALSKRPGVLTVARALSHFGEHSIGWVAAAALGALCSPRRRADWLAAGAGAFVAHAAAVVVKRIVRRERPHHPAVVVNVGTPSRLSFPSAHATSTTAAAILLGRITGLPLPAVLVPPMALSRMVLGVHYPSDVACGIALGAGVAAVARRAPQLARGDQ

SEQ ID NO: 1570 - protein, 305 aa, Mycobacterium paratuberculosis
MTEETQEAVAGPPANVVSGVIKAIRPRQWVKNVLVLLAPVAALGGPVQYDYTDVLGKVSVAFVVFSLAASSIYLVNDARDVEADREHPTKRFRPIAAGVVPEWLAYTLAVLLAAASLGIGWWLTPNLAAVMAVYIAIQLAYCFGLKHQAVMDICIVSSGFLLRAIAGGAATNIRLTQWFLLMMAFGSLFMAAGKRYAELQLAERTGAKIRKALESYTSTYLRFVWTLSATALVVCYGLWAFDREHGEARWFVVSMVPFTIAILRYAVDVDGGLAGEPEDIVLRDRVFQLLALAWMVTVGAAVAFG

SEQ ID NO: 1571 - protein, 691 aa, Mycobacterium paratuberculosis
MRRPGWPVFPYTTMVRSSLWIGVAVVAVLFAWGGWQRRWIADDGLIVLRTVRNLLAGNGPVFNQGERVEANTSTAWTYLMYAGSWVGGPLRMEYVALALALTLSVLGVALLMLGAARLYAPSLRGRRAIMLPAGALVYIALPPSRDFATSGLESGLALAYLGLLWWMMVCWAQPVRNRPDRREFAGALAFVAGFSVLVRPELALMGGLALIMMLVAARTWRRRALIVAAGGALPVAYEIFRMGYYGLLVPGTALAKDAAGDKWSQGMTYLSNFDAPYLVWVPAVLLVLLGVLLAAARRRPSFLRPPLAPNYGRVARAVHSPPAVVAWVLVSGLLQALYWIRQGGDFMHARVLLAPLFCLLAPVAVVPVMVPDGQDYSRETGNWVAGAACALWLGIAGWALWAANSPGMGDDATHVTYSGIVDERRFYAQATGHAHPLTAADYLGYPRMAAILTALNNTPRGRAAAAVGQLHPVGPGADGPAAARHHPRQVSAKAAAHRLFHQPGHGGDERRARRPGDRPDWSGESAGAAHRTPQARPDRARQEPVPGLGDRRRALGEGVSGDPGLPGRAVGRRGRLGAAVPGHPGGAGLGAGPDDPAPVPVQRAALLPIHRLPDRPGAALRARPLRAAGAGGSATAAARVSAAQKNFRPIRHRSGRGVRDKLAATSHLTPDQLATAVKHMRRRRLLYTCWM

SEQ ID NO: 1572 - protein, 164 aa, Mycobacterium paratuberculosis
VPMAQPPPGTTPDKFPQKPQHTVFFTNLGMVGMNVGLDVRVIDQIGLANPLAQHTERLKHGRIGHDKNLFPDWVIADGPWVKVYPGIPGYLDAQWVAEAVSALQCPDTRAVLASVRAPMTPHRFLSNALHSFQFTGYRIDRVPRYELARCGLPVPEEAPPPPRE

SEQ ID NO: 1573 - protein, 347 aa, Mycobacterium paratuberculosis
MTLVDRLRGAVAGMPRRLVVGAAGAALLSGLIGAVGGSATAGAFSRPGLPVEYLQVPSAAMGRDIKVQFQSGGANSPALYLLDGMRAQDDFNGWDINTPAFEWYNQSGISVAMPVGGQSSFYSDWYKPACGKAGCTTYKWETFLTSELPQYLSAQKQVKPTGSGVVGLSMAGSSALILAAYHPDQFVYAGSLSALLDSSQGMGPSLIGLAMGDAGGYKAADMWGPKEDPAWARNDPSLQVGKLVANNTRIWVYCGNGKPSDLGGDNLPAKFLEGFVRTSNLKFQDAYNGAGGHNAVWNFDANGTHDWPYWGAQLQAMKPDLQSVLGATPGAGPATAAATNAGNGQGT

SEQ ID NO: 1574 - protein, 300 aa, Mycobacterium paratuberculosis
VRGVSALLRVFCIAVLAAGLGVALQPAAVTGAARAAGYESLMVPSAAMGRDIPVAFLAGGPHAVYLLDAFNAAPDVSNWVTAGNAMNTLGGKGISVVAPAGGAWSMYTNWEQDGSKQWDTFLSSELPDWLAANKGLAPGGHAAVGASQGGYGAMALAAFHPDRFGFAGSLSGFLYPSSTNYNGAILAGLQQYGGVDGNGMWGVPQLGRWKWHDPYVHASLLAQNNTRVWVWSPTNMGGDDAAMIGQAGAAMGSSREFYQQYRSNGGHNGHFDFPGGGDNGWGSWAGQLGAMSGDIVGAIR

SEQ ID NO: 1575 - protein, 336 aa, Mycobacterium paratuberculosis
MPTNARRKRRRTLAWIAALSVAGVVLLVIVAAVVVLRGREAPPSAVPPGVLPPTSTTGHPHKPRPASQDASCPDVLLVNVPGTWESAPQDDPGNPLQFPNALLHKVTASLTEQFPPSRLQAYTTPYTAQFHNPLSGDTQMTYNASRAEGTRATVAAMTDMNNKCPLTSYVLMGFSQGAVIAGDIASDIGNGRGPVDDDLVLGVTLIADGRRQQGVGNDIGPNPPGQGAEVTLHEVPILSGLGLTMTGARPGGFGDLNAKTNEICAPGDLICAAPEEAFSVANLPATLNTLAGGAGQPVHALYATTQCWSLDGVPATDWTLNWAHGLIANAPQPKHG

SEQ ID NO: 1576 - protein, 632 aa, Mycobacterium paratuberculosis
MAYHNPFIANGKIKFPENTNLVKHVEKWARVRGDKLAYRFLDFSTERDGVACDISWSEFSARNRAVGARLQQVTEPGDRIAVLCPQNLDYLIALFGALYAGRIAVPLFDPSEPGHVGRLHAVLDDCTPSTILTTTEAAEGVREFIRARSAKERPRVIAVDAVPNEVNSTWVPPEADENTIAYLQYTSGSTRTPTGVEITHLNLPTNVLQVLNGLEGKEGDRGLSWLPFFHDMGLITAMLSPVLGHNFTFMTPAAFVRRPGRWIREMARKPDDAPDCEVFTVAPNFAFEHAAVRGVPKEGEPPLDLSNVKGILNGSEPVSPSSMRKFYEAFKPYGLRETAIKPSYGLAEATLFVSTTPMDQAPTVIHVDRAELNKQRFVEVPADAPNAVAQVSAGVIGVDEWAVIVDPETASELPDGHIGEIWLHGNNMGIGYWGKEEETNEVFRNILKSRISQSHAEGAPDDAMWVKTGDYGTYYKGHLYIAGRIKDLVIIDGRNHYPQDLEYSAQEASKALRTGYVAAFSVPANQLPKEVFDNPHTGLKYDPDDTSEQLVIVAERAPGTHKLDYQPIADDIRAAIAVRHGVTVRDLLLVQAGTIPRTSSGKIGHRACRAAYLDGSLRSGVGSPTAFANSTD

SEQ ID NO: 1577 - protein, 653 aa, Mycobacterium paratuberculosis
MRAGDDAERSDAEERRPTTVPEMREWLRNWVGRAVGKSPDEIDESVPMVELGLSSRDAVAMAADIEDMTGVTLSVAVAFQHPTIESLATRIIEGEPEAVDAGDDMDWSRSGPAERVDIAIVGLSTRLPGDMNSPDETWQALMEGRDAITDLPEGRWSEFLEEPRIAARVAGARTRGGYLKDIKGFDSEFFAVAKTEADNIDPQQRMALELTWEALEHARIPASSLRGEAVGVYVGFSNNDYQFLAVSDPTVAHPYAITGTASSIIANRVSYFYDFRGPSVAVDTACSSSLVATHQAVQALRNGECDVAIAGGVNALLTPLVTLGFDEIGQVLAPDGRIKSFSADADGYTRSEGGGMFVLKRVDDARRDGDQILAVIAGSAVNHDGRSNGLIAPNQDAQAEVLRRAYKDAGIDPRTVDYIEAHGTGTVLGDPIEAEALGRVVGRGRPADRPALLGAVKTNVGHLESAAGAASLAKVVLALQHDKLPPSINFAGPSPYIDFDGMRLKVIDSPTDWPRYGGYALAGVSSFGFGGANAHLVVREVLPRDVIEREPEPTPAPQAAAEPTELPEPQAHALRFDDFGNVIPDPEAPEEEEHELPGLTEEALRLKAIALEELAAQQESEPTKPLIPLAVSAFLTSRKKAAAAELADWMESP

SEQ ID NO: 1578 - protein, 1097 aa, Mycobacterium paratuberculosis
VVLAHDHEEAIKGLRAVAEGKQRPNVFSTDGPVTNGPVWAMAGFGAQHRKMGKNLYLRNEVFAEWIEKVDALIQDERGYSVLELILDDSHEYGIETSNVVIFAIQIALGELLRHHGAKPAAVVGQSLGEPASAYFSGGLSLADATRVICSRSHLMGEGEAMLFGEYIRFMALVEYSADELKTVFADFPGLEVCVYAAPSQTVIGGPPEQIDAIVARAEAEGRFARKLQTKGAGHTSQMDPLLGEFSAELQGIKPMSPTVGIFSTVHEGTYIKPGSEPVHDVAYWVKGMRHSVYFTHGIRNAVDSGHTTFLELAPNPVALMQIGLTTAAAGLHDAQLIPTLAKKQDDVESMISAMAQLYVYGHDLDIRTLFTRAKGPQDYANIPPTRFKRKEHWLDVHFSGDGSVIMPGTHVALPDGRHVWEYAPRNGETDLAALVRSAATQVLPDAQLVASEQRAVPGPGARLVTTMTRHPGGASVQVHARIDESFTLVYDALVSRAGQNVAALPTAVGAGAAIAAAPTVAAPEQPAQAPVEEDTNAETLSDSLTARYLPAGTGKWSPDSGETVAERLGLIVSAAMGYEPEDLPWEVPLIELGLDSLMAVRIKNRVEYDFDLPPIQLTAVRDANLYNIEQLITYAIEHRDEVEALHEHQKTLTPEEIAKEQAQLLSGATPASVAAPAPDPQAEPETQPAPPPPSDTPIPPPPTDPSGPSANGGQPKPSLAEALSSEAVTKALNSDVPPRDAAERVTFATWAIVTGKSAGGIFNPLPKLDADTAAKMAQRLSERADGPITVEDVQAAETIEALAERVRTYLEAGQIDGFVRTLRARPEGSTKIPVFVFHPAGGSTVVYEPLLKRLPPDTPMYGFERVEGSVQERAAQYVPKLLELNGDNPFVLVGWSLGGALAYACAIGLKRAGADVRFVGLIDTVRAGEEIPQTKEETRKRWDRYARFAERTFNVEIPAIPYEQLEELDDEGQVKFVLDIVQQSGVQIPGGIVEHQRTSYLDNRALETVQIEPYDGHVTLYMADRYHDDVIEFEPRYAIRQPDGGWGEYVADLEVVPIGGEHIQVIDEPIIGKVGAHLTDVLNKVEAQTSQTSEVGK

SEQ ID NO: 1579 - protein, 524 aa, Mycobacterium paratuberculosis
VTEMAPAPIQHTTAEKLAELYLRLELAKEPGGEKAAAKRDKKGIPSARARIHALVDPGTFLETGALAKTPNDPNALYGDGCVTGHAMIDGRPVGVFSHDQTVFQGTVGEMFGRKVARLMEWCAMVGCPIIGIQDSGGARIQDAVTSLAWYAELGRRHEALSGLVPQISLIFGKCAGGAVYSPIQDDLLVSVRDQGYFFVTGPDVIREVTGEEVTLDELGGSDAQARYGNIHHVVNTEAEAFQYVREYLSFLPSNCFDQPPIVNPGLEPEITPTDLELDSIVPDSDNMSYDMHEILLRIFDDGDFLEVAAQHGPAIITGYARVDGHPVGVIANQPMHLSGSIDNEASDKAARFIRFCDAFNIPLVFVVDTPGFLPGAEEEKRGIIKRGGRFLYSVVEADVPKVTITVRKSYGGAYAVMGSRQLTADFNFAWPTARIAVIGAEGAAQLLMKRFPDPTTPEAQQIKKDFIEGYNLNMAIPWTAAERGFIDAVIDPHETRLLLRKSLKLLRDKQLWFRVARKHGLIPV

SEQ ID NO: 1580 - protein, 297 aa, Mycobacterium paratuberculosis
VHAAKISKPRPAPGADDGVMDANLAAVADTALLVAAIRAHETTRDDRLFADPFAARLAGDRGRELLAGALAATGESATAQIVVRTRFWDDALLEAAQQISQVVILAAGMDARAYRLAWPDGTVVYELDQPEVLAAKDGVLAGERPACRRVAVGVDLAQDWPAALRRAGLDPSAPAVWLIEGLLQYLDEAAVTALFDRVDALSARGSVLLYDVVGKALLESEFMAPVLESMARSGAPWRFGTDDPGGLCERLGWSATVTDVAEPGNRYQRWYAPAVPMDVAGAPRGYFVQATKQAVGD

SEQ ID NO: 1581 - protein, 273 aa, Mycobacterium paratuberculosis
MTAPRLYRPSPPLAEHIEYFGYWRGDEALGVHTSRALPRGAVTAIVDVAGRTDLGFYASDARTPLTVPPLFAAGAGATAYVVRVAPAHTVMTIHFRPAGALAFLGCPLSDLEDALVGLEELWGRDAALLREQLIDAGSPPRRVALLQAFLVRRMRRNAVWPPARLAPVLRGADLDPSMRVSKAQELSGLSRKRFAALFRCEVGLSPKAYLRVRRLQAALRALDTPARGATIAADLGYFDQAHFLREFRAFTGVTPTQYARRRSSMPGHVELAR

SEQ ID NO: 1582 - protein, 589 aa, Mycobacterium paratuberculosis
MSDYAVEAVDRLPFSTAAKSQRYATENYCGAVGLNWYDTDPTLQFTMSYYLRPDELALAERHLSRIGELMGGPVARWAEETDRNPPRLERYDRWGHDISRVVMPPSFVQSKRAVLEAQQALRTEARAAKMSSSLPLFASNYLLNQADIGMGCALGTGGGMVQSLVAAYAPADVREHVLAKFASGEWAGETAQLLTERTGGSDLGALETTATRHGDSWLLNGFKWFASNCAGEAFVVLAKPEGAPDNSRGVANFLVLRTRRDGSRNGVRVRRLKDKLGTRSVASGEVEFVDAEAFLLSGEPTDGAASDGKGLGRMMELTNAARLGIALFGLGNARRALVESLCYARQRRAFGGALIDKPLMRRKLAELIVDVEAAQAMVFDGTGATNHRQPRGMRQRIAVPVTKLRVCRLGITAASDAIEIHGGNGYIENWPVARLLRDAQVNTIWEGPDNILCLDVRRGIEQTRAHETLLARLRDAVSVADDDEATRLVAGRIEDLDAAITAWGKLDKPLAEARLFALAQFMGDVYGGALLVEQAAWERATRGGDRKALVARLYAQRYLADRGALRGIDADSDEALQRFDELVDGAFRP

SEQ ID NO: 1583 - protein, 351 aa, Mycobacterium paratuberculosis
LDLSTRILFLMTDELDAQILHALQLAPRVSFRRIASVVGATEQTVARRYHRLRRDGVVRVVGLENRWADGDADWVCRIRAAPDRISRLADALVRRPDVSHANVLAGWTDLVCVIRAPLGDTREDLLTQLLPRTAAVTDISIDLMLHSFGDPVNAPWTGYGSALSDRQAQRIVAARAQPESGTHRSRPTAEDRPLLAALADDGRTPQSQLAARTGWSVARVSRRIAALEACGALVYDVDVLPERLGHRLSAMLWLTVAPRDVHTVGERIAAHPQIAFAGATSGSKNLMAVAICRDSDDLYRYLREQLGQLDGVLGYEVNVRTQRLKQHGSLVAHGRLINPHPGAGGRVTSQR

SEQ ID NO: 1584 - protein, 309 aa, Mycobacterium paratuberculosis
LVAASAISTPPLSAWKLGLRSAHMHIEIGLPSHIAHVRGRLTVEWARRAEHRGFAGLAAIDRLVYPSLDAMTALAVAAGATTGIGLTFNVLLAPLYPAVLLAKQVITLAEASGGRLRLGLGVGSRCDDYTAVGVDYRRRGRILDETAALLRAACEAEVVTGDQPLCPAPVRIPILFGGRADATIRRAVTVGDGWTAGALRDYANQSVFAERVRAAWAARGRSGRPWLQASVNFAFGDDEAVAAGRRHLQSYYGFKPDYAALNVADMLTTPQEAAQTVRAYADLGFDRLVFHPCVPDTGQVDRLANAVLG

SEQ ID NO: 1585 - protein, 171 aa, Mycobacterium paratuberculosis
MHTLIRLGTHAAAITALILPAAVSSPATAAAEVGGTTVVFDNYLRRCDFSKVSIAPKVPSPMLGTGSAVVRVNGSTAVAEVHLVDAPEPGMHFDVGLIEEPRPSSAGCGPGDPGTAFTGMDLDGAGRGTATVSDTVRPGTTGVWLIIERPNPNSQNPAEFYTSEFVVPVGA

SEQ ID NO: 1586 - protein, 1065 aa, Mycobacterium paratuberculosis
MSVSTVGGDVRVTRWVATIAGLIGFVLSVATPLLPVVQTTATLNWPQGGQLNSVTAPLISLTPVDLTATVPCSSVRDLPPEGGVILSTGPKKGKDAALNALFVVAHGKRVDVTDRNVVIASASRDQVAGAGCSRIEITSTRAGTFATFVGLTDPAGKPLGGGFPDPNLRPQIVGVFTDLTGPSPAGLKLSATIDTRFSTTPTTLKLAAMVTAILATIVALVALWRLDQLDGHRMRRLIPANWRTFTLADVAVIFGFVLWHVIGANSSDDGYILGMARVADRAGYMSNYFRWFGSPEDPFGWYYNLLALMTHVSDASLWMRLPDLFAGIVCWLLLSREVLPRLGPAVAASRPANRAAGMVLLTAWMPFDNGLRPEPIIALGSLVTYVLIERSMRYSRLTPAALAVITAAFTLGVQPTGLIAVAALVAGGRPILRILVRRHRVVGTWPLVAPMLAAGTVILTVVFADQTLATVLEATRIRTAIGPSQAWYTENLRYYYLILPTVDGSLSRRFGFLITALCLFTAVFIMLRRKRIPGVARGPAWRLMGVIFGTMFFLMFTPTKWVHHFGLFAAVGAAMAALTTVLVSPAVLRWSRNRMAFLAALLFMMALCFATTNGWWYVSSYGVPFNSTMPKIGGITVSTVFFAMFVAAALYAIGLHFASREHGDGRLARALTAAPVPLAAGFMALVFIASMVAGIVRQYPTYSNAWDNLREFSGGCGLADDVLVEPDSNVGYMTPLGGDYGPLGPLGGQHPVGFSPNGVPEHTVAEAIRITPNQPGTDYDWDAPTKLSAPGINGSTVPLPYGLDAARVPLAGSYTTGAQQQSRLTSAWYRLPAPDDGHPLVVVTAAGKIAGNSVLHHHTDGQTVVLEYGRPGPGGDIVPAGRLVPYDLYGEQPKAWRNLRFARSDMPADTVAVRVVAEDLSLTPEDWIAVTPPRVPEMRSLQEYVGSTQPVLMDWAVGLAFPCQQPMLHVNGVTEIPKFRITPDYTAKKMDTDTWEDGTNGGLLGITDLLLRAHVMSTYLSHDWGRDWGSLRRFETIADAHPAQLDLGTATRTGWWSPGPIRIKP

SEQ ID NO: 1587 - protein, 1108 aa, Mycobacterium paratuberculosis
VPHDGKQRSQRIPRSVAAVAGIAGLLLCLAVPLLPVRQTTATVLWPQGTVDGHVSQITAPLVSGAPRALDISIPCPAVATLPADGGLVVSTLPPGGMDAGKNGLFVRANKDVVVVAFRDTVAAVAQRPAVAAGACSVLHAWADAGAAGAEFVGIPGAAGTLPAEKKPQVGGIFTDLKVPAGPGLSARVDIDTRFITAPTVLKQIVMVLGTLAVLTAIVALAVLDRHSRGGGTLINWRSPIAWLSRYRPGTHLANWRRVGLATWIADAAVLATLLLWHVVGATSSDDGYNLTIARVAPKAGYLVDYYRYFGTTDAPFDWYLGLLSRLASVSTAGVWMRLPATLAGIGCWLIISHWVLRRLGPGRGGLAANRVAVFTAGAVFVAAWLPFNNGLRPEPLIALGVLVTWMLVERAIALQRLAPAAVAVVVALLTATLAPQGLIAVAALLTGARAVAQTMRRRRASDGLLAPLAVLAAALSLILVVVFRSQTVATVLESARIKYKVGPTIAWYQDWLRYYFLTVESNPDGSMARRFAVLVMLLCLFGMLVILLRRGHVPGVASGPAWRLIGTTAVGLLLLTFTPTKWAVQFGAFAGLAGALGALTAFACSRIGLHNRRNLTLYVTALLFVLAWATSGINGWFYVGNYGVPWYDIQPVIASHPVTSMFLTLSIITGLLAAWQHFRMDYAGHTEVKDSRRNRVLASTPLLVVATIMVVGEVASLTKGAVFRYPLYTTGKANLAAIASGLSPTSCAMADDVLAEPDANAGMLQPLPGQTFGPDGPLGGVNPVGFKPDGVGDDLQSDPVVTKPGLVNSDASPNKPNVAYSDSAGTAGGKGPVGVNGSHAALPFGLDPARTPVMGSYGENSLAATATSAWYQLPPRTPDRPLVVVSAAGAIWSYKEDGTFTYGQSLKLQWGVARPDGSTVPLAEVQPIDIGPQPAWRNLRFPLAWAPPEANVARIVAYDPNLSSEQWFAFTPPRVPVTETLQQLIGSQTPVMMDIATAANFPCQRPFSEHLGVAELPAYRILPDRKQTAASSNLWQSSEAGGPFLFLQALLRTSTIPTYLRGDWYRDWGSVEQYFRLVPADQAPDAAIEQGVMTVHGWSRQGPIRALP

SEQ ID NO: 1588 - protein, 379 aa, Mycobacterium paratuberculosis
LGFGVLGPLSVTAGGAQLPLGAPKQRAVLAMLLIHRNRPVSVDALIDGVWGAAPVPAARTSIQSYVSTLRRLLRSALPNPNGLLASVPPGYQLNVADADCDLGRFRGHKTAGVQAASRGRFEEASGHLAAALREWRGPVLDDLHNFAFVDAFANLLLEERVAAHTARAEAEIACGRADGVIGELEALVAQHPYREPLWAQLITAYYVTERQSDALGAYRRLKTALAEGLGIDPGPTVKALQQRILRQEPLGPGQPGKAARRAMLSTHKQSTVRSESAAAVIDNPVVARLRDKAGRHYQLNGVTTRIGRLDDNEIVLDDTEVSRHHAVIIDTGTDFLITDMKSTNGVQVRGRRVQRSATLVDGDHICIGNSEFVFEIRPA

SEQ ID NO: 1589 - protein, 226 aa, Mycobacterium paratuberculosis
LRPGGRRPRFGVCEHRPTAMTSELMAMARAERADLAEFLATLGPRDWEAPSLCSRWSVKDVVAHVISYEELGAFGLLKRFAKGWVVRANQVGVDEFADLTPQQLLEFLREHLEPRGLTAGFGGMIALVDGTIHHQDIRRALGRPRVVPPDRLQRVLSLVPGNPRLGAGRRIRGLRLRATDIDWTHGDGPQVSGPGEALLMAMSGRPAALADLDGPGRATLAARLGQ

SEQ ID NO: 1590 - protein, 1091 aa, Mycobacterium paratuberculosis
MSTDTGSRIAEELASSSVHDTEANHRIARWVASVAGLLGVLLAVATPLLPVDQTTAQLNWPQNGSFGSVEAPLIGYVATDLNITVPCQAAAGLAGRGNPGKTVLLSTVPKQAPKAVDRGLLIVRANDDLVLVVRNVPVVTAPLSQVLGPACQRLTFTAHADKVTAEFVGLTQGPNTEHPGVPLRGEKSGYDFRPQIVGVFTDLSGPAPPGLSFSATIDTRYSSSPTPLKMAAMILGLVLTGAALVALHILDTADGTRHRRFLPARWWSIGGLDALVIAVLTWWHFVGANTSDDGYILTMARVSEHAGYMANYYRWFGTPEAPFGWYYDLLALWAHVSTTSIWMRLPTLAMALTCWWVISREVMPRLGHAVKQNRAAAWTAAGMFLAVWLPLDNGLRPEPIIALGILLTWCSVERAVATSRLLPVAVACIIGALTLFSGPTGIASIGALLVAIGPLRTILHRRITRFGALPLIAPLLAAATVTAILIFRDQTLAGEVQASMLKRAVGPSLSWFDEHIRYERLFMASPDGSVARRFAVLALVLALGVTVAMSLRKGRIPGTATGPSRRIVGITIISFVAMMFTPTKWTHHFGVFAGLAGPLGALAAVAVTAAAMRSRRNRTVYAAVVLFLVALSFASVNGWWYVSNFGVPWSNAFPAWHYAFATALLGLTVLVLLLAAWFHFVAPDDGPPKTRWGARLAGIIQSPLAIATWALVVFEVASLTLAMTDQYPAWSVGRSNLQALTGKTCGLAEDVLVEQDPSAGLLSPVGGPAGPSAADALGAGLSEAFTANGIPADVRADPVMERPGDRSFVNDEEKTGSNQAGTEGGTTPAPGINGSSAQLPFNLDPARTPVLGSWRSGIQVPAHLRSGWYRLPARDKARPLLVVSAAGRFDPREVQVQWATDEQAAGGHPGGSFQFADVGASPAWRNLRLPLSAIPAAATQVRLVADDEDLAPQHWIALTPPRIPQLRTLQDVVGSKDPVFLDWLVGLAFPCQRPFGHQNGVDETPKWRILPDRFGAEANSPVMDNNGGGPLGVTELLAKATTMATYLKDDWSRDWGSLQRLTPYYPDARPAQLLLGTATRSGLWNPAPLRH

SEQ ID NO: 1591 - protein, 357 aa, Mycobacterium paratuberculosis
MALWLAGLRWRRHGIRAALEPLRRLAVIVGIAVAIGCTTWLPFLVRAARNPVSNTGSAQHYLPADGAELTFPMLQFTLLGVVCMAGTLWLVLRARASVRAGALAIGVLAVYLWSLLSMLTTLARTTLLSFRLQPTLSVLLVAAGAFGLVEAALALRRRSRAVIPVAGAIGLAAAIAFSQDIPDVLRPDLTIAYTDTDGHGQRGDRRPPSAEKFYASIDDVITRETGRPRDQTVVMTADYSFLSFYPYWGFQGLTSHYANPLAQFDLRAAQIDKWSKLKTADELLHALDTCPWPPPTVFLMRHGANNTYTLRLAEDVYPNQPNVRRYTVELRAALFDSPRFAVHRVGPFVLAVRKPAA

SEQ ID NO: 1592 - protein, 263 aa, Mycobacterium paratuberculosis
MRSALATLGQMAVAVLVAVVVAVVSLTAIAGVQWPAFPSSNQLHALTTAGQVGCLAGLVAVGWVWHSFTGRVRRLAQLGGLVFVSAFTVVTLGMPLGATKLYLFGISVDQQFRTEYLTRLADSPALRDMTYLGLPPFYPPGWFWIGGRAAALSGTPAWEVFKPWAITSITVAVAVALVLWWRMVRFEYALIVTTATAAVTLAYGSPEPYSAMITVLLPPVLVLTWSGLRAGECRAGGTARGRGWRGTRDRRACGWRGARERRA

SEQ ID NO: 1593 - protein, 254 aa, Mycobacterium paratuberculosis
MVLDAVGNPQTILLLGGTSEIGLAICERYLQNAHARIILAAMPGDPGRDAAVEQMKAAGARSVEVIDFEATDTDTHPKMIEQAFAGGDVDVAIVAFGILGDAEELWQDQRKAVQAAEINYTAAVSVGVLLAEKMRGQGFGQIIAMSSAAGERVRRSNFVYGSTKAGLDGFYLGLGEALREYGVRVLVIRPGQVRTRMSAHVKEAPLTVDKEYVANLAVTAAAKGKELVWAPAAFRYVMMVLRHIPRPIFRKLPI

SEQ ID NO: 1594 - protein, 466 aa, Mycobacterium paratuberculosis
MSSTDPLITPARLTGFGRTAPSVAQVLRTRDPEVIAKAVARVADSGHSKSRGVIARGLGRSYGDNAQNGGGLVIDMTGLNRIHSISADTRLVDVDAGVSLDQLMKAALPFGLWVPVLPGTRQVTVGGAIACDIHGKNHHSAGSFGNHVRSMELLMADGTVRTITPDGPDASDAELFWATVGGNGLTGIVLRATIAMTPTETAYFIADGVATKDLDETVAVHLDGSEADYTYSSAWFDLISPPPKLGRAAVSRGSLARLDQLPKKLAKNPLKFDAPQLLTVPDVFPVSAMNKLSFMAIGEVYYRLGGTYTGKIMNLSQFYHMLDLVSGWNNAYGPRGFAQHQFLVPPDAMDEFKAIIRWIQTRGHYSALNVFKLFGPGNRAPLSFPMAGWNVAMDFPNKPGVNEFLNELDRRVLQFGGRVYTAKDSRTNAETFHAMYPRIDEWIAVRRKVDPTGVFASDMARRLELL

SEQ ID NO: 1595 - protein, 121 aa, Mycobacterium paratuberculosis
MRFVVTGGLAGIVDFGLYATLYKVVGVQVDVAKAISFIVGTITAYLINRRWTFQAAPSTARFVAVMALYAVTFAVQVGLNHLWLAFLHYRGWAIPVAFVIAQGTATVINFVVQRAVIFRIR

SEQ ID NO: 1596 - protein, 158 aa, Mycobacterium paratuberculosis
VTNKRQSPADAARKNLEAELDRLRQRRDRLEVEVKNDRGMVGDHGDAAEAIQRADELVVLSDRINELDRRLRAGPPDSDASATLPGGTEVTLRFADGEVVTMHVISIVEETPVGREGETLTARSPLAQALAGRQPGDTVTYPTPQGEKQVELIAVKLP

SEQ ID NO: 1597 - protein, 295 aa, Mycobacterium paratuberculosis
MEIVASGPGFAAELRGVTIADVAASPDVYAQVRAAFEEHSVLIFRDQHVSDEAQLAFSRRFGPLEVTKVGAVGRGSHLVVLKTLDDDGNVVPTDHRLALENKANQLWHTDSSFKRVPALASVLSSRIVPGRGGETEYVSTRIAFERLDPGLRERVENSFAWHEYAYSRGKIAPDLARPEERAALPPQCWRLVWRNPVNGRKALYLASHAYGIEGMEPAAARELLAALTEAATAPGASYLHSWRAGDVVMWDNRATMHRGRPWPAHQPRYMVRSTIAATAADGLEAMYPPWHAVAR

SEQ ID NO: 1598 - protein, 276 aa, Mycobacterium paratuberculosis
MTFLDAAAQSRTLRRARSDLVDGFRRHELWLHLGWQDIKQRYRRSVLGPFWITIATGTTAVAMGGLYSKLFHLELSVHLPYVTLGLIIWNLINAAILEGADVFVANEGLIKQLPTPLSVHVYRLVWRQMILFAHNIVIYVVIAMIYPKPWSWADLSVIPALALIVLNCIWVSLCFGILATRYRDIGPLLFSVVQLLFFMTPIIWNDDTLRQQGAGRWSSIVELNPLLHYLDIVRAPLLGSHQELRHWAVVLVLTAVGWLLAAFAMRQYRARVPYWV

SEQ ID NO: 1599 - protein, 229 aa, Mycobacterium paratuberculosis
MSDTVFAVVVTHRRPDELAKSLDALSSQTRLPDHLIVIDNDACDDGRVRELVAAQPIPTTYLQSRRNLGGAGGFALGMLHALAQGADWVWLADDDGRPQDARVLATLLACADKHGLAEVSPMVCNLDDPERLAFPLRRGLVWRRRASELRTEAGQDLLAGIASLFNGALFRASALESIGVPDLRLFIRGDEVEMHRRLVRSGLPFGTCLDAVYLHPCGSDEFRPILGGR

SEQ ID NO: 1600 - protein, 268 aa, Mycobacterium paratuberculosis
MAPGSGPHIETRNAWVEFPIFDAKSRSLKKAFLGKAGGTIGRNTSNVVVVEALRDITMSLELGDRVGLVGHNGAGKSTLLRLLSGIYEPTRGWAQVTGRVAPIFDLGVGMDPEISGYENIIIRGLFLGQTRKQMLAKVDEIAEFTELGDYLSMPLRTYSTGMRVRLAMGVVTSIDPEILLLDEGLGAVDADFMKKAQSRLQGLVERSGILVFASHSNEFLARLCKTAMWIDHGQIRMSGGIEDVVRAYEGEDAARHVREVLAETAEQP

SEQ ID NO: 1601 - protein, 168 aa, Mycobacterium paratuberculosis
LSTRNDDDGVEVIGGVDPRMMGVDDDADESSLTDLVEQPAKVMRIGTMIKQLLEEVRAAPLDDASRNRLREIHATSIRELEEGLAPELREELDRLTLPFNEDAAPSDAELRIAQAQLVGWLEGLFHGIQTALFAQQMAARAQLEKMRQGALPSGIGKPGSAPGHGQYL

SEQ ID NO: 1602 - protein, 657 aa, Mycobacterium paratuberculosis
VGLWFGTLIALFLLIAPGAIIARISQLTWPIAVAVGPALTYGMVALAIIPFGAIGIPWNGWTALAALVVVCLLMTGLQLLLARFRDRDAEARAVSRWPAAAVAAGVLLGAFLIMWAAYRGLAAHWQTIPSTWDAVWHANEVRFILDTGQASSTHMGELRNVETHQMLYYPSVFHALIAVFCQLTGAAPTTGYTLSSVAASVWLFPTSAALLTWRLLRPSWGEWRTAGAAATAGALSASFTAVPYVEFGVAAMPNLAAYGVAIPTFVLITSTLRHRDRIPAAVLALVGVMSVHITGGVIVLLFLIAWWLLDALWHPVRGRLADVAALVCVTAISGLILLPQFISVQQQEDIIAGHSFLTYLSKKRGLFDAVFQHSRHLNDFPVQYGLIALAAIGAIVLLVKKIWWPLAVWLLLVVVNVDAGNPLGGPIGALAGAFGEFFYKDPRRISAAITLLLEPMAGLALFLVVTACVAGAKRAGGRWRPLPAPVWVSATAVLLVATTMLSARHYLYRHLVLFGDKYDSVMIDQRDLMAMAYLAKLPGAHETLIGNGNTDGTAWMYAVADLHPLWTHYDYPQQMGPGPNRFIFWAYARRGDSDPRVVAAIKALNIRYILTSTPTVRGFAVPEGLVSLDKSKSWALIYDNGGARIYEWRAEATTPHP

SEQ ID NO: 1603 - protein, 398 aa, Mycobacterium paratuberculosis
MAYDVARVRGLHPSLGDGWVHFDAPAGMLIPDSVATTVSTAFRRSGPTTVGAHPSAQRSAAILEAARAAVADLFNAEPAGVVLGADRAILLSALAEASSSRAGLGYEVIVSRLDDEANIAPWLRAAHRYGAKVKWAEIDIETGELPTWQWEGLIGKSTRLVAVASASATLGTVTDLRAMTKLVHDVGGLVVVDHSAAAPYRLLDVKETDADVVAVNAAAWGGPPIGAMVFRDPALLNSFSSISADPKATGAARLEIGAHQFGLLAGVVASIEYLASLDESARGTRRERLAVSMQSATSYLNRIYDYLMVSLRSLPLVMVIGRPEVRIPVVSFALHGVPAERVVQRLADNGILAVTNESSRALDVLGVNDVGGAVTVGLAHYSTTAEVDQLVRALASLG

SEQ ID NO: 1604 - protein, 323 aa, Mycobacterium paratuberculosis
MRAIVAESADQLSWQEVADVSAGPGEVVVKVAAAGVNRADVLQAAGKYPPPPGASETIGMEVSGVIAEVGDGVTEWSVGQEVCALLAGGGYAEYVAVPAGQLLPIPAGVDLVDAAGLPEVACTVWSNLVLIAGLRNGQRLLVHGGASGIGSHAIQVAQALGARVAVTAGSAEKLDFCRELGADITINYRDEDFVARLADETRGADVILDIMGAAYLDRNIDALATDGQLVIIGMQGGVKAELNIGKLLAKRARVIGTTLRGRPVSGPNSKTEIVQAVTASVWPMIADGRVRPIIGARLPIQQAGDAHRRLVASEVTGKIVLTV

SEQ ID NO: 1605 - protein, 372 aa, Mycobacterium paratuberculosis
MDSQRFRKLLDAPGPFVSVYFDDSHDTHDAEAQLELKWRAIREDLERRGVGVPIVAGIEDAVMNLRPPIGRSGRAVIAGADGVLINEHLARPAATTILRVSELPYLVPVLEQSFDHPDYVLVVVDHSGADITTHIGGTLRSETVDGTGYPVHKAAGAETAGYGDPQLRTEEAARKNVRAVADRVAELADDKAIDVIFVVGEVRSRSDLLAALPERLHDRAVTLEVGARHSGHDFTEIERAIEAEFVKRQLRAIDDAAQRFTAEIGRQSGLAAQGLDAVCSALRQGAVETLIIGDIGDATVVADEGLTTVAPNENVLSEQGAAPARTLRADEALPFSAIKVGANLVRTDERIAPADGVGAVLRYAPTLHQSVE

SEQ ID NO: 1606 - protein, 63 aa, Mycobacterium paratuberculosis
MATYRVLNPKGDVVATKDIESADKAHAWFADQKVEGNELGWRMEVEHDGQWHFFDDSEGDRSY

SEQ ID NO: 1607 - protein, 414 aa, Mycobacterium paratuberculosis
VTTPTPDGKIRLPADLDAVTTIGAEDHSEIDAAAVDRIWAAARHWYQGGFHPAIQLCIRRHGRVVLNRAIGHGWGNAPSDPPDAEKIPVTPDTPFCVYSAAKGIAATVVHMLVERGVFSLDDRVCDYIPAFTSHGKHRITIRHVMTHSAGLPFPTGPRPDVTRADDHEYAQQKLGELRPLYRPGLFHMYHALTWGPLVREIVYAATGKEIREILATEILDPLGFRWTNFGVAKQDVPLVAPSHATGRTLPPVVAQIFRKAIGGTVHEMIPYTNSPMFLTTIIPSSNTVSTAHEMSRFAEIWRRGGELDGVRVISPETVYHAVAECRRLRPDFAVGLQPARWGTGFILGTNRWGPFGRNAPHAFGSLGLTNIAIWADPARGLAAGVISSGKPGRDPEARRYTALMDTITAAIPRD

SEQ ID NO: 1608 - protein, 274 aa, Mycobacterium paratuberculosis
MAQAYESVTVEKKGHVAQVTLIGPGKGNAMGPAFWSELPELFETLDADPEVRAIVLTGSGKNFSYGLDVPAMGGSFTPLLSGDALAGPRAVFHREVKRMQGAITAVADCRTPTIASVYGWCIGGGVDLISAVDIRYASADAKFSVREVKLAIVADVGSLARLPYILNDGHLRELALTGKDIDAARAEKIGLVNDVYADADACLAAAHATAAEIAANPPLTVHGIKDVLDQQRVSAVAESLRYVAAWNAAFLPSKDLTEGIAATFEKRPAQFTGE

SEQ ID NO: 1609 - protein, 195 aa, Mycobacterium paratuberculosis
MAPDLRPGPDSPPTDELDGAEAALRVMQQVLHPIAADDMSRPTPCAQFDVTRLTDHLLKSLEALGGMAGADVPDHADSGDSVERQVIAVARPALDAWRQRGLDGTVSFGGGEMPARNACAILALELLVHAWDYARAVGRDVRAPEPLAEYVLGLAHRVIRPEVRGQAGFDDPVEVPADADALTKLVAFTGRNPAR

SEQ ID NO: 1610 - protein, 153 aa, Mycobacterium paratuberculosis
VDLARKKFTEFKERSGDIPDSELDDFWAELAPATIEEMLGEWKGGEFRTGHKMNGQLEKAGWFGKTFKSARDVQPLVCLDADGNKFSNVELGKGEASLWLEEFRGEVTATMVYDGQPVHDHFKKIDDNAVMGIMNGKGVRDNGKYYYFYLERV

SEQ ID NO: 1611 - protein, 355 aa, Mycobacterium paratuberculosis
VTARLRPELAGLPVYVPGKNVPGSIKLASNETVYGPLPSVHAAIERAVAVVNRYPDNACVDLKAALAMHLGSDVAPEQIAVGSGSVTLCQQLVQITSAAGDEVMMGWRSFECYLPIVQVAGAIAVKVPLREHTYDLDAMLAAITDRTRLIFVCNPNNPTSTVVDPDALVRFVDAVPADILIAIDEAYVEYIRDGLLPNSLELALSRSNVVVLRTFSKAYGLAGLRVGYAIGHPELITALDKVVMPFAVTNVAQAAAIASLEASGELMARTDALVAERTRVSTALRDAGFELPPSQANFLWLPLGSRTEDFVQEAANARLVVRPFASEGVRVTIGAPAENDALLQFACDWIARTER

SEQ ID NO: 1612 - protein, 395 aa, Mycobacterium paratuberculosis
MRELSVAEQRYQAVMAVISDGLSVSQAAEKFGVARQTLHRWLARYEAAGLEGLVDRSHRPVSCPHQMPAVVEAEMLELRRSRPYWGPRRLVFELAKRGVHPVPSESAVYRALVRAGLIDPAMRDRRSRKWKRWERGAPMELWQLDIVGGFPLADGTSAKALTGIDDHSRMCVCAKLMARERTRAVCDGLRAALAAYGVPEQILTDNGKVFTERFCHPPVEVLFDAICREHGIEHLLTQPRSPTTTGKIEQFHRSLRAEFLSGREPFTNLKVAQQALDEWVEDYNTTRPHQALKMITPAQRFHAGAPASPPSNSCARHVDRSGDDWVSRRVCSNGIVCVSWQQVCIGRHYAGARCDVHVDGDLLRFWVGDNLVKTAARTSRGEVRNKQALRTNAPA

SEQ ID NO: 1613 - protein, 104 aa, Mycobacterium paratuberculosis
VPPYPEDPDYYSEPTQAARYGGGYGEYGGYDDRPPPEPPTPWYRRPAALVAFGALGVLLLGAVVFAAVKLATSSPAHSPATTTTTTTPSTTAAVAVAPRRRPRR

SEQ ID NO: 1614 - protein, 359 aa, Mycobacterium paratuberculosis
LQGSAMTPTSPEGMTVDAVDLPAVADWMSAQGLGEGPLHDVATLTGGTQNVMLRFSRAGRSYVLRRGPRHLRPRSNNVILRETKVLAALAGSDVPHPHLIAVCDDPGVLGDAVFYLMEPVDGFNAGEGLPPLHAGNPQVRHQMGLSMADALAKLGAVDHVAVGLADFGKPEGFLERQVPRWLSELESYSQYDGYPGPQIPGIDQVSAWLERHRPAHWTPGIMHGDYHAANVMFSRTGPEVVAIVDWEMCTIGDPLLDLGWLLATWRQPDGSAVFSHALGGQEGLASTDELFRRYAANTSRDLSHIAWYTVLACFKLGIVIEGTLARACAGQAEKEVGDQLHAATVHLFERALRLIDEQG

SEQ ID NO: 1615 - protein, 314 aa, Mycobacterium paratuberculosis
MPRTDNDSWDITQSVGATALGVAAARAAETESENPLISDPFARIFVEAAGKGMWSIYADPALLTKADDLEPDLRGRLQLMIDFMATRTAFFDEFFLAAADAGVRQVVILAAGLDARSWRLPWPDGTVVYELDQPKVLDFKSTTLREHGAQPKAELVNVPIDLRQDWPKALQEAGFDASRPAVWSAEGLVRYLPAQAQDLLFERIDALSAPGSRLASNVPDSGFTDPDRLARQREDMRRMRAAAAKLVDAEITDFDDLWYPEERTPVDSWLRERGWDVSTATFAELMARYGRSIPQGAQDSMPPTLYVSARRRAG

SEQ ID NO: 1616 - protein, 79 aa, Mycobacterium paratuberculosis
LEVTMRGSGIIGTVALVWLLIGVFAAWQRDYFKNDQTTCASAGTVAVTVIAGPLNYFGVNPKVTDCHLPQPSSMQSINI

SEQ ID NO: 1617 - protein, 51 aa, Mycobacterium paratuberculosis
MVILGIVLLVLGYFFHVPVLSTLGIVLLVIGAVLWILGSIGRPVAGRRYWY

SEQ ID NO: 1618 - protein, 246 aa, Mycobacterium paratuberculosis
VSQPRASAERVVMCRADGNPINVLVVDDEAVLAEMVSMALRYEGWNIATASDGASAIAAARNQRPDVVVLDVMLPDMSGLDVLHKLREENPQLPVLLLTAKDAVEDRIAGLTAGGDDYVTKPFSIEEVVLRLRALLRRTGVTTVDSGAQLVVGDLVLDEDSHEVTRAGEPISLTSTEFELLRFMMRNSKRVLSKAQILDRVWSYDFGGRSNIVELYISYLRKKIDNGREPMIHTLRGAGYVLKPAR

SEQ ID NO: 1619 - protein, 496 aa, Mycobacterium paratuberculosis
LADTRRVWSLRLRLLVGQIVVLALVCLGITAVTELALNHHLVKQLDGQLAGTSFRSALMYPEPNHPRHEHSPYPRPGPGPRFLDAPGQPAGMVAAVVSHGKTVDAGYLTSSGARDALTSTAQTQLEQIAGSRAPVTVNLDGLGRYRVVAAPSRNGSDIIVTGLSMANIDATLIRMLVIFGIVTVIALAAATIAGVVIIRRALAPLRRVAQTAREVADLPLARGEVELPVRVRESDANPSTEVGQLGAALNRMLDHIADALSARQASETRVRQFVADASHELRTPLAAIRGYTELTQRMGDDREAVAQAMSRVASETERMTRLVEDLLLLARLDSGRPLEREPVDLSRLAVDAVNDAHVAGPDHQWELDLPEEPVVVTGDAARLHQVLTNLLANARVHTGAGTVVTTRLSTEPAHTVLQVIDNGPGIPAELQSEVFERFARGDSSRSRKGGSTGLGLAIVSAVVKAHNGTISVNSSPGHTEFTVRLPPNGWQPHASA

SEQ ID NO: 1620 - protein, 161 aa, Mycobacterium paratuberculosis
VKRQLTIAVAGAAILAAGVSGCSSGNKSAPSSSASSSSTSASASSGGAAGTKVIIDGKDQNVSGSVVCTNAGGTVNIAIGGAATGIAAVLSDGNPPQVKSVGLGNVNGVTLGYTSGTGQGNASAEKNGNSYKITGTATGVDMANPLQPVNKPFEIDVTCNS

SEQ ID NO: 1621 - protein, 624 aa, Mycobacterium paratuberculosis
MDHKPPSPVIEAAHRACVLPFSDDADFRDADRGFIAALSPCVVRGADGRVVFDNDAYAFLDGPAPTSVHPSLWRQSTLAAKHGLYEVVPGIYQVRGLDISNVTFVETDTGIIVIDPLVSTEVAAAALTLYRTHRGGDRPVVAVIYTHSHVDHFGGVLGVTTQADVDAGRVEVLAPEGFVEHAVQENVYAGPAMLRRATYMYGTLLPRGPRDHVGCGLGQAASMGEVALIVPTVDIRETGETHTIDGVEIEFQMAPGTEAPAEMHFYFPQFRALCMAENATHNLHNLLTLRGALVRDPRAWSGYLTEAIDTFADRADVVFASHHWPTWGRDGIVEFLSLQRDLYAYLHDQTLRLLNQGHTGVEIAEMFRLPPALERAWHARGYYGSVSHNVKAIYQRYMGWFDGNPARLWPHPPEALGPRYVAAMGGIDRVVDLAQQAFDSGDYRWAATLLDHAMFTDGEHAGARELYADTLEQLAYGAENATWRNFFLSGATELRDGNFGTAGQVTSPTMLAQLTPEQIFDGLAIRVNGPRSWGLDITVDVTLADTAVNHRLALRNGVLVQRKVPADPATATVTVRLANKIRLLALAAGDFASPGLELTGDRGALQALVGALDAPDPDFNIVTP

SEQ ID NO: 1622 - protein, 322 aa, Mycobacterium paratuberculosis
MRAVVCRSYGTPEDLVLDEVPDPVPGPGQLLVRVRAAAVNFPDVLFIAGKYQVKIPPPFIPGNEIAGEVIAAGEGARFVPGQRVAGTTFGAFAEQALLNADQAEPIPDDADFASAAAFGVTYRTAYHALRSTAGVTAGDWVVVLGAAGGVGLAAVDLAVAMQARVLAAASSPEKLELCRRRGAEATVDYDREDLKTRIRELTGDRARVVLDPVGGPYSEPALRGLARGGTFVTLGYASGTIPAIPLNLVLLKDICVRGMEIRTFMTDRPDDAVRDLTELSQMFAAGTVRPYIGARFPLERTAAALRHVADRKVLGKVVIDVA

SEQ ID NO: 1623 - protein, 207 aa, Mycobacterium paratuberculosis
VSSLISDRVTAAVERALDDRQREATEEVERILAAAVRVMERVAPEPPRVSDIVAEAGSSNKAFYRYFAGKDELILAVMERGVAIVVSYLEHQMAKEATPRGKIARWIEGTLAQVADPHLISMTRAAAGQMSAGTSWRAADQEMMRPLRELLVEPVAALGSSDVDRDVEAVFSCTAATLRRYVGSAQQPAPDDIAHVVRFCLRGLGVR

SEQ ID NO: 1624 - protein, 427 aa, Mycobacterium paratuberculosis
MSWDFSTEPEFEEKLEWIRGFVRDEVEPLEVLFPGCEFLPLNDERRRIVDPLKQQVRDKGLWAPHLGPELGGQGFGAVKLTLINEILGRSPWAPIVFGTQAPDTGNAEIIARFGTQAQKDRYLAGLLSGEIFSCFSMTEPQGGADPRVFTTRAVRDGDEWVITGRKYFSSNASVASFFIVVAITDPDVPVHTGASTFLIPAGTEGLVLEANHHLVGADPHEPGHSLVHYNDVRVPADALLGEPGQGFLILQTRLAGGRLHHAMRSIGMAQRAVEMMSRRAKSRFTQGSLLADKQMVQEFVADSYTELIPFRLTVLHAAWLIDNGDERAARAEIAACKILASQVLKSIALRAIQVHGALGLTDQLPLVNVLLGGIALGLADGPTEAHKVNLARMLLKGYEADDGDWPSEMLDVRRAAARAKYGELVDF

SEQ ID NO: 1625 - protein, 254 aa, Mycobacterium paratuberculosis
MGYAEQLFDLTDRVVLITGGNRGLGREMAFGAARCGADVVIASRNLDNCVATAQQVEHETGRRAMAYQVHVGRWDQLDGLVEASYDRFGKIDTLINNAGMSPLYDKLTDVTEKLFDAVVNLNLKGPFRLSALVGERMVAAGRGSIINVSTAGSLRPTPDIVPYAASKAGLNAMTEALAKAFGPAVRVNTLMAGPFLTDVSRAWNLEAVQENPFRHLALQRAGDPREIVGAALFLASDASSFTTGSILRADGGIP

SEQ ID NO: 1626 - protein, 352 aa, Mycobacterium paratuberculosis
MAGQRGGVESGLDAGVLARWLDANDAPGSGEDARLTPLQGGSQNTLYLIERGPARMVLRMPGARADAARIDGLLREIRLVRALSGTDVPHAALIAADDTGTVLGMPFYVMAAIDGWSPMDGGWPAPFDTDLRARRGLAFQLVEGAAKLGRVDWRKQGLEGFGRPDGFHERQVDRWLAFLDAYRVRELPGLDEASDWLRRNRPAHYRPGIMHGDYQFANVMFAHGEPARLAAIVDWEMTTVGDPLLDLAWCLLGYDGENPREDGFYLDIRGMPSRSELLEHYESVSGLSTENIDYYLVLANWKLGIVLEKTYAAGVRGGSRNEGVDPKITEAFGAMIPQLIATAAELARQLGN

SEQ ID NO: 1627 - protein, 227 aa, Mycobacterium paratuberculosis
MTQPDTDWDAAYRQAAPPPWSIGRPQPELERLIDEGKFRSDVLDSGCGHAALSLRLAALGHTVVGLDASATAIAEATAAAAAQGLTTATFARADVTDFADYPPGSEGRFATIVDSGLFHALPPQRRQDYLRSIFRAAAPGAALYILAFAAGALAPAHPDRPGPQGFTETELREAVSVLWHIDDLHAARVYGNDDSAGAPDSPLAHLEHDGEGHFMAPGFLVSAHKPD

SEQ ID NO: 1628 - protein, 48 aa, Mycobacterium paratuberculosis
MQVLLVRHALPLRSEHGQGSDPDLSADGLAQIERLPKALERFPIFRGW

SEQ ID NO: 1629 - protein, 156 aa, Mycobacterium paratuberculosis
VVSSPQRRAVQTAAPVAADRGLSVEIDDRFAEYDRDLPVYIPVEQIRDEMPEEWARLAQGHLPSAVDEDAFRARVRAAVDDLVAAADPEDTVAVFSHGGVINVLLHEILGTARLLSFPVDYASVTRLLFSRSGQATVAAVNSTEHVWDLLPRNQRW

SEQ ID NO: 1630 - protein, 350 aa, Mycobacterium paratuberculosis
VTSADQLEGLDLAALDSYLRSLGIGRDGELRAEFISGGRSNLTFRVYDDATSWLVRRPPLHGLTPSAHDMAREYRVVAALQDTPVPVARTIGLCEDESVLGAPFQIVEFVAGQVVRRRAQLESFSHTVIEGCVDSLIRVLVDLHSVDPDAVGLADFGKPSGYLERQVRRWGSQWALVRLPEDRRDADVERLHSGLGQAIPQQSRTSIVHGDYRIDNTILDADDPTKVRAVVDWELSTLGDPLSDAALMCVYRDPALDLIVNAQAAWTSPLLPTADELADRYSLVAGIPLAHWEFYMALAYFKLAIIAAGIDFRRRMSDQARGLGDAAEHTPEVVAPLISRGLAELAKLPG

SEQ ID NO: 1631 - protein, 38 aa, Mycobacterium paratuberculosis
VAILLAAVVGGLITVAVGTARILQLRRVAKKQHAAGGR

SEQ ID NO: 1632 - protein, 72 aa, Mycobacterium paratuberculosis
MSSHTPDSPGQQPPKPTPAGKTPAPAKEPAIGFTRAGALWSSLIAGFVILILLLIFITQNTAPTAFRFLGLH

SEQ ID NO: 1633 - protein, 338 aa, Mycobacterium paratuberculosis
MKPIPVTGPRGPAGGGREVKVGGMTMRLRVPAVVRPVAVLLTTMFVVAACSNSDPLGAQVRSPDSIVVGSGDFPESQIIAEIYAQALQANGFDVGKRMGIGSRETYIPAIKDHSIDLVPEYIGNLLLYFEPASSATTLDAVEQELHRRLPADLSILTPAPATDTDTVSVTSQAANSWNLRTIGDLAPHSADIRFGAPSAFATRPAGLPGLRQKYGLDIKPGNFVAIDDGGGAVTVRALLEGRVNAANIFTTSPAIPQHHLVALDDPEHNFMAGNVVPLVNSQKRSERLKLVLDAVSAKLTTPGVAGLNAAVSGNSGVDPDQAARNWVRDNGFNHPIGP

SEQ ID NO: 1634 - protein, 86 aa, Mycobacterium paratuberculosis
VIVFANVSKVFADGTAAVDRLSLTVPTGKLTVFVGSSGSGKTTALRMINRMIEPRPAPSASTVSTCPPSTRSNCAWASATSSSMPG

SEQ ID NO: 1635 - protein, 299 aa, Mycobacterium paratuberculosis
VSTLDPVKLRLGIGYVIQHAGLMPHQRVIDNVATVPVLRGQRRRAARTAAYQVLERVGLDVKLARRYPAQLSGGEQQRVGVARALAADPPILLMDEPFSAVDPVVRHDLQNEILRLQSELHKTIVFVTHDIDEALRLGERVAVFKGGVLQQCDEPARLLSRPANDFVSRFIGLGRGYRWLQLIDAAGLPVHDVPRLSAENLSGADVFDGWAVVVDEAGAPLGWIDAEGLRRHRDGLALSDSMTGVGSLFRPRGNLSQALDAALSSPSGIGVAVDDDGRVIGGVLAADVLAAVESQRKSR

SEQ ID NO: 1636 - protein, 228 aa, Mycobacterium paratuberculosis
MHYLLTHLDDAARLTVVHLRLALVPVLIGLAIALPLGMLVQRRRFARRLTTAVASVVFTIPSLALFVVLPMIIGTRILDEANVMVALTAYTAALLVRAVLEALDAVPAQISDAATAVGYPRLSRMMKVELPLAVPVLIAGLRVVVVTNIAMVSVGSVIGIGGLGSWFTQGYQTGKSDQILAGIIALFALAVAVDGLIVLGGRLVTPWAHAVRGGARRSVVAPVVGGAR

SEQ ID NO: 1637 - protein, 238 aa, Mycobacterium paratuberculosis
VNFVQRAIAYLLSADNWTGPVGLAARILEHLEYTGIAVGASALIAVPVGLLIGHTGRGTLLVVGAVNGLRALPTLGVLLFGTLLFGLGLGPSLVALMLLGVPALLAGTYAGIANVEPTVVDAARAMGMTESQVLLRVEVPNALPLILGGLRSATLQVVATATVAAYASLGGLGRYLIDGIKEREFHLALVGALTVAALALVLDGLLAVAVWASVPGTGRLRRTYRPLPHRLAGTSYGR

SEQ ID NO: 1638 - protein, 199 aa, Mycobacterium paratuberculosis
VNAAPSDPSRRVWQAMLTWRAQDVSRMESVRLQVSGNRIKANGRIVAAATDANPAFGAYYDLQTDETGATKRLGMTVTLAERERVFSFARDEENMWLVTDPQGEHRAAYNGALDVDVEFSPFFNALPIRRLGLQERAASVTLPVVYVNVPEMSITADTVSYSSTGSRDEIKVHSPISDTTVSVDEQGFIVDYPGLAERI

SEQ ID NO: 1639 - protein, 327 aa, Mycobacterium paratuberculosis
VAHPRSHPRSKTPVCVLGLGLVGGSIMRAATAAGREVFGYNRSIEGAQAATADGFDADTDLTATLSRAADSDALIVLAVPMPALPSMLAHVKETAPRCPLTDVTSVKKAVLDEVVAAGLRDRFVGGHPMAGTAHSGWTAGHAGLFTGAPWVVSVDDHVDPVVWAMVMTLALDCGAVVVPARSDEHDAAAAAISHLPHLLAEALAVVAGDVPLAFALAAGSFRDGTRVAATAPDLVRAMCEGNSDQLVPTADHVIELLRRARDSLAHHNSVADLIEAGHAARTRYDSFPRTDIFHVVIGAENWRQELAAAGRAGGVIRSALPTLDSPR

SEQ ID NO: 1640 - protein, 173 aa, Mycobacterium paratuberculosis
MGAQRASAQGLSADTPDGFGVAVVREEGQWRCAPMAPKSLTSLSAAETELRELRSSGAVFGLLDVDDEFFVIVRPAPSGTRLLLSDATAALDYDIAAEVLDKLDADIDPEDLEDSDPFEEGDLGLLSDIGLPEAVLGVILDETDLYADEQLGRIAREMGFADQLSAVIDRLGR

SEQ ID NO: 1641 - protein, 152 aa, Mycobacterium paratuberculosis
VISDEDLIRSALAVAATAGPRDVPIGAVVVGADGTELARAVNAREALGDPTAHAEILALRAAAAALGDGWRLEGATLAVTVEPCTMCAGALVLARIARLVFGAWEPKTGAVGSLWDVVRDRRLNHRPEVRGGVLERECAAPLEGFFARQRLG

SEQ ID NO: 1642 - protein, 329 aa, Mycobacterium paratuberculosis
VTFSAAGAVARWIVPLFTVAALVGIGPVAEPAPAVRLAADGNPLAGAPFYVNPNSAAMRAAQSADPPSPELTTIANTPQAYWIVPGGSAATVGKYVGDANAAGAIPVLAIYGIPHRDCGSFAAGGMATADDYRGWIDGIAAGVGTSRVAIVVEPDALAMADCLSGDQRQERYELVRYAVDTLTRNPNAAVYVDAGHLRWHSPEDMAARLNQAGVAHARGFSVNTANFYTTEDEIGYGEAISGLTNGAHYVIDTSRNGAGPAPDSELNWCNPSGRALGTPPTAATAGAHADAYLWIKRPGESDGSCGKGDPPAGNFVNQYAIDLVHNVGH

SEQ ID NO: 1643 - protein, 157 aa, Mycobacterium paratuberculosis
MTRKAEIVAVFAICTAFMTASGAFGGFAARADDPEILYNGINQLRQACGPIAEDPRLTEAAQQHADDMLRNGVSGHIGSDGSSPQARIAAAGYRSRYSGEIVFWATGSAATPSEALDMWMQSPPHRAIILNCGFNAGGFATARDGNKMTAVGDFATS

SEQ ID NO: 1644 - protein, 540 aa, Mycobacterium paratuberculosis
VQLTNLSEPELIASAGGDPWAINQSLQAGSPFQIERLAEAFHNAGRCTAEADHAFQDARKRFDAAWNHQNGDHPINDSDEVQRVTKSLGAQSLQLPKIAADLEGIAASLAEAQKAGAQEIATLERELMFLDRLIGAAKEDLKLNLPAAERAKLERLIKDAHADAVDDVRDAVKEMNSIRNAYSETLRKSMGNLHTDGYQPPAAVDGWMESPLRGVVRNLGPVAGTGANPGIPGIGAADLGEVVEVPGQPGKYYAIFGDSFSGNKAYDGTHYPSVAVPVTFDEEGHPHFGAPLTGADGQNVLFPPPPQAAGKDTLPAGSIRMNDGTTYMMVAGTDQLNPTGGSWLVKVTNDPGQGWKPIDGSWRAPGAGPTQISGYQGKDGYVYIAADSFDRSQGVTMYRVDPSEVTQRDRWQPWNGTGWGKAGDLATATVTAPGTRFGELSFREIGGQPVLSGFNATAGPGAVQLYIGNANGNPTEIFGNTPTTVARNDNDHTPISVLQPYGGYILPNSTINDLNIFISQWDTTLNTPYGVQQVQVNPPQ

SEQ ID NO: 1645 - protein, 377 aa, Mycobacterium paratuberculosis
VERRTALKLPLLLAAGAAVARAPRASAEEAGRWSPERANRWYQAQGWLVGANYIPANAINQLEMFQPDTFDPRRIDTELGWAQFYGHNTARVFLHDQLWAADQRGFQTRLGQFVDIAARHRIKPLFVFFDSCWDPQPRAGRQRPPRPGVHNSGWVQSPGAERLGDPRYIPVMRDYVTSVMTQFRNDDRVLGWDLWNEPDNPARQYRNVERSDKEQLVANLLPQVFRWARAVDASQPLTSGVWRGDWGQPQGRSAISDIQLANADVITFHSYAEPAGFESRINELTPLGRPILCTEYMARPRGSTVESILPVAKRHNVGAINWGLVAGKTQTYFPWESWDHPYTSVPKVWFHDLIRPEGRPFQDIEALTVRKLAGSPT

SEQ ID NO: 1646 - protein, 86 aa, Mycobacterium paratuberculosis
VMTAEFLEHQRSIGNDLLTPVPEYRFPGLLPGDRWCVTALNWLRAHHDGCAAPVVLASTHESTLEVVPLEALQEHKIDVPDDLANL

SEQ ID NO: 1647 - protein, 289 aa, Mycobacterium paratuberculosis
VGSAVDDIDFDDLTSPRLTDVQRQILEFTEAKPVDLDIDRMLAEAIEHAGLPGADLDDTHGFVDRLHVHVAAIEADHGLRQLTRGSLRQRVVRLLRNRLSLTELLQRYPEIESIPIEEPLIVVGMPRSGTTHLVNLIACDPRRRALPYWESQEPIPARGQGPDVFGVDPRYARAKAERGDRGGSGTARPRSGLLRPGMACAGARLARSLPEPGPNPALRLPEEGVAGVDLPARAADLGAQKSAALRAARPADGDLPRCDDRVHAPRPRRGDPVGDHHDGLLGSVAPHQH

SEQ ID NO: 1648 - protein, 245 aa, Mycobacterium paratuberculosis
VVRAPTSSVSTPGMPAPRRNEAIEEEVELLDLDLASYVLEWHARVPAWRDHYLSLDQTRHYAYLKKVLQALTFLRGPRTWVLKSPQHCEQLGPLMATFPDATIAFTHRDPVAVIQSAITMMAYSDRLRRTSIDPQWLLDYWSDRVHRLLSACVRDRDLVAPERSVDISFHQLSGNEIPVIERLYGRGGVELPQRVRDRFRRYLDGNPRGKHGRIRYQLQRHFGISADELRARFGFYFDKFDVRPE

SEQ ID NO: 1649 - protein, 398 aa, Mycobacterium paratuberculosis
MRPASAERADPIAPGLWCSPGLSNSYLLTTAEGRVIVNTGMGFEGPVHRANFDAVDSSPVRYIIFTQGHVDHVGGLDSVRDPDTVVVAQANWTMWRDDNERLIPYRASRSAFAFKDTLAGGIKAIQRRLGTTRLPGQSVPVVDLDFEDTLTLELGGRRMELISVPGGETTDSLVVWLPDERICLCGNTFGPLFGHIPNLVTMRGDRYRDALTAIASVERVRGLRAELLVTGHFEPIAGADRIDEELARLRDALGYLHDQTVAGMNAGKDVRTLMREITLPTEYEVGQGYGKVSWDVRAVWENYSGWFHHESTTELYPVGFDAVAHDVVELAGADALLDRARAHLAADRALHAIHLAQLLPAEHTGAREVLLQAHEKLLASSTNFWESSWLRHQIARNS

SEQ ID NO: 1650 - protein, 160 aa, Mycobacterium paratuberculosis
MTAFALRPEDFYHTGIIVPDLEAAMARLSALAGYRWITPVSYTLPFRTVSGTREVTSTFVYSLQAPHVELIQAVPGTAWAAAPGNAVHHLGYWCDDLAQSAQLLEDNGFAFEATADTAAPDLALFAYYVDAAGTRIEIVDRALFPDFPAFLQAAAAPEAQ

SEQ ID NO: 1651 - protein, 150 aa, Mycobacterium paratuberculosis
VGRIARRHVGQRRRTSRDRARLELQPDHGRGDVLGAHLDADRQRGLRPGPAVEPVTVRDLANHRATLLQGPRFVGTGPQVADQMADWFQTGACDGFVLAATHLPGAFEDVVRMVVPELQRRGLFRTEYRSATLRGHLGLPRPANARVAHA

SEQ ID NO: 1652 - protein, 406 aa, Mycobacterium paratuberculosis
LGCRVPPTPGWPMLDGLRVLDLATLAAAPLVATYLGEFGADVIKVEEPRHGDPIRGWGNQRDGVGLMWKSISRNKKSITLDLRSAEGQQLVRRLVEHADVAIFNTRPQTLRKWGLDYESLRAVNERLVMLHITGYGLSGPKSERPGFGTLGEAMSGFAHITGQAGAPPTLPPFMLADGVTSLNAAYAVMMALYHRDVHGGPGQLIDVNLIDPLARLLEQTLLGYDQLGLVPERSGNRWDISAPRNTYQTADGRWLAMSGSSPALALRVFRAIGRDDLLGDPEFSDPQRRLARAREVDILVADWVAGKTLSEAMAVFEAHEVAAAPVYDISDLVADEQLAHRGVFVSVDDQELGPMTVQAPVPRFSSASGTVEHLGPRLGEHNAEVYGELLGLTPDEIDQLRARGVV

SEQ ID NO: 1653 - protein, 308 aa, Mycobacterium paratuberculosis
MTQLLRRSELAVPASNDNMFDKAAGSGADLVFLDLEDAVPPAFKEESRGKAISALNDLDWGRTARAVRINGLDTPWCHDDLIEVVTAAGRNLDTVIIPKARRARDVWWVDVLLSQLEAKLNLGNKIRLEVLIEEVEGLANAEEIAVASPRLDALIFGVGDFSLSQGARVDTNFVPLGEYPGDFWQYARNKVIVAARIAGIDAIDAPYPDYRDLTGYERDARRAALMGYTGKWAIHPDQVPVANQVYAPTADEIARAEANLAAYREAESNGRGAVGVNGVLVDAAHVKMAQQTLARAALINGTGGSNDR

SEQ ID NO: 1654 - protein, 1127 aa, Mycobacterium paratuberculosis
VLAKVLVANRGEIAIRAFRAAYELEMATVAVYPYEDRNSVHRLKADESYQIGEEGHPVRAYLSVDEIVDTALACGADAIYPGYGFLSENPDLAAACAAAGITFVGPSAEVLELTGDKSRAIAAARAAGLPVLASSPPSTSVQELLSAAETMTFPLFVKAVAGGGGRGMRRVTDPGALAEAIEAASREAESAFGDASVFLEQAVINPRHIEVQILADTHGNVMHLYERDCSVQRRHQKVIEIAPAPNLDPALRERICADAVAFARSIGYTCAGTVEFLLDERGNHVFIEMNPRIQVEHTVTEEITDVDLVSAQLRIASGQTLEEIGLSQDSVIPRGAALQCRITTEDPANGFRPDTGRITAYRTPGGAGIRLDGGTTLGAEISAHFDSMLIKLTCRGRDFPTAVRRARRAVAEFRIRGVSTNIPFLQAVMDDLDFQAGRITTSFIEQRPQLLTARSSADRGTKILNYLADVTVNKPHGERPSAVYPHDKLPDIDLAASPPAGSKQRLTELGPERFAAWLRESGGVGVTDTTFRDAHQSLLATRVRTSGLLKVAPYIARTMPQLLSVECWGGATYDVALRFLKEDPWERLAALREAMPNICLQMLLRGRNTVGYTPYPETVTTAFVAEATDTGIDIFRIFDALNNVDSMRPAIAAVRETGSAIAEVAMSYTGDLSDPAEKLYTLDYYLKLADQIVEAGAHVLAIKDMAGLLRAPAAATLVSALKSRFDLPVHVHTHDTPGGQLATYVAAWQAGADAVDGAAAPLAGTTSQPALSSIVAAAANTEYDTGLSLPAVCDLEPYWEALRKVYAPFESGLPAPTGRVYHHEIPGGQLSNLRQQAIALGLGDRFEDIENAYAGADAILGHLVKVTPSSKVVGDLALALVGAGVGAQDFAEDPSRYDIPDSVIGFLRGELGDPPGGWPEPLRTKALQGRGPAKPEQPLTAEDKAALAAPGARRQAALNRLLFPGPTKELEEHREQYGDTSGLSANQFFYGLRQGDEHRVELERGVELLIGLEAISDPDERGMRTVMCILNGQLRPVVVRDRSIAIDVPAAEKADRANPDHIAAPFAGVVTVAAEVGRQVEAGQTIATIEAMKMEAAVTSPKSGKVARIAVSRTAQVEGGDLLMVID

SEQ ID NO: 1655 - protein, 375 aa, Mycobacterium paratuberculosis
MSTLEDNQPRIHKGLAGVVVDTTAISKVVPETNSLTYRGYAVQDLAAHCSLEQVAYLLWYGELPDDQQLALFSQRERAARRLNRSQLSLLHKLPDTCHPMDVVRTFISSMGAEDPDEDDNSASANHAKALRMFAVLPTIVAADMRRRRGLEPIAPHSHMSYAQNFLHMCFGDVPEQVIVDAFEQSMILYAEHSFNASTFAARVVTSTQSDIYSAVTAAIGALKGSLHGGANEAVMHDMLEIGTPDRAAEWLQGKLSRKEKVMGFGHRVYKNGDSRVPTMKQALQRVAAVRDGQKWLDIYQILERGMARANGIKPNLDFPTGPAYYLMGFDIGAFTPIFVMSRITGWTAHIIEQTASNALIRPLSEYVGPPQRALS

SEQ ID NO: 1656 - protein, 300 aa, Mycobacterium paratuberculosis
MHGLIGAARSPEQKRAQLRAGLESGRLQRFPGAFSPLVAKLVAELGFDGVYVSGAALSADLGLPDIGLTTLTEVSGRGAQIAAVTELPTLIDADTGFGEPLNAARAVTMLEDAGLAGCHLEDQVNPKRCGHLDGKAVVPVDVMVRRLRAAVSARRDPNFVVCARTDAAAIEGLPAAIERARAYADAGADLIFTEALQSPTEFQRFRAALDTPLLANMTEFGKSPLLSTGLLADIGYNVVIYPVTTLRLAMHAVEAGLREIADTGTQSGLLDRMQHRSRLYQLLRYADYNHFDSDIYNFPR

SEQ ID NO: 1657 - protein, 507 aa, Mycobacterium paratuberculosis
VRRVRFMRIHDVRTRRSAEDFPRSEHLAWKIAEVAADPVAVPAETEAMVINRVIDNAAVSAASVLRRPVTVARAQAQAHPAAAKGAKVFGIRGDYSPEWAAWANGVAVRELDFHDTFLAAEYSHPGDNIPALVAVAQHLGVGGADLIRGIATGYEIQIDLARGICLHEHKIDHVAHLGPSVAAGLGTMLRLDPETIYQAIGQALHLTTSTRQSRKGLISSWKAYAPAWAGKVAIEAVDRAMRKESAPAPIWEGEDGVIAWLLSGPEHTYRVPLPEPGEPKRAILDSYTKEHSAEYQSQALIDLARRMRERIGDLNQIATIVLHTSHHTHYVIGTGAGDPQKFDPDASRETLDHSVMYIFAVALQDGTWHHERSYAPERAHRPDTVELWRKISTVEDPEWTRRYHSTDPNDKAFGARAVVTLNSGEVIVDELAVADAHPLGARPFERTQYVGKFHELAEGVVTDAEQQRFLSVAEGLPALPPGAAGELNIVVDPAVLATAPAIPGGIF

SEQ ID NO: 1658 - protein, 502 aa, Mycobacterium paratuberculosis
MRCKSVILRPCPTVFANFVKGAGRRVVRVAKTFAGARLRRLREEQGLTQVALARALGLSTSYVNQLENDQRPITVPVLLTLTERFDLPTQYFAPDSDARLIADLREVLAETPATPGQVEELVARMPAIGQTLVNLHRRLHDTTADLEALYSRANLDISDTPGLPHQPMPFEEVRDFFYDRKNYIGELDVAAEEMFDHNRLRIGGLDGQLARLLGEQLGVAVVIDDGQLLAPNSKRLFDPESKTVYLARWLHPGQRAFQLATQIALLTQPELITAIIAGDDQLSDDARGVARIGLANYFAGALLLPYRRFLDAAERVRYDIDQLSRRFEVGFETVCHRLSTLQRPNARGVPFIFVRTDSAGNISKRQSATAFHFSRVGGNCPLWVVHHAFSRPGQFLTQVAQMPDDRTYFWIARTTSGGPSRYLGPHKSFAIGLGCDVDHADKLIYSVGIDLRDTESIVPIGAGCKICDRAACPQRAFPYLGRPVSVDPHRSTDLPYPPAITP

SEQ ID NO: 1659 - protein, 294 aa, Mycobacterium paratuberculosis
MGVVVIGQIGRDLVLRTDRPPTAGESATVLRREELLGGKGANQAVGLAQLGVPVALIGVVGDDQAGTSILQQAQRDGIDVSKVARRGTTALLVDVVAAPPERMLLEDVPDSSLVRVADLDRSSSLFDTADTVSIQLQQPAATALEAAQRARQRGLRVVADGVPAPQVRADLLATLDVLRADATEASIIAGTEITTVEQAFELADHLLSGGPELVALAVPDVGDLLTWRGGSELFEFADVEVVDPTGAGDAFVAGLVAALRDGAAPREAGRRAAAAAGATVQRLGGRPDLTGLRA

SEQ ID NO: 1660 - protein, 415 aa, Mycobacterium paratuberculosis
VSHASDRGHGVPRLAILDDYAGVALQVADWSRVQKRCDITVFDEHLSEQQAVDALRPFDVVCTMRERMAFPRSLIERLQPARAGRHRRSGISGQIGRLQHRVQRSAARAARAHRPGSRGRGAGQPERGRDQGRRGRRRAHRHDRHPAHPDARTPGPRLDERIDALCRAQRLDLHRPRRGHPDRHLWSRAVELAHRDHRARIRLHQYATASAGGRRDVRGQLERGADRRRPAVGAGRQLAVLLRAPAVGRDPHRAVRPVHRHQAGGAENPRRTAASVVRRALDRFGPRPVRGEHPLLRIAAARGVRRRPGRRAGRRPHAAAFRVAAAQRHRLPVEPPGVRRRRRAPASAAGEPGVAGRADRHRHAGELGLLLRHAAQPVRGRRPAVGAHGFRCGRSQFPHRGAARHRRPAALARVR

SEQ ID NO: 1661 - protein, 424 aa, Mycobacterium paratuberculosis
VLDAIGDPAYQVKLGAYNIEFNVPPHALPGHTGLDLEAEVRASLNEAETKAGAAGGAHIVMIGILPTLMPEHLDHDWMSESTRYAALNDSIFTARGEDIPIDISGPEPLSWHTATIAPESACTSTQLHLQVAAETFAANWNAAQIVAGPQLALGANSPFFFGHQLWAETRIELFAQSTDTRPEELKTQGVRPRVWFGERWIDSVLDLFAENIRYFGSLLPEVSDEDPVAELAAGRTPQLSELRLHNGTVYRWNRPVYDVADGRPHLRLENRVLPAGPTVIDMLANSAFFYGMLRSLSEADDPLWERMDFAVAEANFLTAARHGIDARLRWPGFGEVSARELVLDTLLPIADEGLRRWGVDAEVRDRFLGVIDGRARAGRNGASWQVATVRALQDGGLSRRAALAEMLRRYCEHMHANEPVHTWE

SEQ ID NO: 1662 - protein, 229 aa, Mycobacterium paratuberculosis
LGTMSSDQVMDWDSAYREQAHFEGPPPWNIGEPQPELAALIEQGKFRSDVLDAGCGFAELSLALAARGYTVVGIDLTPTAVAAATRAAAERGLTTASFVQADITSFTGYDGRFATVVDSTLFHSLPVEGRDGYLRSIHRAAAAGASLFILVFAKGAFPAEMQPKPNEVDEDELRAAVGKYWAIDDIRPSFIVSNVPQIADAPFEFPAHERDERGRMKMPAYLLTAHKAQ

SEQ ID NO: 1663 - protein, 397 aa, Mycobacterium paratuberculosis
LVDRRRGGLRVVVGRQVSGGTPLADTWRSARPPAAGLHLDSAACSRQSFAVIEATAQHARNEAELGGYVAAEAAAPVLDAGRFAFTALTGMTDAEAVFTTGSLHALDLLLGSWPAERRTLACLPGEYGPNLAVMTAHGFDRWLLPTLADGRVALDDAALALQTDPPDLVHLTTIGSHSGVAQPVSMIARLCRELGLPLVVDAAQALGQVDCTAGADVTYSSSRKWIAGPRGVGMLAVRRELMENLHPRLAAPDWAPGSTVAQQLEFGEANIAARVGFSLALGEYLGYGPAAVCARLAELGGLSRGVLTDVTGWAVVEDAEEPSAITTLAPTDGADPRAVRDWLLAERRILTTFVGVQRAPLRLTAPVLRISPHLDTTAEDLETFAEALIAATAATSA

SEQ ID NO: 1664 - protein, 322 aa, Mycobacterium paratuberculosis
LMTLSLSNHLAADSAHHALRRDVLDGLRRTPKSLPPKWFYDSVGSDLFDQITRLPEYYPTRAEAEILRAQAPGIASASEADTLVELGSGTSEKTRVLLDALRERGALRRYVPFDVDAGILSASAAAIQREYAGIEIQAVCGDFEEHLTEIPEGGRRLFVFLGSTIGNLTPGPRAQFLAALSAQMRPGDSLLLGTDLVKDTERLVRAYDDAAGVTAAFNRNVLAVINRELDADFDVDAFEHVARWNADEERIEMWLRATVRQRVRVGALGLTVDFRAGEEMLTEVSCKFRPERVSAELAAAGLRRTRWWTDGAEDFGLSLAVK

SEQ ID NO: 1665 - protein, 232 aa, Mycobacterium paratuberculosis
MCRHLGWLGADATVSSLMLEPPFGLRVQSYAPRRQKHGLLNADGWGAGFFDAEVPRRWRSPAPLWGDVSFESVAPALHSHCVVAAVRSATVGMPIEISATAPFTDGRWLLSHNGVVDRSVLPVTSRAESVCDSAILAAVILERGLDALGEVIVEIGAADPAARLNILAANGSRLLATAWGDTLSILRRADGVVVASEPYDDDSDWEDVPDRHLVDVTADGVTLTPLDHPKGF

SEQ ID NO: 1666 - protein, 433 aa, Mycobacterium paratuberculosis
VTSPEAIADQLARTRARTLRLVDFDDDELRRQYDPLMSPLVWDLAHIGQQEELWLLRGGDPARPGMLPPAVEGLYDAFVHSRASRVDLPLLSPEQARAYCRTVRAAVLDTLDALPDDPDAAFVYAMVVSHENQHDETMLQALNLRSGAPLLRDTSVLPAGRPELAGTSVLVPGGEFVLGVDAADEPESLDNERRAHVLDLPAFRIGTVPVTNGEWQQFVADGGYDEPRWWSRRGWQHRQAAGLTAPQFWHPDARTRTRFGHVEDIPADEPVQHVSFFEAEAYAAWAGARLPTEMEWEKACVWDPSTGTRRRYPWGATPPSPAVANLGGAALRPAPVGAYPAGASACGAEQMLGDVWEWTTSPLRPWPGFAPMLYERYSQPFFDGDYRVLRGGSWAVEPGILRPSFRNWDHPYRRQIFAGVRLAWDVPGARDHR

SEQ ID NO: 1667 - protein, 436 aa, Mycobacterium paratuberculosis
MTFAPSTAAASRPAGGDPAAELRIAELTDSAAVAQYIARGCLADAPLGRVGLEVEAHCHDPQDPCRRPGWDEIAAVLDALPALPGGSRVTVEPGGAVELSGPPADGVLAAIDAMRRDQAVLRPAFAGAGLGLVFLGADPLRPPQRINPGARYRAMERFFATSRSGEAGAAMMTSTASIQVNVDAGPREGWAARVRLAHALGPTMIAMTANSPMLDGDFTGWVSSRQRVWGRMDSARCGPVLGASGDDPGTDWARYALKAPVMLVHTPDAEAVTRWVPFADWVDGRVLLGGRRPTVADLEYHLTTLFPPVRPRQWLEIRYLDSVPDTLWPAVVFTLVALLDDPVAAGLAARAVEPVATAWDVAARVGLRDRRLYAAANACLAIAAERAPAELAEPMRRLVRLVEQGRCPGDDFADQVIEHGIAASVSRAARGPQGGP

SEQ ID NO: 1668 - protein, 235 aa, Mycobacterium paratuberculosis
LSRVLKAGGAWHDRCMTMRITRVRRAVLFVGVAAVGAVALPVAAAHPSEPGVVNYAVLGKGSVGNIVGGPMGWESVFTQPGQGDWVDLPECNNWADIGLPEVFNDPDLASFNGAVTQTSATDQTHLVKQAVGVFATNDAADRAFHRVVDRTVGCSGQTTAIHLDNGSTQVWSFDGGPAGPADENWTKQEAGTDRRCFNQTRLRENVVLQAKVCQSGNAGPAVNVLAGAMQNALGQ

SEQ ID NO: 1669 - protein, 181 aa, Mycobacterium paratuberculosis
LLSRGFGSQLLHNRRIAAAIVNAFIICLMSETSETPTVRTSTATAPAPAAAAPYRTPRVFQVAAWVAIVAGIVFIVAVIFFTGFILGHRGGHHGHHHHKHHAMMHHRGPGGPGGPGSFGGPGGPGGQGGQTGPGTSTAPAAPSPVRPSGLAPNQLPASVFHSAATSHGALGQAPSVIVLTN

SEQ ID NO: 1670 - protein, 335 aa, Mycobacterium paratuberculosis
VLRIGPTAGTGTPTGDYGIGATDLCEFVEFPTELLQVCGDSFAGQGVGFGGWYAPVALRVDTASVDDPAGVRYTGVTGISNPLLADPAPPGASQLPAGVVQINRRNYLMVTTTKNLEPQSSRLVTAEPVRAGWQTIPGSTRPASYQGGSQTQISGYYDPIPTEESPSGWVYIVADSFTRRDPVVLYRVTPQAFTDRSRWQGWAAGPQGGWGKPPTPLWPDAVGEMCIRQIDGKAVLSYFNATTGNMEVRVADDPRMLGDAPVTTVVQHDEWPEPAESLPPPYDNRLAQPYGGYISPGSTLDELRIFVSQWDTRARVAAPYRVIQFAVNPFKPGQP

SEQ ID NO: 1671 - protein, 344 aa, Mycobacterium paratuberculosis
MVAIGVVGATGQVGQVMRRLLDERDFPATSVRFFASSRSQGRKLEFRGAEIEVEDAATADPTGLDIALFSAGKTMSLVQAPRFAAAGVTVIDNSSAWRKDPDVPLVVSEVNFERDAHRRPKGIIANPNCTTMAAMPVLKVLHDEAGLQRLVVSSYQAVSGSGIAGVEELATQARAVIDGAEQLVHDGRAVSFPAPQTYVAPIAFNVVPLAGSLVDDGSGETDEDQKLRHESRKILGIPDLAVSGTCVRVPVFTGHSLSINAEFARPLSPERARELLDGAPGVKVVDVPTPLAAAGVDESLVGRIRRDPGVPDGRGLALFISGDNLRKGAALNTIQIAELLAAQL

SEQ ID NO: 1672 - protein, 421 aa, Mycobacterium paratuberculosis
VALVVQKYGGSSVANADRIRRVAERIVATKKQGNDVVVVVSAMGDTTDDLMDLAQQVCPAPPPRELDMLLTAGERISNALVAMAIESLGAQARSFTGSQAGVITTGTHGNAKIIDVTPGRLQAALDEGRIVLVAGFQGVSQDTRDVTTLGRGGSDTTAVALAAALGADVCEIYTDVDGIFSADPRIVHNARKLDTVTFEEMLEMAACGAKVLMLRCVEYARRYNIPVHVRSSYSDKEGTVVVGSIKDKPMEDPILTGVAHDRSEAKVTVVGIPDIPGYAARVFRAVADADVNIDMVLQNVSKVEDGKTDITFTCSREAGPTAVAKLDALKDEIGFTQLLYDDHIGKVSLIGAGMRSHPGVTATFCEALAQVGVNIELISTSEIRISVLCRDTELDKAVVALHEAFGLGGAETATVYAGTGR

SEQ ID NO: 1673 - protein, 614 aa, Mycobacterium paratuberculosis
MRRSEVPSDIPGAITVTSHPDAFSSSRSIVKPAGPPGPGQPAWNPQRGSSMPVNRYRPFAEEVEPIRLPDRTWPDKVIDRAPLWCAVDLRDGNQALIDPMSPARKRRMFDLLVRMGYKEIEVGFPSASQTDFDFVREIITEGAIPDDVTIQVLTQCRPELIERTFAACQGAPQAIVHFYNSTSILQRRVVFRADRAAVQEIAVAGARKCVEEAAKYPETQWRFEYSPESYTGTELEYAKQVCDAVGEIIRPTTENPIIFNLPATVEMATPNVYADSIEWMSRNLARRDSVILSLHPHNDRGTAVAAAELGYAAGADRIEGCLFGNGERTGNVCLVTLGLNLFSRGVDPQIDFSNIDEIRRTVEYCNQLPVHERHPYGGDLVYTAFSGSHQDAINKGLDQMKIDADAADTDVEDMLWQVPYLPIDPKDVGRTYEAVIRVNSQSGKGGVAYIMKADHGLALPRRLQIEFSQVIQKISEGEGGEVSPKEMWDAFFEEYLAPVWPLERVKQRVDASDEDSGVTSISATVKINGEQTEINGTGNGPLAAFVHALAGVGFDVAVLDYSEHAMSSGDDAQAAAYVEASVNGRTVWGVGIAPSITTASLRAVVSAVNRAARA

SEQ ID NO: 1674 - protein, 329 aa, Mycobacterium paratuberculosis
MSAVCWGRPASEPDAGWAVIDVETSGFRPGQARIISLAVLGLDAGGKVEQSVVSLLNPGVDPGPTHVHGLTAAMLEDQPQFADIAGDVVEVLRGRTLVAHNVAFDYAFLAAEAELAGIELPVDTVMCTVELARRLDLGIDNLRLETLAAHWGVTQQRPHDAFDDAMVLTGVLASALQRARERDIWLPVHPVTRRRWPNGRVTHDELRPLKVLASRMPCPYLNPGPYVGGRPLVQGMRVALAAEVERTHEELVERILHAGLAYSDTVDRETSLVVCNDPAAEHGKGYLARQLGVPVISDAQFLDCVRAVIGGTSMDEFTDATPDPQLALF

SEQ ID NO: 1675 - protein, 437 aa, Mycobacterium paratuberculosis
MRATRCARRQAPRLRSPLNSPGADHPCPPGPGRGSERALGVPGDRPRRRRHDRRAGRDDAGPLGAAATGHRPAHRRRHRHQRQVDHHPDDRRRAGHHGIGGHQRRGRQHPAGLVAALAANRGARLAALEVDEMHVPHVSDAVRPGVVVLLNLSRDQLDRVGEINVIERTLRAGLARHPDAVVVANCDDVLMTSAAYDSPHVVWVAAGGSWANDSVSCPRSGEVIVREQGHWYSTGADFKRPSPHWWFDPQDGGNLYGPGGVALPMRLALPGAVNRGNAAQAVAAAVALGADPAAAVTAVSTVDEVAGRYRTVRVGGHDVRMLLAKNPAGWQEALSMVDPHADGVVISVNGRVPDGEDLSWLWDVRFEHFNDAFQTTPVVAAGERGTDLAVRLGYAGVEHTLVHDTVAAIESCPPGRVEVVANYTAFLALQRAVARHG

SEQ ID NO: 1676 - protein, 129 aa, Mycobacterium paratuberculosis
VRIGLVLPDVMGTYGDGGNALVLRQRLRLRGIDAEIVELTLADPVPESLDLYTLGGAEDYAQRLATRHLLRYPGLQRAAERGAPVLAICAAVQVLGHWYETSAGGNGSTAWACWTRRPPRRTPATSASW

SEQ ID NO: 1677 - protein, 121 aa, Mycobacterium paratuberculosis
VGMLDATTSPQDARHIGELVTKPLLAGLTEPLTGFENHRGGTVLGPSAAPLGAVVKGAGNRAGDGFDGVVQGSVVATYMHGPCLARNPQLADLLLRKVVGGLPELPMPEVELLRRERLAAR

SEQ ID NO: 1678 - protein, 203 aa, Mycobacterium paratuberculosis
MFEGPVQDLIDELGKLPGIGPKSAQRIAFHLLSVEPPDIDRLTAVLARVRDGVRFCAVCGNVSDDERCRICSDPRRDASVVCVVEEPKDVQAVERTREFRGRYHVLGGALDPLSGVGPDQLRIRELLSRIGERVDDVDITEVIIATDPNTEGEATATYLVRMLRDIPGLTVTRIASGLPMGGDLEFADELTLGRALAGRRAMV

SEQ ID NO: 1679 - protein, 116 aa, Mycobacterium paratuberculosis
MQPGPGGDMSALLAQAQQMQQKLMEAQQQLANAEVHGQAGGGLVKVVVKGSGEVVAVKIDPSVVDPSDVETLQDLVVGAMADASKQVTRMAQERLGSLAGGFGAPPGQPPAPAPGV

SEQ ID NO: 1680 - protein, 257 aa, Mycobacterium paratuberculosis
VDLRLSRRVGIKVAVGALVAASTAIIPTAAPAAWGVPSNIAGMVVFIDPGHNGSNDASINRQVPTGRGGTKDCQASGTATNTGYQEHTFTWDTALRVRAELTALGVRTALARANDTGLGPCVDERANMANALHPNAILSIHADGGPPSGRGFHVNYSAPPLNQVQAGPSVQYARIMRDQMQASGIPPANYIGQNGLYGRSDLTGLNLAQYPSILVECGNMKNPADSALMESAEGRQKYADAMVRGVAGFLGSQGQAR

SEQ ID NO: 1681 - protein, 145 aa, Mycobacterium paratuberculosis
VGQVSADSTILINADPAATLAAVADYQTVRPKIISPQYSDYQVLQGGQGAGTVAKWKLQATKSRVRDVQVDVDVAGHTVIEKDANSSMVTNWTVAPAGPGSSVTVKTTWTGAGGVKGFFEKTFAPLGLKKIQGEVLANLKRELES

SEQ ID NO: 1682 - protein, 474 aa, Mycobacterium paratuberculosis
VHGLLSKTRVYLVPVLGSALSAHQAGVDRLLESYRSIPATSAVRLAKPTSNLFRARTKRDAPGLDTSGLTGVLGVDPETRTADVAGMCTYADLVAATLPYGLSPLVVPQLKTITLGGAVSGLGIESASFRNGLPHESVLEMDILTGAGELLTASRTQHADLFRAFPNSYGTLGYSTRLRIELEPVAPFVALRHIRFHALADLIAAAERIIDTGGHAGTPVDYLDGVVFSADESYLCVGRRTTTPGPVSDYTGQHIYYQSIRHDSPGDEPTKDDRLTMHDYFWRWDTDWFWCSRAFGVQNPRVRRWWPRRYRRSSVYSKLVSLDRRLRISDRIEARNGRPPRERVVQDVELPVERTFEFLEWFLETVPITPIWLCPLRLRDHDGWPLYPMRPDHTYVNVGFWSSVPAGATEGATNRLIEAKVSELDGHKSLYSDSFYTREEFDELYGGEAYNTVKKTYDPDSRLLDLYAKAVQRR

SEQ ID NO: 1683 - protein, 436 aa, Mycobacterium paratuberculosis
MTTTKQPHRSRTGKLSMAEILEVFAATGRHPLKFTAYDGSTAGSEDAELGLDLRSPRGATYLATAPGELGLARAYVAGDLQAYGVHPGDPYRLLKTLTDRVQFKRPPARVLANVVRSIGFERLLPVAPPPQETRPRWRRIADGLMHTKARDAEAIHHHYDVSNRFYELVLGPSMTYTCAVYPHPDATLEEAQENKYRLIFDKLRLAPGDRLLDVGCGWGGMVRYAARRGVRAIGATLSAEQAKWAQRRIDDEGLGDLAQVRHSDYRDVAETGFDAVSSIGLTEHIGVKNYPAYFGFLKSKLRTGGLLLNHCITRHDNTSTSFAGGFTDRYVFPDGELTGSGRITCAIQDVGFEVLHGENFRHHYAMTLRDWCRNLVEHWDAAVDEVGLPTAKVWGLYMAASRVAFEQNNLQLHHVLAANVDARGDDDLPLRPWWSP

SEQ ID NO: 1684 - protein, 612 aa, Mycobacterium paratuberculosis
VALYRKYRPATFAEVVGQEHVTEPLSIALEAGRINHAYLFSGPRGCGKTSSARILARSLNCVQGPTATPCGVCDSCLALAPNAPGSIDVVELDAASHGGVDDTRELRDRAFYAPAQSRHRVFIVDEAHMVTTAGFNALLKIVEEPPEHLIFIFATTEPEKVLPTIRSRTHHYPFRLLPPKTMRALIGRICEQEGVVVDDAVYPLVIRAGGGSPRDTLSVLDQLVAGAEGGHVTYQRALGLLGATDLALIDDAVDALAAGDAAALFGAVESVIDAGHDPRRFATDLLERFRDLILLQAVPDAASRGVVDAPEDVLERMRDQATRIGPATLTRYAEVVQAGLGEMRGATAPRLLLEVVCARLLLPSASDTESALLQRVERIETRLDMSIPAGSTPAEPVEQPVRFTRPSAAPKPASKPEPAAAKPEHEPEPQPEARPEPRAKPTPEPKPAPEPARASETPSAPGELNAAAVRSMWSTVRDKVRQRSRTTEVMLAGATVRAIEDNTLVLTHESAPLAKRLCEQRNADVIAEALKDALGVNWRVRCEAGSPASATAGPPHPKPEQPVPEPDSARRDEEEHMLAEAVRDEPAARRDPEEAALELLQNELGARRIDGG

SEQ ID NO: 1685 - protein, 428 aa, Mycobacterium paratuberculosis
MVSLESLTPAELAEVHARHQQGYADLQAKKLSLDLTRGKPAPAQLDLSNALLSLPGDDYRDSEGTDTRNYGGLHGLPELRAIFGELLGIPVQNLIAGNNSSLELMHDLVAFSMLYGGVDSQRPWKDEPSVKFLCPVPGYDRHFAITETMGIEMIPVPMLSDGPDVGLIEELVAADPAIKGMWTVPVFGNPTGVTYSWDTVLRLVQMRTAAPDFRLFWDNAYAVHTLTHDFIRQVDVLGLAAAAGNPNRPYVFASTSKITFAGAGVSFFGGSLGNIAWYLQYAGKKSIGPDKVNQLRHLRFFRDADGVRLHMLRHQQILAPKFALALEILDQRLSDSKIASWTEPKGGYFISLDVLPGTAKRTVALAKDAGIAVTEAGASFPYRKDPNDTNIRIAPTFPSLPDLRDAVDGLATCALLAASESLLARDRV

SEQ ID NO: 1686 - protein, 277 aa, Mycobacterium paratuberculosis
MGRKVAIPWHASFSIAAGVLYFFFVLPRWPELMGDTTHSLGTALRIVAGVLVALAALPVVFTLLRTRKPELGTPQLALSLRVASIVAHVLAGLLIIGTAVSEIWLSLDAAGRWLFGIYGAAAAIALLGIFAFYLSFVAELPPPPPKPIKAKKPKKRRLRRKKAGEEAETAETAEAEEAEAEEADETEAAQTVTAETEAAEEAGETEAAEDTAEAEKPAATEPEAETPVAEDSDESRAKLRNRRPTGKGTHRMRRRRTRAGVAVDQTAEQSGDDADEN

SEQ ID NO: 1687 - protein, 125 aa, Mycobacterium paratuberculosis
MLSVKWLEAPEAHDFPAAADYLSMLADAQTVKKVIKKLKRATVMQRKAKDILRAARLDLLPVDNPHVAADLTKIEKGLPLSPILLVRGDFLAGVPLQIADGYHRVCASYHTDENTPIPVLLAVAR

SEQ ID NO: 1688 - protein, 163 aa, Mycobacterium paratuberculosis
VKRLLAAATGTLGCAAAAVTLVGCSSGGHSAAPASSTAPSASTGTNAQVKVGGADLPGVNPASVTCVRTGGKIDIGSGSTGGAQQALAVVLTDEATPKVESLALVVDGNALAVSNNMGAKVGSADVAVDGKTYTITGQAQGADMKNPMAGMITKDFSIKVSCG

SEQ ID NO: 1689 - protein, 561 aa, Mycobacterium paratuberculosis
VSIPDGLQRARRMALAADEAGARDLLLSLIPRIERDDRDDLMLEVLAQLGEIYLARGADDGVEESIRRIQDCLVAYASMPADAENARMICRYSRRARFLQTGLAAARGDHEGAAAALDLLSDTGGEFPELAAEHAQLCARARALCATALCDDDLHVQSVPLWDKILEHIGDSGGDENADHLWVTAATGYGRFCVETGRLAEAEPWLRRAEARADAHGWELARARAQLERAAARWAANDHAGTEQLVSQAYPIIARHARAHDVARCWLYLGLTRLGSGALEAADECWEHAERHWRELGNPLHLHRILLQRSWIAIFWSRFADAVELIAQARELLDSSPRSSWLQYAQLDSHLGTVWRADALADLGFDSSGDPEESLQETEARQAEGLGILRGEVGTPEYRRGMSKLQQAAELKVPAALAVDSVRYSIADADARARWATTIAAPILAGAFAVAWEWENTALISELVEYHSARGTFEALQRPQTGEWASTAVASVPLDTGAEPAALAAAGPPVAGGVSLTRLGPLPPLRMHPGEAPILDHYRTLAVQRYGRAVTADEPAWSTWP

SEQ ID NO: 1690 - protein, 462 aa, Mycobacterium paratuberculosis
VAVTESGRLTLVLRYADLGIATYASLRIVGQPERTVAWVVEEPLLLAALQELAAALPEPHDAENRRAAIGRALSTGAFAAPDTELTLAYILGVLLIGSAGWQLLTECVSSPRAVLFVSPSARLARVPWGLLAIPKSGPSKEELVRARQDAITAAGRAAAQIPWRLGDLAALTDGHRLMELVEVLMAVPPNIVHAPRTATEWDARRDGPPLLVLDPRVPGQRPDSALGSVLGRPSPGTPVGRHFAELMRRRPVLPRVDAVVDLFRRRDADRRWLAGLLARSPCRLLYVGHASSADDDHRHGGRADRAALHLADPAAVPGDANAIGDHRPLTASDLMALRLPMPPRVALLACGSGGDYQFDEATGLVAAMILNGAQLVTATLWSLPTTAAYRQFAMPARESPESVDPMADLVSAVDTAHDAPADAGCALNRWQRAQMRRWRDGDRVASPLYWAALATFTVDGAR

SEQ ID NO: 1691 - protein, 112 aa, Mycobacterium paratuberculosis
LGSVADRPRHPERMNTLLRLADWLKSRRRRDVGNRTVGVGTVRKVKRQVFIEVVAVSGETFIGKLARCDADLDLSVLRPGLVVLVAFDPAAREELSLPDDVLAVHAAWVAAL

SEQ ID NO: 1692 - protein, 442 aa, Mycobacterium paratuberculosis
MSAEPQPPTVPAGAAAGHPRRSVIEAAWRAIGPGVEVLSADDGGPLSRTIKRIIDPLVLRLRSNPAYSAPVVTPETAAAMHELIVGSGPELRAAAAWFEALKLERRRQRIRTGNAQEFYFPVCFELAVTKGAPAPHDNETAAAVLAGIHRDRDRTAIEVLHRYAGNPDVVAALADQLQRSWRDVRAGPADTGPFLAELATVLGMAGGHRGAAARQRVWSAMITDATPYNLGALAHIDCASLPWSIVEVGLSSVEPQRVPEVAAASEGERPLDRNVLDRVRATLRRALDRDALPDIPLLCEEEVDRACAPWGLLAEDKQAALVAGIEVAMQLAPLDPSACCRDDLAAQIQARLRKEAYVLHARRYLADNGPIHPRQQQVVDDLAAFAQPYLSRLWARLHGRDVWQEPCDDVDDVRALLDGVARSVSLDHRQRIKAMLELQVAG

SEQ ID NO: 1693 - protein, 378 aa, Mycobacterium paratuberculosis
MRLVADSGLWTTGRADVTEEPPLVALLEVSGAVLSWTLNDPDDAPPRLTFTDVSRADWLWRVLGEAGHVALLSAVRDAAVPAGGIELAGVDVAPGALAPLRRLATGHWLRRWWPASRQDGIAGLDRALLDAELALLTAGAQHFFPDDTLDSDVAGLLAPHATALLGHLVSPDPRVADLVRASAGLADGIGVDAGRWPELLAALDDSSLVVAPPSDRRDDYALAAGAGAGPRAAAIARGVASVAWSGVPPGVFDAAEDTVGWSIRVDGSAVVAVVQADVIGPDPATGIAVRLRSAAVEGAGALDAAGRATFPLTGARGALTESAAWDHDWSATEVQVGAAVSTESRHTRERVRRWARTRLESPPRDAFLAERLAAESAY

SEQ ID NO: 1694 - protein, 355 aa, Mycobacterium paratuberculosis
VPNTYRVVQWNTGNVGKSSLKSIVTNPTLELVGCYAWSAEKVGRDAGELVGIPPLGVAATNDVDELLALKPDCVVYNPMWIDVDELVRILSAGVNVVTTASFITGGNLGDGRDRLLQACQQGGATIFGSGVSPGFAELLAIVSAMVCNRIDKVTVNEAADTTFYDSPETEKPVGFGQPIDHPDLPAMAAKGTAIFGEAVRLVGDALGVELDDVRCVAEFAQTTEDLVMASWTIPAGHVAGTYISWQGIVGDQVLIDLNVRWRKGQTLDPDWKIEQDGWVIQIDGQPTVTTKVGFLPPPYFEATTIEEFMDLGHIMTAMPAINAIPAVVAAAPGIASYADLPLTLPRGNAHVAGQP

SEQ ID NO: 1695 - protein, 209 aa, Mycobacterium paratuberculosis
MPGAPAAGADPCPDVEVVFARGSGEPPGIGGIGQPFVDALRSQIGSRSLAVYAVKYPASTDFSNPDFPATVIDGIRDASSHLESMVASCPNTREVLGGYSQGAAVAGYTTSAVVPPGVPASAVPPPMPPEVAKHVAAVTLFGTPSGQFLQKYHAPPLAIGPLYQPKTLQLCAVGDPICGTGGGDDLAAHTSYPVNGMTNQAAQYVFSHL

SEQ ID NO: 1696 - protein, 330 aa, Mycobacterium paratuberculosis
MRAMRVLITGGTGFVGGWTAKAISDAGHSIRFLVRNPGKLHTSVAKLGVDVSDFAVADITDRVAVREALQGCDAVVHSAALVATDPRQTAEMLATNMQGAQNVLGQSVELGLDPIVHVSSFTALFHPDLETLTAELPVVGGADGYGTSKAQVEIYARGLQDAGAPVNITYPGMVLGPPVGDQFGEAGEGVRAALQMHAIPGRSAAWLIVDVRDLAALHAALLEPGRGPRRYTAGGHRVPASDLAALLGEVAGTPMVAVPIPDTALRVAGAVLDRAGRFLPFETPFTWAGMQYYTQMPASDDSPSERELGITYRDPRQTLADTFAALSATS

SEQ ID NO: 1697 - protein, 191 aa, Mycobacterium paratuberculosis
MTRRPHPGDSTTRDLLIDATIKVMVEDGYAAATSRRVAGEAGVKPALVHYYFPTMDELYLDVFRRGAAAYQERQTRALTSERPLHALWDTLIEPKDTRLLLEFMGLANHRKAIRAELAAWFGRWRDTQITALNSIVREHDMDAGEFPPAGIAVILAAIGRMLILEDALGATAGHDEAVALVNRFIDRFELP

SEQ ID NO: 1698 - protein, 400 aa, Mycobacterium paratuberculosis
MTVTNDTAVYYDPYDIGIITDPYPTYARLREEAPIYYNERYDFWALSRHSDVERALANWQVFSNRRSDILELIQSKFDMPGGVMMFQDPPEHTVLRGLMSRVFTPRRMAALEDQIRQYCIRCLDPLVGSSSFDIIAELASMMPMRVIGMLLGIPESEPVSVRDANDANLRTKPGAPLRVADADSIADGRIYADYVEWRSKNPSDDLMTTLLNVEFDDEDGVRRKLTRKEVLHYTQVVAGAGNETTGRLIGWLAKVLAEHPDQRREVYRDRSLLTRTVDETLRFEPTGPHVARWMAADFECYGTTVPAGSAMLLLFGAANRDPRRYTDPDTFNIHRDNISHITFGKGVHYCLGANLARLEERVALDELLNRWPEWDIDYDTAQLASTSTVRGWERLRIVVP

SEQ ID NO: 1699 - protein, 331 aa, Mycobacterium paratuberculosis
LPSSRPMPTSTDRMLGDRPNLCRRPCLAASRRVRQDAAGGHRSVKICGIGVKASLRTRHRPAPTGTVTGMTVVEFTGGAAPRGALPSRSTLPGPGSVRVTAAYAAALLVVYLVLAALGPHARQVAVSRMSTNVHNLGRGQLGTLIGSAFVDDGGELFFWLPGLVCLLALGELLWRGKGLLVTFAVGHIGATMIVAVGLVAAIESGMLPASVARASDVGISYGAMCVLGAITAAMPVRWRGVWAGWWLGTAVVATVGADFTAVGHVVALLLGIGLSFRLRSTASWTPVHLALLCVGATFGYLLLAGAASMAPIGGLAGAFIGVLARRPLGAC

SEQ ID NO: 1700 - protein, 557 aa, Mycobacterium paratuberculosis
LSWGFGDDCWVQGRSDDQRELLDAESVAGHLLKADSMFAFLAAHRSQLFPEEMFADLFPSQRGRPSVPAEVMASVITLQALHGFSDNETVDAVTFDLRWKAACGLPITAGAFHSTTLTYWRRRLAASDRPNRIFEAVKTVVAETGVLAGKTRRALDSTVLDDAVATQDTVTQLIAAIRRVRREVPGAAAVIEAHCSAHDYDDPGKPAIAWEDKAARDRLVDGLVGDAHRVLGYLPDQELAPRAAEAVALLALIAGQDVEPVEGSDGTDGHWRIAQQVSGDRVISTVDADTRHAHKTVHRRQDGFKAHLAVEPDTGIITDCALTKASGADNHEAVVGLSLLEGEHTPGAGPGRFGVWHRGRPGGTGRRRPCRGDQTATATLAGSGWLHQRRFPHRFRRPHRDLPGWTRNADPSQWRSHLRKILSLMPVGVPVHDRHARTQTHPSYPRAIIARCSRRGPRPRLASRIPPTPAHGGTLNGLAHSRQPQGPLPRNRQKQPLAAPPRRSTEPTSAAHHGPDPHRHHLGHRLTRPHTKALPQPPTAATLNNGGAISFLSTHRV

SEQ ID NO: 1701 - protein, 509 aa, Mycobacterium paratuberculosis
MPYRRSMRISVESHLEYYHVDYRQFPTAEGVSTFSPADPAVDVLDRFRAAGTVDPKPAAPGEVHSNRVIELPGGAEQTIAESTGPASISALRLYLPAPADQSLTGLRLRIEFDGRTTVDSPLGEFFGAGLGPTPVRSLMFAAFPQPDGSMALWCWWPMPFARSARVSLANTGAGPVFGIAAEVTTTPDARWAGALASGRAGYFTARSHAGPTILGQDWPFADEQGRGKFVGVSQTIRGQRTRTAFSDNAPYFLEGAERVYTDGAASPQWYGTGTEDLYEGGWYFKDGTHFSDPLNGQPDQRTATAGCADYCVAVYRIMPAEAIGYHSALRFGIEHGKRNMVEPDYSSTAFLYTQPDAELTGTDDVNPTDPLSRALHGYTDTDAIDQLLVSEYEGTEDTRPVAGTVRSAQGAITFHVQVDPDNHGVLLRRSGDQVNGFQSADVAIDGAPVGNWFQPRANPFHRWLDDTYPVPGSVTAGKAELTVTLTPTAGSPPWTASRYHVDALVGLSG

SEQ ID NO: 1702 - protein, 188 aa, Mycobacterium paratuberculosis
LTMQGDAQCVRGNRNTAWPLAARLFPAMFALLMLVIAGTGSAAAQPSPWTARPFGDRLVGWDTYRRLDLLPYLSADTQSLQLSSFDRSGGDFDISTGNKNGTGGCLAPGGAGCVIAEDHGAGEVDSIWLTRDGGNLRAIGNIRVELDGQTVLDTPVQSLVDGQLGAPFVWPLVANAGESPGGDYIKVP

SEQ ID NO: 1703 - protein, 342 aa, Mycobacterium paratuberculosis
MAAAEEVDVDGIAVRLTNPDKVYFPKLGSKGTKRHLIDYYRAVAGGPMLDALRDRPTHLQRFPDGIDGEEIYQKRIPQHHPDYLQTCRVTFPSGRTADALKVTHPAAIVWAAQMGTVTLHPWQVRCPDTDHPDELRIDLDPQPGVAFAQARSVAVDVLRPLLDELGLVGYPKTSGGRGIHVFLRIATDWDFVEVRRAGIALAREVERRAPDAVTTSWWKEERGARIFIDFNQNARDRTMASAYSVRRTPIATVSMPLTWDQLAGADPDDYTMATVPDLVSARENPWAAIDDVAQSIGPLLRMAEADEERGLGDMPYPPNYPKMPGEPKRVQPSRDTEHKKKN

SEQ ID NO: 1704 - protein, 369 aa, Mycobacterium paratuberculosis
MDLPVMPPVSPMLAKSVGAIPPAASYEPKWDGFRSICFRDGDEVELGSRNERPMTRYFPELVAAVRAELPQRCVIDGEIVIATDHGLDFEALQQRVHPAESRVRMLAEATPASFIAFDLLALGDEDYTGRPFRERRAALLEAVGGPGPSIHVTPATTDLDTARRWFDEFEGAGLDGVVAKPLDITYQPDKRVMFKIKHERTADCVVAGYRVHKSGADAIGSLLLGLYQDDGQLASVGVIGAFPMAERRRLFTELQPLVTDFEDHPWNWAAHQAGERTPRKNEFSRWNAGKDLSFVPLRPERVVEVRYDHMEGRRFRHTAQFNRWRPDRDPRSCTYEQLEQPVTFRLDDIVPGLGASRADHKPGKQIGAP

SEQ ID NO: 1705 - protein, 115 aa, Mycobacterium paratuberculosis
MNTTHHRKPVVAGALLAGGIAAAGLGIASAAAQPSAPHLIGPLPTDNFTVPHDWCLGQPLPMPDVRWDMNVCHHWYWVPVGGMGNVGQFVWEGDAPRQPLGGPPCYGAPICLPGL

SEQ ID NO: 1706 - protein, 122 aa, Mycobacterium paratuberculosis
MSVTAFQDLPLADRDREWDGDAAEKRVRKWAGAQDEPNEKYRDAHVWYDADKKDNFTAYKLLIADVIGGELKAVPRGVMAAGAIMDGARGGIDVPKSDIDRIKSHLAKYYQKMGESPPWERS

SEQ ID NO: 1707 - protein, 411 aa, Mycobacterium paratuberculosis
MTTAPTESAESQGLLLQLLDPANRADPYRLYAQFRERGALQLPEANLAVFLSYRDCDEVLRHPSSSSDNVNSTVAKRQAAAGTAPVRQGPPGFLFLDPPDHTRLRRLVSKAFAPRVVAALEPDIRSLVDGLLDRAADKGELEIVEDFAYPLPVAVICRLLGVPLDDEPQFSRASALLAQALDPFSTITGVPAEVASERQRAGTWLRDYFHQLIEARRSRPGDDLLSGLIAVEESGDQLTEEEIVSTCNLLLIAGHETTVNLIGNAVLAMLRDPGQWAALGADPGRAPAIVEETLRYDPPVQLAGRIALDDMVIGGVEVPAGDVMMLLLAAANRDPAEFDRPDTFDPDRKCLRHLGFGRGVHYCLGAPLARLEAGVALSAVTARFPRARLDGEPQYKTNVTLRGLSRLVVAV

SEQ ID NO: 1708 - protein, 301 aa, Mycobacterium paratuberculosis
MHTLRTPDDRFHTVPDFPYPPRYCEVSDDDGGALRVAWVEDGPAGADPVLMLHGEPSWSYLYRKMIPVLAGAGHRVVCPDLVGFGRSDKPTRREDHSYARHVEWMRALAFDVLDLHNVTLVGQDWGGLIGLRLAAEHPERFARLVVANTGLPNGDQPMADVWWRFREAITSAPQLNIGAFVQGGCRRRLSDAERAGYDAPFPSDEYCAGPRAMPTLVPTSPEDPAAAANKAAWAKLAVSPTPMLVAFSDSDPITGPMAAIFQREMRGAQGIDHPLIRGAGHFLQEDAGAELAGHIVEFLRR

SEQ ID NO: 1709 - protein, 161 aa, Mycobacterium paratuberculosis
MPKLSAGVLLYRTGDGVVEVLIAHPGGPFWARKDDGAWSIPKGEYDEGEDPWPAARREFAEELGLAVPAGERIDLGTLKQSGGKLVTVFAVHGDLDVTEARSNTFALEWPKGSGTLREFPEVDRVGWFPVAAARTKLLKSQHGFLDRLMAQPAVAGLSEGT

SEQ ID NO: 1710 - protein, 451 aa, Mycobacterium paratuberculosis
MELIMPTDAVFLLGESREHPMHVGGLQLYQPPEGAGRNFVRDFYKQLVAQPDFQPTFRKHPAKFVGGIANLGWSYDADVDVDYHVRRSALPSPRRVRELLELTSRWHSSLLDRHRPLWETHIVEGLKDGRFAIYTKVHHALIDGVSAQKLMQRALSSDPDDLEIRAPWTLPKRSRKAGPSSRLSSLVHAAGSVAALAPSTVSLARAALVEQQLTLPFGAPRTMLNVKIGGARRCAAQSWPLERIKNVKNAAGVTVNDVVLAMCSGALRYYLLEQNALPDTPLIAMVPVSLRTEEEADAGGNLVGAILCNLATDSDDPAQRLLTISESMRSNKKVFSQLPRFQALALSAANLSSLALAAVPGWVSATSPPFNIVISNVPGPTAPLYYGGARLDGNYPLSIVLDGQALNITLASNAGNLDFGLVGCRRSVPHLQRLLMHLESSLKDLERAVGE

SEQ ID NO: 1711 - protein, 297 aa, Mycobacterium paratuberculosis
LSIIAGYGKGAAMGVLEGKVAIVTGTSRGVGVGIAHELLRAGATVVGCARSPLDTIPGIEPDWTERAFQRVCDQGDYRGIDAFVTDVVATHGRLDILVNNAGGTVPAPHAESIPELVQRIQGSPAADDDYARTALFHAFAVQMNLIGPLWFAIRTYRQMQTQDRMGCIINISSGAGHPAGSPTLVSYGAAKSGLNHLTRSLAQEWGPKVRVNCVALGPTMTENFRSFVLPKDDPTGEKYFAAVPLRRAGEPAEVGRICVFLAGGQADFVNGTTIECDGGMLPGVLYDAGLKTITDLL

SEQ ID NO: 1712 - protein, 367 aa, Mycobacterium paratuberculosis
VKNSGRSTMSSPSKLRVIQWATGGVGKAAIQCVLNHPRLELAGCWVHSAEKNGVDVGRIIGTQDLGVTASTSVDEVLALDADCVVYSPLIPNDDEVIAILRSGKNVVTPVGWVYPDPGNPRHRAVADAALESGVTLHGSGIHPGGITERFPLMVSSLSSAVTHVRAEEFSDIRTYNAPDVVRHIMGFGGTPEEATGGPMAGLLDGGFKQSVRMIADHMGFRIDPNIRTIQDVAVATADIDYDPFPITAGTVAARRFRWQALVDGEPVITAAVNWLMGEQNLDPAWDFGGRGERFEVEITGDPDVSLTFKGLQPETIAEGLVKNPGVVVTANHCVNAIPDVCAAAPGIKTYLDLPLFAGRPAPGLATS

SEQ ID NO: 1713 - protein, 257 aa, Mycobacterium paratuberculosis
MSYSHPDSMRGQVAIVTGAAQGVGKGIAAALLERGAAVLLVDIQQETLEATATELRALGRVERLVTDLRDPDSAPRIAAAAVDAFGSVHGLVNNAIATNEPKAFVDITTDDLALGYEVGPRATFLLMQAVHPLLVKEGGGAIVNLGSGTGTGGEPRWGGYAAAKEGIRGLSKVAALEWGRDNIRVNVVCPFAESDGVKLWKQFAPNDYAKAVGRVPMKRIGDVRTDVGALVAFLLSTDATFITGQTIHVDGGIGCFR

SEQ ID NO: 1714 - protein, 198 aa, Mycobacterium paratuberculosis
MTPESLRDRQRAQIRADIRRAAFRLFVERGYDAVTTEEIATAAGVSPRTFFRHVPAKEELLLAPVRYGGAAIVHLLEGRPAGESPDVALINAIITRTRSFEPADTEEWRQALLVAPGLLDKVTVHRPADKERATKLIADRMRVDPHTDIRPGLLVQLAFAAADFGFQQWVLQSGRRWPLDRYVAEALKAVKSPHWRRK

SEQ ID NO: 1715 - protein, 328 aa, Mycobacterium paratuberculosis
LHLRCGRRGQARHVRQRTSAGIPAQGGAVSGRLRDDARPVVLRVRAAADRHGDRVQPGRRRLPAGHVPHLRLLTIVGRQLPNLDMAAATEHGIAVARSEFAHPRFAALRDATPELAWGLMIATVRHLADEHRQMRAGGWQRTAGMTLSGKTLGLLGLGRVGSRMAGFAAAFGMEVIAWSQNLTDDTAAAVGARRVSKAALFESADVVSVHLVLSERTRGLVGEPELALMKPSAYLINTARGPIVDEPALIAALTAGRIAGAGLDVYDVEPLPGDHPLRSLPNVTLSPHLGYVTREMLGAFYADTVESVLAWLDGTPIRIANHEVLQRD

SEQ ID NO: 1716 - protein, 515 aa, Mycobacterium paratuberculosis
VSPNRRAVAEFAEFIAAIDQGTTSTRCMIFDHQGAEVARHQLEHEQILPRAGWVEHDPIEIWERTSSVLTSVLNRANLSAENLAALGITNQRETTLVWNRKTGRPYYNAIVWQDTRTDRIASALDRDGRGQVIRRKAGLPPATYFSGAKLQWILDNVDGVREAAERGDALFGTADSWVLWQLTGGPRGGVHATDVTNASRTMLMDLETLDWDDELLSFFTIPRAMLPEIGPSSSPRPFGVTSDTGPAGGRIPITAVLGDQHAAMVGQVCLAEGEAKNTYGTGNFLLLNTGESIVRSEHGLLTTVCYQFGDAKPVYALEGSIAVTGAAVQWLRDQLGIISGAAQSESLARQVDDNGGVYFVPAFSGLFAPYWRSDARGAIVGLSRFNTNAHLARATLEAICYQSRDVVDAMAADSGVRLEVLKVDGGITGNDLCMQIQADVLGVDVVRPVVAETTALGAAYAAGLAVGFWADPGELRANWREDKRWTPAWSDEQRTAGYAGWHKAVQRTLDWADVT

SEQ ID NO: 1717 - protein, 238 aa, Mycobacterium paratuberculosis
MSNPFTPPDGPFGARPGFGFGFGPGRVDRRALHEARRQARRDFREHLREHAGGHDGPLGFGPGFGPGFGPGFGPGFGFGPGGPRGAWRRGGPGRGKRGDVRAAVLALLAERPMHGYEMIQLIAERSNGLWKPSPGSVYPTLQLLADEGLITATETDGSKKLFELTDDGRAAAEKIETPPWDEIAEGADPGHMNLRAAIGQLFGAVGQSAHTASPEQQQRIVDILNNARREIYGILGED

SEQ ID NO: 1718 - protein, 129 aa, Mycobacterium paratuberculosis
MDANDKLTVDGGAAGAVASGRPGRPGGRNVWPWVNWGLALATVPAAAIVMLFALGAVMSTDGCSDRSCPNLGHGGIDFGVAFYGAPAVAVVVIIVSFLTAKRRGGIAVPLCGWALLIADVALMAASVSS

SEQ ID NO: 1719 - protein, 289 aa, Mycobacterium paratuberculosis
MSEVVTGDAVVLDVQIAQLPVRALSALIDIAVIVVGYLLGLMLWAATLTQFDTALSNAILLIFTVLVIVGYPLILETATRGRSVGKIALGLRVVSDDGGPERFRQALFRALASLVEIWMLFGSPAVICSILSPKAKRIGDIFAGTVVVNERGPRLGPPPAMPPSLAWWASSLQLSGLSSGQAEVARQFLSRAAQLDPGLRLQMAYRIAGDVVARIAPPPPGAPPELVLAAVLAERHRRELARLRPPAPWPAPGYPPAWPGSGPAPQWPAPGPANPGPPEGFSAGFTPPR

SEQ ID NO: 1720 - protein, 330 aa, Mycobacterium paratuberculosis
VDVDAFVLAHRPTWDRLDRLVGRRRSLSGAEIDELVELYQRVSTHLSMLRSASSDSMLVGRLSSLVARARSAVTAAHAPLSSTFVRFWTVSFPVVAYRSWRWWVATGAAFFAVVVIVALWVAGNPEVQSALGTPSDIDQLVNHDVESYYSEHPAAAFALQIWVNNSWVSAQCIALSVVLGLPIPLVLFENAANLGVIAGLMFPAGKGGLLLGLLAPHGLLELTAVFLAGATGMRLGWSVISPGDRPRGQVLAEQGRAVVSVAVGLVAVLLVSGLIEALVTPSPLPTFVRVGIGVVAEAAFLCYIGYFGRRGVKAGESGDIEEAPDVVPAG

SEQ ID NO: 1721 - protein, 440 aa, Mycobacterium paratuberculosis
VILTGRTGLVALICVLPIALAPWPATVFTALLAALAVAVAVDAALAASPARLRYIRSPDRSARLGQHADAALLIHNDGPRRFRGQIRDAWPPSARARPRLHPVDIPAGQHQHIATRLEPVRRGDQRATVVTARSIGPLGLAGRQGSQSVPGQLRVLPPFLSRKHLPSRLARLREIDGLLPTLVRGQGTEFDSLREYVVGDDVRSIDWRATARRADVVVRTWRPERDRRVVIVLDTGRTAAGRVGVDPTAADPAGWPRLDWSMDAALLLAALASRAGDHVDFLAHDRVGRAGVFGASRTELLAQLVDAMAPLQPTLVETDWRAMVSAIALRARRRSLVVLLTDLNAAALDEGLLPVLPQLSAKHHLLVAAVADPRVDQMAAGRSDAAAVYDAAAAERSRNERAAIAARLRHGGVEVVDAAPAELAPALADHYLAMKATGRL

SEQ ID NO: 1722 - protein, 327 aa, Mycobacterium paratuberculosis
VTQPTQPVTASPTAESAREALLALRAELAKAVVGQEGVVSGLVIALLCRGHVLLEGVPGVAKTLLVRALAAALQLEFKRVQFTPDLMPGDVTGSLVYDARTAAFVFRPGPVFTNLLLADEINRTPPKTQAALLEAMEERQVSVEGEAQPLPEPFIVTATQNPVEYEGTYQLPEAQLDRFLLKLNVTLPPREAEIAILHRHAHGFDPRDLSVVQPVAGPADLAAGRDAVQQVRVADEVLGYIVDIVGATRSSPALQLGVSPRGATALLATARSWSWLSGRNYVTPDDVKAMARPTLRHRVMLRPEAELEGATCDGVLDGILASVPVPR

SEQ ID NO: 1723 - protein, 377 aa, Mycobacterium paratuberculosis
MATTTATATAPRRRRSWRWVLATLLVLAVIAGVDAYLSAPRPGTRMDAASTDPDGAHALVALLRDGGVDVVVADHIADVESAARPDALILVAQSQYLADSVLDRLARIRSDLLLVEPTTEARKALLPGVRISGTNGFDSDPNCTLREAVRAGSVRFGRATTFESEDGRAMTRCYDGALIRFRDGGRAITAVGSTDFMTNGSLLQAGNAALAMNLAGGRPRLVWYAPHFVEGESSSKATVLDLIPANVYWVVGQLAVVVLLVAVWQGRRPGPLVAEELPVVVRASETVEGRGRLYRSRRARDRAAAALRTAALQRLTPKLGLAGGATPEAVVSTAAQRTGSDPGWVSYHLFGPPPTTDHDLLQLARALDGIERQVAHP

SEQ ID NO: 1724 - protein, 217 aa, Mycobacterium paratuberculosis
MPSIDIDRDAAHRAAADELHKPIYSKGSTPSQLVAWLNDAIYRMLQKISTVPGGWLTATVLFLLLAIAAVVAVHTLRRTMRTRRGGDHMLFEAAPLTAAQHRATAESCAAEGDWAAAIRHRLRAVARQLEETGVLTAAPGRTANELARDAGAALPHLAGELAQAATAFNDVTYGEQPGTQAAYQLIADLDEHLRSRWQGVTPPPGQPVVAESWAQVR

SEQ ID NO: 1725 - protein, 419 aa, Mycobacterium paratuberculosis
MCATLRAGARVNVVKWSGRRQDGAHDEPPVHEPRGSVSAPPPGYPVGPPPAYGPQSQYGAQYGAHFPGRYGAHYGPPPTYPPPGYPPAPAFGPPPGYGVLKPGIIPLRPLTLGDIFNGAVGYIRANPKATLGLTAIVVIAMQIITKAAVLGPLAAYGRFTGDRSDELTAGVLGAWSVSVGAGVLVGWLGGMLLSGMLTVIVGRAVFGSSITIGETWTKIRGRLPALLGLALLEAVVVAAIAGLVVVVIAILATIGNAAAAVVLGIPLVLTVIAVLVYLYTVVLFAPVLIVLERLPVLDAITRSFQLVRRGFWRVLGIRALAFLVTAVVANAVAVPFSIVGQVFQISSSGTAFLISTAILSVGAAIGEIITAPFNAGVIVLLYTDRRMRAEAFDLVLQSGAAQGSYAAASTDSLWLTRPR

SEQ ID NO: 1726 - protein, 154 aa, Mycobacterium paratuberculosis
MAELKSRLRADLTAAMKAQDKLRTATLRMLLAAIQTEEVSGKQAKDLTDDEVIKVLAKESRKRAESAEIYTQNGRGDLAANEHAEARIIDEYLPTPLTEAEVADVVDTAIAQVAEEIGERPSMKQMGMVMKAATAIAAGKADGARLSAAVKERL

SEQ ID NO: 1727 - protein, 570 aa, Mycobacterium paratuberculosis
VFVLATAGHVDHGKSTLLHRLTGMWPDRLAEEQRRGLTIDLGFVWTELAGRRLAFVDVPGHERFVANMLAGVGPVPAVVFVVAATEGWMPQSEEHLAALDALRVRHGLLVISKADLADPGPAVAQATERFAATSLAGVPVAIGTDLERVRAELVALTDRLPPPDPHADVRLWVDRSFTVRGAGTVVTGTLAAGTVRVGDELEHAGRRVTVRGLQSLGRNEIQVGAVARVALNLRGVDRRDIGRGDTVRTPGAWRDTAEIDVALRGPGTAEDTLHSQLVLHVGSAAVPVRVRRLGPAAARLRLARPLPLRVADVGLLRDPGKHRIAAGVEVLDVRPPELRRRGAARLRAAELATGSAPAPHIARADELRAMGAPARGQRVGDWVVDPQWWAARRDEAAAQVRRWAGEHDIAAGMPLETLRRQVGLPAAELVPKLLQGTGFEVADGLVRAPGAGLPARVDQAVREVEAWLAAEPFRAPEADELAGLGLGPRELAAAVRTGRLTRIADGVVLGPDALARAAGVLAGLPQPFTVSEARRALGTTRRVAVPLLEQLDARRVTRRAGDGTRVLIAD

SEQ ID NO: 1728 - protein, 361 aa, Mycobacterium paratuberculosis
LRPVINATGVVVHTNLGRAALDAVVAAGGATDVEFDLATGRRARRGRGALAALARAVPAAGGVHVVNNNAAALLLVALTLAPGREIVLSRGELVEIGDGFRIPELLESTGARLREVGTTNRTGLRDYTEALGPQTGFVLKVHPSNFHVTGFTSAVGVAALAAELRTRDIPLVVDIGSGLLAPHPVLPDEPDATSTLADGADLVTASGDKLLGGPQAGLLFGRGDLVERLRRHPAARALRVDKLTLAALEATLTGPPPPVAAALDADVGRLRARAQSLAAALPADADAVALDCVAAVGGGGAPGVELPSAAVSLPERYAAALRAGRPPVVGRLEGGRCLLDLRTVSPEDDELLAAAVRACSS

SEQ ID NO: 1729 - protein, 305 aa, Mycobacterium paratuberculosis
VVRGLGAASPRDPLGELLVGLDSGDDAAVVRIRQGTALIATTDFFTPVVDDAYDWGRIAATNALSDVYAMGGRPVVAVNLLGWPREVLPFELAAETLRGGLDVCGLAGCHLAGGHSVDDPEPKYGLAVTGIADPNRLLRNDSGKPGLPLSLTKPLGIGVLNNRHKATGERFEEAIAVMTTLNAEAAGAALAAGVECATDVTGFGLLGHLHKLARASGVTAVLDAAAVPYLDGAREALAAGYLSGGTRRNLDWVAPHVDLSGVGEDEALLLADAQTSGGLLIAGEIPGAPVIGELVPRGEHTIVVR

SEQ ID NO: 1730 - protein, 184 aa, Mycobacterium paratuberculosis
VFLEWPVLRQVRSTDKLGRGSAVTSKHTRALAPRTATADRVVQSVCPYCAVGCGQRVYVKDERVVAIEGDPDSPISRGRLCPKGSASEQLVNSPGRQLQVLYRAPRATEWQPLQLDTAIDMIADRFVESRRNSWQDIDKKGNLLRRTMGIAALGGATLDNEENYLIKKLFTAAGAIQIENQARI

SEQ ID NO: 1731 - protein, 874 aa, Mycobacterium paratuberculosis
MAECHPVGFQWVEEARARGARVIHVDPRFTRTSAVSDRHIPIRAGSDVVLLGALINHVLTNDLWFSEYVVAYTNAATIINENFRDTEDLGGLFSGFDPETGQYDTSSWAYEEEDDGRSGGEIESPGGGHTHGATATHSAAGDEHGSGGPPLAHARVRRDETLQHPRTVFQILKRHYARYTPEMVKDVCGISREDFDYLARSIVENSGRERTTCFAYAVGWTQHTLGAQFIRTATILQLLMGNVGRPGSGIMALRGHATIQGSTDIPTLFNLLPGYLPMPKAGVHDTLADYLAAVGSKKQKGFWANADAYTVSLLKAWWGEAATADNDWAYDYLPRLTGPHGTYQTVMGMLADEVEGYFLLGQNPAVGSAHGRMQRLGMSHLKWLVVRDFNLIESATWWKDGPEIASGELKTEEIETEVFFLPAATHVEKAGSFTQTQRLVQWRHQAVEPPGQCQSELQFFYELGKRIRQRLAGSTDERDRPLLDLTWDYPTDEHGDPDGEAVLAEINGYRVGEPADPLASYTELRADGSTAAGCWIYTGVYANAVNQAARRVPNGGASPSQSEWGWAWPADRRVLYNRASADPDGKPWSERKRYIWWDPDQRRWVGYDVPDFVVDRAPGARPDPELGGPDALAGDDPFIMQADGKGWLFAPKGVVDGPLPTHYEPQESPVANALYPQQRNPARITFARKDNLSAPSAGEPGSDVYPYVFTTYRLTEHHTAGGMSRWLPYLSELQPEMFCEVSPELAAERGLQPYGWATIISPRAAIEARVLVTKRVAPLVINGHTVHQIGLPYHWGVGGDAVVSGDAANDLLGVTLDPNVQIQESKAGSCDIRPGRRPRGEELLRLIADYQSRSGVTAETGNVRVDDAVWERGS

SEQ ID NO: 1732 - protein, 324 aa, Mycobacterium paratuberculosis
MGQLTGPTDPAADAGWADRKPRKGFFTDTSICIGCKACEVACKEWNRNPQDGDLELLGSSYDNTGALGASTWRHVAFVEQGRERIEQARESGRALIDLGMPTLPGAASEPTEPAVPHTPEFRWLMSSDVCKHCTHAGCLDVCPTGALFRTEFGTVVVQHDVCNGCGTCVAGCPFGVVERRNDGTYATPAQRPDRPSEEIVTGVAQKCTLCYDRLLEDEIPACAKTCPTTSIKFGDHDDLVAMARRRVAALHAQGLTEARLYGANEHDGVGGTGSIFLLLDEPEVYGLPPDPRVCTADLTTMFKRAGLAAAGMVGAAVLAFWRSR

SEQ ID NO: 1733 - protein, 361 aa, Mycobacterium paratuberculosis
VSTSEFDSFRPPEPAGGKRRKDKRGGRRGAGDGSREMPMVPEAEFSSYYGRPVVKPAPWGHEVGAYLFLGGVAGGSGLLAAGAQLTGRDTLRRNTRLTALAAVLLSLVALVKDLGRPERFLNMLRTVKLTSPMNLGSWILSAFSAGISVAAAAEVDRMTGQRLPLGPLRPVLRAAEGPAGLQAAVLAPPLAVYTAVLLADTATPTWNAAHEDLPFVFVSSASLAASGLAMVTTPVHQAGPARTLAVLGALGDLAASKVMERRMDPVAAEPLHTGGPGRMLRASERLVIAGGLGTLLGGRHRAVAVVSGLALATASALTRFGVFEAGLESARHPRYTIEPQQRRLAARRAAGITSDSITTAG

SEQ ID NO: 1734 - protein, 328 aa, Mycobacterium paratuberculosis
MTNFGYTLMTEQSGPKELVRYAISAEERGFDFHVCSDHFSPWLTSQGHAPNAWAVLGAVAQATERVDLYTYVTCPTMRYHPAIVAQQAATVQILSDGRFTLGLGSGENLNEHVVGKGWPTITRRQDMLREAIKIIRELFGGQLVDFTGDYFRVDSARLWDVPDVPVGIGVAIGGTRAVDKFAKLADHLIATEPNADLVDAWHGARQAANLAGGGRVVGQIPVSWDPDPDTAVKRAHDQFRWFAGGWKVNADLPTPAGFAGATQFVRPEDVADAIPCGPDLDAIVEGVRPYWEAGFTDIALVQIGGDTQERFLKEAAEPLLAALRDAAK

SEQ ID NO: 1735 - protein, 184 aa, Mycobacterium paratuberculosis
MSNELQGKKIAILAADGVEKVELEQPAAALREAGAGVEVVSLQDGEIQARNHDLEPAGTFTVDRKVADASVDDFDGLVLPGGTVNPDKLRLDDTAVSFVRDFVGSGKPVAAICHGPWTLVEAGVATGRTLTSYPSIRTDLRNAGAHVVDEEVVVDGNLITSRSPKDLPAFCSTILAQFAGATTG

SEQ ID NO: 1736 - protein, 229 aa, Mycobacterium paratuberculosis
VTTTYPEPAVLPAHNVYQPQEDSRLLVDVMHGTGLIPGRRVLDLCTGSGFVAIAAAEMGCASVTAFDKCPHAVRCARENAALAGVDVDVREGSWLAAVDCAPFDVVVSNPPYVPTPPGAVLDELGPVTGPSWAWNAGRDGRLVLDPLCESAPKLLRDGGSLLLVHSALAGVQQSLDCLKWAGMDAKVIASKWIPFGPVMLSRAHWLEDVGLIPRGRREEELIVIRAEKR

SEQ ID NO: 1737 - protein, 283 aa, Mycobacterium paratuberculosis
VTRTSIPTQPVLPSAHGPLSTAVRCALTGPPCVDHLARIGASVRDSDPYGLDLQLALAMCYELHYRGFTGVDPAWEWNPALLALRAELERVFLAGVRRDVGPIDPDRTAADEMDAIAAEPVEGTGPSYHLRDRGSWQQMCEYFVHRSLYHLKEGDLHAWAIPRLTGTAKAAFVAVEFDEYGAGQGPRLHQQRSPPRRDRRAWCAPCNACRRRRPASRSTASTWRRMRCTSRWCASMWSAIWWRANRSCSATSSSGSARTRRSRTAWRTRSWRRGSRVGRRCGG

SEQ ID NO: 1738 - protein, 256 aa, Mycobacterium paratuberculosis
VFLAILDTETGVLQYSNAGHMPAVLAGPEPGTTTLLTDAASVPLAVRREDPRPQATRLLPPGSTLMLFTDGLVERKHEPIDDGIGRAAEVLAQTMTLPLDTVADEVLRELAPAAGYDDDVAMVIYRHQQSPLRIETAATADQLVRIRHRLADWLGAAGITGELAADIVLVVNEACTNCVEHAYRGFVAGTMVLDARLGEGEVHTRITDYGSWKTPAANPVNSGRGLPLMKALSQAMELRTSATGTVADITFRRPAE

SEQ ID NO: 1739 - protein, 218 aa, Mycobacterium paratuberculosis
VVAVSWPSGDGDPAVQVAGRPAASSWRELDPWLRDTFAEARHQLPLTAKTVDHPDNPGKSRGLVAVLSGAGDLALWLELRTPRWVSGEDRLLVTVLIGHLSLALQHVRQFENARETSLTLQRAMLPPVQPPPGFAVRYEPAVPPLEIGGDWYDVLPIGDHRIGIVVGDCVGRGLPAAAIMGQLRSSARALLINGAEPAVLLDQLDSAASLIPNAYCTT

SEQ ID NO: 1740 - protein, 229 aa, Mycobacterium paratuberculosis
MSDDNDFHDQYARALRAYLASRDEASLAVGHELGRRALQEQISLLEIIEQHVRLVFEISQDVRIDAPIALEFLLQLLVPLDVATRGFIDGNRRYAEQRARAEGLADRDKFRNALVNSLQEGFFVADHEGSVIEVNNAFIEILGFPAEGLPYRWPHPWLVDPKTASEQIGVVLRTGSAEYETPIRHADGHLAWVKVSINAVKDSGSDRDAYVGTIRDVTAERAFAARESA

SEQ ID NO: 1741 - protein, 207 aa, Mycobacterium paratuberculosis
VRDSGRFGPIEWARAGRPLPSEYTSGDRGIAIDIDGEAALFALVDGLGHGPPAAEAALRAVDTVTAAGAEPIEVLIQLCHRALEGTRGVAMTLARIDFAANTLTWTGVGNVTAHLVAKAPTGTEVRSSARLAGGIVGYRIPEIRPAQVVSIRPGDLLVMRTDGTNTWTTSTSPPPPWPSPKVCWARTPRRPTTPWCWPPGTGEPRHE

SEQ ID NO: 1742 - protein, 136 aa, Mycobacterium paratuberculosis
VAADIVVAIDNPDDIVEARKAGHQLALDLGFSLTDVTMIATAISEIARNITSYAGRGAVRVAVADREGRKALVVRAEDEGPGIADIERAMEDGYSTGRGLGMGLPGARRLMDRLVVESTLGQGTVIEMWKWVPPRA

SEQ ID NO: 1743 - protein, 129 aa, Mycobacterium paratuberculosis
MPVPILKQGAILIASVQAALSDSDAERLRYDLMERVSRFRAQGIIVDVTAIDVMDSFAARSLRTIAHMTRLRGADTVIVGLQPEVAFAMVQLGLAFDDMNTALDLEEGIALLNRQLAQRKPTIGRDGGG

SEQ ID NO: 1744 - protein, 300 aa, Mycobacterium paratuberculosis
MSDSPSDFNSTGTAAQTVGISSEGLLPQLVQHLRQNRTILREEWARRITEAELLTAMTPEELFSEATAVYDNYVEVLETGSVEALQAYARDLSERIIPRGVETDEVVGIVLLLRDVLARSLFEKYQTEFEMLNRVLDAYEPAANRIANTVAVSFVQERERIIRQQQEAIRELSTPVLQVREQLLILPIIGVLDSQRARQVTEQLLRAIRANRAKVVVIDITGVPTIDSTVANHLVQTVDASGLMGASVIITGLSSEIALTLVTIGLDLSKMNAVGDLQGGIEEAERLLGYEVTRTGEQTG

SEQ ID NO: 1745 - protein, 122 aa, Mycobacterium paratuberculosis
LSAPDSITTLVEDHDGVSVVSVSGEIDMVTAPALEQAIGAVVADSPPALVIDLSAVEFLGSVGLKILAATYEKLGKETGFGVVARGPATRRPIHLTGLDKTFPLYPTLDDALTAVRDGKLNG

SEQ ID NO: 1746 - protein, 173 aa, Mycobacterium paratuberculosis
LADNVSGGDVDDPQEDQRWDRRERGETEVQRLDRNWNSLLQELRVVQTGVQLLTGFLLTLPFQQRFDVLGPPMRVAYLATVVFSVCATVLLIAPVAMHRILFRRHRLQVLVSAAHRCAYAGLGALGLALIGVTTIIFAAVAGRNVGLVAGACALPLFVLFWFVLPLLLRTRGM

SEQ ID NO: 1747 - protein, 215 aa, Mycobacterium paratuberculosis
VDGSLVDSNYLHVHTWQRAFDDEDIAVASWQIHRCIGMDGSRLVRTLSGDAPDDVGERLRDKHSRYYRELTPMLKPLPGARALLRRVADLGLQVVLASSAPEDELEILRKVLDCDDVIAATTSSRDVDTAKPEPGIVRVALDRAGVRAEEAIFVGDAVWDAHAARGAGLACIGLCSGGIARDELRAAGADPVFADPQDLLDHLESTRIAALARGG

SEQ ID NO: 1748 - protein, 114 aa, Mycobacterium paratuberculosis
LAHNDSRRGMTLDHRNSDPVDHARTFRQHAGETFTYGANVPGLAGSAVAVVAMTVGVFAVAAGHLTGGAIALIVAAVVGAVSAGWLLRTHRKVREAELRWHAAHSDRPPPPPSS

SEQ ID NO: 1749 - protein, 100 aa, Mycobacterium paratuberculosis
MATTTDYDARRVSDNDTPDKSSLRELAPALHGAGTTVVDDDPDDVHFFELPGADLSGEELSVTVIPQRADEFTCSSCFLVQHRSRLRRSAAGLPVCADCA

SEQ ID NO: 1750 - protein, 197 aa, Mycobacterium paratuberculosis
MDKALGALLLLGLGVPWYFTQHATGSLPAGCAAGLAGLAAAVGALWWLSLQRDRLRADAHRRRDLKHARAGLRAIDRMSGAEFEDFVAAQLRVAGYVVTPTAGTGDYGVDLIAKKDGVRMAVQCKRLAKAVGVAAVQQVVAGARQHGCDRTVVVTNQTFTKAARRLAITHRCRLVGRTQLRSWTRVAPIPVRGPRVS

SEQ ID NO: 1751 - protein, 229 aa, Mycobacterium paratuberculosis
VTNFDDLTLLNDVLRAIYSADTADFPQVLDDLTAASARWVPGAQEAGITVTSRQNEVSTPSVTDDCARLLDEFQQRYLEGPCLHAAWTRKVVVVDDLRTDSRWPKYQADALARTPIRSILSLPMYAGELSMGALNFYAERPHAFSDDSRRMAALFATLGSLAWSNVVRTQQFKEALSTRDMIGQAKGILMERYELDDETAFNTLIKLSQSMNTPLRDIARRVIDDTTQR

SEQ ID NO: 1752 - protein, 186 aa, Mycobacterium paratuberculosis
MVATEHEWSKPAALAIPREGYFELERGRYGPLYPRTPACYGFSIIAKVKEGREEAVRAYGKQIEEAIKADPHVLAALRLHYLRWLLFDVGSGLHFQYQGIFDTDFDKYTEDAVQLFSQTGITTVFTNLEGFPEDWRENPDAFVKFVREHQCPSFLEYGEYPYVTADEIKKALRLKAAFQTMLDQMQ

SEQ ID NO: 1753 - protein, 398 aa, Mycobacterium paratuberculosis
VQSAASVRDTMDSAKRWVTLGFTWNGLRALGVPGDALASFPEEFRQGMAARADILGDTGRNHPDNWVGGLAGADLHAIAILFARDDAEHARATNAHDDLLKRCQGVRRLSHLDLNATPPFNYAHDHFGFRDRLSQPVIEGSGEEPTPGSGAPLKAGEFILGYPDEVGPVANQPEPEVLSRNGTYAAYRRLREHVAVFRDYLRSVAGADRQEELLAAKLMGRWRSGAPLVLAPDEDDPELGADPLRNNDFNYKEMDPFGYACPLGAHARRLNPRDTAHNMNRRRMIRRGATYGPALPEGAPDDGEDRGIAAFIICASLIRQFEFAQNVWINDRTFHELGNEHDPICGTQDGTLDFTIPKRPIRRVLKGLPAFTTLTGGAYFFLPGINAMRYLAALGERS

SEQ ID NO: 1754 - protein, 337 aa, Mycobacterium paratuberculosis
MSTRPPARTYNQAHRVRPHTGGRRISIYWTWSYPWESQRDIQTLDNRFSTMTEVRRAAWPRYEGPDWDDAHFLQGIAGTLELFHRSTLAFQELAGEATGQQVAVFQRVDQAGYRLVIDERILADTDTLMVFGLDHLAGEDEAEPGEISAIRAWLEREGTCLLLAPHHDVGGTDDMAQRQVEYLHHGDPLVPRQQRFSAYTRSLMKGLDVPVRNRWGLHPARVAATGQMAPLTCFRDLDAPGLLDDVTTLNFHPHLPHYELTAPESDGLRVLATQRVDPARPHPFTEAGNSEFNALIWMPPHAERAGDIVLVDSTNFTTLFGGSDSLRNFWHNLATMR

SEQ ID NO: 1755 - protein, 367 aa, Mycobacterium paratuberculosis
VTRTRIAVRNLPRDWTDNAIRLIQADARRSADTHLLRYPLPSAWAGDADVALYLKDETTHVTGSLKHRLARSLFLYALCNGWIGEGTTVVEASSGSTAVSEAYFAALLGLPFVAVMPESTSAAKVALIESQGGRCHFVADSSQVYAEAERVARQTGGHYLDQFTNAERATDWRGNNNIAESIFEQMRDEKHPVPAWIVVGAGTGGTSATIGRYIRYRRHATRLCVVDPEHSAFFAAYAEGRDDVVASRSSRIEGIGRPRVEPSFLPGVVDRMVAVPDAASVAAARHVSAVLGRRVGPSTGTNVWGAFGLLAELVSQGRGGSVVTLLADSGDRYADTYFDDEWVAAQGLDPAGSAAALAEFERSCAWQ

SEQ ID NO: 1756 - protein, 315 aa, Mycobacterium paratuberculosis
LPILLRTGAAALGSTVAGLGYAAIIERNAFVLREITMPVLSPGSTPLRVLHISDLHMTPGQRRKQAWLRELAGWEPDLVVNTGDNLAHPKAVPAVIQALGDLLSRPGVFVFGSNDYFGPHLKNPLNYVTNPSHRVRGEPLPWQDLRAAFTERGWLDLTHTRREFEVAGLHVAAAGVDDPHIDRDRYDTIAGPASPAANLRLGLTHSPEPRVLDRFAADGYQLVMAGHTHGGQVCLPFYGALVTNCGLDRSRAKGPSRWGAHMQLHVSAGMGTSPYAPVRFCCRPEATLLTLIATPMGDRDAVSDLSRSQPTASVR

SEQ ID NO: 1757 - protein, 809 aa, Mycobacterium paratuberculosis
MSDRPPAALTVLKLAGFCLLASVVATALLFPVAGGIGLVSNRASEVVANGSAQLLEGEVPAVSTMVDAKGNTIAWLYSQRRFEVPSDKIANTMKLAIVSIEDKRFADHNGVDWKGTLTGLAGYARGDVDTRGGSTIEQQYIKNYQLLVTAKTDAEKRAAVETTPARKLREIRMALTLDKTFTKPEILTRYLNLVSFGNNSFGVQDAAQTYFGINASDLNWQQAALLAGMVQSTSALNPYTNPEGALARRNLVLDTMIENIPQEADALRAAKAAPLGILPQPNELPRGCIAAGDRAYFCDYVQEYLSRAGISKEQVARGGYLIKTTLDPDVQIPVKAAIDKFASPTLPGISSVMSVIQPGKTSHKVMAMASNRTYGLDVDAGQTMRPQPFSLVGDGAGSVFKIFTTAAALDMGMGINATLEVPGRFQAKGMGSGGAKGCPKDTWCVVNAGNYKGSMNVTEALATSPNTAFAKLIQQVGVTRTVDMAIKLGLRSYADPGTARDYNPDSNESLADFVKRQNIGSFTLGPIEVNALELSNVAATLASGGTWCPPNPIDKLIDRKGNEVAVTTETCDQVVPEGLANTMANAMSKDAVGGGTAAGSAGAAGWDLPMSGKTGTTEAHRSSGFVGFTNHYAAANYIYDDSPNPTDLCSAPLRHCGEGDLYGGNEPARTWFTAMKPIATNFGPVQLPPTDPRYVDGAPGSRVPSVAGLDIDAARQRIKEAGFQVADQNNFVNSSAKQGEVVGTTPSGATIPGSIITIQVSNGIPPAPPPPPEGAPPPVGSQVVEIPGLPPITIPLLAPPPPAPGQPPP

SEQ ID NO: 1758 - protein, 116 aa, Mycobacterium paratuberculosis
VSPTRPAARRTNIAAAQGVLRSVDAEERIAWVSKALCRTTDPDELFVRGAAQRKAAVICRHCPVMQECGADALDNRVEFGVWGGMTERQRRALLKQHPEVVSWADFFDKRRNRSAG

SEQ ID NO: 1759 - protein, 380 aa, Mycobacterium paratuberculosis
MSTTPKQLDMAAILADTTNRVVVCCGAGGVGKTTTAAAIALRAAEYGRNVCVLTIDPAKRLAQALGVNDLGNTPQRVPLAAEVPGELHAMMLDMRRTFDEMVVQYSGPGRAQAILDNQFYQTVASSLAGTQEYMAMEKLGQLLAEDRWDLVVVDTPPSRNALDFLDAPKRLGSFMDSRLWRLLLAPGRGIGRLVTGAMGLAMKAMSTILGSQMLADAAAFVQSLDATFGGFREKADRTYALLKRRGTQFVVVSAAEPDALREASFFVDRLSQEGMPLAGLVLNRTHPPLCSLPAERAIDGTEMLEHDGDPETTSLAAAVLRIHADRAQTAKREIRLLSRFTGANPHVPVIGVPSLPFDVSDLEALRALADQITSNQATAR

SEQ ID NO: 1760 - protein, 340 aa, Mycobacterium paratuberculosis
MVATTSSGGAAVGWPARLTKARLHFVTGKGGTGKSTIAAALALTLAAGGRKVLLVEVEGRQGIAQLFDVPPLPYQEVKIATAERGGQVNALAIDIEAAFLEYLDMFYNLGIAGRAMRRIGAIEFATTIAPGLRDVLLTGKIKETVIRVDKNRLPVYDAIVVDAPPTGRIARFLDVTKAVSDLAKGGPVHSQADGVVRLLHSEQTAIHLVTLLEALPVQETLEAIEELAEMQLPIGSVIVNRNIPAYLQPADLAKAAEGDIDADAVRAGLQKAGITLDDKDFAGLLTETIEHATVIATRAEIAQQLDALHVARLELPAISDGVDLGSLYELSESLAQQGVR

SEQ ID NO: 1761 - protein, 158 aa, Mycobacterium paratuberculosis
MSAAPSWKARLAELGLTLPEVVAPLASYVPAVRTGNLVYTAGQLPMQDGKLAATGKVGAHISPDEGRALARICALNALAAVDALVGIDAVTRVVKVVGFVASAPGFNGQPSVVNGASDLLAEVFGEHGAHARSAVGVGELPLDAPVEVELIVEVGARP

SEQ ID NO: 1762 - protein, 267 aa, Mycobacterium paratuberculosis
VTEVAASPTHPAYGRLRAVTDTASVLLADNPGLLTLEGTNTWVLRGRGSDELVIVDPGPDDDEHIARIAALGRIALVLISHRHGDHTDGIDKLVGRTGAIVRSAGSGFLRGLGGELTDGEVIDAAGLRIKVMATPGHTADSLCFLLDDAVLTADTVLGRGTTVLDKEDGSLTDYLESLRRLRGLGRRAVLPGHGPDLTDLESVAQGYLEHRRERLDQVRSAVRELGEDVSARRIVEHVYVDVDEKLWDAAEWSVQVQLNHLRSEPST

SEQ ID NO: 1763 - protein, 224 aa, Mycobacterium paratuberculosis
VDEILARAGIFQGVEPSAVTALTKQLQPVDFPRGHTVFAEGEPGDRLYIIVSGKVKIGRRSPDGRENLLTIMGPSDMFGELSIFDPGPRTSSATTITEVRAVSMDRDALRAWIADRPEIAEQLLRVLARRLRRTNNNLADLIFTDVPGRVAKQLLQLAQRFGTQEGGAMRVTHDLTQEEIAQLVGASRETVNKALADFAHRGWIRLEGKSVLISDSERLARRAR

SEQ ID NO: 1764 - protein, 131 aa, Mycobacterium paratuberculosis
MFTLRVSWLLVAGVPVLLMLAALGLGRLEKELVRDPAAVADVDEFLERTGGVDMHTLAAEGMPEALEYLHRREAQQSAGPAPGGRSGGPRHAAPSFAAGFVDPDEMTLPTRIGGHSHVNPQFRAPRHANRV

SEQ ID NO: 1765 - protein, 265 aa, Mycobacterium paratuberculosis
VTTAKSSGRAKSTPAPPGDAAARRWSTESRVALVRRARRMNRILAQAFPEAHCELDFTTPLELTVATILSAQSTDKRVNLTTPALFKRYTCALDYARADRDELENLIRPTGFFRNKASALIRLGQALVERFDGEVPATMAELVTLPGVGRKTANVILGNAFGVPGITVDTHFARLVHRWRWTAEKDPVKIEHAVGELIERSEWTMLSHRVIFHGRRVCHSRKPACGVCLLAKDCPSFGLGPTEPPLAAQLVRGPETEHLLALAGL

SEQ ID NO: 1766 - protein, 222 aa, Mycobacterium paratuberculosis
MPIPRPTLTRKVRWHIAILTVVVALIVALLAQLRDDAATPGPPATGRAVADREHRDADTPAALAGPRQRADLPPCPAAGTGPGPAALRGVTAECAADGSVVDAGRAVAGRRVVLNFWAYWCAPCAAELPAMAEYQRRAGAEVTVLTVHQDENETAALLRLAELGVRLPTLQDGRRRVAAALRVVNVMPATVVLRPDGSVAQTLPRAFSTADEIAAAIGNDRG

SEQ ID NO: 1767 - protein, 272 aa, Mycobacterium paratuberculosis
VSAGGSPLRNGDPAPARGTVPLTPDACPSWLRPLVDNVDHVPDAARRRLPADVLAMITTKAASALTSVRGAAREAAVLVLFSGPESGPPGGGPPTDADLLVTVRASTLRHHAGQAAFPGGAADPTDDGPVATALREAREETGIDVSRLHPLATMEKMFIAPSQFHVVPVLAYSPDPGPVAVVNEAETALVARVPLRAFINPANRLMVYRGDLGRRWAGPAFLLNEMLVWGFTGQVISALLDVAGWAQPWDTSDQRELDAAMALVGERGDALE

SEQ ID NO: 1768 - protein, 397 aa, Mycobacterium paratuberculosis
MTPSQWLDVAVLAVAFIAAISGWRSGALGSLLSFVGVLLGAIAGVLLAPHLVSHIAAPRAKLFAALFLILALVVIGEVAGVVLGRAVRGAIRSRSIRTVDSVIGVGVQLVVVLTAAWLLATPLTQSKDQPELAAAVRGSRVLAKVNEVAPPWLKTVPKRLSALLNTSGLPAVLEPFSRTPVIPVASPDPELASNPVVQATAPSVVKVRSLAPSCQKVLEGSGFVIAPDRVMTNAHVVAGSNSVQIYASGNPLDATVVSYDPSVDIAILAVPNLPPPPLPFAQTEAKTGASVVVLGYPGGGNFTATPARIRELIKLSGPDIYRDPAPVTRDVYTIRASVEQGNSGGPLIDLNGQVLGVVFGAAVDDPDTGFVLTADEVAGQLAKIGETKTVGTGSCVS

SEQ ID NO: 1769 - protein, 321 aa, Mycobacterium paratuberculosis
MAPPDPSVTRIDGPWRHLDVHANGIRFHVVEALPVGDARGLPATARPLVMLLHGFGSFWWSWRHQLRGLTGARVVAVDLRGYGGSDKPPRGYDGWTLSGDAAGLIRALGHSSATLVGHADGGLACWATALLHARLVSAVALISSPHPAALRQSTLTRRDQARALLPTLLQYQVPLWPERLLTRDGGAEIERLVRSRRCAKWLASEDFSETIGHLRTAIQIPAAAHCALEYQRWAVRSQLRDEGRRFLRSMRRQLGVPLLHLRGEEDPYVLADPVDRTRCYAPQGRYVTVAGAGHFSHEEAPEEVNRHLTSFLEDVYGPAVN

SEQ ID NO: 1770 - protein, 179 aa, Mycobacterium paratuberculosis
VSKVEGKNGVPSTLTTIPLTDPHAKPAEPTIGDLIKDATTQVSTLVRAEVELARAEITRDVKKGLTGSVFFIAALVVLFYSTFFFFFFVAELLDTWLWRWVAFLIVFGVQVVVGAVLALLGFLKVRRIRGPRQTIESVKETRTALTPGHDKAGGARALTESHGKHAKPGDGAAADPSGW

SEQ ID NO: 1771 - protein, 232 aa, Mycobacterium paratuberculosis
VRRAHRCCLVAMVALLVAVTGSHPRAAAADVRIPLGGGAGIVVNGDTMCTLTTIGGDAAGDLIGFTSAHCGGPGAQVAAEGAENAGILGTMVAGNDNLDYAVIKFDPAKVTPVANFNGFLISGIGPDPAFGEIACKQGRTTGNSCGVTWGMGQTPGTIVMQVCGQPGDSGAPVTVNNQLVGMIHGAFSDNLPTCVIKYIPLHTPAVVMSFNAILADINAKHRPGAGFAPLPG

SEQ ID NO: 1772 - protein, 650 aa, Mycobacterium paratuberculosis
VTASNTASPASYPPPPQFVEQANADEQLYREAERDRLTFWAEQANRLSWATPFTEVLDWSRAPFAEWFADGTLNVAYNCVDRHVQAGHGDRVAIHWEGESPGDQRSLTYSELYTQVCKAANALTDLGLVAGDRVAIYLPLIPEAVIAMLACARLGVMHSVVFAGFTAKALQARIADAAAKLLITSDGQFRRGKPAPLKDAADEAVADPDSPVEHVVVVRRTGIDVSWTGGRDLWWHDVVDAAAPEHTPEPFPAEQPLFLLYTSGTTGKPKGIVHTSGSYLTQAAYTHYYVFDIKADTDVFWCTADIGWVTGHTYGVYGPLANGVTEVLYEGTPDTPTQHRHFEIIEKYGVTIYYTAPTLIRTFMKWGREIPDAHDLSSLRLLGSVGEPINPEAWRWYRSVIGADRLPIVDTWWQTETGATMISPLPGVAAAKPGSAMRPLPGISARIVDDHGDQLVPGIHHGEHVTGYLVLDQPWPSMLRGIWGDPDRYVETYWSRFAEQGWYFAGDSAYYDRDGAIWVVGRIDDVMNVSGHRLSTAEVESALVGHHGVAEAAVVGATDATTGQAICAFVVLCADYQVHDGIVDELRAEVAREISPIAKPREVHVVPELPKTRSGKIMRRLLRDIAENRELGDTSTLLDPGVFDAIRAAK

SEQ ID NO: 1773 - protein, 180 aa, Mycobacterium paratuberculosis
VPGHSRGLRRSVASFAALATSYAAATAAGWPAAALPADTTDTPTPCWSDQIAVTAAPAQGAVGHRAVTLVFTLAGGAEPCTLTGYAAVDSGAGGALVHAQPTPRGYLGGLPAGVDAPPTVILSISTQGQAIVEGVAVDADGQPCPTYTDLLVNPPDTTAVVTVPATIEACELQVHPITAV

SEQ ID NO: 1774 - protein, 541 aa, Mycobacterium paratuberculosis
MRGMRTPVAVLATAAAALLVVASLAGCGGGVLSPDLVVVNGGEPPNPLVPTGTNDSQGGRILDRLFAGLMSYDAAGNPAPEVAQSIESGDNVNYRIVLKPGWRFTDGSPVTAHSFVDAWNYGALSTNAQLQQSFFSPIDGYDALAAGQPQQTTMTGLRVVNDLEFTVRLKAPTVDFKLRLGHSAFYPLPQAAFRDMAAFGRHPIGNGPYQLAGGPDGPAWEHNVRIDLRPNPDYHGNRKPRNKGLRFEFYANLDTAYADLLSGNLDVLDTIPPSALPVYRRDLGDRVTAGPAAINQSLDTPLRLPHFGGEEGRLRRLALSAAINRAQICRQIFADTRSPARDFTARSLPGFDPNIAGSDALDFDPDRARRLWAQADAISAWSGSYPIAYNADAGHQDWVDAVANGIKNVLGIDALGAPQPTFAGFRTQITNRSIGSAFRSGWQGDYPSMIEFLAPLFATGAGSNDVGYSSPRFDAALATAEAAPDLPQAAALANDAQRILFHDMPVVPLWNYISVVGWSAEVSHVTVTWNGLPDYENIVKA

SEQ ID NO: 1775 - protein, 308 aa, Mycobacterium paratuberculosis
MGWYIARRIAVMVPVFLGATLLIYAMVFLLPGDPVAAIAGDRPLTPAVAAALRARYHLDDPFLVQYLRYLGGVLRGDLGRAYSGLPVSDVLAHAFPVTLRLSLIALAVEAVLGIGFGVIAGLRQGGLFDSAVLITGLVIIAVPIFVLGFLAQFVFGVRLGIAPVTVGNAATFTRLLLPGIVLGSVSFAYVVRLTRSAVAANAHADYVRTATAKGLSQPRVVTVHILRNSLIPVVTFLGADLGALMGGAIVTEGIFNIHGVGGVLYQAVTRQEAPTVVSIVTVLVLIYLVTNLVVDLLYAVLDPRIRYG

SEQ ID NO: 1776 - protein, 291 aa, Mycobacterium paratuberculosis
MAERIRARGGFWRETWRRLRRRPKFIGAGLLILVILAVALFPALFTAADPTYADPAQSMLPPSRTHWFGTDLQGHDVYARTVYGARASVTVGLGAAAIVFVVGGALGALAGFYGGWIDAVVSRVTDVFFGLPLLLVAIVLMQVLHHRTVWTVIAILALFGWPQVARIARGAVLAVRASDYVLAAKALGMSRFQILIRHALPNALGPVIAVATIALGLFIVTEATLSYLGVGLPPSVVSWGGDINLAQTRLRAGSPILFYPAGALAATVLAFMMMGDALRDALDPASRAWRA

SEQ ID NO: 1777 - protein, 548 aa, Mycobacterium paratuberculosis
MTTPLLSVEGLHVGFGEHAAVRGLDLRVLPGQTVAVVGESGSGKSSTAAAILGLLPPGGRITAGRIMFDGVDISAADRRALRSMRGRQIGYIPQDPMTNLNPVWKVGFQIREALRANTSDRDTRRRAVQLLEAAGMPDPAKQAARYPHQLSGGMCQRALIAIGLAGRPRLLIADEPTSALDVTVQRQVLDHLQRLTADLGTAVLLITHDLALAAERAESVVVVHDGVAVESGAAQSILQDPRHEYTRRLVAAAPALTVRGGARTGPRQPDRTQPEPADILVASDLTKLYREPRATLWRRTEFRAVDAVSFRLRRARTLAIAGESGSGKSTLALMVLGLLPPTSGTVVFDGTRIDDTLSGDQHLAFRRRVQPVFQNPYSSLDPMYSVFRAIEEPLRIHRVGDRRQRAKAVHDLVDQVALPSSVLDRLPRELSGGQRQRVAIARALALRPQVLVCDEAVSALDVLVQAQILELLARLQADLGLAYLFISHDLAVIRQIADDVLVMRAGRVVEQAPTEKLFTAPAQDYTRQLLDAIPRPRRGGDRLSSCDG

SEQ ID NO: 1778 - protein, 252 aa, Mycobacterium paratuberculosis
VTADPLAPLMELPGVAEASDRARDALGRAHRHRANLRGWPVTAAEAALRAARASSVLDGGPVRLEDLAEAGQISDPVFAGALRVAQALEGGEGPVVGIWRRAPLQALARLHMLAAADQVDDERLGRPRADAGVGPRLELLADLVNGRTRVPAPVLAAVAHGELLTLRPFGSCDGVVARAVSRLVTIASGLDPHGLGVPEVSWMRQPAAYRDAARGFADGTPEGVGAWLVLCCRAMRAGAQEALSIADSMSNR

SEQ ID NO: 1779 - protein, 285 aa, Mycobacterium paratuberculosis
VTVFDPAAEQSAPEQSAPSGVPHARTAAFFDLDKTIIAKSSTLAFSKPFFAQGLLNRRAVLKSSYAQFIYLLSGADHDQMDRMRAHMTNMCTGWDVEQVKSIVNETLHDIVTPLVFAEAADLIAAHKLCGRDVVVVSASGEEIVAPIARALGATHAMATRMVVEDGRYTGEIAFYCYGEGKVQAIRELAAREGYPLEHCYAYSDSITDLPMLEAVGHPSVVNPDRGLRREALERGWPVMSFSRPVSLRDRIPAPSGAAIATTAAVGISALAAGAVTYSLLRRYSF

SEQ ID NO: 1780 - protein, 351 aa, Mycobacterium paratuberculosis
MLAEPELRAELDRVAAAAGVRVVHAGDAAAVSRKTWAAAAAVVLDAAAAARCGRWALPRRDHVTVLTAAEPATTTWAAAVRIGAARVLRLPEHEADLVGELAEAAESSRDDGQRGHAVAVVGGCGGAGASLLAVALAQAAGDALLVDLDPWGGGIELLLGGENTPGLRWPDLALQGGRLNWAAVRDALPRHRGVSVLSGTRRGHEVDAGPVHAVVDAGRRGAVSVICDLPRRFTDAAQAALGAADLVVVVVSRCDVRACAATGALAPVLAAVNPNVGLVVRGPSPGGLRAAEIAGITGLPLLAAIKAQPQLGAQVERGGLRLGRRSALAVAARQVLGVLPPAGARRKGKAA

SEQ ID NO: 1781 - protein, 352 aa, Mycobacterium paratuberculosis
MLGDTEVLANLRTLQTELTGAGILEPLLCADGTTDVLVTAPDAVWVDDGNGLRRSEIRFPDEAAVRRLAQRLALAAGRRLDDAQPWVDGELTGIGAGGFAVRLHAVLPPVAAAGTCLSLRVLRPASQDLAALSAAGAIEPAAAALVADIIAARLAFLVSGGTGAGKTTLLAAMLGAVPPDERIVCVEDAAELAPPHPHLVKLVARCANVEGVGEVPVRQLVRQALRMRPDRIVVGEVRGAEVVDLLAALNTGHDGGAGTVHANNPGEVPARLEALGALGGLDRAALHSQLAAAVQVLLHVERNRAGRRRLSEIAVLQRVQERVRSVTVWHADRGMTEAAPLLRRVLENRMPS

SEQ ID NO: 1782 - protein, 267 aa, Mycobacterium paratuberculosis
MTGPVAGALLLAVALVVGPPSPRRRLGVAVSGSRRPSARRLAGLGWVAAGAGCAALAVLPLPSVLAGAVVAATAGLRHRRHGRIRRAAGEGRALETALDVLVGELRAGSHPVRAFDVAAGETAGPVAVALRSVAARARLGADVAAGLAAASRSSARPEHWQRLALCWRLAGDHGLGIATLMRAAQRDIAERQRFSARVSSSLAGARATAAILAALPVLGVLLGQLIGARPLDFLLGGQVGGWLLLVGATLACAGLLWADRIVDRVMA

SEQ ID NO: 1783 - protein, 193 aa, Mycobacterium paratuberculosis
LAAAVLMGPGPSLTRRRAGTPARAGGPRREPGPGRGRGPDPLAIASCLDVLAVCLGAGMAVSAAAAAAVPSAPAQLGRVLRRAADLLALGADPAVAWSMPPDPPGGPADPQIDALLRLARRSAASGAALAGGVAELADQSRSDAAHTAAAAAERAGVLIAGPLGLCFLPAFVCLGIVPVVAGLAGDVLRSGLL

SEQ ID NO: 1784 - protein, 67 aa, Mycobacterium paratuberculosis
LMRKVFREFSARVAVLVADESGMSTVEYAIGTIAAAAFGAVLYTVVTGDSIVSALTNIIGRALNTKV

SEQ ID NO: 1785 - protein, 89 aa, Mycobacterium paratuberculosis
VVLVACLAGVTAVAMQVRCVDAAREAARLAARGDERSATAAAVRLGPAGARVDLRRDGDLLVATVVAHSKLLPALDIRAQAVSAAEPAR

SEQ ID NO: 1786 - protein, 345 aa, Mycobacterium paratuberculosis
MAHDWLLVETLGGDPTVVAQGRQLKNLVPITTFLRRSPYLSAVRTAIAESVQTGQALTSITPKRDRVIRTEPVVMSDGFIHGVHVWTGPSDIEPPERPIPGPLKWDLTLGVATDTRESLINSGKNPEVEVTFGRAFAEDLPSRELNPNETKVLAMAVKAKPDQTLCSTWDLTDWRGEAIRIGFVARTILEPGPDSREHLVARAINWQAEQKGPAVSTDDLAQRILSGLAQAGVHRALIDLNNWTLLKWLDEPCTFYDWRSSETGKPRVHPDDHAVMSAMTEEFSGGATSRVLRLAGHDGDWVPVHITVNRVELEPDAYAGLVSLRLPTEEELAAAGLPQATGGTP

SEQ ID NO: 1787 - protein, 776 aa, Mycobacterium paratuberculosis
MASFGSELLAAALAGTAADEQPLRHVAELPPRRGRPHDWPAWAEPEVVGAFAARGIKSPWSHQFTAADLAWSGRHVVVSTGTASGKSLAYQLPALNALATDPRARVLYLSPTKALGHDQLRAAHALTAAIPRLREPGFAVAPTAYDGDSPTEVRRFARERSRWVFSNPDMIHLSTLRNHARWAVLLRGLRFVIVDECHYYRGVFGSHVAMVLRRLLRLCARYASAPTVIFASATTDSPGATAAELIGLPVREVTEDGSPQGARTVALWEPALRADLVGENGAPVRRSAGAEAARVMADLIAEGAQTLTFVRSRRAAELTALGAQARLDEIAPGLSAQVASYRAGYLAEDRTALERALAEGRLRGLATTNALELGVDIAGLDAVVLAGFPGTVASFWQQAGRSGRRGQGALVVLIARDDPLDTYLVHNPAALLGKPVERVVIDPRNPYILGPQLLCAATELPLQEAEVRELDATEVAESLVDDGLLRRRNGKYFPAPGLQPHAAVDIRGAGGQVVILEADTGRLLGSAGAGQAPASVHPGAVYLHQGESYVVDSLDLQEGIAFVHAEDPGYATFAREITDIAVTGAGERLVFGPVTLGLVPVRVTHRVVGYLRRRLSGEVIDFIELDMPEHTLATTAAMYTITEEALRDNGIDGPRIPGSLHAAEHAAIGLLPLVASCDRGDIGGLSTAVGPEPAGLPSVFVYDGHPGGAGFAERGFRRASTWLGATAAAIEACECPRGCPSCVQSPKCGNGNDPLDKAGAARVLRLVLAELDRGPR

SEQ ID NO: 1788 - protein, 67 aa, Mycobacterium paratuberculosis
MPQGTVKWFNAEKGFGFIAPEDGSADVFVHYTEIQGTGFRTLEENQKVEFEIGHSPKGPQATGVRSL

SEQ ID NO: 1789 - protein, 196 aa, Mycobacterium paratuberculosis
VSQLSFFTAESVPPAVADLSGVLAASGQIVMVGTPEPHGARLSVVVDHTWRAEALADMISEAGLVAEIGRTDEDTPLVRTAVDPALSPLAAEWTRGAVKTVPPRWLPGPRELRAWTLAAGNPEGEHYVLALDPHAPDTHSPLASALMRVGIAPTLIGTRGGRPALRISGRRRLSRLVENVGEPPDSPEASAHWPRV

SEQ ID NO: 1790 - protein, 932 aa, Mycobacterium paratuberculosis
LADPKLKENTSGGNGSRRRLVIVESPTKARKLASYLGSRYIVESSRGHIRDLPRAAADVPAKYKSEPWARLGVNVDADFEPLYIISPEKKHTVSELKGLLKDVDELYLATDGDREGEAIAWHLLETLKPNIPVKRMVFHEITEPAILEAAENPRDLDIDLVDAQETRRILDRLYGYEVTPVLWKKVAPKLSAGRVQSVATRIIVQRERDRMAFRSASYWDIVAQLDASVSDPQASPPTFAARLTSVDGLRVATGRDFDSQGQLRKADEVIVLDEPQATELAAGLQGAQLSVASVEEKPYTRRPYAPFMTSTLQQEAGRKLRFSAERTMSIAQRLYENGYITYMRTDSTTLSGSAINAARTQARQLYGEEYVSPSPRQYTRKVKNAQEAHEAIRPAGETFATPDAVRRELDGDEFRLYELIWQRTVASQMADARGTTLSLRIGGQAGDRQVVFSASGRTITFAGFLKAYVETVDELAGGEADDAESRLPQLTQGQRLDAIELTPDGHATNPPPRYTEASLVKALEELGIGRPSTYSSIIKTIQDRGYVHKKGSALVPSWVAFAVTGLLEQHFGRLVDYDFTAAMEDELDAIASGQERRTDWLNNFYFGGEHGVADSIARSGGLKKLVGVNLEGIDAREVNSIKLFDDEQGRPVYVRVGKNGPYLERMVTGDDGEPTPQRANLNDSLTPDELTLEVAEQLFATPQEGRVLGVDPATGHEIVAKDGRYGPYVAEVLPEPPPDDDDGSGAPAKKGKKPTGPKPRTASLLRTMDLQTVTLEDALRLLSLPRVVGVDPETGEEITAQNGRYGPYLKRGNDSRSLASEEQLFDITLEEALKIYAEPKRRGRQGAAAPPLRELGADPATGKPMVIKDGRFGPYVTDGETNASLRKGDDVMSLTDQRAAELLADRRARGPAKRTAKKTSRKAPAKKAAKRG

SEQ ID NO: 1791 - protein, 553 aa, Mycobacterium paratuberculosis
LPRTQFSFRDVAAARYGGIVTTAAALPGRISAFARWVVRTPWPLFWLSMMQADIIGALFVLGFLRYALPPEDRIQLQDLPVVNLAVFATSLVVLFLAASVVNLTLLMPVFRWQRRDNLLAESDPAATELARIRALRMPFYRTVTSMVIWCIGGVVFIIASWSVARFAAPVVAVATGLGAAATAIIGYLQCERVLRPVAVAALRSGVPENVKAPGVILRQILTWMLSTAVPVLAIVLAVVADKTSLLHATPEKLFTPILLLAVAALGIGLVSTLLVAMSIADPLRQLRWALSEVQRGNYNAHMQIYDASELGLLQAGFNDMVRDLSERQRLRDLFGRYVGEDVARRALERGTELGGQERDVAVLFVDLVGSTQLAATRPPAEVVHLLNEFFRVVVETVGKHGGFVNKFQGDAALAIFGAPIEHPDSPGGALAAARELHDALLPVIGSAEFGIGVSAGRAIAGHIGAQARFEYTVIGDPVNEAARLTELAKLEPGHVLASAIAVSGALDSEALCWDVGEVVELRGRTAPTQLARPVKLATPEEVAPQEVSSEVSG

SEQ ID NO: 1792 - protein, 401 aa, Mycobacterium paratuberculosis
MSGVFTRLVGQDAVKAELLGAARAARGDAGHSDAGAGTMTHAWLITGPPGSGRSVAALCFAAALQCTADGEPGCGRCHACTTTLAGTHADVRRVVPEGLSIGVDEMRAIVQIAARRPATGNWQIVVIEDADRLTEGAANALLKVVEEPPPSTVFLLCAPSVDPEDVAITLRSRCRHVALVTPSTEAIARVLVDSDGLTPETADWAASVSGGHVGRARRLATDPEARQRRERALGLVRDAATPSRAYAAAEELVAAAEAEAVVLTAERAEAETEELRTALGAGGTGKGTAGAMRGAAGAIKDLERCQKSRQTRASRDALDRALIDLATYFRDALMASSGAGAVRANHPDMAERVAALAAHAPPERLLRCIEAVLECREALAVNVKPKFAVDAMVATIGQQLG

SEQ ID NO: 1793 - protein, 395 aa, Mycobacterium paratuberculosis
MKELTVAEQRYQAVLAVISDGLSISLVAEKVGVSRQTLHAWLARYEASGLEGLVDRSHRPVSCPHQMPAVVEAALLERRRSRPYWGPRRLVFELAKRRVGPVPSESAVYRALVRAGMIDPALRDRRSRKWKRWERGAPMELWQMDVVGGFPLADGTSAKALTGIDDHSRMCVCARLMARERTRAVCDGLRAALAAYGAPQQILTDNGKVFTGRFNHPPVEVLFDAICRQNGIDHLLTQPRSPTTTGKIERFHRSLRAEFLSNTRAFSNLKTAQQALDEWVHYYNTARPHQSLNMTTPAERFTATASPVSPGDDVPASIDRDGQDWVSRRVTTNGVVSVAWQQVCVGAHYAGARCDVHVDGELLRFWIGDQLVKTAARTNHAEVRNKRAFRTREQA

SEQ ID NO: 1794 - protein, 395 aa, Mycobacterium paratuberculosis; identical to SEQ ID NO: 1793

SEQ ID NO: 1795 - protein, 584 aa, Mycobacterium paratuberculosis
LAAAALVVVQLAVRAVLAFGGYFYWDDLILIGKAGTHNLLAPSYLFDDHDGHLMPGAFLLAGTIIRAAPLDWTWPAVSLLVLQLLASLALLRALHVILGWRPVLLIPFTFALFTPLAVPGFAWWAAALNSLPLLAALAWVCGDAILLVRTGNRRYALTGVLVYLGGLLFFEKAAVIPFVAFAVAALLRHVAGDRAAARTVWRAGLRLWVPSLALTAAWVGLYLAVVNQRRWSSDVVMTGRLLVRSITHGIVPGLAGGPWHWDRWAPASPWATPPPLVMVLGWLVLAGVLAVSLLRKRRIGPVWLTAAGYAVACQVPIYLMRSSKQTALELAQTLRYLPDLVVVLALLAAVALSAPNRPAGPRRLDASPKRTVVACGLAALFLASSLYSTATFLTSWRDNPAQPYLRNARAALAAAHAASDAPLLDQEVDPLVLQRVAAPENLASHLFALLRDRPEFASATTQLRMLDSSGRLIRARVTWVRTITPGPMPQCGYFAQPDRPARLVLDGPLLPADWTVELNYLANSDGSMTLSMTQGPPVKVPVHPGLNRVFVRLPGAGDAITVRANTTALALCLASGPVGFLAPA

SEQ ID NO: 1796 - protein, 318 aa, Mycobacterium paratuberculosis
MYGGPVRALVTGAAGFIGSTLVDRLLADGHTVVGLDNFASGRASNLEHLVGNPAHVFVEADIVTADLEAILDEHRPEVVFHLAAQIDVRHSVADPQFDASVNVIGTVRLAEAARRTGVRKMVHTSSGGSIYGTPPTYPTPETVPTDPASPYAAGKVAGEIYLNTFRHLYGLDCSHIAPANVYGPRQDPHGEAGVVAIFAQALQSGKPTKVFGDGTNTRDYVFVDDVVDAFVKASGDAGGGQRFNIGTGVETSDRQLHSAVAAAVGGPDDPEFHPPRLGDLKRSCLDIGLAARVLGWQPKVGLQQGVARTVEYFRNQHN

SEQ ID NO: 1797 - protein, 113 aa, Mycobacterium paratuberculosis
MNWIQVLLIGSIVALLVYLLRSRRNARSRAWVKVGYVVFVLAGIYAVLRPDDTTVVANWFGVRRGTDLMLYALVMAFCFTTLSTYMRFKDLELRYARLARAVALESALPPDPN

SEQ ID NO: 1798 - protein, 233 aa, Mycobacterium paratuberculosis
MGTDTHYSAVWVVIPAFNEAAVIGEVIADVRSVFDNVVCVDDGSTDDTGEIARRAGAHLVRHPINLGQGAAIQTGVEYARRQPGAQVFATFDADGQHRVKDLAAMVNRLRVGDVDVVIGTRFGTRQGARPPLVKRMVLQTAARLSRRGRRLGLTDTNNGLRVFNKKVADGLDITMSGMSHANEFVMLIDENHWRVVEEPIEVLYTEYSRSKGQPLLNGVNIIFDGFLRGRIPR

SEQ ID NO: 1799 - protein, 438 aa, Mycobacterium paratuberculosis
VGRLLFSNCGDTSGQRAESAAPMTEISASRGPVARGSMARVGTATAVTALCGYAVIYLAARDLAPGGFSVFGVFWGAFGLVTGAANGLLQETTREVRVMPYLEVAPVKRTHPLRVAMLLGAAAAVVIAGSSPLWSGRVFVEARPLSVLLLSVGLAGFCVHATLLGMLAGTNEWTRYGALMVTDAVIRVMVAAATVVLGWRLVGFLWATVAGAVAWLILLAASPATRATARLLTPGGTATFLRGAAHSITAAGASAILVMGFPVLLKLTSAELGAQGGVIILAVTLTRAPLLVPLTAMQGNLIAHFVDERSDRVRALIGPAAIVGAIGAVGVLAAGVLGPWVLRVVFGPQYQAGSALLAWLTAAAVAIAMLTLTGAAAVAAALHRAYALGWVGATVASGLLLALPLSLQTRTVVGLLCGPLVGIGVHLVALSRAARLTG

SEQ ID NO: 1800 - protein, 359 aa, Mycobacterium paratuberculosis
LRTFGVSLLVTAAALVLGYAYGGPKSLYLLLVLAALEVSLSFDNAVINAAVLKQMSRFWQRMFLTIGILVAVFGMRLLFPLLIVWATAGLDPVRALELALRPPPHGALEFPDGSPSYQKLLTAAHPQIAAFGGIFLLMLFLDFLLIDRDIKWLKWIEVPFARIGRLGQVSVVLSGLTLVLVGTGLTHSSQEAVTVLTAGLLGMVAYLVVNGLSRAFRPSGVGQPQPAGPATGWAGLSLFLYLEVLDAAFSFDGVTGAFAITSDPVVIVLGLGAVGSMFVRSITIYLVHQETLDRYVYLEHGAHWAIGALAVIMLASIEPRLTVPEPVTASVGVFFIGTAVGFSVLRRRRESGRASAPGP

SEQ ID NO: 1801 - protein, 162 aa, Mycobacterium paratuberculosis
VEFDVTIEILKGQRNKYEVNHETGRLRLDRYLYTAMAYPTDYGFIEDTLGEDGDPLDAMVLLPQSVFPGVIVEARPVGMFRMTDEKGGDDKVLCVPAGDHRWEHIQDIGDVPEFELDVIKHFFVHYKDLEPGKFVKAADWVGRAEAEAEVQRSIERFKAQEH

SEQ ID NO: 1802 - protein, 461 aa, Mycobacterium paratuberculosis
MARTRWQKSTPVFIGLGVLAFVAAVVVAATFFTTTGHGAGNAHAPIPAPHAPTVKPGMLPVSDTAELPTGPGVSAALAPVAADPNLGRLGGRITDAITGKELWQVADDMPLVPASTNKVLTAAAALLTLDRQARISTRVVAGSQNAQGPVVLVGAGDPVLSAAPPGQPTWYRGAARISDLVEQIRRSGVTPTAVQVDTSAFSGPTMAQGWDPSDVDNGDIAPIESVMIDAGRIQPTTVNSRRTRTPALDAGRELAKALGLDPNAVTVATAPSGARQLAVVQSAPLVQRLSEMMDHSDNVLAECIAREVAAAINRPRSFAGAADAVTNRLSTAHVDTAGATLMDSSGLSVDDRLTAKTLDGVLQAAAGPDQPALRALLDLLPIAAGSGTLGDRFTDASTNQGPAGWLRAKTGSLTAINALAGVLTDRSGRVLTFAFISNDAGPNGRNAMDALATRLWFCGCS

SEQ ID NO: 1803 - protein, 357 aa, Mycobacterium paratuberculosis
MTPAPDLTLGTAVDWRFAATVGRRLARPGPPSTDYTRRQVIDELAGAATKAEPLVRQVTGLLTDGADDGRVPAARIVDRPEWIAAAAESMRVMMNGTERPRGFLTGRVTGAQTGAVLAYVSSGILGQYDPFATDRGAGAGCLLLVYPNVIAVERQLRIEPSDFRLWVCLHEVTHRVQFTANPWLPGYMSQALALLTRDTGDDLGQVLSRLADYARNRGNPASQADANSTGILGLVRAVQSEPQRQALDQLLVLGTLLEGHADHVMDAVGPMAVPSVATIRRRFDERRHRKQPPLQRLLRALLGLDAKLSQYTRGKAFVDQVVGRVGMARFNAIWTGPETLPLPVEIEEPQRWIDRVL

SEQ ID NO: 1804 - protein, 320 aa, Mycobacterium paratuberculosis
MDRPGALDRLRTAVEAFSTAHLGAVERWCVALSGGPDSLALTAVAARLRPTTAVIVDHGLQPDSAAVAQTARAQAIALGCVAAQVISVHVDGEGGLEAAARRARYAALAAHRDGPVLLGHTLDDQAETVLLGLGRGSGVRSIAGMRPHDPPWCRPLLGQRRAVTHAACAELGLTAWQDPHNSDRRFARARLRAEVLPLLEEVLGGGVVEALARTATALREDNELLDALAERALPAARAGAGLQVAALAGLDAPVRRRVIRAWLLAGGATGLTDKQIRGVDNLVTAWRGQGAVAVGSSLPGERLFAGRRDGVLTLWREPVR

SEQ ID NO: 1805 - protein, 203 aa, Mycobacterium paratuberculosis
VGVAQISSAITPAQPAELYPGDIKSVLLTAEQIQARIAELGREIGDNYRDAATETGQDLLLITVLKGAVIFVTDLARAIPLPTQFEFMAVSSYGSSTSSSGVVRILKDLDRDIQGRDVLIVEDVVDSGLTLSWLLRNLSTRHPRSLRVCTLLRKPDARGAHVDIAYVGFDIPNDFVVGYGLDYDERYRDLSYIGTLDPRVYQQ

SEQ ID NO: 1806 - protein, 249 aa, Mycobacterium paratuberculosis
MPVATNAPKCVRSAIAAAAAGLAVVAISACDKHGPPPSGAAPRQVTVVGSGQVQGVPDTLTADVGIEFTAPDVTTAMNQTNERQQAVINALVGAGIDHKDISTTEVALTPQYSNPEAGGSAAITGYRASNAVAVKIHPPDAASRLLALIVGTGGDATRIRSVSYSIADDSQLVKDARTRAFNDAKSRAEQYAQLSGLHLGKVLSISEATGNAPPPGGPPPSPRAMPMAVPLEPGQQTVKFTVTASWELD

SEQ ID NO: 1807 - protein, 99 aa, Mycobacterium paratuberculosis
MSFLMVRPEILDAAARELHGINAAVLQSNSAVVTPTTAVAPAAGDVVSLVTAARFSRHGLAFQEVSAQAAQLRDQFATTLGISAGSYAAAEIANTAAVG

SEQ ID NO: 1808 - protein, 424 aa, Mycobacterium paratuberculosis
LRKHDAGIRAAGFRAAGFRAASAGDQLRADVFRTRRGAAAAAWNGLAAELRSAAASFGSVITGVGDAGWQGPAASSMMAAAAPQLAWLSGTAGRAELAAGQALAAVSAYETAFAETVPPPVIAANRALLLQLLATNFLGQNTPAIADVEAQYGEMWAQDTAAMYGYALASAAASTLPPFEPAKPATDPAGLARQAAATAQAAGTGAGDSAQGLGAAPQPMSTLAAGTNNPPPANPGFSLGGISLNPEGDGLVIGGPLGDLLEGLTGSQTLDASTPFDAFIRLISPTRLFTTSFKDIQGIAQGMMPAAKSAGEGVAKAAEAVLPAAVPGAGLGSLGSIGGSVGKAASIGGLSVPASWASAAPTPPSVAVALNGATTTGAAEHAASAVGGVPMMPAGAAGRGAGAHFVVPRYGFKPTVIAQPPAGG

SEQ ID NO: 1809 - protein, 526 aa, Mycobacterium paratuberculosis
MFESGPDPAALVAVIESTHREESMLVARRFAAVAALLRHRVATTDRPEPEYAEIDGFEQTAAEVAAAMNLSAAAASYLVSYAETLDTRLPEVAALLAEGRTDWRTVRLIITRTSLVTDTELIAKLDRSLAARIGNWHGWSRQRIVNAVDAAVRTADPDAARERRLAAEEDRHIGISAAENGMAEVHGSVAAAAATAFDRRLSQLAKQVCPADPRTLDQRRADALAALAEGRGLPCACGQPDCPARTGDQHADDGTGARVVINVVASDRTVYADGAEPGYLEGYGVIDADQVRRLAAAAHLLVANPATSPAAALRYQPSAALERAVRCRDLTCRFPGCSRPAVICDLDHSVPFNHQNPVAGGWTVLENLKCLCRQHHRLKTFGGWRDRQLADGTVVWTSPSGRTYRTSPAGADLFAQPRGPACAAPTPNRRSRSKQRNGRIMRARKHNREQRPINEARIRLEQARQREIADRKFRNHMRDMLFLFKGAPSTSPFCAWVNDPREPEELPPDWAPDEPAYQPLPDDPPF

SEQ ID NO: 1810 - protein, 337 aa, Mycobacterium paratuberculosis
MRAAVLRDGRMVYRDDVPEPIPETGQVLVGVRACGICGSDLHFAAHGAQVLQMSDRVAGGAGGMRVDLDHDIFMGHEFSAEILEAGPDTETHPPGTLVTSLPVLLSAKGVEPIVYSNTTIGGYAERMLLSAPLLLPIPNGLDVKHAALTEPMAVGLHAVNKSNITPAETALVLGCGPIGIAIIAALATRGVESIVASDFSPKRRQLATAMGAHRTLDPAQGSPFDSVKPAVVFEAVGVPGIIDDVLLRARPGTRLVVAGVCMQPDTVHPFFAIAKEINVQFVLAYTPEEFGDSLRALAEGDIDVAPLITGEVGLDGVGAAFDDLADPERHCKVLVTP

SEQ ID NO: 1811 - protein, 395 aa, Mycobacterium paratuberculosis
MSAPLRFGVFITPFHPVGQSPTVALEYDLERVVALDRLGFDEAWFGEHHSGGYELIACPEVFIATAAERTKHIRLGTGVVSLPYHHPLMVADRWVLLDHLTRGRVMFGTGPGALPSDAYMMGIDPVDQRHMMQESLEAILALFRAAPTERIDRHSDWFTLRDAQLHIRPYTWPYPEISTAAMISPSGPRLAGALGTSLLSLSMSVPGGYAALETTWDVVREQAAKAGRDEPDRGDWRVLSIMHIADSREQAIDDCTYGLQDFANYFGAAGFVPLANSVEGTQTPHEFVAEYAAKGNCCIGTPEDAIAHIEDLLDRSGGFGTLLMLGHDWASPEATYHCYDLMARKVIPHFKRQLDASRASHDWAKGMRDQLLGRAGEAVVKAISEHVDEHKDAVH

SEQ ID NO: 1812 - protein, 327 aa, Mycobacterium paratuberculosis
LCFGETVPPTQRLVDTNGVRLRVTEAGDRGAPVVILAHGFPELAYSWRHQIDVLANAGYHVLAPDQRGYGGSDRPDAVEAYDIHQLTADLVGLLDDVGAQRAVWVGHDWGAAVVWNAPLLHPDRVAAVAAMSVPVTPRPRVAPTQAWRKMFGENFFYILYFQEPGVADAELNADPAQVMRRMMGSLRTDGDKAAGLRMVAPGPEGFLERLPEPDGLPEWISQDELDHYIAEFSRTGFTGGLNWYRNFDRNWETTPELDGAKIAVPCLFIGGTADPVLSFTRADRAAEVISGPYRQVMIDGAGHWLQQERPAEVNAALLEFLNGLELR

SEQ ID NO: 1813 - protein, 137 aa, Mycobacterium paratuberculosis
MRLDHVVLWTRNPRVSMDFYTRVVGLEPVRFAEFEAGEAPFPSVRICADSIIDLMPLEMVSGAASSGVAEGSAGNPVNHVCIALSKAEYDALEARLQAEGVDTGVRLSRSFGARGWSPHTYYFADPDGNVVEARYYE

SEQ ID NO: 1814 - protein, 799 aa, Mycobacterium paratuberculosis
MNRKNVIRTITAIAVVVLLGWSFFYFSDDTRGYKPVDTSVAMAQINGDNVKSAQIDDREQQLRLTLKKGNGDTDNSDKVITKYPSGYAVDLFNALSAKNAKVSTVVNQGSILGELLVYVLPLLLLVGLFVMFSRMQGGARMGFGFGKSRAKQLSKDMPKTTFADVAGVDEAVEELYEIKDFLQNPGRYQALGAKIPKGVLLYGPPGTGKTLLARAVAGEAGVPFFTISGSDFVEMFVGVGASRVRDLFDQAKQNNPCIIFVDEIDAVGRQRGAGLGGGHDEREQTLNQLLVEMDGFDPRAGVILIAATNRPDILDPALLRPGRFDRQIPVSNPDLAGRRAVLAVHSKGKPIAPDADLDGLAKRTVGMTGADLANVINEAALLTARENGTVITSAALEEAVDRVIGGPRRKGRIISEQEKKITAYHEGGHTLAAWAMPDIEPIYKVTILARGRTGGHAVAVPEEDKGLRTRSEMIAQLVFAMGGRAAEELVFREPTTGAVSDIEQATKIARAMVTEFGMSSKLGAVKYGSEHGDPFLGRTMGTQADYSHEVARDIDDEIRKLIEAAHTEAWEILTEYRDILDTLAGQLLEKETLHRAELESIFAGVEKRPRLTMFDDFGGRIPSDKPPIKTPGELAIERGEPWPPPAPEPAFKAAIARASEAAAAARLEADRNANGGNGSHANQGGNRQGPTQPDYGAPAGWRAPGWPPQQSQQPNYWHPPAQPPYWQQPAHGYPGQQPYPGQQPYPGQPGGPAQSGPPQARPPYPPYPPYPPPGQPAPEGGSPDRQDDDVSRSNPPAHG

SEQ ID NO: 1815 - protein, 204 aa, Mycobacterium paratuberculosis
MAGNGSAPDTATHQVRQFDQARAEAAVRELLFAIGEDPDRHGLAETPARVARAYREMFAGLYTDPDSVLNTMFDEEHDELVLVKEIPLYSTCEHHLVSFHGVAHVGYIPGNDGRVTGLSKIARLVDLYAKRPQVQERLTSQIADALVKKLNPRGVIVVVEAEHLCMAMRGVRKPGAVTTTSAVRGLFKTNAASRAEALDLILRK

SEQ ID NO: 1816 - protein, 270 aa, Mycobacterium paratuberculosis
LQVMGVLNVTDDSFSDGGRYLDPDKAVAHGLALVAEGAGIVDVGGESTRPGATRIDPRVETSRVVPVVKALAAEGVTVSIDTMHADVARAALGSGARIVNDVSGGRADPAMAPLLAEAKVPWVLMHWRSVSAERPHAAPQYRDVVAEVRAELLASVDAAVAAGVDSARLMIDPGLGFAKTGQHNWALLHALPQLVATGIPVLLGASRKRFLGTLLAGPDGTPRPPDGRETATAVISALAALHGAWGVRVHDVRATVDALKVLGAWMGDDG

SEQ ID NO: 1817 - protein, 133 aa, Mycobacterium paratuberculosis
MADRIELRGLRVRGQHGVFDHERVDGQDFVIDVTVWIDLVGAAASDELADTYDYAALAQLAADVVAGPARNLIETVGAQIADQVMDDERVHAVEVVVHKPQAPIPQQFADVAVVVRRSRRGGRGSVVPAGGAL

SEQ ID NO: 1818 - protein, 182 aa, Mycobacterium paratuberculosis
MTRVVLSIGSNLGDRLARLQSVVDGLGGAVRAISPVYETQPWGRVDQAPFLNAVLIADDPACDGQGWLRRAQEFERAAGRVRGERWGPRTLDVDLIACYGDGEVISRENNLTLPHPLAHLRAFVLIPWLAVDPDAQLTVADGPQPVARLLAQLDQADRDGVRPTGLTLTPPAGSPADSGAGS

SEQ ID NO: 1819 - protein, 158 aa, Mycobacterium paratuberculosis
MGPTRKRDLTAAVVGAAVVGYLLVQGLYRWFPPITVWTGLSLLAVAVIEALWARYVRTKINDGEIGSGPGWLHPLAVARSLMVAKASAWVGALVLGWWIGVLVYFLPRRSWLRAAAEDTSGAVVAAVSALALLVAALWLQHCCKSPPDSGEHGEGAET

SEQ ID NO: 1820 - protein, 462 aa, Mycobacterium paratuberculosis
MTVLSRGARVRRGGRRPGWVLLTALLVLAMGASSALVFTNRVELLKLAVILALWAAVAGAFVSVLYRRQSDADQSRVRDLKLVYDLQLDREISARREYELTVESQLRRELASELRAQAADDLAELRAELSALRTSLEILFDTDLGQRPALGAFEGEPQPERAYSEWERNGENPRDTPVDWVPSDRVTSAPQEHPPGRHDETAIIDVPEEPLMPPRPQQPAPLRRERPRYQEPPGPTEPRFEPRYQPPPAAAATPPPPETPPEPPREPQPEPQPEPQPQPQGRDWQPVGAEGQWLPPGSPGSNWAGADAESTGGRRRARHSGADEAWDGMPVEPVPPPPYAESGRRARSRHSAEYRDYGVRNFAPGSEPPAGPAPAPPPPAAATPPPPAAPAPSGPAAGASPPPRLAPPPAAEHTPRHGGEPEPADPRRARDASGTGGQSVADLLARLQVQPSEGGRRRRREG

SEQ ID NO: 1821 - protein, 303 aa, Mycobacterium paratuberculosis
MVQFDGLRPARLKVGIISAGRVGTALGVALERADHVVVACSAISHASRQRAQRRLPDTPVATPPEVAAGAELLLLAVPDSELAGLVSGLAATEAVRAGTIVAHTSGANGVGILAPLTRQGCIPLAIHPAMTFTGSDEDISRLPDTCFGITAADEVGYAIGQSLVLEMGGEPFSVAEDARVLYHAALAHASNHLVTVLSDALEALRAALRGSELLGQQTVDEQPGGIAERIVGPLARAALENTLQRGQAALTGPVARGDAAAVAGHLAALHRVAPELAQAYRVNALRTAQRAHAPQEVVEVLAP

SEQ ID NO: 1822 - protein, 308 aa, Mycobacterium paratuberculosis
VKPAFTAGELNTYTSPGDVTAVSRALRHTGRRVMLVPTMGALHDGHLALVRAAKRVPGSVVVVSIFVNPLQFGAGEDLDAYPRTLDDDLALLRSEGVEIAFTPTAAAMYPNGLRTTVQPGPLAAELEGGPRPTHFAGVLTVVCKLLQIVRPDRIFFGEKDYQQLVMIRQMVADLNIDVQVVGVPTVREADGLAMSSRNRYLDATQRELAVTLSAALTAGAHAAHLGGAAALRAARAVLDAVPELTVDYLELRDAGLGPAPAHGSARLLVAARLGNTRLLDNIEMQIETPAGTAGPDGDRQYAQSPWRN

SEQ ID NO: 1823 - protein, 143 aa, Mycobacterium paratuberculosis
MLRTMLKSKIHRATVTQADLHYVGSVTIDADLMDAADLLEGEQVTIVDIDNGARLVTYAITGERGSGVIGINGAAAHLVHPGDLVILIAYGTMEEAEARAYQPRIVFVDADNKPVDLGHDPAFVPDFEIAGAAELLDPRIVAR

SEQ ID NO: 1824 - protein, 271 aa, Mycobacterium paratuberculosis
VLLAIDVRNTHTVVGLISGSKEHAKVVQQWRIRTESEITADELALTIDGLIGDDSERLTGAAALSTVPSVLHEVRLMLDQYWPSVPHVLIEPGVRTGIPLLVDNPKEVGADRIVNCLAAFHRFQSPAIVIDFGSSICVDVVSAKGEFLGGAIAPGLQVSSDAAAARSAALRRVELARPRSVIGKNTVECMQAGAVFGFAGLVDGLVGRIREDVPGFGGDDVAIVATGHTAPLLLPELDTVSHYDQHLTLHGLRLVFERNRDAQRGRLKTAR

SEQ ID NO: 1825 - protein, 499 aa, Mycobacterium paratuberculosis
VSPAPDADIPEQYRIRRDKRARLLAEGHDPYPVAVERTHTLAQVRAAHPDLPVDTATDDVVGVAGRVIFARNSGKLCFATLQEGDGTTLQVMVSLDKVGREALDAWKADVDLGDIVSVHGTVISSRRGELSVLADSWRMASKSLRPLPVAHKEMSEEARVRQRYVDLIVRPQARTVARQRIAVIRAIRNALERRGFLEVETPMLQTLAGGAAARPFVTHSNALDIDLYLRIAPELFLKRCVVGGFDKVFELNRVFRNEGADSTHSPEFSMLETYQAYGTYDDSAVVTRELIQEVADEAIGTRQLPLPDGSVYDIDGEWASIEMYPSLSAALGEEITPQTTVEKLLGIAERLGVEIPRDRGYGHGKIVEELWEHTVGDTLTAPTFVRDFPVETTPLTRQHRSIDGVTEKWDLYVRGVELATGYSELTDPVVQRERFAAQARAAAAGDDEAMVLDEDFLAALEYGMPPCTGTGMGIDRLLMTLTGLSIRETVLFPIVRPHS

SEQ ID NO: 1826 - protein, 112 aa, Mycobacterium paratuberculosis
MAKKVTVTLVDDFDGAGAADETVEFGLDGVTYEIDLSSKNAAKLRNDLKQWVEAGRRVGGRRRGRSGSGRGRGAIDREQSAAIREWARRNGHNVSTRGRIPADVIDAFHAAT

SEQ ID NO: 1827 - protein, 843 aa, Mycobacterium paratuberculosis
MFERFTDRARRVVVLAQEEARMLNHNYIGTEHILLGLIHEGEGVAAKSLESLGISLEGVRSQVEEIIGQGQQAPSGHIPFTPRAKKVLELSLREALQLGHNYIGTEHILLGLIREGEGVAAQVLVKLGAELTRVRQQVIQLLSGYQGKEAAEAGTGGRGGESGSPSTSLVLDQFGRNLTAAAMEGKLDPVIGREKEIERVMQVLSRRTKNNPVLIGEPGVGKTAVVEGLAQAIVHGQVPETLKDKQLYTLDLGSLVAGSRYRGDFEERLKKVLKEINTRGDIILFIDELHTLVGAGAAEGAIDAASILKPKLARGELQTIGATTLDEYRKYIEKDAALERRFQPVQVGEPTVEHTIEILKGLRDRYEAHHRVSITDSAMVAAATLADRYINDRYLPDKAIDLIDEAGARMRIRRMTAPPDLREFDEKIAEARREKESAIDAQDFEKAASLRDREKQLVAQRAEREKQWRSGDLDVVAEVDDEQIAEVLGNWTGIPVFKLTEAETTRLLRMEDELHKRIIGQEDAVKAVSKAIRRTRAGLKDPKRPSGSFIFAGPSGVGKTELSKALANFLFGDDDALIQIDMGEFHDRFTASRLFGAPPGYVGYEEGGQLTEKVRRKPFSVVLFDEIEKAHQEIYNSLLQVLEDGRLTDGQGCTVDFKNTVLIFTSNLGTSDISKPVGLGFTQGGGENNYERMKQKVNDELKKHFRPEFLNRIDDIIVFHQLTRDEIIRMVDLMITRVAGQLKSKDMDLVLTDKAKALLAKRGFDPVLGARPLRRTIQREIEDQLSEKILFEEVGPGQIVTVDVDNWDGESAGEDAVFTFTGTRKPPAEPDLAKAGAHSADPQ

SEQ ID NO: 1828 - protein, 71 aa, Mycobacterium paratuberculosis
VSHPQPTRSRTRSVDLSAAGTALFLAATVFFALLALYLVGVDQGAVSLFGSDSHVHEFMHDARHLLGFPCH

SEQ ID NO: 1829 - protein, 249 aa, Mycobacterium paratuberculosis
LLAGAVGAVPAFVFARLCAEPVIARAIAFEDGRADAENAHGVHEHGAELFSRGVQSGPGLGFGVLIFGLAMGALFAVLFSVVYPRTESISPQALSLLLAAGAFGAVYLVPFVKYPPNPPAVGQADTIGARTGWYLALVAASAALTIGAVWLARRLQARLGPWNARLLSAAAYLVAIVAVAVLAPSVDETPAPLRDAAGAIVYPGFPADVLYEFRLVSLAAQLVLWAGIGLVFAAVSGRLLGARAPRVPA

SEQ ID NO: 1830 - protein, 182 aa, Mycobacterium paratuberculosis
VTGVVRLTLVSHGMTDAMADGRFPADEPLNELGRRQVQPIAAQLGGAASYFVAPELRTRQTAGLLGCDGAPEPLLADLDCGRWRGRALQTVDEADLAAWLSDPAGAPHGGESIADLIERASRWLNALTANPLHTAAVTHPAVIRAALLAALDADPASFWRVDVAPAACVVMHHRGGRWTLRL

SEQ ID NO: 1831 - protein, 479 aa, Mycobacterium paratuberculosis
MANRYLQGPFAPMHHEYTLTGLEVVGTIPDYLDGRYLRNGANPIGDVDPERYHWFLGDGMVHGIRIRDGKAEWYRNRWVRSPATSKALGQPAPPGHFGFFPIGANTNVIGHAGKTLALIEGGIANYELTEELDTVGVCDFAGTLTGGYAAHPHRDPETGELHAVSYNPYRGNRVQYSVIDVEGRARRTVNVTVGGSPMMHDFSLTERYVVFYDLPVTFDEAVGAAMTAPRGLRPIARLMLSALIGRVAIPDPIAARLPAATTDRRMPYSWNPNYPARVGVMPRDGEDADVRWFDVEPCYVFHPMNAYEEDGTIVLDVVRNPKMFDRDRTGPNEGPPTLDRWVIDLAAGKVRESRIDDRGQEFPRIDERLVGKRHRYGYTPTVLEGIEGGDCLLKHDLIGGSTQSRCLGPQKALGEFVFHPSSPAAAEDEGVLMGYVYDRATNRSELAILDAQTLEDVASIKLPHRVPAGFHGNWVPSTN

SEQ ID NO: 1832 - protein, 459 aa, Mycobacterium paratuberculosis
LCWTLPQTSRLASGLFAWRRALALSAAAALVATLAPGCASSPSPQANAANPGRQIDTRTPPGIRAQQTLDMLNSDWPIGPVGVRTLAAADKVESVQTTLEALWWDRPFTLNGVDIGASVATLHLTSSYGARQDIRIHTDDGGWVDRFDLDTRAPTVNSWHDVDAVLSKTGARYSYQAAKVDPQGRCEPVAGTNTGEALPLASIFKLYVLHALAGAVTAGRVSWDDQLTVTDKSRAVGSSGLALPAGAQVSVRTAAEKMIATSDNMATDLLIDKLGTHAIEEALATAGHHDPSSMTPFPTMYELFSVGWGRPDLRSQWEHGSPQVRARLLAQANSTPYDPDPMRAHSPASSYGAEWYGNAQDICRVHAALQADAVGKAAPVRDILSAVSGIQLDPAVWPYIGAKAGGLPGDLTFSWYAVDKTHQPWVVSFQLNWPRDHGPTATGWMLQVAKQAFALIAPR

SEQ ID NO: 1833 - protein, 106 aa, Mycobacterium paratuberculosis
MPPVVKINAIEVPADAGPELEKRFAHRAHAVENQPGFLGFQLLRPVQGEDRYFVVTHWESDEAFQAWAKGPAIEAHAGHRANPVATGASLLEFEVVLDVAANKQAG

SEQ ID NO: 1834 - protein, 272 aa, Mycobacterium paratuberculosis
MPLGYPGPRPGQPARCTQDGGMPSTVLTRHGGHGEPLVLVHGLMGRGSTWTRQLPWLTRLGTVYSYDAPWHRGRDVDDPHPISTERFVADLADAVGTLDAPARMVGHSMGALHSWCLAAQHPELVSALVVEDMAPDFRGRTTGPWEPWLHALPVEFDSAEQVFAEFGPVAGQYFLEAFDRTETGWRLHGHTSRWIEIAAEWGRRDYWAQWRAVRVPALLIEAGNSVTPPGQMLEMAERAFAATYLHVPQAGHLVHDEAPKAYRQAVESFLAG

SEQ ID NO: 1835 - protein, 303 aa, Mycobacterium paratuberculosis
MADIMPQPPADGSPLISVTDLLEWYRVARRDLPWRAPGVSAWQILVSEFMLQQTPVSRVLPIWPDWVRRWPTPSATAAASAADVLRAWGKLGYPRRAKRLHECATVIARDHGDVVPDDVDTLLTLPGVGGYTARAVACFAYRRPVPVVDTNVRRVVARAVHGQADAGAPSAGRDHADVAALLPGDGSAPEFSVALMELGATVCTARAPRCGLCPLRRCAWREAGHPPATGPARRVQTYAGTDRQVRGRLLDVLRGNDSPVTRAELDVAWLTDTAQRDRALYSLLADGLVTQTTDGRFALAGEE

SEQ ID NO: 1836 - protein, 205 aa, Mycobacterium paratuberculosis
MPNTSPVTAWKSLKEGNERFVAGKPQHPSQSVEHRASLAAGQSPTAVVFGCSDSRVAAELIFDQGLGDMFVVRTAGQAIDTAVLGSIEFAVSVLNVPLIVVLGHDSCGAVKAALGAIEEGAIPGGFVRDVVERVAPSILMGRREGLSRVDEFEERHVRETVAQLVSRSTTIAERIGDGTVAVAGVTYHLADGRAALCDHVGDIGE

SEQ ID NO: 1837 - protein, 277 aa, Mycobacterium paratuberculosis
VTWAYAANVLDLEPRGPLPTEIYWRRRGLAVGIAVVVIGVVAAAVIAFMGHSAGAKPANADKPNSAQSKPGSPAPQAPAPPGPEGPAPAVPPAQGQNPETPTPTAAVQPPPVLKEGDDCPDSTLAVKGLTNAPQYFIGDQPKFTMVVTNIGLVACKRDVGAAVLAAYVYSLDNKRLWSNLDCAPSNETLIKTFTPGEQVTTAVTWTGMGSAPHCPLPRPAIGPGTYNLVVQLGNLRSQPVPFIMNQPPPPPGPVPGPGQPGAVPQPEAPPVPPPPAG

SEQ ID NO: 1838 - protein, 357 aa, Mycobacterium paratuberculosis
VTRPTLRETVARLAPGTGLRDGLERILRGRTGALIVLGNDENVEAICDGGFALDVRYAPTRLRELAKMDGAVVLSTDGSRIVRANVQLVPDPSIATDESGTRHRSAERAAIQTGYPVISVSHSMNIVTVYVGGERHVVADSATILSRANQAIATLERYKIRLDEVSRQLSRAEIEDFVTLRDVLTVVQRLELVRRIGQVIDNDVVELGTDGRQLRLQLDELLGGNDNARELIVRDYHASPEQLSEAQMTATLDELDALSDTELLDFTALAKVFGYPTTTEAQDSAVSPRGYRALAGIPRLQFAHADLLVRSFGTLQNVLAASASDLQSIDGIGAMWARHVREGLSQLAESTITDSLS

SEQ ID NO: 1839 - protein, 474 aa, Mycobacterium paratuberculosis
VATARSQYRCSECRHVTAKWVGRCLECGTWGTVDEVPALSAVAGRRPRLTAASQAVPITSIKPDASRHRSTGVDELDRVLGGGVVPGSVTLLAGDPGVGKSTLLLEVAHRWAQSGRRALYISGEESAGQIRLRADRIGCGGDQVYLAAESDLHTVLEHIATVKPALVIVDSVQTMSTTEADGVAGGVTQVRAVTAALTAAAKANGVALILVGHVTKDGAIAGPRSLEHLVDVVLHFEGDRNGSLRMVRGIKNRFGAADEVGCFLLHDNGIAGVTDPSNLFLDQRSAPVPGTAITVTLDGKRPLIGEVQALLASPSGGSPRRAVSGIDHSRAAMITAVLEKHGKLPVAVNDIYLSTVGGMRLTDPSSDLAVAIALASALSELPLPTTAVMIGEVGLAGDLRRVSGMARRLSEAARQGFSIALIPDGDDPRREIVPSGMRALRAPTIGAALKHMVDIAEPRKGWTHRALGPQNDTL

SEQ ID NO: 1840 - protein, 188 aa, Mycobacterium paratuberculosis
VNRFKIRLGLPARAVRVALAGAVAVPAVLLSGCGAGQVSQMAVQEPAINGNKVTFNNVALRDIRIQAVQTGDFLQPGRAVDLVAVAVNQSPNTPDKLVGITTDIGTVTLSGDTRLPAGGMLFIGTPEGQKVAPGPIGSNTAAKATVTLAKPITNGLTYNFTFSFEKAGQASVLVPISAGVAPQPDHAG

SEQ ID NO: 1841 - protein, 162 aa, Mycobacterium paratuberculosis
MIFKVGDTVVYPHHGAALVEAIETRTIKGEQKEYLVLKVAQGDLTVRVPAENAEYVGVRDVVGQEGLDKVFQVLRAPHTEEPTNWSRRYKANLEKLASGDVNKVAEVVRDLWRRDQERGLSAGEKRMLAKARQILVGELALAESTDDAKAETILDEVLAAAS

SEQ ID NO: 1842 - protein, 235 aa, Mycobacterium paratuberculosis
LVPETGLAPETGSSGTVAAVVPAAGSGERLAAGIPKAFCEIDGASMLARAVAGLLDSKVVDHVVVAVPADRVDEAKRLLPGQATVVAGGADRTASVRLALAAVPGNPAFVLVHDAARALTPPALIARVVQALRDGHRAVVPALPLHDTVKAVDANGVVLGTPERDGLRAVQTPQGFATDLLLRAYAAGAGTAGFTDDASLVEHVGGQVQVVDGDPLAFKITTQLDLLLAETIVRR

SEQ ID NO: 1843 - protein, 159 aa, Mycobacterium paratuberculosis
VNTTPRIGLGVDVHPIQPGRPCRLLGLLFDDADGCAGHSDGDVGAHALCDAVLSAAGLGDVGAVFGVDDPRWAGVSGADMLRHVADLTARHGFRVGNAAVQVIGNRPKVGPRRAEAQRVLSELLGAPVSVAATTTDGLGLTGRGEGLAAIATALVVPTG

SEQ ID NO: 1844 - protein, 468 aa, Mycobacterium paratuberculosis
VTDRPRLRLHDTAAGAVRDFVPLRDGHVSIYLCGATVQGLPHIGHVRSGVAFDILRRWLIALGYDVAFIRNVTDIDDKILNKAAAAGRPWWEWAATYERAFSAAYDALDVLPPSAEPRATGHITQMVELIERLIEKGHAYTGDGDVYFDVLSYPEYGQLSGHRIDDVHQGEGVASGKRDQRDFTLWKGAKPGEPSWPTPWGRGRPGWHTECVAMAHEYLGPEFDIHCGGMDLVFPHHENEIAQSRAAGDGFARYWLHNGWVTMGGEKMSKSLGNVLAIPAMLQRVRPAELRYYLGSAHYRSMLEFSDTALQDAVKAYVGVEEFLHRVRVRVGAVEPGEPNPRFADALNDDLAVPAALAEVHQARAEGNRALDSGDHEGALRQARSIRAMMGILGCDPLHERWETRDETSAALAAVDVLVRAELQNREKAREQRNWALADEIRNRLKQAGIEVTDTADGPQWTLGGDGK

SEQ ID NO: 1845 - protein, 309 aa, Mycobacterium paratuberculosis
MAGNSRRRGAVRKAGTKKGPTVGSGGQRRRGLEGRGPTPPAHLRPNHPAAKRAQSPPRRPAKRTEETETVLGRNPVLECLRAGVPATALYVALGTEADERLTESVSRAADSGISILEVPRADLDRMTGNHLHQGIALQVPPYIYAHPDDLLEAAAGSLPALLVALDNISDPRNLGAIVRSVAAFGGHGVLIPQRRSASVTAVAWRTSAGAAARIPVARATNLTRTLQDWADRGLRVIGLDAGGDTMLDDLDGSDPLVVVVGSEGKGLSRLVRQNCDEVVSIPMAGSAESLNASVAAGVVLAEISRQRRG

SEQ ID NO: 1846 - protein, 297 aa, Mycobacterium paratuberculosis
MAVLLSAAPVYGQPATFDLQAHRGGRGETTEESLRAFAKAIQTGVSTLELDIVVTRDGQPLVWHDPTIQADKCSDTGPAFPGDPGYPYVGKLVHQLTVAQIHTLDGGHRLKEFPDAEVVRGNKIATLPEVFAVADSHRADAIRYNIETKVEPDDTGASAQPQEFVDVILAAVRSADKLARVEIQSFDWRTLPLVRRAEPSIPLVALYDERAAGDPVLGARAAGADIVSPDYRLVTGKPYVDRAHALGLKVIPWTVDDAEDMRRQIDYGVDGLITDFPTLARGVLAELGVPLPPAVPG

SEQ ID NO: 1847 - protein, 477 aa, Mycobacterium paratuberculosis
MTTKVGEHAVVLGASMGGLLAARSLADFFDRVTVVERDPLPDAHGARRGVPQGRHLHALLCRGAQAIEELFPGVLDQMVRDGAQYFDGQDLSQLYYNIGGHLMTRSGAAPGLTAYSATRPFLEDHVRGRLRGIPNVTLRDEHCVTRLVSTADRRRVVGAWVADGRTGETTAMPADLVVDATGRAAHTPTWLDGLGYDRPREDRVTVQLTYASQALRMTGEAPRELGLLIGIVPGRPRGCGLLHCEHDTWLLTVMGVGGEEPATLDLATMCDFIADCAPAHLLAAVRGAEPVGEPVRHRMPCSRWRRYDKLRRFPDGLLVTGDAICSFNPIYGQGMSVAALEALALRDCLSSGTTDLARRFFRAAAAPIRQAWQLSTNPDLALPEIEGTPPLIARAFNKYVDRVLTAAETDTVALNQFIRVTSLVDPATRLLRPSIMWRAARARGADHPGTAGGSGTPSSASTPRANVGKSVMSPSTP

SEQ ID NO: 1848 - protein, 499 aa, Mycobacterium paratuberculosis
VIGGELLIGRDSELAAIRRALNGADHHRGVVIAGAAGVGKTWLARAALRRAGASGEQIKWIVGTQSAQALPLGAFIGLLGDAMSEPLTSVRRVIETFVARQRRGRVVVGVDDAHLLDGLSALVVHQLAQSGGVRLVVTVRTGSHQPDAVTALWKDDLLTRLDLEPLSAAATREVIESTLGGPVDARCAARFRRLTGGNTLFLRQLLSDQMAAGRMRRVAGVWMWDGDVAVSASLSDTVGRQLGRLTPPLALVVDTLSQCEPLPVDLLCDLASREDLVAAEAMGLVTVERTPRALMARLAHPLFGELRRAGAGEMYLSTIRGRLATRLAQDQDADMQATVRRALLTLESDLDPQPELYLESARHAMTLLDLDLADRLANAAARAGAPGAAGVRAMNLVLLGRGEQAEEALRAITDGADGDASDRHYWATVRAANLVWMLGRPADAALILDGLAARPETPAQAAARCAVQACLDAVAARCQLAAERARADWIPSRCRISMR

SEQ ID NO: 1849 - protein, 378 aa, Mycobacterium paratuberculosis
MMASLALIMAMGALGQVDDLTAVAEQALRRATTSFEASHMRFWFGAVYGRACRLTGRIDEFVSTARRLADSARDVPGLAYANLALLLGNAELARGAAAEAARLVQEALAGAQIHEVTSGLRPASYFALAEAHGRLGHPAQANEAIAGARSCVPPDFLFMHTGLALATGWALAAGGQLREAVATAQAAARLARDRGQPTHELACIQAAAQWGDAAGAARARALADALSLPLADAIACHAEALRAGNGEALLTVAAAYRAIGDAAAAADAAAQASAAFVEGQQHQRGRYAAALAGELAEECGGLCTPALRTPAGLKLSGRQRDVIELAVAGLSNRQIAERLVMSVRTVEGHIYRACQRVGAQSRDELATIIRTRPAGRES

SEQ ID NO: 1850 - protein, 413 aa, Mycobacterium paratuberculosis
MALTVALVLLAVVLGFAVARPRGWPEAVAAVPAALLLVGVGAIPVAAAEQQIADLSGVVAFLGAVLVLAKLCDDEGLFEAAGAAIARGRVGSAGMLRRVFVIASAITAVLSLDAAVVLLTPVVLAAVRRQRTAVRPYAYATAHLANGASLLLPVSNLTNLLAFHTAQLSFTRFTLLMAAPWLAAVATLYAVFRGFFAKDLRVQPDPAALGAPPRPPVFVLVVVALTLAGFAVAQSVGIAPAWVALCGASVLAVRSLARGHTTVTEIARSVHVSFLVFVLALGVVVQAVMRNGMDRAMSAVLPSGSGLPALLAIAATAAVLANVVNNLPATLVLLPLVAPAGPVAVLAVLIGVNIGPNLTYVGSLSNLLWRRVLRQHGVDAGVGEYTRLGVCTVPVSLLVAVLALWASARLLGG

SEQ ID NO: 1851 - protein, 305 aa, Mycobacterium paratuberculosis
MRLRLGRPDITRYADRFDVPAAGPGGLSVTWLGVASLLIDDGSSALLTDGYFSRPGLARVVAGKVSPSPPRVDGCLARAKVSRLEAVIPVHTHFDHTLDSALVADRTGALLVGGESAANVGRGYGLPEDRIVVAADGEPIRLGAFDVTLVKSHHCPPDRFPGVIEEPLIPPARASAYRCGESWSTLVRHRPTGRRLLICGSAGFVAGALAGQRAEAAYLSVGQLGLRPRSYLDEYWDQTVRTVGARRVILIHWDDFFRPLSKPLRALPYAGDDLDSSIRVLDELAERDGVALHLPSVWRREDPWA

SEQ ID NO: 1852 - protein, 252 aa, Mycobacterium paratuberculosis
VAGIDLNADLGEGFGVWRLGDDDAMLGIVSSANVACGFHAGDPAGLLRVCRSAAERGVRVGAQVSYRDLAGFGRRFIDVAADELLADVVYQIGALQAIAHAAGSSVCYVKPHGALYNTIVTHPAQAAAVAEAVRLVDPGLPVLGMAGSVFFDEAARRGLRVVAEAFADRAYRPDGRLVSRREPGAVLADPAAIAERVLAMVDTGAVTAVNGTRLELSVESVCVHGDSPGAVQIATAVRDRLRAAGVEIRAFC

SEQ ID NO: 1853 - protein, 286 aa, Mycobacterium paratuberculosis
MEHRLADMADHLFSLDITVHLLGHDFVQQALVAAALLGLVAGLIGPFIVMRQMSFAVHGSSELSLTGAAFALLVGIGVGVGALIGSALAAALFGVLGRRARERDSVIGVVLAFGLGLAVLFIHLYPGRTATSFALLTGQIVGVGYTGLTMLALVCLLVIAVLATCYRPLLFATVDPDVAAARGVPVHALGIVFAALVGVVAAQAVQIVGALLVMSLLITPAAAAARVVASPGAAMLASVAFAEVSALGGIVLSLAPGVPVSVFVATISFLIYLACWLIGRRREAAT

SEQ ID NO: 1854 - protein, 273 aa, Mycobacterium paratuberculosis
VSLQAAAAVDHDADTVSLRGARLAFGDRVLWEDLDLSVSRGEFVAVLGPNGSGKTSLLKVLLGQLPLSAGVGLVDGKPITSGSGRIGYVPQHRPMERDVMLRGRDLVRLGLDGGRWGAAPLRPRERARRRATVDQALRQVNGELLADVRVGVMSGGELQRMRVAQALVSDPLLLLCDEPLLTLDPANAKLVSALLERRRRDAATTVIVVTHEINPILPYVDRVLYLVDGRFRIGTVEQVMNSETLSALYRADIQVVKVKGGYVVAGEHTDGHG

SEQ ID NO: 1855 - protein, 311 aa, Mycobacterium paratuberculosis
VGTALTRDATRVGRTTRWLAAVLAVTGWAALTGCTGPAHPHATAVVASTDVWGSVARAVAGGHVAVASILSGSDQDPHSYEASPSDAAAIADAGLVVFNGGGYDGWVDDVLAHHPGVARVDAYALLPDDGRPRNEHVFYHLGVAKAVAAAVADRLAAIDPGNAADYRRNAAAFGRDADAIAGIEHTIAAAHPGGSVVATEPVAFYLLEASGLVNRTPPALEAAVENETDPAPADLARALDLLDRHQVSALVVNPQTSASAVNGLREAARRAGVPVVEVRETLPDGADYLSWQRNTVGQLQTALQPVRSLQP

SEQ ID NO: 1856 - protein, 398 aa, Mycobacterium paratuberculosis
MSSRRPASRCTILMKIVSITKPAGEARTRAHRSAVASPSVSPTPRRRATLASLADELKVSRTTVSNAFNRPDQLSADLRERVLATAKRLGYPGPDPVARSLRTRKAGAVGLVMAEPLTYFFSDPAARDFVTGVAQSCEALGQGLLLVAVGPSRSLDEGTAAVLSAGVDGFVVYSVCDDDPYLQAVLQRRLPVVVVDQPKGLTGVSRVGIDDRAAMRELADYVLGLGHREIGLLTMRLGRDRRQGLVDAERLRSPAFDVQRERITGVWEAMTAAGVDPDSLTVVESYEHLPESGGAAAKVALEANPRITALMCTADILALSAMDYLRAHGVYVPGQLTVTGFDGVPDAISRGLTTVSQSSLHKGSRAGELLLKPARSGLPVVELLDTELIRGRTAGPPA

SEQ ID NO: 1857 - protein, 248 aa, Mycobacterium paratuberculosis
VGNSHAECVSFADEPPGTGAHRHMPARATSKAESKADSSRVSDSQPREVMNVAVLAESELGSEAQRERRKRILDATMAIASKGGYEAVQMRAVADRADVAVGTLYRYFPSKVHLLVSALGREFSRIDAKTDRAAMTGGTPFQRLNFMVGKLNRAMQRNPLLTEAMTRAYVFADASAASEVDQVEKLIDSMFARAMADGEPTEDQYHIARVISDVWLSNLLAWLTRRASATDVSKRLDLAVRLLLGEHG

SEQ ID NO: 1858 - protein, 707 aa, Mycobacterium paratuberculosis
VVATVTDEQFAARALVRDWARNASTGPGGTAAIRDVEQGNPDAWRPVFARLAELGIFGVAVPEEAGGAGGSVEDLCAMVEEAAKALIPGPVATTALATLVVSDAELLAALAAGERFAGLALQGDITFDGAASTASGTLPFALGAADGGVLLLPADGRWLVVDTASDGVHIEPLAATDFSRPLARVVLDSAPATVLAQTPERVEELAATVLAAEAAGITRWSLQTAVDYAKVREQFGKPIGSFQAIKHLCAEMLCRAEQAEVAAADAARAAAEDDPAQFSLAAALAAATAITAVKANVKDCIQVLGGIGCTWEHDAHLYLRRAHAIGRFLGGAERWLRRITALTQAGVRRRLGIDLTEVEDQRPQITEAVARIAALPAEQRQAALAEAGLQAPHWPAPYGRGASPAEQLLIDQELAAAGVARPDLVIGWWAAPTILEHGTPEQIERFVPGTLRGEFLWCQLFSEPGAGSDLASLRTKAVRTDGGWLLTGQKVWTSAAHKARWGVCLARTDPDAPKHKGITYFLVDMSAPGIEIRPLREITGDSLFNEVFLDNVFVPDEMVVGEVNDGWRLARTTLANERVAMASGTALGNPMEELLELLSTLPLDSAQQDRLGRLIVTAQTGALLDQRIAQLAVGGQDPGAQSSVRKLIGVRYRQALAEYTMDVSEGGGLVHNRAVYDFLNTRCLTIAGGTEQILLTVAAERLLGLPR

SEQ ID NO: 1859 - protein, 190 aa, Mycobacterium paratuberculosis
MARWEPDARARLVAAALDLFNERGYDQTTVAEIAERAGLTKSTFFRHFPDKRDVLAAGQDAIAALLREGIAAAPADATPLALVCSGLKSAAAAFTPFNKELAPRLRAAIAASAELQERNALKQIGLALAVSEALQARGVPEPAAALAAELGALAVKTAYARWAEPDESGDLGDMACQALRELHAAAADLG

SEQ ID NO: 1860 - protein, 317 aa, Mycobacterium paratuberculosis
VMRPLSRHWCRVMGPLSHHSKEQLVRVLVTGASGGIGSAVVKELLAAGHHVIGLARSEASAATVSGLGAEPLRGDIADLDVLQKAAVDTDGVAYLAFSHDFSDVGDAIADEARAIDALGAALADTGKPLVLASGTPARPGSVSTEDDPFIADGPLAGRGRTGQAVVALAGRGVRSAVVRLPRAVHDAGGRYGLVGILIQLARQRGVSSFAGDGTQRWPAVHRDDAAALFRLALEQAPAGSVLHAVGDEGVPLRAIAEVIGRRLGVPVESAPADTFGPLGQVFAVDQPSSSALTQRRFGWQPVGPGLLDDLETGVYPE

SEQ ID NO: 1861 - protein, 186 aa, Mycobacterium paratuberculosis
VGLQGREAAMMRLVSGFAVAAALPMFLPAGVCAAASNTATTLFPLDGPNQLETRALLNCFKSDGHCDFTAGADMLTPDGVTGFPPGLWARQTSEIRSSNRLAYLDAHADGQYERVHKSMGSDEITTIYMGEGPPDKYEAHGRIDSTDWQTGQPKTDNNVILCTHIQVVYSGVNITSPSTCAVTTFS

SEQ ID NO: 1862 - protein, 364 aa, Mycobacterium paratuberculosis
LTEADSAQALDEPLGDHVLELQIAEVIAETDDARSLVFAVPDDDGDPDIPPERLRYAPGQFLTLRVPSERTGSVARCYSLCSSPFTDDALTVTVKRTADGYASNWLCDNARPGMRIHVLAPSGNFVPKTLGDDFLLMAAGSGITPIMSIAKSALSEGSGQVTLLYANRDERSVIFADALRELSAKYPDRLTVLHWLESLQGLPSVTALAQLAAPYTDRPVYICGPGAFMDSAREALETLKVPAAQIHIEVFKSLDSDPFAAVKIEDTAEGDEPPATAVVELDGETHTVSWPRNAKLLDVLLAKGLDAPFSCREGHCGACACTLRKGQVSMEVNDVLEQQDLDEGLILACQSHPESDSVEVTYDE

SEQ ID NO: 1863 - protein, 394 aa, Mycobacterium paratuberculosis
VTSIQQRDAQSVLAGIDDLLPRIRERAQATEDLRRLPDETVADLQDVGFFTLLQPEQWGGLQCDPTLFYEAVRRLASACGSTGWVSSIIGVHNWHLALFDQQAQEEVWGEDPNVRISSSYAPMGAGVVTDGGYLVNGSWNWSSGCDHATWAFLGGPVIKDGRPVDFGSFLIPRSEYRIDDVWHVVGLRGTGSNTVVVKDVFVPRHRFLSYKAMNDGTAGGYQTNTAPVYKMPWGTMHPTTISAPIVGMAYGAYAAHVEHQGKRVRAAFAGEKAKDDPFAKVRIAEAASDIDAAWRQLSGNVADEYALLSAGKEIPFELRARARRDQVRATGRAIASIDRLFEASGATALANDQPVQRFWRDAHAGRVHAANDPERAYQIFGNHEFGLPPGDTMV

SEQ ID NO: 1864 - protein, 293 aa, Mycobacterium paratuberculosis
MTATEELTFESTSRFAEVDVDGPLKLHYHEAGLSFKGTGRTVVLLHGGGPGAASWTNFGRNIPVLARHFHVLAVDQPGYGLSDKRAEHGQFNRYAARALNGLFEQLELGRVPLVGNSLGGGTAVRFALDYPDKAGRLVLMGPGGLSINLFAPDPTEGVKRLGKFSAEPTRENLEAFLRVMVYDQKLITDELIDERFALASTPESLAATRAMGMSFAGADFELGMMWREVHRLRQPVLLIWGREDRVNPLDGALVALKTIARAQLHVFGQCGHWAQVEKFDEFNKLTIDFLGGA

SEQ ID NO: 1865 - protein, 303 aa, Mycobacterium paratuberculosis
MSNGAIRSLGYLRIEATDMAAWRDYGLKVLGMVEGKGDTEGALYLRMDDFPARLVIVPGERDHLLEAGWECANAEGLQEIRDRLDMEGVPYKEATAAQLADRRVVEMIRFSDPSGNCLEVFHGVALEHRRVVSPYGHKFVTGEQGLGHVVLSTRDDEESLHFYRDVLGFKLRDSMRMPPQVVGRPADGAPAWLRFFGCNPRHHSLAFLPLPTPSGIVHLMLEVENADDVGLCLDRALRRKVPMSATLGRHVNDLMLSFYMKTPGGFDVEFGCEGRQVEDDDWVARESTAVSLWGHDFTVGMRG

SEQ ID NO: 1866 - protein, 187 aa, Mycobacterium paratuberculosis
MAAPIDPRTFRQVLGQFCTGITIITTVHDEVPVGFACQSFAALSLDPPLVLFCPTKVSRSWKAIEATGRFCVNVLTEKQKHVSARFGSKEPDKFAGIDWHPSELGSPIIDGALAHIDCTVASVHEGGDHFVVFGAVQSLSEAPKIKPRPLLFYRGEYTGIEPDKTTPAQWRDDLEAFLTTTTQDTWL

SEQ ID NO: 1867 - protein, 276 aa, Mycobacterium paratuberculosis
MTLDLGAYFDRIGYGGKAAPNLEVLRALMAAHTGSIPFENLDPLMGVPVDDLSPAALTDKLVHRRRGGYCYEQNGLLGYALAEIGFRVRRLAGRVVWMQPPDTPPRAQTHTVLAVTFPGSQGAYLVDVGFGGQTLPSPIRFETGNAQQTTHEPYRLDDRGEGLVLQALVRDEWPPLYVFGTRTVPQIDLLVGSWYVSTHPSSMFVTGLMVARTTADARWNLAGRELTVHRAQSSEKIRLDDADAVLDVLGERFGIDVAGIGQRGALLARIEQVLDA

SEQ ID NO: 1868 - protein, 388 aa, Mycobacterium paratuberculosis
VTDRVSLRAGITPFYVMDVWLAAAERQRSHGDLVNLSAGQPSVGAPEPVRAAAAAAVHSNELGYSVSLGTPELRAAIAADYRRQHGLEVEPDAVVITTGSSGGFLLTFLACFDVGDRVALASPGYPCYRNILSALGCEVVEIPCGPQTRFQPTAAMLAELDPPVQGVIVASPANPTGTVIAPEELAAIASWCEASGARLVSDEVYHGLVYEGAPPTSCAWQTSRNAVVVNSFSKYYAMTGWRLGWLLVPVELRRAVECLTGNFTICPPVLSQLAAVAAFTPEATAEADGHLHHYAKNRALLLDGLRGIGITRLAPTDGAFYVYADVSDFTDNSMEFCSKLLEQTGVAIAPGIDFDTTRGNSFVRLSFAGPTTDIEEAVRRLGSWLRAR

SEQ ID NO: 1869 - protein, 319 aa, Mycobacterium paratuberculosis
MSAISEERQMLRETVAALVAKHAGPAAVRTAMESERGYDESLWRLLCEQVGAAALVIPEELGGAGGELADAATVLQELGRALVPSPLLGTTLAELALLGAAEPDTAALQALAEGSAIGALVLDPDYVVNGDIADVVIGVEDGRLSRWTGVTAQPVTTMDPTRRLARVRAQQTEPIGTDPGLADTAAVLLAAEQIGAAEQCLARTVDYAKDRVQFGRPIGSFQALKHRMADLYVTVAAAKAVVDEACLDPSPTNAATARLAATEALNVVAAEGIQLHGGIAITWEHDMHLYFKRAHGSAHLLDTPQQLLTRLEPEVLATP

SEQ ID NO: 1870 - protein, 314 aa, Mycobacterium paratuberculosis
VKFALDEQQRDFAASIDAALGAADLPAAVRAWAAGDTAPGRKVWEQLANLGVTALAVPEKFDGIEAEPIDLVVAIERLGRWCVPGPVVESIAVAPVLLAGDEHAERCAALASGELIATVALPPQVPRAVDAEEAGLVLLANQDGVAEAAAGWQHASVDPSRRLYDVEATGDRWQADIGRGYEFGALATAAQLVGAAEALRDAAVDYAKQRTQFGRVIGSYQAIKHKLADVHIAIELARPLVYGAALTLQPRDVSAAKAAASDAALLAARSALQTHGAIGFTQEHDLSLLLLRVQAVRSAWGPPQVHRQRVLEAL

SEQ ID NO: 1871 - protein, 381 aa, Mycobacterium paratuberculosis
MDLDLDEGTLAFRDEVRQFLSANAEAIPTKSYDNAEGFEQHRRWDRVLYDAGLSVITWPKKYGGRDAPLLHWVVFEEEYFRAGAPGRASANGTSMLAPTLFAHGTEEQRDRILPKMASGEEIWAQAWSEPESGSDLASLRSTATPTDGGWLLNGQKIWSSRAPFAERGFGLFRSDPSAERHHGLTYFMFDLKAEGVTVRPIVQLGGDTGFGEIFLDDVFVPDRDVIGTPHQGWRAAMSTSSNERGMSLRSPARFLATAERVVRLWQDRGSPAEFADRVADGWIKAQAYRLQTFGTVTRLAAGGELGAESSVTKVFWSDLDVELHQTALDILAADGELAGPWTEGLLFALGGPIYAGTNEIQRNIISERLLGLPREKSGSKK

SEQ ID NO: 1872 - protein, 75 aa, Mycobacterium paratuberculosis
VAAHRRHRVPDERLGEVGRAFVVPRPGAQLDEQSVIAYTREHLANFKAPRSVRFVDALPRNSGGKVVKPQLRELD

SEQ ID NO: 1873 - protein, 421 aa, Mycobacterium paratuberculosis
VTTDPRTVPAALDRLARRLPDHDALITEDRSFTAAALRDEVHRAAAALIELGVRAGDRVAIWSPNTWHWVVACLAIHHAGAAMVPLNTRYTAAEAGDILARVGAPVLFGMGRFLGHDRLADLDRAALPALRHIVRIPIEADDPVPGSWDEFIAHGTDLGAVAERAAAVTPDDVSDILFTSGTTGRSKGVLCAHRQSLSASASWAANGKITSDDRYLCINPFFHNFGYKAGILACLQTGATLIPHLTFDPLRALQAIEQHRITVLPGPPTIYQTLLDHPARRDYDLSSLRFAVTGAATVPVVLVERMQSELDIDIVLTAYGLTEANGMGTMCRADDDAVTVATTCGRPFADFELRIDDSGEVLLRGPNVMLGYLDDPDATAAAIDADGWLHTGDIAFPTSGSARWAARSWSPAPGPNSTSNP

SEQ ID NO: 1874 - protein, 382 aa, Mycobacterium paratuberculosis
MQDVEEFRAEVRSWLADNLVGEFAALKGLGGPGREHEAFEERRAWNQHLAKAGLTCLGWPVEHGGRGLSTAHRVAFYEEYARADAPDKVNHFGEELLGPTLIAFGTPEQQQRFLPRILDVTELWCQGYSEPGAGSDLANVSTTAELDGDQWVINGQKVWTSLAHLSQWCFVVARTEKGSKRHAGLSYLLVPLDQPGVQIRPIVQITGTAEFNEVFFDDARTDASMVVGQPGDGWRVAMGTLTFERGVSTLGQQIRYARELSNLAELARRNGAADDPFIRERLTRAWTGLRAMRSYALATMDVEQPGQDNVSKLLWANWHRALGELAMDVIGKPGMTMPDGEFDEWQRLFLFTRADTIYGGSNEIQRNIIAERVLGLPREVKG

SEQ ID NO: 1875 - protein, 262 aa, Mycobacterium paratuberculosis
MSLSEAPKEIAGHGLLEGKVVIVTAAAGTGIGSATAKRALAEGADVVISDHHERRLGETADQLAALGQGRVESVLCDVTSTAQVDALFASAHARMGRIDVLVNNAGLGGQTPVVDMTDDEWDRVLDVTLTSVFRATRAALRYFRDAPHGGVIVNNASVLGWRAQHSQSHYAAAKAGVMALTRCSAIEAAEYDVRINAVSPSIARHKFLEKTSSADLLDRLSAGEAFGRAAEPWEVAATIAFLASDYSSYLTGEVISVSSQHP

SEQ ID NO: 1876 - protein, 202 aa, Mycobacterium paratuberculosis
VDRVTGPANSRRDELLELAAAMFAERGLRATTVRDIADSAGILSGSLYHHFSSKEEMVDEVLRSFLDWLFARYREIIDSESNPLERLKGLFMASFEAIEHRHAQVVIYQDEAKRLLSQPRFSYIEDMNRQQRKMWLEVLNQGVDEGYFRPDLDVDLVYRFIRDTTWVSVRWYQPGGPLTAEQVGQQYLAIVLGGITVDAKKD

SEQ ID NO: 1877 - protein, 386 aa, Mycobacterium paratuberculosis
MPEAYVIDAVRTAVGKRGGSLAGIHPVDLGALGWRGLLDRVDVDPAAVDDVIAGCVDAIGAQAGNIARLSWLAAGYPEEVPGVTVDRQCGSSQQAISFGAQAIMSGTADLIVAGGVQNMSQIPISSAMTVGEQFGFTSPTNESKQWLHRYGDQEISQFRGSELIAEKWNLSREEMERYALTSHERAFAAIRGGHFDNEIITVETESGPFRVDEGPRESSLEKMAGLKPLVEGGRLTAAMASQISDGASAVLLASERAVNDHGLQPRARIHHISARAADPVFMLTGPIPATRYALDKTGLSIDDIDTVEINEAFAPVVLAWLKEIKADPEKVNPNGGAIALGHPLGATGAKLFATMLNELERIGGRYGLQTMCEGGGTANVTIIERL

SEQ ID NO: 1878 - protein, 246 aa, Mycobacterium paratuberculosis
VSAVAVLLTALGMADLCRRAVAAAWVPLAVGPIVVAACAALGGLWRGADIALLALAAVAVVAWEWLCARSELSGAQQAAPVAVLAAALVSLTVLSGWSSPVAGAISRWSAWAHLPLSHVPPTRALMVVGVVLVQFATANQLVRLVLGSVGAVRPAGQPQPSDRLKGGRLLGPMERLLILSLGVGGQLAAASAVVAAKGIIRFPELNAQKGQNGDVGIDEVTEYFLVGSFTSWLLALGGIGLVLATR

SEQ ID NO: 1879 - protein, 215 aa, Mycobacterium paratuberculosis
MARVKAKPSPRATVIGDVVGSRRAADRPALHRRVAAALREVAGGAIDPPAFTVGDEFQGSYPSVGAAIDAALTVRLLLAPEIDVRFGLGWGAVTVLDAAAGIQDGPGWWTARAAIQQTAHAQRQPGLALVRTTFRADDGTRTDADAINAALICRDHLLGSLDERSLRIVRGLMTGRSKRELAAAEGISPSAVSQRAGRDGLDLIVLASQYLRELP

SEQ ID NO: 1880 - protein, 358 aa, Mycobacterium paratuberculosis
VDMRLRTPLTELVGVEHPVVQTGMGWVAGARLVSATANAGGLGILASATMTLDELATAIAKVKAATDKPFGVNIRADAADAADRVDLMIREGVKVASFALAPKQELIARLKEAGAVVIPSIGAAKHARKVAGWGADAMIVQGGEGGGHTGPVATTLLLLSVLDAVRGTGIPVIASGGFFDGRGLAAALSYGAAGVAMGTRFLLTSDSTVPDAVKKRYLEAALDGTVVTTRVDGMPHRVLRTGLVEKLESGSPVRGLTAAVRNAAKFKHMSKMTWRSMISDGLAMRHGKEMTWSQVVMAANTPMLLKAGLVEGNTEAGVLASGQVAGILEDLPSCAELIDSIVRDAIAHLRSASGLIEE

SEQ ID NO: 1881 - protein, 247 aa, Mycobacterium paratuberculosis
VTSTRAEICAVACAELFRDAGEIMVSPMTNMASVGARLARLTFSPDILLTDGEAQLLADTPALGAAGAVEGWMPFGRVFETLSWGRRHVVMGANQVDRFGNQNISAFGPLQQPTRQMFGVRGAPGNAINHATSYWVGNHSKRVFCEKVDVVCGIGWDNVDSDNPAFRFANTHRVVSNLGVFDFGGPDRSMRAVSLHPGVSPQDVREATSFEIHGLDEADETRLPTDDELRLIREVIDPKSLRDREIR

SEQ ID NO: 1882 - protein, 293 aa, Mycobacterium paratuberculosis
VADKRTSLDEAVAQLRSGMTIGIGGWGSRRKPMAFVRALLRTDVTDLTVVTYGGPDLGLLCSAGKVKRVYYGFVSLDSPPFYDPWFAKARTSGAIQAREMDEGMLRCGLQAAANRLPFLPIRAGLGSSVPDFWEGELQTVTSPYPTDGAHETLIAMPALRLDAAFVHLNLGDAQGNAAYTGIDPYFDDLFLMAADKRFLSVERVVSTQELVKAVPPQALLVNRMMVDAVVEAPNGAHFTTAAPDYGRDEKFQRHYAEAASTEEGWRQFVQTYLSGNEDDYQAAVRAFAEEAAK

SEQ ID NO: 1883 - protein, 251 aa, Mycobacterium paratuberculosis
LPITSKTIEPGIVAVTVDFPPVNAIPSRGWFDLADTVTAAGQDPETHVVILRAEGRGFNAGVDIKEMQRTEGFTALIDANRGCFAAFRAVYECAVPVVAAVNGFCVGSGIGLVGNSDVIVASDDATFGLPEVERGALGAATHLSRLVPQHLMRRLFFTAATVDAATLHHFGSVHEVVPRDELDAAALRVARDIAAKDTRVIRAAKEALNFIDVQRVNSSYRMEQGFTFELNLAGVSDEHRDAFAGTQKGKK

SEQ ID NO: 1884 - protein, 265 aa, Mycobacterium paratuberculosis
VTRAEACPPFAEAINLGLTGRVVLVTGGVRGVGAGISSVFAAQGATVVTCARRAVEGLPYEFHSCDVRDDDAVKALIDTIADRHGRLDVVVNNAGGSPYVLTAESSAKFNRKIIELNLIGALSVSQHANAHMQKQAQGGSIVNICSLSGRRPSPGTGAYGAAKAGLESLTQTLAVEWGPKVRVNACVVGMVETEQSELFYGDADSIAAISKNVPLGRLAKPADIGWAAAFLASDAACYISGASLEVHGGGEPPHYLATTNASAIK

SEQ ID NO: 1885 - protein, 301 aa, Mycobacterium paratuberculosis
MGVVDGRVVIVTGAGGGIGRAHALAFAAEGARVVVNDIGVGLDGSPASGGSAAQSVVDEITAAGGEAVADGSNVADWDQAAGLIQTAVETFGGLDVLVNNAGIVRDRMIANTSEEEFDAVIAVHLKGRFATMRHAASYWRGLSKAGEAVDGRIINTSSGAGLQGSVGQGNYSAAKAGIATLTLVGAAEMGRYGVTVNAIAPSARTRMTETVFAEMMATQDQDFDAMAPENVSPLVVWLGSAEARDVTGKVFEVEGGKIRVAEGWAHGPQIDKGARWDPAELGPVVADLLAKARPPVPVYGA

SEQ ID NO: 1886 - protein, 148 aa, Mycobacterium paratuberculosis
VEKPKSLNSPMTGFFIKWMSRVNTWMYRVSRGKWGGTFQKRPVALLTTTGRKTGQPRVSPLLYLREGDRVILVASQGGRDKHPLWYLNLKANPKVSVQIKDEVLQLQARDATPEEREQYWPKLVAMYPSFDDYQSWTDRVIPVVICDP

SEQ ID NO: 1887 - protein, 133 aa, Mycobacterium paratuberculosis
VVSVSDESRIAAAQAYIDALVSHDGDAVPFAPGCTRVEQGIKNGFSGNHLRRSLNRGPQYRLLAHTTTPDYRIDGDRVHASYQVLTKAALGGRRLAAHVTETFLIPAESPSGRAEIQHIKVRFQPFIQTRGRQ

SEQ ID NO: 1888 - protein, 386 aa, Mycobacterium paratuberculosis
MGNPVIVAATRSPIGKRNGWLSGLHATELLGAVQKAVVEKAGIDAGDVEQVIGGCVTQYAEQSNNISRTAWLTAGLPDHVGATTVDCQCGSGQQANHLIAGLIATGAIEVGIACGIEAMSRVGLGANAGPDHNWRAESWDIDMPNQFEAAERIAKRRGITREDIDEFGLASQAKAKQAWDEGRFDREISPIVAPALDENKQPTAERVTISRDQGLRETTLSGLSALKPVIEGGIHTAGTSSQISDGAAAVLWMDEDKAKALGLRPRARIISQALVGAEPYYHLDGPVQSTAKVLEKAGMKMGDIDITEINEAFASVVLSWARVHEPDMARVNVNGGAIALGHPVGCTGSRLITTALHELERSDQTTALITMCAGGALSTGTIIERI

SEQ ID NO: 1889 - protein, 416 aa, Mycobacterium paratuberculosis
VPSPNLPPGFDLLDPDVCVKGLPVAELAELRKSAPIYWVDVPGGTGGFGDKGYWAITKHKDVKEISVRSDIFSSQQDCAIPVWPKEMTREQIDLQRNVMLNMDAPHHTRLRKIISRGFTPRAVGRLRDELDARAQNIAKTAAAAGAGDFVEQVSCELPLQAIAGLLGVPQEDRDKIFRWSNEMTGNEDPEYAHIDPAMSSAELIMYAMKMAEERAKNPGDDIVTQLIQADLDGEKLSDDEFGFFVVMLAVAGNETTRNSITHGMIAFADNPDQWELFKKERPETAPDEIVRWATPVTAFQRTALEDYELSGVQIKKGQRVVMFYRSANFDEEVFEDPHRFNILRNPNPHVGFGGTGAHYCIGANLARMTISLIFNAVADHMPDLKPLSAPERLRSGWLNGIKHWQVDYTGKCPVAH

SEQ ID NO: 1890 - protein, 362 aa, Mycobacterium paratuberculosis
MASETTMDFDPSPTQQAVADVVTSVLDRELSWEALVDGGVTALPVPERLGGDGVGLPEVATVLTEVGRRGAITPALATLGFAVLPLLELASEEQQDRFLAGVARGGVLTAALNEPGTPLPDRPATTFADGRLSGTKIGVGYAAQADWMIVTADSAVVVVSPKADGVQVVQTPTSNGSDEYTVSFTGVAVADSDVLAGATAARVNQLALAAVGAYADGLVSGALRLTADYVANRKQFGKPLSTFQTVAAQLAEVYIASRTIDLVAKSVVWGLSEGRDVDHDLGVLGYWVASQAPPAMQLCHHLHGGMGMDITYPMHRYYSTIKDLTRLLGGPSHRLDLVAIASAAQPGAAGRHADDLVGAQCS

SEQ ID NO: 1891 - protein, 387 aa, Mycobacterium paratuberculosis
MFIDLTPEQRQLQAELREYFSNLISSDEMKAMEQDRHNEAYRAVIRRMGRDGKLGVGWPKEFGGLGFGPIEQSIFVNEAHRADVPLPAVTLQTVGPTLQQFGSEMQKKKFLPAILAGEVHFAIGYTEPEAGTDLASLRTTAVRQGDEYIVNGQKIFTTGAHDADYIWLACRTDPEAVKHKGISILIVDTKDPGYSWTPIILSDGAHHTNATYYNDVRVPADMLVGEENGGWKLITTQLNNERVMLGPAGRTAGIYDRVREWASKPGSDGVTPIDHADVQRALGEIYAMWRINELLNWQVAAAGEDINVADAASTKVFGTERIQYIGRLAEEVVGKYGNPADPETGELLRWLDSQTKRNLVITFGGGVNEVMREMIAAAGLKVPRVPR

SEQ ID NO: 1892 - protein, 317 aa, Mycobacterium paratuberculosis
MTDIAEAIAEIKAAGGPKPRAGRDPVNQPMINNWVEAIGDRNPIYVDEAAARAVGHPGIVAPPAMIQVWTMFGLGGERPKDDPMGPIMELFDNAGYVGVVATNCEQTYHRYLRPGEQVSITSEMGDVIGPKQTALGEGWFINQHIIWRVGDEDVAEMNWRILKFRPRESDAAASPVPDDLDPATMMRPASSRDTAFFWEGVKAHELRIQRRPDGSLQHPPVPAVWQDKTAPIDYVVASGKGTVYSFVVHHAPKVPGRTLPFVIALVELAEGVRMLGELRGIDPARVRIGLPVRATYLDFPADDNGPEWSLYAWEPDA

SEQ ID NO: 1893 - protein, 133 aa, Mycobacterium paratuberculosis
MSAPVIEVGTTLPELKLYGDPTFIISTALATRDFQDVHHDRDKAQAKGSKDIFVNILTDTGLVQRYVTDWAGPSALIKSIGLRLGVPWYAYDTVTFSGEVTAVQDGLVTLKVFGRNSLGDHVIATVTLTMGDA

SEQ ID NO: 1894 - protein, 389 aa, Mycobacterium paratuberculosis
MLSRKAAIVGIGATDFSKDSGRSELRLAAEAVLDALDDAGLSPADVDGLTTFTMDTNNETAVARAVGIGDLKFFSQIGYGGGAACATVQQAAIAVATGVADVVVAYRAFNERSGMRFGQVQTRLAGDARAQADSTAADNSFSYPHGLSTPAAQVAMIARRYMHLSGATSRDFGAISVADRKHAAKNPKAYFYEKPITIEDHQNSRWIAEPLRLLDCCQETDGAVAVVVTSVERARDLKQRPAVIEAAAQGSSPDQYTMVSYYRSELGLPEMGVVGRQLWQQSGLKPTDIQTAVLYDHFTPFTLIQLEELGFCGKGEAKEFIADGAIEIGGRLPINTHGGQLGEAYIHGMNGIAEGVRQLRGTSVNPVPDVEHVLVTAGTGVPTSGLILG

SEQ ID NO: 1895 - protein, 279 aa, Mycobacterium paratuberculosis
VGEPFLGSEAVARGVLTRSRLSTGYTRLFRDVYVSRDDEVTAVLRARAGWLWSGRRAVVAGFSAAALHGSKWVDAMTVVDLIHHNRYRQPGIRVHGDRIEEDEITVVDGILVTSAARTALDLGCWYPTTAAVAGIDALARETRIKAADVELLAQRYPGRRGIVRAREAIALFDGGSQSPKESWLRVVLTQAGLPPPQTQIRVVDDLGDPVAYLDMGWEDLKVAVEYDGDHHRSDRRQYGWDIRRSEMLQRLGWIVVRVVAGDRPADIIARVREARARRT

SEQ ID NO: 1896 - protein, 286 aa, Mycobacterium paratuberculosis
MPIDVDVALNAELDPIEFSWASSDVQLYHLALGAGSDPMDPRELRYLVDDTPQVLPTFGNVAATFHATKPPTVQFPGIDIELGKVLHASERVEVPAPLPPSGSARAVTRFTDIWDKGKAAVIWSETKVTAPDGTLLWTQKRSIFARGEGGFGGERGPSGGDAAPERAPDVEVDVPILPQQALLYRLCGDRNPLHSDPEFAAAAGFSQPILHGLCTYGMTCKAIVDALLDGDAGAVAAYGARFAGVAFPGETLKVGIWKEGGRFLASVVAPSRDNAVVLSGVELVPA

SEQ ID NO: 1897 - protein, 563 aa, Mycobacterium paratuberculosis
VFYMSAQEYDVVVVGSGGAGMVAALTAAHRGLSTIVIEKAPHFGGSTARSGGGVWIPNNEVLKRDGVKDTPEAARTYLHGIIGDVVEPERIDTYLERGPEMLSFVLKHTPLKMCWVPRYSDYYPESPGGRAEGRSIEPKPFNARKLGPDEAGLEPAYGKVPLNVVVMQQDYVRLNQLKRHPRGVLRSLKVGARTMWAKATGKNLVGMGRALIGPLRIGLQRAGVPVVLNTALTDLYLEDGVVRGVYVRDSQAAESAEPRLIRARRGVILASGGFEHNEQMRVKYQRAPITTEWTVGAKANTGDGILAAEKLGAALELMEDAWWGPTVPLVGAPWFALSERNSPGSIIVNMSGKRFMNESMPYVEACHHMYGGEFGQGPGPGENIPAWLVFDQQYRDRYIFAGLQPGQRIPRKWLESGVIIQADTLEELASRAGLPVDEFLATVQRFNGFARTGIDEDYHRGESAYDRYYGDPTNKPNPNLGEISHPPYYAAKMVPGDLGTKGGIRTDIHGRALRDDGSIIEGLYAAGNVSAPVMGHTYPGPGGTIGPAMTFGYLAALHIAGEN

SEQ ID NO: 1898 - protein, 261 aa, Mycobacterium paratuberculosis
MLSVATRDELAAELAQAERSGEPIPPLTAAYPEIDVVDAYEIQLINIRQRVAEGARVLGHKVGLSSLAIQQMMGVDEPDYGHLLDDMQLFEDTPVKTNRYLYPRVEVEVGFILNADLPGAGCTEDDVMAATEAFVPAIELIDTRITDWKIELCDTIADNASSAGFVLGAARVSPQDIDIKGIDAVLRRNGEVVAEGRTDAVLGNPVTAVAWLARKVDGFGVRLRKGDVVLPGSCTKAIDAHPGDEFVADFAGLGSVCLSFE

SEQ ID NO: 1899 - protein, 305 aa, Mycobacterium paratuberculosis
MPTKAKVAIVGSGNISTDLLYKLLRSDWLEPRWMVGIDPQSEGLARARKLGLETTHEGVDWLLAQPEKPDLVFEATSAYVHRDAAPKYEAAGIRAIDLTPAAVGPAVIPPANLRQHLDAPNVNMITCGGQATIPIVFAVSRVVEVPYAEIVASVASVSAGPGTRANIDEFTKTTSRGVETIGGAKRGKAIIILNPADPPMIMRDTIFCAIPEDADRDAIAQSIHDVVKEVQTYVPGYRLLNEPQFDEPSLNSGGQAVVTTFVEVEGAGDYLPPYAGNLDIMTAAATKVGEEIAKETLATTAGGAQ

SEQ ID NO: 1900 - protein, 352 aa, Mycobacterium paratuberculosis
MTTDIFFNPIWDVRLTDTSLRDGSHHKRHQFTKDEVQAIVAALDAAGVPVIEVTHGDGLGGSSFNYGFSKTPEQELIKLAAETAKDAKIAFLMLPGVGTKEDIKEAQNNGGSICRIATHCTEADVSIQHFGLARELGLETVGFLMMSHTIPPEKLAQQARIMADAGCQCVYVVDSAGALVLEGVRDRVAALVAELGDDAQVGFHGHENLGLGVANSVEAVRAGAKQIDGSCRRFGAGAGNAPVEALIGVFDKIGVKTGIDFFDIADAAEEVVAPAMPAECLLDRNALIMGYSGVYSSFLKHAIRQSERYGVPAHQLLHRAGQRKLIGGQEDQLIDIALEIKREQESGAAAAR

SEQ ID NO: 1901 - protein, 101 aa, Mycobacterium paratuberculosis
MSTSNTVGARRRGLYGLLAGGLLTAAAATVIALPVAGVAHAECNQDVGQSIDSYLQKHPDLHQQLQQRSQAEGGNGNVIDYLNRHPDVRQHLIDLSHSCPP

SEQ ID NO: 1902 - protein, 375 aa, Mycobacterium paratuberculosis
VFSDPLTSAIAEAENLVAAAPHIETEADLLEGLQYLAGCISACIHLAVDYERDHPFLQSGTGPFTKMGLDNPDTLYFGTRVHAGYDYVVTGRRGTTTDLSFQLLGGEYTDDNVPASQAAFDDRELDIAPDGSFEWRVRPTSNGQLVIREVYGDWAAQRGTLAIAREDTAGTAPPPLTRETIEKRYATAGKQLVNRVKTWLQFPQWFYFNIPVNTMVAPRLTPGGLATQYSSAGHYELRPDQALLITIPVTDAPYLGFQLGSLWYISLDYINHQTSLNNTQAQADPDGKVRIVVAEQNPGVTNWVETVGHRKGFLQFRWQRVSRQLTEADGPTVELVDFDAVPAKLPYYEHNKISDDEWRARIALRQQQIAARMLG

SEQ ID NO: 1903 - protein, 260 aa, Mycobacterium paratuberculosis
MAGMLDGKVVVISGVGPGLGTTLAHRCADSGADLVLAARTAERLEKVAKEVNDGGHRALAVRTDITDDDEVAYLVETTMATYGRADVLINNAFRVPSMKRLAGTSFQHIRDAIELSALGALRLIQAFTPALETAHGSIVNVNSMVLRHSQAKYGAYKMAKSALLSMSQSLATELGEKGIRVNSVAPGYIWGDTLQAYFEHQAGKYGTTVEQIYAATAANSDLKRLPTEDEVASAIMFLASDLSSGITGQTLDVNCGEYHT

SEQ ID NO: 1904 - protein, 381 aa, Mycobacterium paratuberculosis
VSDRTDIGTVEELHASATKLTGLDDFGTDDDNYLQALEVLLDSYRREAGLTVLGSKMNRFFLRGALVARLLSESAWKQYPQYADVAIQRPIFVTGLVRTGTTALHRLLGADPAHQGLHMWLAEFPQPRPPRETWESNPLYRQLDAQFTQHHRDNPGYTGLHFMAAYELEECWQLLRQSLHSVSYETLAHVPSYAQWLSEQDWTPSYQRHRRNLQLIGLNDADKRWVLKNPSHLFALDALMATYPDALVIQTHRPVETIMASMCSLAQHTAEGWSTTFVGAQIGADAMDTWSRGLERFNTARAKYNPAQFYDVDYKELIADPLGTVADIYRHFGLTLTEEAKAAMAKTHADSQSGERAPKHSYSLADYGLSVETVKERFAGL

SEQ ID NO: 1905 - protein, 145 aa, Mycobacterium paratuberculosis
MTDDQPAVPDVDRLARSMLLLHGDHHDHDERPAASPANGGSWSKSRDFTDDPQRAAAVAEASRADRERYLNSGLLPVDCRFCHARVAVRRLGPGHTAVQWSTEAWQRCAYFTEVRRAGGNTARTKSCPKLGDSIEHAVAEGYLDD

SEQ ID NO: 1906 - protein, 329 aa, Mycobacterium paratuberculosis
VLFGGNVFGLFGLQVLRDLGIPVLVGPSGVHLDLEALHHLRLDVGDVDVELLVPAAQLVDGAVLLDQQRIVDAGLVLPDLDVLQEALADPLGEHPGQLVGHLLVHALGLLHDHAPLQHERVLRHRVVAVDQDRLGLVVAVAVVQPVDHERRTEVGRLRIQVCLTVRRAEVVHVGAAHVVQVLRRDVALEHVLEVCRQPEMDVEEVRHVGDVVDDVAAVGALDEDAVPPPVGPLVAVRLRDLRDADGRVRRVVLVVVPDEQQPAPHIGGPRPGARRLRRALGVRHQLAPAVAAPAPVVERAGDLVALDGALRQVTAHVPAVAVEHVDVAV

SEQ ID NO: 1907 - protein, 174 aa, Mycobacterium paratuberculosis
MPLFAFEGRSPRVDPTAFVAPTATLIGDVVVEAGASVWFNAVLRGDYGPIVVREGANVQDGSVLHAPPGIPVDIGPGATVAHLCVIHGAHVGPEALIANHATVLDGAVIGAGSLVAAHSLVTAGTQIPAGMLAMGAPAQIKGPVAGTDAQLWVKLNPQAYRDLAQRHLAGLEPI

SEQ ID NO: 1908 - protein, 135 aa, Mycobacterium paratuberculosis
VHPAHEAGRRSREAVTARDKEAWLAVFADDAVVEDPIGPSVFDPEGKGHRGRAAISAFWDKAIAPTTKIEFVFRDTYQCGNEEANVGHILVTTGDYQTTAEGVFTYKADDEGKLVALRAYWEMDRAAANTKKISG

SEQ ID NO: 1909 - protein, 397 aa, Mycobacterium paratuberculosis
MAGAGPNIAAVLGTGQTKYVAKRQDVSMNGLVREAIDRALADSGCTFGDIDAVVVGKAPDFFEGVMMPELFMADAVGATGKPLIRVHTAGSVGGSTGVVAASLVQSGKYRRVLAMAWEKQSESNAMWALSIPVPFIKPVGAGAGGYFAPHVRAYIRRSGAPTHIGAMVAVKDRLNGCRNPLAHLHQPDITLEKVMESPMLWDPIRYDETCPSSDGACAVVIGNEEAAEARLAQGNPVAWIHATALRTEPLAYAGRDQVSPQAGRDAAAALWKAAGIKSPIDEIDAAEIYVPFSWFEPMWLENLGFAPEGEGWKLTEAGETKIGGRLPVNPSGGVLSSNPIGASGLIRFAEAAIQVMGKGGDHQVPGARKALGHAYGGGSQYYSMWVVGADKPAAEKV

SEQ ID NO: 1910 - protein, 354 aa, Mycobacterium paratuberculosis
MSARNVAVVGFAHAPHVRRTDGTTNGVEMLMPCFAQLYQDLGITKADIGFWCSGSSDYLAGRAFSFISAIDSIGAVPPINESHVEMDAAWALYEAYIKLLTGEVDTALVYGFGKSSAGVLRQILSRQTDPYTVAPLWPDSISMAGLQARMGLDTGKWTEEQMARVAFDSFANARRVDNVEGSITVAELLERPFFAEPLRRHDIAPITDGAAAIVLAAGDRARELRENPAWITGIEHRIESPALGVRDLTESPSTKAAAEIATGGRTDNLDVVEICAPFTHQHLIIAEAIRIPGPTKVNPSGGALAANPMFVAGLERIGFAAQHIWDGSAERVLAHATSGPALQQNLVAVMEGKN

SEQ ID NO: 1911 - protein, 344 aa, Mycobacterium paratuberculosis
MLNPFLEPVLLDGVTASSSSPTLTDHPEPPLSAPLTLSFDYTRSVGPTLSKFFTALRERRVLGVRGSDGRVHVPPPEYDPVTYEPLGEMVPVSPVGTVVSWAWQPDPIEGQPLDRPFAWALIKLDGADTPLLHAVDAGEPKAIKSGTRVHVHWADEPVGAITDIAYFALGEDPEPVAEQPDADKDPVSMIVTPISLTIQHTASHEESAYLRAIAQGKLLGARTGKNGKVYFPPHGADPATGQPTTEFVELPDKGTVTTFAIINIPFQGQRIKPPYVAAYVLLDGADIPFLHLVADVDAHEVRMGMRVEAVWKPREQWGFGIDNIEYFRPTGEPDADYDTYKHHL

SEQ ID NO: 1912 - protein, 343 aa, Mycobacterium paratuberculosis
MKLGLQLGYWAAGPPENHGELVAAAEEAGYDSVFTAEAWGSDAYTPLAWWGSSTSRVRLGTSVVQLSARTPTACAMAALTLDHLSGGRHILGLGVSGPQVVEGWYGQRFPKPLARTREYIDIIRQVWAREKPVTSDGPHYPLPLTGTGTTGLGKALKPITHPLRADIPIFLGAEGPRNVALAAEICDGWLPIFYTPRLADMYNEWLDEGFARPGARRSRADFEICATANIVITEDRGAAFAAMKPYIALYMGGMGAEDTNFHADVYRRMGYAEVVDEVTRLFRSGRKDEAAKIIPDEVIDDAAIVGDVDYVRKQIKAWEAAGVTMMVVSGRSTEQVRELATLI

SEQ ID NO: 1913 - protein, 240 aa, Mycobacterium paratuberculosis
MTESQHIVAGTVLTMPVRIRKADVHTAMFSVDAQAAQRLIDYSGLKVCQHRPGRAVVNLMLARYIDGDLGQYHEFGTCVMVNPPGSTARGWRALGEAAAFIHHLPVDQSFTLEAGRSIWGFPKIMADFTVREQGRFGFDVSADGAHIAGIDFAPGLPVPSLFTSRPQVLKTYTFAEGTTREVPWEMRVRGLRGRPGGATLRLGTHPYAQELASLGLPTRAMISGSVGHVEMTFGDAHPLG

SEQ ID NO: 1914 - protein, 406 aa, Mycobacterium paratuberculosis
MTSTIPEAIANIDLADGNFYADRRASREAYRWMRANQPVFRDRNGLAGATTYQAIQDAERNPELFSSTGGIRPDQPGMPYMIDMDDPAHLLRRKLVNAGFTRKRVKEKEPSIGTLCDTLIDAVCERGECDFVRDIAAPLPMAVIGDMLGVLPTERGMLLKWSDDLVCGLSSHIDPTSAEFQTVMDAFAAYTAFTMDIIAKRRAEPTDDLFSILVNAEVEGQRMSDDEIVMETLLILIGGDETTRHTLSGGTEQLLRHRDQWDALVRDPSLLPGAIEEMLRWTSPVKNMCRTLTADTEFHGTELRAGEKIMLLFESGNFDESVFDDPDSFDIRRNPNSHMAFGFGTHFCLGNQLARLELSMMTERVLKRLPDLRLADDGDLPLRPANFVSGLEAMPVVFTPSAPLLR

SEQ ID NO: 1915 - protein, 290 aa, Mycobacterium paratuberculosis
MAEPFIGSEAVASGLVTPYALRSRFVRVHPDVYVPAGTALSAGLRARSAWLWSRRRGVVAGRSAAALYGTKWIDDRAPAQLLYPYRRPPDGIQTWSDRLVGDEIQTIGGMPVTTPARTALDIACRSPVDKAVAAIDALARATELKVLEIELLADRYRGRRGITRGRSVLPLVDAGAESPRETWLRLLLLRAGFPRPRTQLPVRQYGALIACLDMGWEDIKLAVEYDGDQHRTDRRQFTKDIRRAEVLAELGWTVVRVTAEDTPAGIIARVSTAWTRRTCTGSEKPAGNSR

SEQ ID NO: 1916 - protein, 270 aa, Mycobacterium paratuberculosis
VAEASANEKTGPDALVEQRGHTLIVTLNRPHARNALSTEMMEIMVQAWDRVDNDDDIRCCILTGAGGYFCAGMDLKAATKKPPGESFKDGSYDPSRIDALLKGRRLTKPLIAAVEGPAIAGGTEILQGTDIRVAGESAKFGISEAKWSLYPMGGSAVRLVRQIPYTVACDLLLTGRHITAAEAKEMGLIGHVVPDGQALAKALEIAEVIENNGPLAVQAILRAIRETEGMHENEAFKIDTQIGIKVFLSEDAKEGPRAFAEKRKPNFQNR

SEQ ID NO: 1917 - protein, 546 aa, Mycobacterium paratuberculosis
VAVALNIADLAEHAIDAVPDRVALICGDEKLTYAELEEKANRLAHYLLDQGVKKDDKVGLYCRNRNEIVIAMLGIVKAGAILVNVNYRYVEGELRYLFDNSDMVALVHERQHSDRVANVLPDTPNVKTILVVEDGSDKDYQRYGGVEFYSALEKGSPERDFGPRSADDIYLLYTGGTTGFPKGVMWRHEDIYRVLFGGTDFATGEFVKDEYDLAKAAAENPPMIRYPIPPMIHGATQSATWMSIFSGQTTVLAPEFNADEVWRTIHEHKVNLLFFTGDAMARPLLDALNKDHDYDLSSLFLLASTAALFSPSIKERLLELLPNRVITDSIGSSETGFGGTSIVAKDAPHAGGPRVTIDHRTVVLDEEGNEVKPGSGVRGLIAKKGNIPVGYYKDEKKTAETFKTFNGVRYAIPGDYALVEEDGTVTMLGRGSVSINSGGEKIYPEEVEGALKGHPDVFDALVVGVPDPRYGQHVAAVVQPRPGTRPSLAELDRFVRSEIAGYKVPRSLWLVDEVKRSPAGKPDYRWAKEQTEARPADDVHAAHVSA

SEQ ID NO: 1918 - protein, 255 aa, Mycobacterium paratuberculosis
VTDFVKQHPRSPEGFFGWEAAGLRWLSSVDGGVPCARVLAVDATSLTLRRLQSVPAGRDAAHEFGRRLAVTHDAGAAAFGAGPDGWDGPGYFGPLSQPLPMSLRRHRHWGSFYAEERLVPMAERAAPRLAASTRDAIGAVAARCRAGDFDDDDGPARLHGDLWSGNVMWTPDGVVLIDPAAHGGHRETDLAMLALFGCPHYDAVLAGYQQVRALKPGWRNRIGLHQLYPLLAHVVLFGGGYAGQTDAAARAALAA

SEQ ID NO: 1919 - protein, 275 aa, Mycobacterium paratuberculosis
MTIDVWMQHPTVRFLRSDMLASLRRWTGGSIPDTDIPIEATLASMDAAGVRYGLLSAWRGPNGQDLVSNDEVAQWVAAHPNRFAGLAAVDLDRPMEAVRELRRRIADGGFVGLRVVPWLWNAPPTDRRYYPLFAACVEAGVPFCTQVGHTGPLRPSETGRPIPYIDQVALDFPELVIVCGHVGYPWTEEMVAVARKHENVYIDTSAYTIERLPDELVRFIKTGTGQRKVLFGTNYPMITAEHALAGLDGLGLSDEARRDFLHGNAERVFRLEAAT

SEQ ID NO: 1920 - protein, 417 aa, Mycobacterium paratuberculosis
VNGAQALIRTLVDGGVDVCFANPGTSEMHFVAALDSVPRMRGVLALFEGVATGAADGYARIADRPAAVLLHLGPGLGNGLANLHNARRARVPMVVVVGDHATYHKKYDAPLESDIDALAGSVSGWVRRTSDASQVSADAVEGIAASRWGSQISTLILPADVSWSDGAQLFSTMDARPAGADPLLAPEVVEVLRSGEPTVILVGGDATRRAGLAAAARIAAATGARVLCETFPTRLERGAGIPAVERLAYFAEAAAAQLDGAKHLVLAGAKSPVSFFAYPGMPSDLVPAGCEVHVLAGHTGAADALSALADQLAPGTAAPVAAASRPALPTGPLTSASAADVIGALLPERAIVVDESNTSGVLLAQATASAPAHDWLTLTGGAIGYGIPAAVGAAVAAPDRPVLCLESDGSAMYTISG

SEQ ID NO: 1921 - protein, 126 aa, Mycobacterium paratuberculosis
VVESRRLRRGFTAFGQTQWSLQRQARFAAELSTIPDAAEVIDMMQRLSPTQRWGLAAKGLAAKGGWGPGGRDEYLVRQFGVVPTPTGNWGVALAADTHDGVFETGVDVLDTLTDWLLSRLPSLARY

SEQ ID NO: 1922 - protein, 126 aa, Mycobacterium paratuberculosis
MLRRHRHARRHRKRRMTSRPLELALEASFDQLAATVPAKVGVAVARPDRTFSLGSWWSGVAWSTIKVPLAIAALRKDWLGARELATKAVTESDNRASEQLWSQLGEPAEAARQVQAVVAEGGDTAT

SEQ ID NO: 1923 - protein, 70 aa, Mycobacterium paratuberculosis
MTKVHKLIAGSLLVGSLAGGLGPGAGRAAADPPPPPPMPPPPPLVWAPPTPESEPPEAPPAAELPPPPSG

SEQ ID NO: 1924 - protein, 503 aa, Mycobacterium paratuberculosis
MELSDDLTVTELLVPLTEIDDRGVYFEDSFTSWRDHLQHGAAIAAALRARLDPARPPHVGVLLENTPFFSAVLVAAGMSGIVPVGLNPVRRGDALRRDIARADCQLVLADANSAGTLGDIEHLNVDSAAWADEVAAHRGAPIVFRSASPADLFMLIFTSGTSGEPKAVKCSHGKVAIAGVTMTQRFGLGRDDVCYVSMPLFHSNAVLVGWAVAAACQGSMALRRKFSASGFLPDVRRYGATYANYVGKPLSYVLATPERPDDAQNPLRAVYGNEGVPADIERFARRFGCVVQDGFGSTEGGVAIARTPDTPPGSLGPLPAGIDIVDPDTGASCPPGVVGELVNTAGPGRFEGYYTDEAAEAERMAGGVYHSGDLAYRDEAGYAYFAGRLGDWMRVDGENLGAAPIERVLLRHPDVTEVAVYPVPDPTVGDQVMAALVLAPGAEFDDEKFRAFLAEQPDLGPKQWPSYVRISTELPRTVTFKVLKRQLAAQGVDCGDPVWKIGR

SEQ ID NO: 1925 - protein, 53 aa, Mycobacterium paratuberculosis
VAHTIVHVHGGVGVDTDHPVHRYFLAAKQAEFALGGATGQLRRIGRELAETPA

SEQ ID NO: 1926 - protein, 286 aa, Mycobacterium paratuberculosis
MDFTTTEAAHDLGNLVDTIVDSVCTPEHQRELDGLEQRFDRDLWAKLIDAGILSSASATSLGGDGFGALEQIAILVALGHQLAAVPYLESVVLGAGALARFGTEELQQGWGVPAVSGEKTLTVALDPEMGEGPVQAVSAGAGYRLTGTRTQVGFGPVADAFLVPAETDSGTAVFLVAADDPGVTVTALETTGLGSVGHLALDGTQLDGTRQVGGAEVAAWLGTLGTLGRAAFQLGVLERGLQMTAEYARTREQFDRPIGSFQAVSQRLADGYIDVKGLRLTLTQAA

SEQ ID NO: 1927 - protein, 392 aa, Mycobacterium paratuberculosis
MRISYTPEQEDLRRELRSYFTKLMTPERREALSSTQGEYGVGNVYRETVAQMGKDGWLTLNWPKEYGGQDRSPMDSLIFTDEAAIAGAPVPFLTINSVAPTIMAFGTDEQKKYFLPKIAAGELHFSIGYSEPGAGTDLANLRTTAVRDGDDYVINGQKMWTSLIAYADWVWLAVRTNPEAKKHRGISMLVVPTTAEGFSWTPVHTMAGPDTSATYYSDVRVPVTNLVGEENGGWKLVTNQLNHERVALVSPAPIYLALREVREWAQNTKDASGARLIDSEWVQINLARVHAKAEVLKLINWELASSDGHALGPADASAAKVYGTELATEAYRLLMEVLGTAATVRQDSPGALLRGRVERMHRACLILTFGGGTNEVQRDIIGMVALGLPRNR

SEQ ID NO: 1928 - protein, 63 aa, Mycobacterium paratuberculosis
VRVIVDRDRCEGNAVCLGIAPDIFDLDDEDYAVVKLDPIPADQEQLAEQAIAECPRAALSRGD

SEQ ID NO: 1929 - protein, 304 aa, Mycobacterium paratuberculosis
LTSSTNATDLSGKVAVVTGAAAGLGRAEALGLARLGATVVVNDIATALDASDVIDEINAAGSKAVAVAGDISERATADELVAQADGLGGLDIVVNNAGITRDRMLFNMSDEEWDLVIAVHLRGHFLLTRNAAAYWRSRAKEAGGRIFGRIVNTASEAGLVGPVGQANYGAAKAGIISLTLTAARALGRYGVCANAICPRARTAMTADVFGDAPEVPAGGVDPLSPEHVVNLVTFLSSPAAAEVNGQVFIVYGPQVTLVAAPTAEHKFSAQGPAWDPAELSATLQDYFAGRDPEHNFSASALMEQ

SEQ ID NO: 1930 - protein, 254 aa, Mycobacterium paratuberculosis
LIEQLAVPARAVGGFFEMMIDTGRAAFRRPFQFGEFLDQTWMIARVSLVPTLLVSIPFTVLVAFTLNILLREIGAADLSGAGTAFGTITQLGPVVTVLVVAGAGATAICADLGARTIREEIDAMRVLGIDPIHRLVVPRVLASTVVALLLNGLVCAIGLSGGYVFSVFLQGVNPGAFINGLTVLTGLRELVLAEVKALLFGVMAGMVGCYRGLTVKGGPKGVGNAVNETVVYAFICLFVINVVMTAIGVRISAK

SEQ ID NO: 1931 - protein, 280 aa, Mycobacterium paratuberculosis
MSYDATLRFRRWFSRLQEPVDDFGEQALFYGQTMRYVPNALTRYRKETIRLIAEMTMGAGALVMIGGTVGVAAFLTLASGGVIAVQGYSSLGNIGIEALTGFLSAFLNVRVVAPVIAGIALAATIGAGATAQLGAMRVSEEIDAVECMAVHSVSYLVSTRLIAGLIAIVPLYSLSVLAAFFAARFTTVYINGQSKGLYDHYFNTFLIPSDLLWSFLQAIVMSIAVMLVHTYYGYNAHGGPVGVGIAVGQAVRTSLIVVVVITLFISLAVYGVSGNFNLSG

SEQ ID NO: 1932 - protein, 154 aa, Mycobacterium paratuberculosis
MVAFAVLTYLSYTAAFAPIDTVTVSAPRAGLVMEQGAKVKYRGIQIGKVEAIEYSGDQARLTLGINSKDMHFIPSNATVHIAGNTIFGAKAGGIHSAANTFADLPAPGRPRRGHLGAAGGQYLVPVADRPAAQDRPGRTQRNAERVLRRPARPR

SEQ ID NO: 1933 - protein, 288 aa, Mycobacterium paratuberculosis
VEFIPPQTPSPTSLRPDAHVAATSVQLEVNTLFQSLIDLLHKIDPVELNGTLSAFSEGLRGHGDDLGGILSGLNTLTRQANPKLPALQEDFRKTAVVSNVYADAAPDLNTVFDNLPTINKTVVDQQKNLDTTLLATIGLANNAYDTLAPAEQDFIDTINRVRAPLKVAADYSPEFGCLFAGIERGIKEFAPLLGVRKAGLFTSSSFVLGAPSYTYPESLPIVNASGGPNCRGLPDIPTKQTGGSFYRAPFLVTDNANIPYEPFTELQVDAPSTLQFLFHGAFAERDDF

SEQ ID NO: 1934 - protein, 350 aa, Mycobacterium paratuberculosis
MAGSGMPSHRSMMIKVSIFAAAMLLVSAGLVVVFGDFRFGPESTYHATFVDVSRLKAGQKVCIAGVPVGAVEAVKLNRDNTIDVTFGVDKRYTLYSSTRAVIRYENLVGDRYLEITSGPGELRKLPAGGTINSQHTQPALDLDALLGGLRPVLKGLDADKVNTISSAVIQLLQGQGGALSNVLADTSAFTSALGQRDQLIGDVINNLNTVLTTVDQRSAQFSASVDQLQQLITGLAKHKDDIAGAIPPLASTTTDLTELLQNSRRPLQGVLENTRPLATELDNRKAEVNNDVEQLGEDYLRLAALGAYGSFFNIYFCSVTIKINGPAGSDILLPLGGQVDPSKGRCAFVK

SEQ ID NO: 1935 - protein, 354 aa, Mycobacterium paratuberculosis
LSSNAPRERDPLRTGIFGVVLVVCVVLIAFGYAGLPFWPQGKIYDAYFTDAGGINPGNAVYVSGLKVGKVTDVGLAGDSAKISFSVDRHVAVGDQSLAAIRTDTILGERSIAVTPAGGGKATTIPLSRTTTPYTLAGALEDLGSNASNLNKPQFEQALHVLTDTLHDATPELRGALDGVTSLSRTLDRRDEALQSLLAHAKSVTGVLSQRAEQVNKLVDDGNELFAALDERRAALGRLISGIQGLSAQISGFVADNRKEFGPALNKLNDVLANLNERRDYITEALKRLPTYATELGEVVGSGPGFNVNVYGVIPAPLLATMFDFFYQPGKMPASLADYLRGLIQERWIIRPKSP

SEQ ID NO: 1936 - protein, 475 aa, Mycobacterium paratuberculosis
MMQRLAGSRGLRYTTIIALVAVLVGGVYVLTSQAKTRKIVGYFTSAVGLYPGDQVRVLGVPVGTIDTIDPRPTDVKITMSVSQDVKVPKDAKAIIMSPNLVAARFIQLTPAYTGGPALADGASIGLDRTAVPVEWDEVKQSLTQLAVQLGPTAGSMQGPLGAAINQAADTFDDKGESFHSALRELSQAAGRLGDSRGDIFGTVKNLQILVNALSSSNEQIVQFAGNVASVSQVLADSSRHLDTTLGTLNKALSDIRGFLHENNSTIVDTVNNLNDFAKTLSDQSDNIEQVLHVAGPGIANFYNIYDPAQGTLNGLLSIPEFANPVQFICGGSFETAGGPRAPDYYKRAELCRERLGPVLRRLTVNYPPLMFHPLNTITAYKGQIIYDTPETQAKSATPVPQLTWIPAKGAQTPPAAQNPADLQALLVPTAPQSGPAPAGGAPAPGPAPGSAFGPRPGPPPGQAPGGLGADLGGGG

SEQ ID NO: 1937 - protein, 475 aa, Mycobacterium paratuberculosis; identical to SEQ ID NO: 1936

SEQ ID NO: 1938 - protein, 574 aa, Mycobacterium paratuberculosis
MHDRLTKIQLAIFAVITVITLTVMAVFYLRLPATFGIGTYGVSADFVAGGGLYKNANVTYRGVAVGRVESVGLSPNGVIAQMRLNSETAIPSNVTATVKSVSAVGEQYIDLVPPSAPASTKLRNGSRIERQNTRIGQDVAELLRRSETLVNSLGDTRLRELLHETFIAANGSGPELARLFESARLLVDEANANYPQVSQLIDQAGPFLEAQIRAGADIKSLSDGLARFTSEVRQADPQLRDTLATAPGATDEASTAFSGIRPSFPALAASLANLGRVGVIYHKSIEQLLVVLPALFAAITTAAGGGPQDEGAKLDFKLDLNDPPPCAVGFLPPPLMRTPADETVRELPKDMYCKTAQNDPSTVRGARNYPCQEFPGKRAPTVQLCRDPKGYVPIGRNPWRGPPVPYDTPVTNGLNVLPPNKFPYIPPDAEPDPGTPIVGPPPPGVVPGPGPLPNKQPAYAPPPPNDNGPAAPFTSWQPPGVPPVPPQLPYPKWLPPPAPPEGINRAAGVRGRDKPWGPPPGGQPQASGPAYATYDEKTGAFVDPGRGTGIFAAGATGTSGAENWVDLMRDPRPM

SEQ ID NO: 1939 - protein, 253 aa, Mycobacterium paratuberculosis
VIQGLCDGAGNGPCRGGRRRGRPTDEQAACPSARLPRGGPGQERVDPARDRRDRGGRTDARPEPSAKSGKTLKSLKPPPRRQPHRTLVAWISFAAAVLAVGALAGGVAVLFVQQRDAQAKQSRDQRFVDTATQTVVNMFSYKQDNIDESVNRFVNGTSGPLRGMLSANNNVENLKGLFRSTNATSEAVVNGAALEGVDAVTDNASVLVSVRVTVADIDGVNKPSMPYRLRVIVHEDDAGRMTGYDLKYPDGGN

SEQ ID NO: 1940 - protein, 164 aa, Mycobacterium paratuberculosis
LMRWRRRLLVVAGYLLAVAFVGLSAVAGAMYWDRVQTRGEQAARAVLPGLAAKEIPEVFAYDYQTVERSLSAAYPLLTPDYRAEFQKSVNNQIIPEAKKREVVVQANVVGVGVMSAQRDSASVMVYMNRTVTDKSRQPLYDGSRLRVDFKKIGKQWLIAYITPI

SEQ ID NO: 1941 - protein, 192 aa, Mycobacterium paratuberculosis
MKLRHGLAAGAAVVMAVGTGIAVQSGQPAKAVGPPADGTYNYNEAGVSGVTWTISALCDQPSGTRNMNDYSDPIVFAFNCALNIVSSTPEQISAADKLQNFSGRARMSSMLWTFKVQKDNGVSCPGGGTAPTTETYAFSDETMSGTHTTLHGAVCGLQPEMKKQPFSLQMTGPPPSPIERYPLYCNGIAMCY

SEQ ID NO: 1942 - protein, 492 aa, Mycobacterium paratuberculosis
MAPGGGRGSKTAGYGNSDFVVVANRLPVDQERLPDGSTAWKRSPGGLVTALEPLLRRQRGAWVGWPGIVDEDVDHEDDPIVQDDLELRPVKLSADDVAEYYEGFSNATLWPLYHDVIVKPIYHREWWDRYVAVNRRFAEATSRAAARGATVWVQDYQLQLVPAMLRELRPDLTIGFFLHIPFPPVELFMQLPWRTEIVKGLLGADLVGFHLTGGAQNFLFLSRRLIGANTSRGAVGMRSRYGEVELESRVVRVGAFPISIDSTALDQTARHRDIRRRAREIRAELGNPRKVLLGVDRLDYTKGIDVRLKAFSELLAEGRAKRDDTVLVQLATPSRERVDSYQQLRNDIERQVGHINGEYGEVGHPVVHYLHRPVPRNELIAFFVAADVMLVTPLRDGMNLVAKEYVACRSDLGGALVLSEFTGAAAELRQAYLVNPHDLEGVKDTVEAALNQSVEEGRRRMRSLRRQVLAHDVDRWARSFLDALAESGPRDG

SEQ ID NO: 1943 - protein, 222 aa, Mycobacterium paratuberculosis
VFEFVDVVVERRGLRALDGLTAAIPGRGVTAVFGPSGSGKSTLLRLCNRLELPTSGRVSFYGSDIAGLDPLWLRRRVGMCFQRPTPFPGTVADNLRVADPDADEARMRETLDRVALTGAWLDRDVLALSGGEAQRVCLARTLMARPRVLLLDEPTSAVDAEAAEVIERAVRELAADGTPALWVTHDAAQVTRAADRVLRLERGRSLGLSQVGGGPDDGAVPR

SEQ ID NO: 1944 - protein, 260 aa, Mycobacterium paratuberculosis
MNGQVGWLGLATSLILVAFAGAISLWRRLGLERQLLWAASRALVQLLLVGGALTLLFEPGRSLWWSWAWVAGMVGYAGDVARRRAPEVPRFAPLAVAAFAAAAVVTLGVLFGLRVFPLQGRTLVPVAGMMIGNSMTAMVLVARRLVDELRDKRDEVEARLALGQPSGQAASPYLRIALRSAISPQIETTKATGLVFLPGAMTGLILAGVPPLQAVLVQAVVMFLILGSVAATTVVVALGIVRLVFTRDHRLRPLDQRPPD

SEQ ID NO: 1945 - protein, 314 aa, Mycobacterium paratuberculosis
VGAMTLSEQAGAQPGARPAEELVTYETLDEGRIARIWLNRPDAHNAQSRGLLVQLDEAFVRAEADDAVRVVILAARGKNFSAGHDLGSELALAERQPGPGQHPTFRFNGATRDPIAEKTYLQEWHYFFQNTCRWRDLRKITIAQVQGNAISAGLMLIWACDLIVAADNAKFSDVVGVRMGMPGVEYYAHPWEFGPRKAKELLLTGDALDADEAYRLGMVSKVFPADELADKTLEFARRIAERPTMAALLIKDSVNAASDAMGFTEALRHAFHIHELGHAHWAAHNENRYPVGLPPDVEDWRNAKPTRLARRDTP

SEQ ID NO: 1946 - protein, 281 aa, Mycobacterium paratuberculosis
VQLSFQDRTYLITGGGSGIGKGVAAGLVSAGASVMIVGRNPDRLAGAVEEIAPLADRAGNGGAIRYEPTDVTNEDEVARAVDAATAWHGRLHGAVHCAGGSLTVGPITHTDSEAWRNTVDLNVNGTMYVLKHVGRELVRGGGGSFIGISSIAASNTHRWFGPYGVTKSAIDHMMMLAADELGESWVRVNSIRPGLIRTDLVDASVIQSPEISADYAQCTPLPRVGEVEDVANLAMFLLSDAAGWITGQCINVDGGHMLRRGPDYSSMMVQMFGQDALRGVV

SEQ ID NO: 1947 - protein, 263 aa, Mycobacterium paratuberculosis
MKRLEGKRILVTGAASGIGQATALRLLDEGAAVAASDVAVDGLERTRDRAAQAGTAERLVTVTMDVGREDAVVDGVRVAVAQLGGLDSLVNAAGMLRAAHTHQTSLQLWNQIIGVNLTGTFLVVREALPALLDNARSAVVNFSSTSASFAHPYMAAYAASKGGIQAFTHSLALEYARRGLRAVCVAPGSIKSGITDATGGYIPEDADWSLFSRLLPVLPTTVESSGTGMAEPTAVAGVIAMLVSDDGAFITGTEIRIDGGTHA

SEQ ID NO: 1948 - protein, 520 aa, Mycobacterium paratuberculosis
MARSGGAHRRHRAVRQPSRFRKGLTRTLGALVSVAAIGLTGAGYYVAHGALGGITVSNALQPDDPRSSGDNMNILLIGLDSRKDQDGNDLPYSILKHLHAGDSDDGGYNTNTLILVHVSADNKVVAFSIPRDDWVPFSGVPGYNHIKIKEAYGLTKQYVAQKLANQGTSSQKELETKGREAGRAATLRAVRNLTGVPIDYFAEVNLAGFYDLAQTLGGVEVCLNHPVYDSYSGADFPAGRQRLDASEALSFVRQRHGLDNGDLDRTHRQQAFISSVMQELQAAGTFTNIDKLKNLMAVARKDVVLSAGWTDDMIQRLGGLAGGNIEFRTLPVVRYDNIDGQDVNIVDPAAIKAEVAAAIGANAPTSAPTSTSVAPDPSTVVDVVNSGSMSGLASEVSHALKKRGYTTGQVRDRESGDPAATTIEYGAGAQNDARNLANLLSLDAPNQPSPSIAPGHIRLTVDTNFTMPTTDDTQLDDTTSTSSTTTSSKAKTYYYNGTTTTYPTPDQGKPIDGGGVPCVN

SEQ ID NO: 1949 - protein, 80 aa, Mycobacterium paratuberculosis
VHRIPLTIGIAVVVLLAALAAPIKQRCGAPGLSCASTLDTEGNAHYYYEVEPVGVYLAEIVTGSNIALFYQSGEDLVKAR

SEQ ID NO: 1950 - protein, 58 aa, Mycobacterium paratuberculosis
MRAEEGDESVKDYAKESRETLGRIKASQHGGGRLGAIARRFARLWRGPRGPEDAGPAR

SEQ ID NO: 1951 - protein, 498 aa, Mycobacterium paratuberculosis
MRLDEYMALDATALAGLVADKQVTPAELLALARQRADAVNPRLNAIVCRLDDVADRQAADPNLSGPFAGVPFLLKDLGQEYRGFPTSCGSRSLANDVADRHALVTQRFLDAGLVIFGKTNTPEFGAKGATEPDYWGPARNPWDTERTPGGSSGGSGAAVAAGIVPAAGANDGGGSIRIPAACNGLVGLKPSRGLAPYGPQTGELMLGMATQGVVTRTVRDSAALLDAIIGHHPDASYRVALPDKPFAEQITRPPGPLTIGYSARSALNPRPDREAVVAVENSAALLSELGHRVREVAPPYDDAALGRDFLTIWFAQLHQQVADIRRRTGARDNDFEADTLAISELGRSGGVLPVMSALENRNTYIQSLAAFHEGYDFFLTPTLATPPLVVGATSTSAALQRAARLVSRVRGGKLMRLSGILDDLIRESLGWVPYTQLANLTGRPAISVPLHWTDDGLPLGVQFVGKLGADGDLLQLAAQLEQARPWAQRHPAPVTPPN

SEQ ID NO: 1952 - protein, 261 aa, Mycobacterium paratuberculosis
VVFLHGGGQTRRSWGKAAAAVAARGWQAVTVDLRGHGESDWSGDGDYRVVSFAADVQAVLGTLPPKPVLVGASLGGFTSMLLAGELSPGIASAVVLVDIVPNMDQSGANRIHAFMADRVDSGFASLDEVADAIAEYNPHRPRPTDLEGLTTNLRRRGDRWYWHWDPQFTSGTAAFPPFEVTDPDRMHAAVEAILRDGVPILLIRGQMSDLVSQERADEFLARFPQVEFTDVRGAGHMVAGDRNDVFADAVLDFLARRLDVE

SEQ ID NO: 1953 - protein, 222 aa, Mycobacterium paratuberculosis
VTVSWLRGSGLVGAVLVAATAVAKTAGAAPPPALPAPPPSPGIGVDHENGRCTAGFAAQGSDGSYYLMTSGHCDAHDGAEWTYGNDAPLGRISASEHEGDKRDAAIIRLEPSVGMPVGDVGGRYQVRDVLSRPQIQVGMPFCKIGAVTGETCGAIKGVDGDVVEASVFSLDGDSGSPGFVMNPDGSVSAVGLLMSSPDGDDYTTYFMLVNPLLDRWGLRILP

SEQ ID NO: 1954 - protein, 156 aa, Mycobacterium paratuberculosis
VKRGIVVGLAGVALVIGASAGCSSNKSNTGASGSSGAPAAAAPQLIVDGQTQNVSGQVTCTTNGDKTTIGIGDPTAGLGAVVSNGNPPLVHSVGLGTVNGVALGFSDAAPNQGGNAGAAVNGKTWAIKGTATGVDMSNPQQPQQVTKSFELDATCP

SEQ ID NO: 1955 - protein, 341 aa, Mycobacterium paratuberculosis
MSMKRVVGAAAVAAGLGISAASLNAGSAYSAPLDPPPPCPNCHGGGGNPGGPGGGPGGQPAGPGGGAGGQHGGGNTPPQGGQNNPPPNGPNNPPQNGPNNAPQGGQNNPPQGGPNNAPQGGQNNPPQGGPNNAPQNGPNNPPQGGQNEPGGQYPPNQHGQNPPQNGQNQPPYDHDQNPPTPGGPTNAPANTQNPPPPPERQRYAALNPPNTQPPHPPYVPRHDVVTASAQIGGPAGADVQFSIVGRGAPPPPREHGYGWNDGPPPHHPPPNWYGPPPPGGWDGPPPPGGWNRPWDGPPRDVAVARADFGPFSYNTFTVIPVFNWQYGGWGYWFFGVWVPLY

SEQ ID NO: 1956 - protein, 313 aa, Mycobacterium paratuberculosis
VSNRRTAPLVAAAVLVALAGCSPSHPSAAPRPTATRTAAPSAPASRMLPADADTPGGAQPRLASDPAQLGDDLVADERALRDPGTSEPALTAAAHREQAAYRAIARHPEWEAAARGRIPPELIDVYDRNVDARRQLTALTPVRNTLPAWRIEPPAPADELLGYYHQAEAESGVGWNYLAAINFIETRFGSIVGASTAGAQGPMQFLPSTFAGYGQGGDIHSPRDSILAAGRYLAANGFAADRDHAIYAYNHASEYVRAVDQYAALMAADPATFAAYYRWDVYCFTTAGDVLLPIGYDASSPIPAADYVAAHPQ

SEQ ID NO: 1957 - protein, 157 aa, Mycobacterium paratuberculosis
MIFFVHQRDSTAPATEPAPSAAPPKAAAPKPPAPRIEMADMAFIAALKHEGVPVPSQDYVMKQGHAVCDFLAQQHNFADAIGFVQRSSIWNAEQSAEVTAGAIVAYCPQSQATAADLTGPAYQNTLSDLQAIEGKLQGIEGDLQGIQRDLDNIPGHR

SEQ ID NO: 1958 - protein, 632 aa, Mycobacterium paratuberculosis
MFDAVRWRLSAGAMAVAVTVAACCAPSEPADPCMVASGAADESQGMDAMAMATEACPLVRLTENDPDPPLYPYLGSAHWHVPWAQEYFDQGLRFYFGFNNREAYRAFKKAARDAEDNDIACSACYWAQALVLGVDLNMPRELEPDRDAANNALRRAAQQKPNREDDKIIAALTGRYRDCPKTVDPRKCQAGRNQAYYDGMKAVVDEFGRDDPNVITLFADAAMNMTPWAYWKDGNPVSPRTTQAREYLEKALELSRYPPNEGPIHWYIHLMEQSRTPGAAGKYADRLAALAPNSGHLVHMPSHIYYRMGDMPKAIRANKEAIDADERYFATEPHLYRPDGDRYRYGYYLHNIHFVIAAAALSGDDDEHDVDRYADKLLQWLPDNASGFRADVYRSAYYLAKINFSSTADIRGFDPPSPFNQQPLATIAYDFARLMADIWDKNHSPHWLDTLDGDVARYRQHATASGKPNADCDPKLELPKPELCLAAILRDLGHARASAAKADWGAAADVANEAVDIQDKLPYDEPPLWPYPVRQTLASILIRRAIAAGNPMDRALHLAAAKELLLKSLNKGKGDDPEQTPIGTYPGNGWAYYGLLEIATRDGSPPEVVKAADAELVRHWFGGTGYRNLDRL

SEQ ID NO: 1959 - protein, 395 aa, Mycobacterium paratuberculosis; identical to SEQ ID NO: 1793

SEQ ID NO: 1960 - protein, 242 aa, Mycobacterium paratuberculosis
VSITRADRTARDDGRRRPGNGIRSAMLLSGLTTMVSATTASCNVAIAGSSASIPGVNRARVSATSASWSSGPCLAVSLSISPPSASSRSASPSSASSRSISPSSATSWSASPPGCRVRCRAPPSAVNRSSRPPSLVSMSTTPPGRSKRSSGPSGATARPSGASSSSSRASRLARTIASSMPSIDVIALVPAVPLSPSARFATPTAALATLRPASAAASPARAGAVAADTMFLARFIPRVYAR

SEQ ID NO: 1961 - protein, 239 aa, Mycobacterium paratuberculosis
MTSATPTDAKPEARVLVVDDEANIVELLSVSLKFQGFEVHTATNGAQALDRAREARPDAVILDVMMPGMDGFGVLRRLRADGIDAPALFLTARDSLQDKIAGLTLGGDDYVTKPFSLEEVVARLRVILRRAGKGGAEPRSARLTFADIELDEETHEVWKAGQPVSLSPNEFTLLRYFVINAGTVLSKPKILDHVWRYDFGGDVNVVESYVSYLRRKIDTGEKRLLHTLRGVGYVLREPR

SEQ ID NO: 1962 - protein, 478 aa, Mycobacterium paratuberculosis
MVVTRPRRGLPLRVGLVAATLALVACGLAVSGIAVTSILRHSLVSRIDSTLLDASRGWAQAPRRQSSSAYEGPDPGRPPSKFYVRGVSTDGTPFTAINDRNAEPALPANNDVGPNPTTLPSVNGSDIQWRAVSVRGPHGLTTVAIDLSDVQHTVSSLVWLQIGIGVAVLAVVGIASFAVVQRSLRPLVEVEQTAAAIAAGQLDRRVPERDPRTEVGRLSLALNGMLAQIQQALASSESSAEKARGSEDRMRRFITDASHELRTPLTTIRGFAELYRQGAARDVAMLLSRIESEASRMGLLVDDLLLLARLDVQRPLEHHRVDLLALASDAVHDAQAMDPKRTITLEVLDGPGTPEVFGDEPRIRQVLGNLIANALQHTPESADVTVRVGTDGDDAVLEVADRGPGMNEQDASRVFERFYRTDSSRARASGGTGLGLSIVESLVRAHGGTVGVTTAPGQGCCFRVTLPRISDVPAVQAS

SEQ ID NO: 1963 - protein, 134 aa, Mycobacterium paratuberculosis
MASIFTKIINRELPGRFVYEDDDVVAFLTIEPMTQGHTLVVPREEIDNWQDVDSAAFNRVMGVSQLIGKAVCKAFRTERSGLIIAGLEVPHLHVHVFPTRSLSDFGFANVDRNPSPESLDEAQAKIKAALAQLA

SEQ ID NO: 1964 - protein, 136 aa, Mycobacterium paratuberculosis
MTETAAASPALAASQASWRCVQAHDRAGWLALMSDDVVIEDPIGKSVTNPDGTGVRGKEAVDANIAANQLSITCEETFPSSSPDEIAHILVLNSRFDGGVTSSVRGVFTYKVDEAGLITNMRGYWNLDMMQFGQES

SEQ ID NO: 1965 - protein, 375 aa, Mycobacterium paratuberculosis
VKTKGALIWEFNQPWSIEEIEIGDPQAHEVKIQMEAAGMCHSDHHLVTGGIPMAGFPVLGGHEGAGIVTEVGPGVEDIAPGDHVVLSFIPSCGSCPTCQAGMRNLCDLGAGLLGGEAVSDGTFRIQARGQNVYPMTLLGTFSPYMVVHRSSVVKIDPSIPFEVAALVGCGVTTGYGSAVRTADIRPGQDVAIVGVGGVGMAALQGAVNAGARYIFAIDPVEWKRDQALKFGATHVYPDIMAAMAGMAEVTYGLMAHKVVVTVGELQGADVDNYLNITQKGGTCVLTAIGSLLDTNVTLNLAMLTLMQKNLQGTIFGGGNPQYDIPQLLSMYKAGKLNLDDMITRQYRLEQINDGYQDMLDGKNIRGVIRYTDADR

SEQ ID NO: 1966 - protein, 182 aa, Mycobacterium paratuberculosis
MTATASREELEAWVDRWLQANKDCEKAGDWRPLADFYAKDATYGWNIGPKEDVMCVGVDEIRDIALGLEMEGLENWVYEYQKVLIDEKQGEIVGFWKQIVNKADGTQDEIYGIGGSWFRLNSDNLIEWQRDFFDFGHVAKMFGKLIESGDLSAGMQKRIERSVAGEKPPGYYPLGQAPVPIW

SEQ ID NO: 1967 - protein, 69 aa, Mycobacterium paratuberculosis
MSGFRIEADLDLCQGHAMCELEAPDYFRVPKRGKVEIVDPEPPEDARDEVERAVEMCPTQALFIKEKED

SEQ ID NO: 1968 - protein, 451 aa, Mycobacterium paratuberculosis
MTTSTVVPRISGGEEEHGHLEEFRTDPIGLMQRVRDECGDVGWFQLVDKHVILLSGAQANEFFFRSADEDLDQAEAYPFMTPIFGKGVVFDASPERRKEMLHNSALRGEQMKGHASTIEGEVKKMIADWGDEGEIELLDFFAELTIYTSTACLIGLKFREQLDHRFAEYYHDLERGTDPLCYVDPYLPIESFKRRDEARVKLVALVQEIMDQRLANPPKDKADRDMLDVLVSIKDEDGKPRFSADEITGMFISLMFAGHHTSSGTSAWTLIELIRHPDVYAEVLAELEELYADGQEVSFHALRSIPKLDNVVKETLRLHPPLIILMRVAKGEFEVEGFPIHEGDYVAASPAISNRIPEDFPDPDAFKPDRYNKPEQADIVNRWTWIPFGAGRHRCVGAAFAQMQIKAIFSVLLREYDFEMAQPADSYRNDHSKMVVQLARPAKVRYRKRNA

SEQ ID NO: 1969 - protein, 275 aa, Mycobacterium paratuberculosis
MPRFDPLPERRPAIVAGASSGIGEATAIELAAHGFPVALGARRVEKLNDIVGKINADGGEAVGFHLDVTDPNSVKSFVAQAVDALGDIEVLVAGAGDTYFGKLAEIAGDEFESQLQIHLVGAFRLASAVLPGMLERQRGDLIFVGSDVALRQRPHMGAYGAAKAALVAMVNNFQMELEGTGVRASVVHPGPTKTAMGWSLPAEKIGPALEDWAKWGQARHDYFLRAADLARAITFVAETPRGGFIANMELQPEAPLADNKDRQKLALGEEGMPGQ

SEQ ID NO: 1970 - protein, 408 aa, Mycobacterium paratuberculosis
MTVHVGDHELVLDPYDYDFHEDPYPYYKRLRDEAPLYRNDELKFWALSRHQDVLQGFRNSTTLSNKYGVSLDPASRGPHASKTMSFLAMDDPAHLRLRTLVSKGFTPRRIRELEPRVTEIATQHLDTMLDKAGSAAGGAVDYVDEFAGKLPMDVISELMGVPQADRVQVRAWADGVMHREEGVTDVPPEAVEASLNLIVYYQGMVEERRKKPTGDLTSALLEAEIDGDRLTDDEVLGFMFLMVIAGNETTTKLLANAAFWGHKNPDQLTPVYDDLSRVPLWVEETLRYDTSSQILARTVSGPLTLYDTTIPEGDVLLLLPGSGHRDERVFDNPDDYLIGREIGPKLLSFGSGAHFCLGAHLARMEARVALTELFKRIRGYEVDEANAVRVHSSNVRGFAHLPMSVEVR

SEQ ID NO: 1971 - protein, 215 aa, Mycobacterium paratuberculosis
VSSDALVTITSDAGGETGQPPRNRRQEETFRKVLAAGIETLREKSYSDLTVRAVAARAKVAPATAYTYFSSKNHLIAEVYLDLVRQVPYFTDVNDPMPTRVEQVLRHLALVVADEPEVSAACTTALLSGGADPAVRAARDRIGVEIHRRITSAMGPDADPTTVSALEMSFFGALVQAGSGEFSYREIADRLAYVVRLILTGTTQASPETEAGDTR

SEQ ID NO: 1972 - protein, 489 aa, Mycobacterium paratuberculosis
MALLADGVSELFIDGKMSAGNAGTFPTVNPATEEVLGVAANADAADMDRAIDAARRTFDETDWSRNTELRVRCVRQLRDAMREHIEELRDITIAEVGAPRMLTSAAQLEGPVGDLSFAADTAESYEWNQDLGQASPMGIPTRRTIAREAVGVVGAITPWNFPHQINLAKLGPALAAGNTVVLKPAPDTPWCAAVLGQLIAEHTDFPPGVVNIVTSDDHGVGALLSKDPRVDMVSFTGSTATGRSVMSDAAATIKRVFLELGGKSAFVVLDDADLGGACSMSAFTAAMHAGQGCAITTRLLVPRDRYDEAVAAAAGTMGSIKPGDPNDPGTVCGPVISARQRDRVQSYLDLAIAEGGTFACGGGRPADKDVGFFIEPTVIAGLTNDARPAREEIFGPVLTVIAYDGEEDALRIANDSPYGLSGTVFSADPERAANFASRMRVGTVNVNGGVWYSADAPFGGYKQSGNGREMGLAGFEEYLEIKTIATAVQ

SEQ ID NO: 1973 - protein, 249 aa, Mycobacterium paratuberculosis
MRFENKVGIVTGSGGGIGQAYAEALAREGAAVVVADINAEAAEAVAKQIVADGGTAISVAVDVSDPESAKAMADRTLAEFGGIDYLVNNAAIFGGMKLDFLLTIDPEYYKKFMSVNLDGALWCTRAVYKKMTKRGGGAIVNQSSTAAWLYSNYYGLAKVGINGLTQQLSRELGGRNIRINAIAPGPIDTEANRTTTPKEMVDDIVKGLPLSRMGTPDDLVGMCLFLLSDEASWITGQIFNVDGGQIIRS

SEQ ID NO: 1974 - protein, 292 aa, Mycobacterium paratuberculosis
MTTNAAHTTEQLKLGYIGLGNMGAPMATRMTEWPGGVTVYDIRIEAMTPLAEAGATLADSVADVAAADLIHITVLDDAQVREVVGELAGHAKPGTVIAIHSTISDTTAVELARDLKARDIHIVDAPVSGGAAAAARGELATMVGAGREVYERIKPAFKHWAAVVIHAGEPGAGTRMKLARNMLTFTSYAAACEAMKLAEAAGLDLQALGRVVRHTDALTGGPGAIMVRDNMKDLEPDNFLYQPFLHTRGLGEKDLSLALALGEAVSVDLPLARLAYEGLAAGLGVPHTEKEA

SEQ ID NO: 1975 - protein, 146 aa, Mycobacterium paratuberculosis
VMDERRRKGLEKMNEVYGWEMPNVEGDAYFDLTVDHLFGSIWTRPGLSMRDKRIMTLTAVTAIGNRDLAEIQINAALLNGELTETELKEMAVFLTHYLGFPLGSALNGAVDAVVAKRRKAAAKGAGEDKKANVDAALKMHSGGERG

SEQ ID NO: 1976 - protein, 422 aa, Mycobacterium paratuberculosis
VRVLVIGSGAREHALLLALRKDPQVTGLAIAPGNAGTARLAEQHDVDITSAPDVVALARAVRADLVVIGPEVPLVLGVADALRAAGIVCFGPGKDAARIEGSKAFAKEVMAAAGVRTAASEIVDTPAHLDAALDRFGPPAGEAAWVVKDDRLAAGKGVVVTADREVARAHAAALLEAGHPVLLESFLDGPEVSLFCVVDGETVVPLLPAQDFKRVGDADSGPNTGGMGAYAPVPWLPDRVYRDIVHRIVEPVAAEMVARGCPFSGLLYAGLAITSNGPAVVEFNCRFGDPETQAVLALLESPLGQLLYAAGSGTLADFGELRWHDGAAVTVVLAAANYPGRPRVGDVITGSEAEGVLHAGTARREDGEIVSSGGRVLSVVGTGPDLAAARAKAYQILGSIRLPGSHFRTDIAQSAADGKIRV

SEQ ID NO: 1977 - protein, 542 aa, Mycobacterium paratuberculosis
VALGAGPHAGVTLAKVNQPFGWDFPYAWPRKPVLADNVVCTSQPLAAQAGLRMLAEGGSAVDAAIATAITLTIMEPVSNGIGSDAFAIVWDGEKVHGLNASGRSPAAWTPEYFGGNAVPVLGWNSVTVPGAVSAWTELHARFGKLPFERLFAPAIAYGRNGFPVSPVVAEQWAAQVPLFAGQPGFAKAFAREGRAPRPGERFRLPAHADTLEAIAASRGEAFYRGALAARVAEHAAANGGAMTADDLAAHRADWVETITGDYRGYTVHEIPPNGHGIVALIALGILERFDMASLPVDSADSVHLQIEAVKLAFADAQAYLADIEHMPLRPERLLDTEYLEQRAALIDPARAKPVSAGAPAGGTVYLTAADAAGMMVSMIQSNYMGFGSGVVVPGTGISLQNRGANFTAGLGHPNSVGPNKRPYHTIIPGFVTKDGAPVMSFGVMGGMMQPQGHVQVMVRIADHGQNPQAACDGPRFRWVQGTQVSCENGFPAATLDELRRRGHDLVAVDDYNQFGSCQAIWRMDTGYVAASDPRRDGQAAAF

SEQ ID NO: 1978 - protein, 319 aa, Mycobacterium paratuberculosis
LPFRPNDPPNGHGMMTRMPDLSRRAVLRLGAGAAVGAVGVYGLDILLQPRASQAMPAAGTGTPLAPPPPAPGPPRDPAPPAAAAPTMVTGSFVSAARGGVNTNWAIARPPGQTKPLRPVIALHGKGSDAATVMAGGVEQGLAQAVNAGLPPFAVVAVDGGGSYWHKRSSGEDSGAMVLDELIPLLGNQGLDTSRVAFLGWSMGGYGALLLGGRLGPARTAAICAVSPALWLSSGAAAPGAFDGPDDFAANSVFGMPALGSTPIRVDCGDSDPFYAATKQFIAQLPNPPAGGFSPGGHNPEFWSSQLPAELSWMAPLLTA

SEQ ID NO: 1979 - protein, 205 aa, Mycobacterium paratuberculosis
VTAAVTPKGERRRYALVSAAAELLAEGGFEAVRHRAVARRAGLPLASTTYYFSSLDDLIARAVEHIAMIEVAQLRSRVSALSRRRRGPETIAEVLADLLVGDVSGPGLTEQLISRYERHIACTRLPALRETMRRSLRQRAEAVAEAIERSGRSVHIDLVCTLICAVDGSVVSALVEGRDPRAAAQGAVVDLIEVLAPIDQRPVQI

SEQ ID NO: 1980 - protein, 263 aa, Mycobacterium paratuberculosis
MYFAGVDLAWAGRNPTGVAVIDSAGELVSVGAVHDDDEILAALDPYVRGECLVAFDAPLVVNNPTGQRPAETALNRDFRRFQAGTHPCNTGKPEFADGPRAARLAAALGLALDPRSPRPRRAIEVYPHAATVALFGLQQTLKYKAKPGRSLERLKSELLLLMAGVERLAHAPVPVRVGRHAGWRALRRAVECAQRKSELRRAEDPVDAVVCAYVALFAQRRPDAVTSYGDPGTGCIVTPSLPAARRQSLRSAPAADRSGPAPR

SEQ ID NO: 1981 - protein, 472 aa, Mycobacterium paratuberculosis
VSIPNVLAARYASAEMVAIWSPEAKVVAERRLWLAVLRAQQQLGVAVPAEAIADYERVLEDVDLASIADRERLLRHDVKARIEEFNALAGHEHVHKGMTSRDLTENVEQLQIRRSLELVFAHGVAVAARLAERAVAYRDLVMAGRSHNVAAQATTLGKRFASAAQETLIALARLRELIDRYPLRGIKGPMGTSQDMLDLIGGDPAKLAELERRVAEFLGFSMVLTSVGQVYPRSLDHDVVSALVQLGAGPSSMAHTIRLMAGHELVTEGFAPGQVGSSAMPHKMNTRSCERVNGLQVVLRGYASMAAELAGAQWNEGDVFCSVVRRVALPDSFFAIDGQIETFLTVLDEFGAYPAVIGRELDRYLPFLATTKVLIAAVRAGMGREAAHHVIREHAVATALAMREHGAEPDLLERLAADERLPLDRAALDAALADRRAFTGAAADQVDEVAAQVDALVSRYPDAAKYTPGAIL

SEQ ID NO: 1982 - protein, 415 aa, Mycobacterium paratuberculosis
VTLAGTLSQIDFTDLDNFANGFPHHLFAVHRREAPVYWHEPTDNTPDGEGFWSVASYAETLEVLKDPATYSSVTGGERPYGGTLLQDLAIAGQVLNMMDDPRHSQIRRLVSSGLTPRMIRLVEDDLRARARRLLDAVVPGEPFDFLVDIAAELPMQMICILLGVPESERHWLFQAIEPQFDFGGSRKAALSQLSEAEAGSRMYEYGQQLIAAKRAEPTDDMLSVVANATLDDAAAPALSDLELYLFFSLLFSAGAETTRNAVAGGLLALAEHPEQLRWLRDDLGALPTAVEEMVRWTSPSPSKRRTATRDATLGGQSIKAGQKVQIWEGSANRDASVFDRADEFDVTRKPNPHLGFGQGVHYCLGANLARLELRVLFEELLSRFGAVRVVRPVEWTRSNRHTGIRHLVVELRAEQ

SEQ ID NO: 1983 - protein, 206 aa, Mycobacterium paratuberculosis
MTPRFLPYSTRPGRLAAQLFSDLAVVIWTGLWILVGLAVYDAIATIADAGRQVESGAHGVAGNLASAGHGAQHIPVVGDTVSKPLNSASQAGLDMAGAGHDLDVAASWLAVLLAMAVVALPILVAVGPWLFLRLRFFRRKLTVTALAATPAGTQLLALRALANRPPRKLTAVSADPVGGWRREDPATIRALAALELQSAGIAIRGM

SEQ ID NO: 1984 - protein, 296 aa, Mycobacterium paratuberculosis
MPALSDYQHLASGKVRELYRVDDEHLLLVATDRISAYDFVLDSTIPDKGRILTAMSVFFFGLVDAPNHLAGPPDDPRIPDEVLGRALVVRQLEMLPVECVARGYLTGSGLLDYQATGKVCGIALPPGLVEASKFAEPLFTPATKAALGDHDENISFARVIEMVGGVRANQLRDRTLQIYVQAADHALRKGIIIADTKFEFGTDPDGNLLLADEIFTPDSSRYWPADEYRVGVPQTSFDKQFVRNWLTSPESGWDRHGTEPPPPLPDHIIEATRNRYIEAYERISGLRFDDWIGPRA

SEQ ID NO: 1985 - protein, 471 aa, Mycobacterium paratuberculosis
MTETHLATSVPPVAKRVDTRREHHGDVFVDPYEWLREKTDPDVIAHLEAENDYADRMTAHLAPLRQQIFDEIKARTKETDLSVPTRQGRWWYYARTYEGKQYRVQCRCPVADPDDWNPPNLDEDTEIPGEQIMLDSNVEAEGHEFFALGAATVSLDGNLLAYSVDTVGDERYTLRFKDLRTGELYPDEIADIAAGATWAADNRTVYYLTLDAAHRPDKVWRYQAGSGEAPELVYHEADEKFWLGVGLTRSEAYVMIASGSSITSEFRYADAADPHAQFTVVLPRRDGVEYSVEHAVVGGQDRFLILHNDGAVNFTLTEAPVGDPTRQRTLIPHRDDVRLDAVDAFEGHLVISYRRAALPRLQLWRIDADGTYARPEEISFDSELMSAGLAGNPNWSAPRLRIRAGSLVIPARVTTSTSSPGSGACCASNPCWGITGPPTTSNGATGPSPTTAPASRCPSCTVPTLNSPLPH

SEQ ID NO: 1986 - protein, 482 aa, Mycobacterium paratuberculosis
REVLARRGSHPERGLRHDRLGLLDHLRIPLRRRRRPARAVHRGAAAPRRCRVLGRACGGRRAGPVFDPAQRRRGELHPHRGPGRRSDPAAHPDPAPRRRPARRGGRLRRPPCHQLPACRAAAAAAVAHRRRRHIRAARRDFVRLRADVGRAGRQPELVGAPAADQGRLVGHPGAGYDIDFVTGERSLLREQPVLGDYRPADYVERRDWAVADDGTRVPVSIVHRADIEFPAPALIYGYGAYEICIDPSFSIARLSLLDRGMVFAIAHVRGGGEMGRLWYEHGKLLEKKNTFTDFISAARHLVESNVTRPDRLVALGGSAGGLLVGAVANLAPELFAGILAQVPFVDPLTTILDPSLPLTVTEWDEWGNPLADKDVYFYMKSYSPYENVEARRYPAIMAMTSLNDTRVYYVEPAKWVAALRHANPAGGPFLLKTQMNAGHGGVSGRYKAWEETAYQYAWLLAAAEGDRYGGGQKDDLHPDPQG

SEQ ID NO: 1987 - protein, 148 aa, Mycobacterium paratuberculosis
MAPLITLVVGSLVAWVVGRLGVAYVDGWAPALAVGLAAMFVLTGIAHFAPPLRADLVAIVPPRLPAPGLLVSLTGVLELLGALGLLLPATRAAAAGCLLVLMLAMFPANIHASRMPDPPKSMTTRLPLRIGMEIVFLAAAVAVALGGR

SEQ ID NO: 1988 - protein, 187 aa, Mycobacterium paratuberculosis
MTRHSYHHGDLPAVILAEAARLVAERGAERVSLRELARCAGVSHAAPAHHFTDRRGLFTALATQGFELLTQALADARGDFADAALAYVQFALDHPGHYQVMFNRSLLDASDGGLAAAEAAAGAELSRGVATLRDPHARADPRGAELAAWSLVHGFATLWLNDAVDAAVRAADPMDTVRRIATMLFAG

SEQ ID NO: 1989 - protein, 537 aa, Mycobacterium paratuberculosis
MLNGAMEKTRSAAFSVPLATASGPSLRDDEYPDKLDAALFRIAGVCGLACIMAVLDSTVVAVAQRTFIAQFGVNQAIVSWTIAGYMLAFATVIPITGWAADRFGTKRLFMGSVLIFTLGSLLCAVAPNILLLILFRVVQGVGGGMLLPLSFVILTREAGPKRVGRLMAVGGIPILLGPIGGPILGGWLIGAYGWKWIFLINLPIGLTAFALAALLFPKDRSAPSEALDITGALLLSPGVAIFLCGVCSIPGRHTVADRYVLVPALVGLVLIAAFILHAWYRTEHPLIDLRLFRNPVVTQVNVTLLVFAAASVGVGLLVPSYFQIVGHETPMQSGLHMLPIGVGAVLTMPLGGAVMDKHGPGKIVLTGLPLMAVGLAVFTYGVARQAAYSPVLVCGLAIMGLGIGLTTTPLSAALMQALAPHQVARGTTLISVNQQVGGSIGAALMAVILTNQFNRNPALMAANEAAGMHPVTGKRGLPVDPSTVPRPAMTPELAGHVSHHLSHAYTAVFVLAVVLVACTIIPASFLPRKPPSPPAGD

SEQ ID NO: 1990 - protein, 538 aa, Mycobacterium paratuberculosis
MLSNAMDEAPYAAAKTPPHAPTGQPGATEREYPDKLDAALLRISGVCILATVMAILDVTVVSVAQRTFIDQFSSSQAVVAWTMTGYTLALATVIPITGWAADRFGTKRLFIGSVLAFMLGSLLCALAANVLQLIVFRVVQGIGGGMLLPLGFMILTREAGPRRLGRLMSILSIPMLLAPIGGPILGGWLIDTSSWRWIFLINVPIGLLTVALAAVVFPRDHPARSETFDAVGVLLLSPGLATFLFAVSSIPGRGTVADRHVLIPAAMGLTLIAGFVGHAWHRADHPLIDLRLFRNPVLTHANVTMLVFATAFFGAGLLLPSYFQQVLHQTPMQAGVHMIPQGLGAMLTVRLTGPLVDRQGPGKVVLVGIALITAGLGAFAFGVARQAPYLPTLLAGLAITGLGMGCTMMPLSVASVQALAPHQIARGTTLMSVSHQVGGSMGTALMSMILTNQFNRSPNIVAANKLAALHQKAAAGGTPIDQSAIPRQSLAPGFWGNVLHDLSHAYTAVFVIAVALVVCTIIPASFLPKKPATETAGK

SEQ ID NO: 1991 - protein, 234 aa, Mycobacterium paratuberculosis
VSGKLIVSVSGIGERTLPDVEAFCAQMDARNVPVSLLVAPRLSGDYRLDHDPRTVEWLTGRRAGGDAIVLHGYDDAATKKRRGEFAILRAHEANLRLMAADRVLEHLGLRTRLFAAPGWVVSPGVVKALPGNGFRLLADLHGITDLVRHSTVRARVLGIGEGFLSEPWWCRMVVLSAERIARRHGVVRVAVAARHLRKPGPLQAMLDAVDLALMHNCEPTVYRWRSDRAALDAA

SEQ ID NO: 1992 - protein, 550 aa, Mycobacterium paratuberculosis
VAAFGADAIVVGAGLAGLVAACELVDRGLRVLVLDQENSANLGGQAFWSFGGLFFVDSPEQRRLGIRDSHELALQDWLGTAAFDRPEDFWPRQWAHAYVDFAAGEKRSWLRARGLKLFPLVGWAERGGYGAQGHGNSAPRFHITWGTGPALVEIFARRLRDRSTVRFAHRHRVDELIVEGGAVTGVRGSVLEPSAAPRGVASSRNTIAQFEFRADAVIVTSGGIGGNHELVRKNWPKRMGRVPEQLLSGVPAHVDGRMIEITQRAGARVINPDRMWHYTEGITNYEPIWPRHGIRIIPGPSSLWLDANGKRLPVPLYPGFDTLGTLEYITKSGFDYTWFVLNAKIIEKEFALSGQEQNPDLTGQSVRELLRNRARSGPPGPVQAFVDRGVDFVSANSLRELVTAMNKLPDVAPLDYATVEAEVTARDREVANRFSKDGQITAIRAARGYLGDRLGRVVAPHRLTDPKAGPLIAVKLHILTRKTLGGIETDLASRVLGADGTPLTGLYAAGEAAGFGGGGVHGYRALEGTFLGGCIFSGRAAGRGVADDIT

SEQ ID NO: 1993 - protein, 129 aa, Mycobacterium paratuberculosis
VHVGDELQIGELTVRAVGGKHAVIHPEIPVIENISFLVGDGGHRARLMHPGDALFVPDEPVDVLATPAAAPWMKVSEAVDYLRAVAPARAVPIHQGIIAPDARGIYYGRLSEMTSTDFQVLPEEDAVTF

SEQ ID NO: 1994 - protein, 74 aa, Mycobacterium paratuberculosis
VHRPAGCAQLGGGLWVGVQRGIRVTLEQCRQPGGVDVVGVLMGDQDGGEAGDALETVCEGTGVKEHSGVVELGK

SEQ ID NO: 1995 - protein, 244 aa, Mycobacterium paratuberculosis
MAEMRQLHIYDCALMDKLPMRVFLATMVVAGSFAVALIVVIPAYGEPETCPGICDRIPNTAWIDQHAVPLDAVYHWPALAGQAAHTTGAAPGPRFRFEELCGAPALPQDPRDSAVVARSTVAHPDGQWQLQAQVLHWRGDTAHGGAVAATVFGNAVAALRGCQQRAPQESPSLTSDEPTRMAAVISGPVVMHTYLLAHPASSTISELTLWSSAPPQTPWPAMADDPVLGAMNASLCEAYIASCP

SEQ ID NO: 1996 - protein, 79 aa, Mycobacterium paratuberculosis
VARVIVSVMPKAEILDPQGQAIVGALGRLGHSGISDVRQGKRFELEVDDSVDDAALAEIAETLLANTVIEDWTISRETQ

SEQ ID NO: 1997 - protein, 224 aa, Mycobacterium paratuberculosis
VTARIGIITFPGTLDDVDAARAARRVGAQPVSLWHADADLKGVDAVVVPGGFSYGDYLRAGAIARFAPVMTEVVDAARRGMPVLGICNGFQVLCEAGLLPGALTRNVGLHFICRDVWLRVASTSTAWTSRFEPDADLLVPLKSGEGRYVAPADVLDELEGEGRVVFRYHENLNGSQRDIAGVSSADGRVVGLMPHPEHAIEALTGPSDDGLGLFYSVLDGVLAG

SEQ ID NO: 1998 - protein, 172 aa, Mycobacterium paratuberculosis
VAHRLAPSVRKFAGGSMFVMTNEQSCANLVERYLRTRGRRYFRGHHDGEYFFVTAAPRRLHVHFEISPAHDDVLIIRVSPGYYFPASDRPWLTHFSDRWNRLGRRVTAIVHGSSDPQRIGVTARKSQWIRNGVGFTDFAAFLDETIADATQLFEELNPAAPPAHVPLLRDAG

SEQ ID NO: 1999 - protein, 273 aa, Mycobacterium paratuberculosis
VVPDQLDLDAADLRISRGSVPASTQLAEALKAAIVKQRLPRGARLPTERELVDRTRVSRATVRAAVGLLERQGWLVRRQGLGTFVANPVKQELGPGVRTITEVLAASGITPNVDVLSHRVEDAPQRIAETLHLTKVLCVHRRFRDGEQPLALMIAYLPPGLGKAVEPLLKSATDTQTGRAMESTYTMWERRLDTPIARASYEIHAAGASVEVAGALNLPLGSPVLVLERTSYGHDDTPLEVVEFHYRPERYRFSVTLPRTVPGRGAGIVERSR

SEQ ID NO: 2000 - protein, 155 aa, Mycobacterium paratuberculosis
MATADGFHPDFDDATPHAARNRVYHVKASQLSSDTAQSEGLRRFAALSGNSVGSEKLWMGETHALPGSASDNHHHGESETAIYVRTGNPEFVFHDGVHEVRIATAPGDYVFIPPYLPHREENPDPHTTAEVVIARSTQEAIVVNLPALYPLTDPD

SEQ ID NO: 2001 - protein, 265 aa, Mycobacterium paratuberculosis
MNNLYRDLAPVTEAAWGEIELEASRTFKRHVAGRRVVDVSEPGGPAAAAVSTGRLIDVEAPTNGVVAHLRASKPLVRLRVPFTLSRYEIDNVERGANDSDWDPVKEAAKKLAFVEDRAIFEGYAAASIDGIRSASSNKPLALPADPREIPDVITQAISELRLAGVDGPYSVLLSADVYTKVSETTEHGYPILEHIDRLVPGDIIWAPAIDGAFVLTTRGGDFDLQLGTDVSIGYTSHDADTVQLYLQETLTFLCYTAEAAVPLTS

SEQ ID NO: 2002 - protein, 354 aa, Mycobacterium paratuberculosis
MVNIVAVRRHGVHVRVIHVPPVQPQPILAPLTPAAIFLVLTVDDGGEATVHEALQDISGLVRAIGFREPQKRLSAIASIGSDVWDRLFSGPRPAELHRFVELHGPRHTAPATPGDLLFHIRAESLDVCFELADRILKSMAGAVTVVDEVHGFRYFDNRDLLGFVDGTENPDGALAVSSTAIGDEDPDFAGSCYVHVQKYLHDMSAWTALSVTEQENVIGRTKLDDIELDDDVKPADAHIALNVITDDDGTELKIVRHNMPFGELGKSEYGTYFIGYSRTPRVTEQMLRNMFLGDPPGNTDRILDFSTAVTGGLFFSPTVDFLDDPPPLPAPGTPAAPPARNGSLSIGSLKGTTR

SEQ ID NO: 2003 - protein, 432 aa, Mycobacterium paratuberculosis
MSGGPRNQTKSSASAQGLCEFIDASPSPFHVCATVAARLIAAGYTELDEAKHWPSQPGRYFTVRAGSLVAWDSTGADGPFRIVGAHTDSPNLRVKQHPDRTVAGWRVVALQPYGGAWLNSWLDRDLGISGRLSVRDGSGLSHRLVRIDEPILRVPQLAIHLAEDRKSVTLDPQRHVNAVWGVGESARSFVDYVAARAAVAPDDVLAADLMTHDLTPSTLIGASENGTADLLSAPRLDNQASCYAGLEALLATEPSGPLPVLVLFDHEEVGSSSDHGAHSDLLSTVLERIVLAAGGTRQDYLSRLPASLLASADMAHATHPNYPERHEPGHPIAVNAGPVLKVHPNLRYATDSRTAAAFALACRQAGVTLQRYEHRADLPCGSTIGPLAAARTGIPTVDVGAAQLAMHSARELMGAHDVAAYSAAMHAFLSPG

SEQ ID NO: 2004 - protein, 115 aa, Mycobacterium paratuberculosis
MGLNVEMVTFDCRDPARLAGWWAEQFGGTTHDILAGEFTAVSFPEGLRLGFQKVPDPTPGKNRVHLDLGVADLDAEVSRLTAAGANEVGRHQFGESFRWVVLADPEGNVFCLVRP

SEQ ID NO: 2005 - protein, 84 aa, Mycobacterium paratuberculosis
VSEDERKTEETMTVETGHVTGTKDKNYNLIWFTEKCLDNALRLETYIQDAEREGDNDVAELFRKAQSDSRKGAQMAEQLLAKRL

SEQ ID NO: 2006 - protein, 765 aa, Mycobacterium paratuberculosis
VTVSPTSAPTQAIDTVERAATTPDEPQPFGELGLKDDEYQRIREILGRRPTDTELAMYSVMWSEHCSYKSSKVHLRYFGETTTDEMRAGMLAGIGENAGVVDIGDGWAVTFKVESHNHPSYVEPYQGAATGVGGIVRDIMAMGARPVAVMDQLRFGAADAPDTRRVLDGVVRGIGGYGNSLGLPNIGGETVFDACYAGNPLVNAMCVGVLRQEDLHMAFASGTGNKIILFGARTGLDGIGGVSVLASDTFDAENSRKKLPSVQVGDPFMEKVLIECCLELYAGGLVVGIQDLGGAGLACATSELASAGDGGMEVRLEAVPLRTAGMTPAEVLCSESQERMCAVVTPENVDAFLAVCRKWDVLATVIGEVTDGDRLRITWHGQTVVDVPPRTVAHEGPVYQRPLARPDTQDALNADSSARLPRPATGAELRATLLALLGSPHLCSRAFITEQYDRYVRGNTVLAEHADGGVLRVDETTGRGIAVSTDASGRYTMLDPYAGAQLALAEAYRNVAVTGATPVAVTNCLNFGSPEDPAVMWQFAQAVRGLADGCVALGIPVTGGNVSFYNQTGSAAILPTPVVGVLGVLDDVSRRLPTALGAEPGETLMLLGETRDEFDGSVWAQVTADHLGGLPPKVDLAREKLLAEVLRAASRDGLVSAAHDLSEGGLAQAVVEAALAGETGCRIVLPEDADPFVTLFSESAGRVLVAVPRTEESRFRSMCEARGLPAVRIGVVDQASDEVEVQGLFTVPLAELRQTSESVLPRLFG

SEQ ID NO: 2007 - protein, 216 aa, Mycobacterium paratuberculosis
MRPSLFRRTAALSLAGALVGWSFAGPRLPAGARMVLQAGMGAALVALTRAPLGLHPPRLWAGLRCGAAVAGCAAGAVAATTLVPAVRESMAGREPPAPAPDWLLLRIPVGTVWSEEAAFRAALTAAGSAAFGRRGAMLLQAIAFGLSHIADARAIGEPLAGTVLVTAVGGWFFGWLTDRCGSLAAPLLAHLAVNEAGAIAVLAVRRRSGRNAAPRI

SEQ ID NO: 2008 - protein, 131 aa, Mycobacterium paratuberculosis
MAPRDKPDPAKTRHAVLAVAQWLRDESAPEPARDEVATAVRLTARTLAAAAPGRSVELRIPPFAAVQCIPGPAHTRGTPPNVVETEPRTWLLLVTGKLAFADARRTGALRLSGSRAGEIEHCLPLFDVDRT

SEQ ID NO: 2009 - protein, 551 aa, Mycobacterium paratuberculosis
LKCRFTPAGRDFAGQHARRIRRRGRAARRLRYVTNRSPGSRPIVTVAEPEQDFNAPREECGVFGVWAPGEEVAKLTYYGLYALQHRGQEAAGIAVADGSQVLVFKDLGLVSQVFDEQTLAAMQGHVAIGHCRYSTTGDTTWENAQPVFRNTAAGTGVALGHNGNLVNTAELAARARDAGLIAKRAPAPATTDSDILGALLAHGAADSTLEQAALDLLPTVRGAFCLTFMDENTLYACRDPHGVRPLSLGRLDRGWVVASETAALDIVGASFVRDIEPGELLAIDADGVRSTRFANPTPKGCVFEYVYLARPDSTIAGRSVHATRVEIGRRLARERPVEADLVIGVPESGTPAAVGYAQESGIPYGQGLMKNAYVGRTFIQPSQTIRQLGIRLKLNPLREVIRGKRLIVVDDSIVRGNTQRALLRMLREAGAVEVHVRIASPPVKWPCFYGIDFPSPAELIANAVEDKHEMLEAVRHAIGADSLGYISLRGLIAASEQPASRLCTACFDGQYPIELPGETALGKNVIEHMLANAARGAGLDDLAADEVPVVH

SEQ ID NO: 2010 - protein, 367 aa, Mycobacterium paratuberculosis
MTDPGKSPGRHSGSQGITYASAGVDIEAGDRAVELFKPLATKATRPEVRGGLGGFAGLFALRGEYREPLLAASTDGVGTKLAVAQAMDKHDTVGLDLVAMVVDDLVVCGAEPLFLQDYIAVGRTVPERLSAIVSGIAEGCVRAGCALLGGETAEHPGLMEPDHYDISATGVGVVEADDVLGPDRVKPGDVIIAMGSSGLHSNGYSLARTVLLEIDRMNLEGYVEEFGRTLGEELLEPTRIYAKDCLALAAETHVRTFCHVTGGGLAGNLARVIPHGLVAELDRGTWTPAPVFAMIAQRGRVTREEMEKTFNMGVGMIAVVAPEDTDRALAILTARHLDCWVLGTVGKGGKAGPRAKLVGQHPRFTRF

SEQ ID NO: 2011 - protein, 61 aa, Mycobacterium paratuberculosis
MGRGRAKAKQTKVARELKYSSPQTDFQRLQRELSGTGSDDSNDLDTDGSDQPWDDQDGWRG

SEQ ID NO: 2012 - protein, 364 aa, Mycobacterium paratuberculosis
VTHPVPAPDTGPDAGAVWHYGDPLGEQRAAETEALVIDRSHRGVLTLTGADRQTWLHSISTQYVSDLPEGASTQNLSLDGQGRVEDHWIQTELAGTTYLDTEPWRAGPLLDYLRKMVFWSDVTPAAADLAVLSLLGPKLAERAVLDALGVDALPAEAAAVPTRGGFLRRMPAGPAGRLELDLVVPRAEAADWRNRLAQAGVRPGGVWAYEAHRVASRRPRLGMDTDERTIPHEVGWIGGPGQGAVHLDKGCYRGQETVARVHNLGRPPRMLVLLHLDGSADRPATGDPVQAGGRAVGRLGTVVDHVDLGPIALALLKRGLPADTALATGPQAAVAAVIDPDSLPAAEQIGAGRLAVERLRGGAG

SEQ ID NO: 2013 - protein, 289 aa, Mycobacterium paratuberculosis
VIVTLDGEVHAPDAPLLHADDLAAVRGDGVFETLLVRDGRACLIESHLQRLTQSAALTELPEPDLPRWRSAIEAATRRWCAGGADEGAMRLIYSRGREGGSAPTAYVMVTAIPDRVTAVRRDGLAAITLDRGLPATGVDAMPWLLAGAKTLSYAINMAALRHAARHDAGDVVFVSTDGYVLEGPRSTVVIATDSEAPGGGPCLLTPPPWYPILRGTTQQALFEVARAKGYDCDYRALRVADLFAAQGVWLISSMTLAARVHTLDGRPLPRAPMAAEFAELVDAAIVSDR

SEQ ID NO: 2014 - protein, 235 aa, Mycobacterium paratuberculosis
LVCALHAVPAHHRRVVTPAGDDPSGPAGSGDRAVAAAAERAKLTAGRNIPSFDDLPLPADTANLREGANLSDALLALLPLVGVWRGEGEGRGHDGDYRFGQQIVVSHDGGDYLNWEARSWRLNDTGDYQERGLRETGFWRFVRDPDDPSESQAIELLLAHSAGYVELFYGRPRTQSSWELVTDALARSRSGVLVGGAKRLYGIVEGGDLAYVEERVDADGGLVPHLSARLSRFAG

SEQ ID NO: 2015 - protein, 100 aa, Mycobacterium paratuberculosis
MCSAPKQGVTLPASVDLEKETVITGRVVDSDGQAVGGAFVRLLDSSDEFTAEVVASATGDFRFFAAPGSWTLRALSAAGNGNAVVTPSGAGIHEVDVKIA

SEQ ID NO: 2016 - protein, 277 aa, Mycobacterium paratuberculosis
MARSDVRVSTDWAESNLDTPGVVFVEVDEDTSAYHAGHIPGAIKLDWRSDLQDPVKRDFVDAQQFSKLLSERGIANDDTVILYGGNNNWFAAYAYWYFKLYGHEKVKLLDGGRKKWELDGRTLSSDPVSRPATSYTAAAPDNSIRAFRDEVIAAINVKNLVDVRSPDEFSGKILAPAHLPQEQSQRPGHIPGAINVPWSKAANEDGTFKSDEELAALYAAAGLDTGKETIAYCRIGERSSHTWFVLYELLGHRNVKNYNGSWTEYGSLVGAPIELGS

SEQ ID NO: 2017 - protein, 156 aa, Mycobacterium paratuberculosis
LPSSNTTTQPDLVDVRGPRFAAWVTTAVLVLALAVSAVSPAAAAVILAVQAVVFAIGAVGGPRKHPYGRVFAAVVAPRLGPVREREPIPPLKFAQLVGLIFAVLGAAGFAAGASLFGLVATAAALAAAFLNAAFGICLGCQLYPLVARFRRPARST

SEQ ID NO: 2018 - protein, 139 aa, Mycobacterium paratuberculosis
MTTLVVIFAVLAAATLAGWLLTRRSRRIREIDAGPQRDTGDDVAALGLSRDGPTVVHFSAPWCGPCDRVRRVVDQVCADLGGVAHVEIDLDAHPDTARRYAVLSLPTTLIFDADGRQRYRSSGVPGAADLRSALKPLLA

SEQ ID NO: 2019 - protein, 289 aa, Mycobacterium paratuberculosis
VSPATGGPPATVSRGLRHNMRVRKVLIGVAATAILVAVVALGAIGVDYGTSIYAEYRLSSSVRRAADLGTDPFVAIVAFPFLPQALRGNYNQLEIKANAVSHAMTGKATLEATMYSVDLAQASWLIAPDAKLAVRKLESRIIIDSTHLGRYLNISDLMVEAPPKETNTATGGITASGISGSHGLVFTGTPKSAGFDHRVSVSVDLSIAPDDPATLVFTPTGVLTGSDTADQSVPADKHDAVLHAFSGRLPNQRLPFGVAPTTEGARGSDVIIEGITYGVTVTLEEFKQS

SEQ ID NO: 2020 - protein, 260 aa, Mycobacterium paratuberculosis
LELLLLTPELHPDPVLPSLSLLAHTVRTAPPEPSSLLEAGTADAVIVDARTDLSSARGLCRLLSTAGRSVPVLAVVSEGGLVAVNSDWGLDEILLPTTGPAEVDARLRLVVGRRGGLADQESAGKVTLGELVIDEGTYTARLRGRPLDLTYKEFELLKYLAQHAGRVFTRAQLLHEVWGYDFFGGTRTVDVHVRRLRAKLGPEYEALIGTVRNVGYKAVRPARGRPPVAEADDAESESDSASESDAEDVHDPLVDPLHTQ

SEQ ID NO: 2021 - protein, 316 aa, Mycobacterium paratuberculosis
VTAADWRRTLNPQEQREVRELVGAATEFDAVAPVGEQVLRELGHDRTEHLLIRGSVSGGAADAVVGYLNLTPPRDAQPQMAELVVHPRARRRGIGSALARAALAKTGAANRFWAHGTLEPARATAAALGLSPVRELMQMRRSLRDLPDSVPAVPGVRIRTYAGPADDAELLRVNNAAFAYHPEQGGWTDVELAERRAEPWFDPAGLFLAFGDDDSDRPGRLLGFHWTKVHLDQPGLGEVYVVGVDPCAQGRGLGQALTAVGIEWLARRLGAGDSAADPTVMLYVEADNVAAVRTYQRLGFTTYSVDTAYAVPPAAN

SEQ ID NO: 2022 - protein, 365 aa, Mycobacterium paratuberculosis
VRLDRQGGALAAAALTGCGSDENHRGTAAPSISGTTGTAGCGGKNKLTAEGSTAQENAITMFNQVWGQYCPGKGLAYNPTGSGAGREQFIAGHVDFAGADSPLVADQIGPAAQRCGGNPAWDLPLVFGPIAITYNLPGNPALVVSSDAVAKIFTGKITNWNDPILAALNPGVALPDTKITPIYRTDSSGTTDNVQKYLTAAAPQSWAKGVGTEFQGGVGEGAAKSAGVIQAVRATTGAVGYVEKGFADQAGMPYAKIATRGGVVPLTNETAGNAVNAAKFLSEGDDLVLDLHAMYASQEPGVYPLLLVTYEIVCSKGYDPETLAAVKSFLGVAATSGQNGLSTAGYIPLPDKVRQRLVTAINALQ

SEQ ID NO: 2023 - protein, 331 aa, Mycobacterium paratuberculosis
VVAAPFPEPSATPISPWGQGRPHAGDRIFRRLAQASGVLIVLVIAAIAVFLLDRAVPALQRNRENFFGYGGNWVTTDTSAMHFGIASLLPVTVFVSLFALILAMPVALGVAIFITHYAPRRAATPLAYAVDLLAAVPSIIYGAWGLYVLAPQLRPVATWLNHSMGWCFLFADGNTSAAGGGTIFTGGIVLAVMILPIITAVTREVFIQTPHDQIEAALALGATRWEVVRTVTLPFGRSGYISGGMLGLGRALGETVALLIILRGTQSAFGWSLFDGGSTFATKIAGAAAELDDRFKAGAYIAAGLTLFVLTFVVDALARGAVAGVGRRAGP

SEQ ID NO: 2024 - protein, 304 aa, Mycobacterium paratuberculosis
MTSMLDRPLKSRTFSPLSRRRRAANSVATVLVSLSLLVAVTPLVMVLCSVVVKGFRAITSTVWWSHSQAGMTAFVTGGGAYHALVGTVLQGLVCAAISIPIGLMVAIYLVEYGGGTPLGRLASFMVDILSGVPSIVAALFVYALCVATLGLPRSEFAVSLALVLLMLPVIVRATEEMLRIVPVDLREASYALGITKWKTIARVVLPTGLSGIVTGILLAMARVMGETAPLLILVGYAQSMNFDIFSGFMGTLPGMMYNQASAGAGINPIPTDRLWGAALTLILVIATINVVARVITKFLGARKS

SEQ ID NO: 2025 - protein, 258 aa, Mycobacterium paratuberculosis
VAKRLDLKGVNIYYGSFHAVAEVTLSVLPRSVTAFIGPSGCGKTTVLRTLNRMHEVVPGGRVEGSLLLDDEDIYGPGVDPVGVRRAIGMVFQRPNPFPAMSIRDNVVAGLKLQGVRNRKVLDETAEYSLRGANLWDEVKDRLDRPGGGLSGGQQQRLCIARAIAVQPDVLLMDEPCSALDPISTMAIEELISELKQDYTIVIVTHNMQQAARVSDYTAFFNLEAVGKPGRLIEVDDTEKIFSNPSQKATEDYISGRFG

SEQ ID NO: 2026 - protein, 222 aa, Mycobacterium paratuberculosis
MRTAYHEQLSELSERLGEMCGLAGVAMERATQALLQADLVLAEQVISDHEAIAAMSARAEETAFVLLALQAPVAGDLRAIVSAIQMVADIDRMGALALHVAKIARRRHPQHALPEEVNGYFAEMGSIAVELGNSAQEVVLSRDPEKAARIREEDDAMDDLHRHLFSVLMDREWKHGVAAAVDVTLLGRFYERFADHAVEVARRVIFQATGRLPEEETKPASQ

SEQ ID NO: 2027 - protein, 674 aa, Mycobacterium paratuberculosis
LAAAPWERFFEPPPDDRLHRWRPDAAALEPVAAPEDDDEPGGCHTGGGVTVADLIAKVGAPNRPVHRRAAPEETEPIEPEPVEPEPVGSEPPGPASGLPLELQQTQVIDDLAYSVDAVSELRELMATDYPNDGDSDQQSADAADTAAGEPRRRRRPMLMAGRSVAALAAVLALATTGGAWQWSASKNARLNTINALDRNSSDIRDPGGQYGDEDFLIVGLDSRAGDNANMGAGSTDDADGARSDTVMLVNIPANRKRVVAVSFPRDLAITPMQCEAWDPSTGKYGPIYDPKTKSWGPKMVYTETKLNSAFAFGGPKCLVKEIQKLSGLSINHFIAVDFAGFAKMVDALGGVEVCSSTPLHDYELGTVLEHGGRQVLDGDTALNYVRARQVTTEVNGDYGRIKRQQLFLSSLLRSLISADTLLDLNKLNNVVNLVINDTVVDNVKSKDLVQLGQSLQGMAAGHVTFVTVPTGVTDQNGDEPPRMSDMRALFDAIINDDPLPEENDQNAQNLSASGSTTGAPKAPTTRKSPTPTPEPQREQVTTTSPSGVTVRVSNATTQSGLAATATSQLKRDGFNVMTPDDYPSSVNTTTVLFSPGNEEAAATVASSFANAKVQRVSGYGQVVQVVLGPDFKSVTAPSPSGSTMSLQIERGSSNAPAKLPEDLTVTNAADTTCE

SEQ ID NO: 2028 - protein, 377 aa, Mycobacterium paratuberculosis
LRIGPIELASPVVLAPMAGVTNVAFRTLCRELERELVGTVSGLYVYEMVTARALVERHPATMHMITFAPDESPRSLQLYTVDPATTYAAAKMIADEGLADHIDMNFGCPVPKVTKRGGGSALPYKRRLFGQIVAAAVRATQGTEIPVTVKFRIGIDDEHHTHLDAGRIAEAEGAAAVALHARTAAQRYSGTADWEQIALLKQQVRTIPVLGNGDIYDASDALTMMAATGCDGVVIGRGCLGRPWLFAELSAAFTGSPPPTPPTLGQVADIVRRHGRLLAAHFGEDKGMRDIRKHIAWYLHGFPAGSELRRALAMVKTLDELDRLLDRLDGSVPFPDEATGPRGRQGSPARVVLPEGWLDDPDDCTVPAGADIMHSGG

SEQ ID NO: 2029 - protein, 340 aa, Mycobacterium paratuberculosis
MSAELTNLQLLQELEPFVEKYLNRHESMHKNWNPHDYIPWSDGKNFYALGGQDWEPGQSKLSDVAQVAMVQNLMTEDNLPSYHREIAMNFGMDGPWGQWVNRWTAEENRHGIALRDYLVVTRAVDPVELEKLRIEVVNRGFSPGQNHQVREDLFAESLFDSVIYVTFQELATRISHRNTGKACNETIADQMLAKISADENLHMIFYRDVSEAGFAIAPNQAMKSLHKVLRNFQMPGYQVPEFRRKAVMIAVGGVYDPRIHLDDVVMPVLKKWRIFEREDFTGEAAALRDDLALLIKELETTCDKFEISKRRQLEREARTGKRTTALELHTTAGTLTMSRR

SEQ ID NO: 2030 - protein, 204 aa, Mycobacterium paratuberculosis
VQTGQRRGRWTGVPLESRLALRRDNLINAGVQLLGGSGGPALTVRAVCRKAALTERYFYESFTDRDEFVRAVYDDVCTRAMNTLTSATTPREAVERFVELMVDDPVRGRVLLLAPAVEPVLTRSGAEWMPNFIDLLQRKLSRIGDAVLQKMIATSLVGGLSSLFTAYLHGQLGATRKQFIDYCTNMLYITAAPYVSAGELGKPQ

SEQ ID NO: 2031 - protein, 357 aa, Mycobacterium paratuberculosis
VTQDTSASRPLTSDVTGSDAAGLTEQSISARPADAGAAVAGGCPVSPLGYEAPPAPLGPDSLTWKYFGDWRGMLQGPWAGSMQNMHPQLGAAVLDHSTFFRERWPRLLRSLYPIGGVVFDGDRAPITGAEVRDYHTDIKGVDEQGRRYHALNPDVFYWAHSTFFVGTIHVAERFCGGITEEQKRQLFDEHVQWYRMYGMSMRPVPKSWEEFQEYWDHMCRNVLENNEAARAVLDLTELPKPPFAQWIPNRLWAAQRKLLAPFFVWVTVGLYDPPVRELMGYRWSARDEWLHRRFGDLVRIVFALVPSRFRKHPRARAGLDRASGRIPLDAPLVQTPARNLPPEDERGNPKHYCPMVS

SEQ ID NO: 2032 - protein, 135 aa, Mycobacterium paratuberculosis
LRMHADSSAGRLPDDQVRLVVEVFRMLADATRVQVLWSLTDREMSVNELAEHVGKPAPSVSQHLAKLRMARLVRTRREGTTIFYSLENEHVRQLVIDAVFNAEHAGPGVPGHHRGEGGLKSVAASSRHRPRGAAR

SEQ ID NO: 2033 - protein, 166 aa, Mycobacterium paratuberculosis
VTDFARRTIDLARQNVAEGGRPFATVIVQDGEVLAESANKAAQTNDPTAHAEILAIRAACLKLGTEHLVDATIYVLAHPCPMCLGALYYCSPREVIFLTTRESYEPYYVDDRKYFELSNFYAEFAKPFDERRLPMRYQPHPDAVDVYRLWNERNGGRRRSTVVPSD

SEQ ID NO: 2034 - protein, 268 aa, Mycobacterium paratuberculosis
MARTDRDRWDLATSVGATATMVAAQRALSSDANLIDDPYAAPLVRAVGIDVYVRLVDGEIQPGTSEFDPHRMAKGMACRTRFYDDFFLDAARAGVGQAVILASGLDARAYRLPWPAGTVVYEVDMPDVIEFKTLTLADLGAQPTAQRRTVAIDLRDDWAAALREERFDTQAPAAWSAEGLLVYLPEQAQDALFDNITALSAPGSRLAFDFVPDTAVFADPRWRAHHDRMSELGFEVDFNDLVYHGERSHIVDHLSGRGCSLVPLFRVG

SEQ ID NO: 2035 - protein, 395 aa, Mycobacterium paratuberculosis
MRELSVAEQRYQAVMAVISDGLSVSQAAEKFGVARQTLHRWLARYEAAGLEGLVDRSHRPVSCPHQMLAVVEAAVLELRRSRPYWGPRRLVFELAKRGVHPVPSESAVYRALVRAGLIDPAMRDRRSRKWKRWERGAPMELWQLDIVGGFPLADGTSAKALTGIDDHSRMCVCAKLMARERTRAVCDGLRAALAAYGVPEQILTDNGKVFTERFCHPPVEVLFDAICREHGIEHLLTQPRSPTTTGKIEQFHRSLRAEFLSGREPFTNLKVAQQALDEWVEDYNTTRPHQALKMITPAQRFHAGAPASPPSNSCARHVDRSGDDWVSRRVCSNGIVCVSWQQVCIGRHYAGARCDVHVDGDLLRFWVGDNLVKTAARTSRGEVRNKQALRTNAPA

SEQ ID NO: 2036 - protein, 279 aa, Mycobacterium paratuberculosis
MGGRVEGKVAFITGAARGQGRSHAVRLAQEGADIIAVDICAPISSNSQIPPSTPDDLAETADLIKGLDRRIVTAEVDVRDYYALKAAVDSGVEQLGRLDIICANAGIGNGGQTLDKTSEDDWRDMIDVNLSGVWKTVKAGVPHMISQGHGGSIILTSSVGGLKAYPHTGHYIAAKHGVVGLMRTFAVELGQHFIRVNSVHPTNVNTPMFMNEGTMRLFRPDLKNPGPDDLKVAAQFMHVLPVGWVEPVDISNAVLFLASDESRYITGLPVTVDAGSMLK

SEQ ID NO: 2037 - protein, 215 aa, Mycobacterium paratuberculosis
MPTTDRAGRSSKTGAATRRSRRNTDAGARTKLIEATARLMREEGYAAATSRRVAAEAGVKQALVYYYFPTMDDLFVEVLRAGAESALTRMRALLTEDDPLQALWLMNSDTALTALNAEFMALANHRKAIGAELKAYAERVRDIETTAATMVLRANGIDLEEYPPVAISMLIAQAARSLCNEKAVGVTQGHDELRVFVQRQLSRLTAPAAASTTSG

SEQ ID NO: 2038 - protein, 72 aa, Mycobacterium paratuberculosis
MRVRVDPRLCEAHALCVEIAPEVFRLDDDTASCADDPAESLRHSVQAAVAACPRQAISVLTEQPPYAPDEGN

SEQ ID NO: 2039 - protein, 426 aa, Mycobacterium paratuberculosis
MTDLAQVDYFTDADVAQDPYDYWDYLREQGPVFREPHYGVVAVTGYQEVQAAFKDVESFSAVNAIGGPFPPLPFTPEGDDISELIEAHRHEFPIFEHMVVMDPPEHDKARSLLGRLLTPRRLQENKDYIWQLADRQFDEFIANGHCEFLSEYAKPFATLAIADLLGVPDEDRPQIRRNLGAGNAPGARVGALDHEPVGSNPLQYLDDLFSGYIADRRERPRDDVLTGLATATYPDGSTPPLLEVVRPATFLFAAGQETVTKLLSAAVQVLGDQPELQARLRADRGLIGPFIEEALRMQSPTKVDFRLARKTTTLGGVHIPAGTVIMLCLGAANRDPRKFENPNEFRIDRKNVREHIAFGRGIHTCAGAPLARVEGQITINRLLDRTSELRINKAKHGPASSRQYRYESTFLLRGLTELHIEFTRAG

SEQ ID NO: 2040 - protein, 67 aa, Mycobacterium paratuberculosis
MAQGTVKWFNGEKGFGFITPDDGTKDLFVHYSEIQGSGYRSLDENQRVQFDVEQGAKGPQAVGVSTV

SEQ ID NO: 2041 - protein, 245 aa, Mycobacterium paratuberculosis
LTPARPTNRDNDRMRLAWVLRLTIAASLVAAGGTRTAEASPDVPPVSDAAKAAGFVDIRSVIPDAVLDLRYATSNNFTHTQLYPSDARCLVHQSMAPGLAAAAGALRPQGHLLVFWDCYRPHDVQVKMFSLVPNPAWVARPGAYARSHESGRSVDVTFTTAQQPCSSGLHAGGLCLADMGTDFDDFTSRATAFNTQGISADAVANRAALRNAMNYGGLKVYSGEWWHFDGPGAGVDQPILNVPVD

SEQ ID NO: 2042 - protein, 324 aa, Mycobacterium paratuberculosis
VNDQHRATYTHGHHESVLRSHRRRTAEDSAGYLLAHLTPGLSVLDVGCGPGTITADLAARVAPGQVTAVDQAADVLDVARAEAEQRNLSNVSFGTADVHRLDFADDTFDVVHAHQVLQHLSDPVAALREMRRVCRPGGIVAVRDADYAGFIWYPELPALDLWRDLYRRVARANRGEPDAGRRLLSWARRAGFDDITPTGSLWCYATPETRDWWGGMWADRILHSTVARDLVSLGLAAREQLEEISAAWREWAAAPDGWIAIPHGEIICRASAFSRGTGPESVARRRRRQTGRRPRQSATPPRRCSSRRWLPARGGRRSRRPRRP

SEQ ID NO: 2043 - protein, 274 aa, Mycobacterium paratuberculosis
MADNSLTDRTVVISGGSRGIGLAIGIAAARRGANVVLLAKTDTPHPRLPGTVHTAAADVEAAGGKALAVVGDVRREEDVRRAVEATVQRFGGVDVCVNNASAIAVEPTAELSAKKFDLMQEVNIRGTFLLTKACLPYLRRAANPHVLTISPPINMNPRWLGAHPAYTLSKYGMTLLSLGWAAEFADDGIGVNCLWPQTYIATAAVANMADGDKLAESSRSPEIMADAAVEIVSRPAREATGDCYIDAEVLHSAGVDDLSVYGGGEQPIPDLFLD

SEQ ID NO: 2044 - protein, 530 aa, Mycobacterium paratuberculosis
LQVRYSSMDNTAHTPSGIPLQPVYGPADRSAEPPQPGEFPFTRGNFASGYRGKLWTFRQYSGFGTAEESNRRYLLEQGGTGLSVALDLPTQCGYDSDDPEFGEEVGRVGVAVDTLADFEILFDGIPLDKLSTSMTINGTAAILLAFYVAAAEKKGIPRAKLTGTIQNDILKEYASRGTWIWPPEPSLRLIADTIEFCAAEVPKFNAISVAGAHFRDAGANAVQEMAFTLADGVTYCDTVVERGRMTIDQFAPQISFFFYTHGDFFEEIAKYRAGRRRWATIVRERYGATTAKASMFRFGCVCGGASLYAPQAHNNIVRVAYEAMAAVLGGVQSMFTAAWDEPFALPTEETTTLALRTQQILAYETGVASVADPLGGSYFVEALTDETEARIIEIMADLDRHGGMVSAIEDGYLQGLIADEAFRLHQDIEAGTRPVVGVNRFVTEEPEHDVVTYELDAEGRDLQLKRLSKVKAERDSAAVKSSLAALSRAAEGDDNLMHKLIDCANAYCTVGEMVSALKAVWGEFQQPVVF

SEQ ID NO: 2045 - protein, 146 aa, Mycobacterium paratuberculosis
VAVRILVAKPGLDGHDRGAKIVARTLRDAGFEVIYTGIRQRIEDIASIAVQEDVAVVGLSILSGTHLALTARTVEALRACDAADIAVVVGGTIPHADVPKLLAAGAAAVFPTGTPLDKLVREIRALTGTGEPDDKEAITEEQCASE

SEQ ID NO: 2046 - protein, 318 aa, Mycobacterium paratuberculosis
VRVGVMIGAERGDMARKVNKLVSDIEWAESAGLDTAWMPQVPNDFDCLTMVSLMAAHSSRIELGTAVVPLQAQHPIALARQALSTHAVAGGRLALGVGPSHHWIIRDMLGLPYQKPAAYTRDYLQVLNAAIAGPGPVDVENDSFTVHNPMVIGADTPMPVLVAALGPVMLQIAGELADGTVLWMADERAIGEHIAPKITKAAADAGRPAPRIVAGIPVCLCAPSQVDEAKERANRILGEAEVSPNYQRLLERGDARDVGDLCAAGEPEQILARMRRFADAGVTDLSVRLLPIGDNRDELVASKSRTREMIASLAAELR

SEQ ID NO: 2047 - protein, 346 aa, Mycobacterium paratuberculosis
LSGNNTGPLAGIRILEVGTMLAGPYSTMLLADLGAEVTKIEPAGGEISRSVGATYFASLNRNKSSICLDLNSDAGQRRLGELAAESHALLVNLKPSAIRRLRLTYDDLRRHNEKIVCVAITGFGLYGGDDPAFDYVVQAGVGTAALTGDPDGPPTLPGYSSADNSTGMCAALGLLAKIISGTGGQVDVSLRDVMLSQLNYHASAYLNSGVEPQRRPHGAHSYYVPAQLFPTAEGYLALFITHDGFWKSFAAEAGIGGFETMAERVARRDEVLAVVTAMLSTDSAAGWERRLRPLGVPAAAVRTLPEALEATPEVIVTAGEFRLVGSPIHVSGYQPEYRPPPQLPQS

SEQ ID NO: 2048 - protein, 421 aa, Mycobacterium paratuberculosis
MKADDLILVSIDDHVVEPPDMFLRHVPAKYRDEAPIVVTDDKGVDQWMYQGRPQGVSGLNAVVSWPAEEWGRDPAGFAEMRPGVYDVHERVRDMNRNGILASMCFPTFTGFSARHLNMHREEVTLVMVSAYNDWHIDEWAGSYPDRFIPIAILPTWNPEAMCAEIRRVAAKGCRAVTMPELPHLEGLPSYHDEDYWGPVFRTLSEENVVMCLHIGTGFGAISMAPNAPIDNMIILATQVSAMCAQDLLWGPAMRNYPDLKFAFSEGGIGWIPFYLDRSDRHYTNQKWLRRDFGSQLPSEVFREHSLACYVTDKTSLKLRHEIGIDIIAWECDYPHSDCFWPDAPEQVLAELTAAGADDADINKITWANACRFFSWDPFARTPRDQATVKALRAKALDVDVSIRSRAEWARRYHEKQLAGQT

SEQ ID NO: 2049 - protein, 104 aa, Mycobacterium paratuberculosis
MAKGIILVESRPSSPEREQEYNTWYDEVHLGELVALDGFVSARRLRPVDGDGPYVAIYEIEGDDLQAILDNMIASAGQLHMSDALQLDPAPIPRLLEVTTECGG

SEQ ID NO: 2050 - protein, 112 aa, Mycobacterium paratuberculosis
VTVTRIIEETPRVTDPATNGSSAGTVTIHLDRKKVSVPMVPGETLLETARRAGLEPPFSCEAGNCGTCMAKLEEGHATMRANDALEPDEVAEGYILTCQGVPDTDSVTVRYE

SEQ ID NO: 2051 - protein, 467 aa, Mycobacterium paratuberculosis
VTEPAALVFEERRFSVPELDALADGWAAALAKDGVTAGRRVAVMTSNRPEFLAVLLAIWRLAATAVLISPAWKRDEVEHALALTDPGHAVGDHPVLAGLMPMLHLDEPVPPAQPTAGAPPRAGDAVLVFSSGTTGLPKAVRHTHASLDEAVRHWREALRLTRRDRIQVATPPSHILGLLNLLTALKTGACVRLHPRFDIDKVLHHIESDRVTVEMAVAPIALAIASHPDLESYDLSSLRYIVWGATPVNAEVAQTVTRRTGVGWLPAYGTTELPVIACNPIEDARLDTVGRPVPGVEVRVVSLASGEPAGAGEVGEIQARSASLMAGYLPGEATGEAIRDGWYRTGDAGWLDTGGWLRITDRLKEMIKVRGFQVAPAEIEAVLQGHPAVADCAVFGVPDGLNGEAVVAAVAVSAPVDVTELTALVRQKLASYKHLSRVVVVPEIPRLPSGKVLRRVLKERHGCTSDS

SEQ ID NO: 2052 - protein, 301 aa, Mycobacterium paratuberculosis
MDVRLTAEQQQLRDAAAKLADDLGPATVQDLDDQGRISRLDKQIEMSGWRSLRSDGASGVEVAIVAEEFGRRLVDTPFLGPVLADDLLRHVGADAAATTVAVDDRAVDARGARRAVSLSGGAVLAADVRPAPDNVDLTRADATTVGSPETLGEVGSDVAGQWRALALVTTTADLVGVARGAHALACDYAKIREQYGNPIGSYQAIAHLLAESLALIEGSISVARHAGWAVDALAPAEAIRAAQIAKVYCARAARTVCETAIQVHGGIGNTWECAAHVYLRRALTSTELWPVALKEIDLGLS

SEQ ID NO: 2053 - protein, 360 aa, Mycobacterium paratuberculosis
LDFRDSPDEAAFRERLRSWLSLHAKEFASSGDDYWARQAEWHQALYREGFFGLSWPREYGGQELAPVYDVIVDEELARAGAPPRPSVGYLIYGIGRHASDELRRRFLPGIINGTERWCQGFSEPGAGSDLASLTTTARLEGDTYVVDGHKIWTSYSDVADWCLLLARTDPQAKRHRGLSAFILEMKQPGVQQRPLRMINGVTNEFGQVFFDGAKVPADRMVGAPGDGWAVAMTVVGHEREPSTLGYAARYGKIVRSLYARTDGPVCEELAWAAVQSEMLTHHVRRRLSEQLDGVSHGPEGSLDKLLMTWVEQSVGHAALAVAGTRDPDLLSAYLYSRAQSVMGGTSQIQKNIIASRILGL

SEQ ID NO: 2054 - protein, 210 aa, Mycobacterium paratuberculosis
LTDDPTARAAVITGAGRAFSAGGDFGYLKELSADADLRAKTIRDGREIVLGMARCRIPVVAAVNGPAVGLGCSLVALSDIVYIAENAYLADPHVQVGLVAADGGPLTWPLHISLLLAKEYALTGTRISAQRAVELGLANHVADDPVAEAIACAKKILELPQQAVESTKRVLNIHLERAVLASLDYALSAESQSFVTEDFRSIVTKLADKN

SEQ ID NO: 2055 - protein, 287 aa, Mycobacterium paratuberculosis
MTEGMVAVPGGQVWFQRTGGGAGLPLLVIHGGPGLPHDYLRSLRRLATDREVIFWDQLGCGNSKCPPNPGLWTMERSVAEVDAVVRALRLDRFHLFGNSWGGMLAQQYVLDAAPAGAASLTISNSIASIPQFAKMVARLKSELDPATQAAINRHEAAGTTHDPEYQAAIRTWNETYLCRVRPWPRDLEDAFRKMSAEVFETMFGASDFHIVGTVRDWDVFDRLGEIAVPTLVLAGRYDECVPEHMWEMHRRIPGSRFELFESSAHMPFIEEPEKFDAVMRDFLRLHD

SEQ ID NO: 2056 - protein, 177 aa, Mycobacterium paratuberculosis
MGGTNMTSVANPIPPQDFSGIVGHRFIYTYANGWQYEMYVKNATTIDYRIHSGHVGGRWVKGQEVNLVQLDDDSYKISWTEPTGTCVAVNVLPSKRRIHGVIFFPQWIRQHGERTVCFQNEHLDEMRAYRDRGPTYPIYEVPEFAYITLFEYVGTDDETVIDTAPGDLPRGWSDRTN

SEQ ID NO: 2057 - protein, 389 aa, Mycobacterium paratuberculosis
LHLLVELEKTVAEAVIVSALRTPIGTARKGTLRDTSAFDLAHHVVSEAVKDIDPTQVDDVILGEGLYGGGVLARHAAITAGLTQVPGLANNRHCAAGQAAVQSAAASVRAGMDQLVIAGGVNSASTSPRSRMQVDGEWVDWFPPTHPDRPDAPNMDMSITVGWNAAVKAGVSREEMDAWALRSHRNAIAAIDEGRFKEEIVPIDTPHGLFSVDEHPRRDTSMEKLAALKPLHPEIEGFSITAGNACGANDGAAVLTIASDRLGLRPLATIRSWASVGVDPAITGLAPVEAIPKALGRAGLSISDVDLFEINEAFAAMCVATVKLLELDPDKVNVSGSGCSLGHPVAATGARMLVTLVHELRRRGGGIGVAAMCAGGGMGSATVIEVAGE

SEQ ID NO: 2058 - protein, 295 aa, Mycobacterium paratuberculosis
MTIGELIDRARNGSPRAAGRLLSLVEGERRDEVLTAIGPAPRDTGPVIGITGPPGAGKSTTVAALVGAYRRRGCRVAVLAVDPSSPFSGGALLGDRIRMAAHINDSDVLIRSVATRGHLGGLAAAVPAAIRLLAAIGYDVVLLETVGVGQSEIEIAAVADPTVVILNPGAGDAVQAAKAGVLEVADIVAVNKADRDGAEQTVRDLRAETSAPIVSLIAARGEGIEDLMAVIEDHRRTDSRARRLARARAQILSLAQTRLRTQPALDRLAEAVVDGTQDPYTAADRLLSPSRTETD

SEQ ID NO: 2059 - protein, 297 aa, Mycobacterium paratuberculosis
MTAPEHDDRLEPYRRMWVLRLLDMALDESGVGAAIDDDAPVDFGQEAVAVGAVAALRPGDLVNATTPRFRHAQQIGLGLPLGPAIAELLGTTRGGAGGSRKSGAADWKQALANESALGQSTLFALGDANAQRMAGDGRVTLCAIAGSDTHSVEFATAAKIAASWRLPVVFVVQNVRGGPDARRCAYRSETMPMALVDDRDVVAVGDSVGQAVRRASAGGGPSLVEAITYRTNHPVAIDPLVLARRRLMADGIDPDRLVEVERGARHLVAEAMACAKALVRARRFDAVSAPDRWSAAS

SEQ ID NO: 2060 - protein, 217 aa, Mycobacterium paratuberculosis
MADPATRETVRVVVADDHPLFREGVVRALVSSGAVNVVGEAEDGSAALELIKSHQPDVALLDYRMPGMDGAQVAAAVRADGLATRVLLISAHDESAIVYQALQQGAAGFVLKDSTRSEIVKAVLDCAQGRDVVAPALVGGLAAEIRQRAEPTGPVLSAREREVLHRIARGQSIPAIAGELYVAPSTVKTHVQRLYEKLGVSDRAAAVAEAMRQGLLS

SEQ ID NO: 2061 - protein, 429 aa, Mycobacterium paratuberculosis
LGAPMSRLLVCLGSTGADEYGDRVAVAGDAELERVRAVHQMRSYRIGSVLRVGVVGLMVAAMIIGTARSEWPQESVLILLYGIIALGAVALAFAPFRRWIGTGRLAGVGRLEPFAFTVVDILALTIFQLLSTNGIYPLLIMAMLPVLLGLDVSSRRAAVVLIFSMLGFAIAVLQDPVMSSSVRLPEAGFRFLLYGFLCCAAFLVVRIEERHTRSVAGLSALREELLAQTMNASDVSQRRISEFIHDGPLQDILAVRQELVELDAAVPDDEHIGRALAGLQLASERLRQATFELHPAVLEQVGLGAAVQQLAEFTAQRSGIEISTDIDYSGRSAIDAVVFGVVRELLSHVVQHSRARTAAIMLGRTDGTCVLHVVDDGVGFNQETVARRLGEGHIGLASHRARVEAAGGELVFLDVPVGTHVCVEVPLRN

SEQ ID NO: 2062 - protein, 507 aa, Mycobacterium paratuberculosis
VQVYEKAPTVGGTTAVSGGIVWIPAHNRCPDGELTAADALKYLRAQSLGSMDDELVETFVRTGPAMLDFIEAHSGLHFEIATGFPDYRPELPGGRPRGGRSLSAVPFDLAQLGEWATRITSFPADWSNVGFDAETRARLHAAIDERTGHLCVAGTALIAGLLKGLLDLGVTPRVNARAEELVAEDGEITGVRIASAEGRIGVRARRGVILGTGGFEWDPVLVQAFLRGPMHGAVSPPNNTGDGLRMAMAHGADLANMGEAWWVPIVQIPGDTIDGKPRSRSVRLERTRPRSIIVNAAGRRFVNEACDYNSMAGAFHYLDPRGGYVNDRGWMVFDSVHLQRYGFLGVEPGQPVPDWFCESADLAELAAKTGIDADGLARTVENWNRYVVAGVDPDFGRGSSAYDGYWGDDSATTQAGKTLGPIDTAPYYAVPVSIGAMGTKGGPRTDRDARVLHVGGEPIPGLFAAGNAMGGVTGRAYGGAGGTLGPAMVFGYRAGHAAATGKSVDLQ

SEQ ID NO: 2063 - protein, 225 aa, Mycobacterium paratuberculosis
VTGSGTGSQTLARGLTALQMVADAPAGLTVQQLADQVGVHRTIAYRLLTTLAEFRLVAKGEDGRYRPAAGLAVLGASFDRNVRQLCLPTLRALADELGTTVSLLVAEGDQQVAIAVIVPSHVAYQLSFHEGSRYPLDRGAAGIALLACMPPRPGERELVSRARERGWVTTYGEIEPNTYGLAVGVRRPAPSPPTCINLISHREDVVMRGKDAVMRAAEQLSKLLS

SEQ ID NO: 2064 - protein, 287 aa, Mycobacterium paratuberculosis
VAEFESIWSDLQGVAFEQGYLDAGGIRTRYLRAGDPGKPVLVLLHGSGGHAEAYVRNLAAHADHFWTWSIDMLGHGYTDKPGHPLEVRHYVEHLMTVLRTIGVERASISGESLGGWVAARAAIDHPDVVDRLVLNTAGGSQADPVVMQRIIALSMAAAENPTWETVQARIKWLMADKSRDYDDLVASRQRVYRQPGFVAAMRDIMALQDPEIRARNILGPAEYGSIIAPTLVLWTSDDPTADVSEGRRIASMIPGARFEVMPGCGHWPQYEDAKTFNRLHLDFLLGR

SEQ ID NO: 2065 - protein, 580 aa, Mycobacterium paratuberculosis
MIAPGPRATDHDTDVLVVGAGPVGLTLANILGLQGIRTVVVEERDTLIDYPRGVGLDDEALRTFQSIGLVERVLPHTVPNQILRFMDAKRRVLAEMAPPDARFGWPKRNGFVQPLVDAELLAGLDRFAHVQVRWGSPMTGCREDADGVNVELGADGGNVGDGGGDGHPARLRARYVVGCDGGRSMTRRVMGVSFDGTTSSTRWLVVDIANDPLGHPNSEVGADPERPYASISIAHGIRRFEFMIHADESDEQAEDPEFLTRMLARMVPHPDRVDVIRRRVYTHHSRIAGEFRRGRLLLAGDAAHLMPVWQGQGYNSGIRDAANLGWKLAAVVSGRAGDKLLDTYDMERRKHARAMIDLSTMVGRVISPTNRRVAGARDLLVRSASIVPTLKRYVLEMRFKPMPRYEQGAVVHANPGRADSPVGTLFIQPRVDTRDQQDVLLDDVLGPWFAVLCWNNNPRKILGETAFANWKALGARFFALRPATQLHWTGHDDPDVVVVGDRRGDLKSWFDTHAESVLFLRPDRCIAGACIAQRAPDLSAALFDALTLTPRGGDPQSGTGSVLYVAQPAPESSGAVAGPA

SEQ ID NO: 2066 - protein, 316 aa, Mycobacterium paratuberculosis
VIRKVALALCCMSHSPLLNLPGPSRDLLDDIDAAIARARGFVEDYDPQLVVIFSPDHYNGFFYKVMPPFCIGSSASGVGDYGTHAGPLDVPEKLAVDCAQAVLDAGVDIAVSASMDVDHGTVQPLEKLFGTAISRPVIPVFVNAIGVPLGPMHRCRALGAAVGTYLATLDKRVLVMGSGGLSHSPPVPTLATAPEPVLQRIVHGAPMTAEQRQARQAAVIDAARSFAAGDSALQPLNPTWDHRFLEIIDRGSLSELDRWSNSFVTHEGGGSAHEIRTWVAAFAALQAAGPYETTMRYYTPAPELIAGFAIRTARPK

SEQ ID NO: 2067 - protein, 575 aa, Mycobacterium paratuberculosis
MTDFDHVVDVLIVGSGGGGMTAALTAQAAGLDALIVEKSSHFGGSTALSGGGIWVPGAPAQRREGYSPSPEGVVEYLKHITDGLVSEARIRQYVETAPQMLAFLENLSGWFEFVWKPGYADYYPELPGGSELGSTINVPPIDLRKLGPDEHTLLQPLALAPKGIWLGPKELRTFYRIRQSWAGKAVLLKLIARMVRARVFGERMAAIGQSLAARMRLALRDRGVPLWLDSPMVRLLTDPQGAVSGAVVEREGKPQRIGARFGVILASGGFDHDLAWRKELLPEVDQDWSFGNPAAMGDGIRAGQNVGAATDLLDEAWWFPAIQWPDGRMQFMLNERMMPAQFIVNGAGRRFINEAAPYMDFGHAMIEGQRSGVTHIPCWLITDHRSWNRYVIGGHLPLPKIPGAPVPTGRKIPPAWLESGVVKAAMTWDEMAAQIGVPAGELAETARRFNELARKGHDDDFNRGDSVYDNYYGDPTLPNPNLYPLGDPPYYAFRIVLGDLGTSGGLRTDEHARVLRADDTVVPGLYAVGNTSAPVMGRSYAGAGATIGPAMTFGYVAAKHVAAQVANRAANTHRR

SEQ ID NO: 2068 - protein, 436 aa, Mycobacterium paratuberculosis
MKISLFYEFALPRPWAPDDEHVLLQECLDEVEAADKAGFSTVWLTEHHFLEEYCHSTAPEIFLAAASQRTKNIRLGFGIMHLPPAVNHPARVAERIATLDLLSNGRVEFGTGESSSVGELGGFNIDPADKRAQWEEALEVAIRCMIEEPFSGFHGEHVQMPARNVIPKPLQKPHPPVWVACTRPASVQMAAQKAIGALSFAYTGPGPLTERVNGYYKEFEENGVPVTPAINPNILAIGGDLSMMVAKTDEEALQRLGKGGGFFSFGIMHYYMTGVHTPGRTGVWKRYLEEVEKDPTLAYGPGRGAIGSPATVREFLRGYEESGVDEIILLLNPRSHEGTMESIELMGKEVLPEFIERDAKAVADKATRLAPVIEKVEARRPKSTAPQFDENYSFGGLPTGRGGKFTASEIPEAMAEINEGRVQAAQRAKEQQQQKK

SEQ ID NO: 2069 - protein, 275 aa, Mycobacterium paratuberculosis
VAEIDALWRYDRRRAVVTGCASGIGEQVVRQLGQLGADVIGLDQRRPGCALGEFHEVDLADPESIDRAAAGIDGPVDALFNIAGVSSGIGNPPLVVTVNFLGTRQLTEALIPKMVAGSSIVSVSSLAAAGYREHLRQAAPLLDTATMREGIDWCTSHPEELGTGYQLSKEALILYTMRSVTPLGARGIRINCTGPGVTETPILDQLRTAYGQGFLDDIPKPLGRVSRPAEQAAVLLFLNSDAASYISGQVVWVDGGNVGAAIARELEEGRTPWPV

SEQ ID NO: 2070 - protein, 329 aa, Mycobacterium paratuberculosis
VASVTDFRRAARDVSNWGRWGDDDELGTLNFITEEKIAQAASLVQHGKVFPLGVDFGSSGPQGAFGFRHNPIHVMTVDGGDAATLAQYGPGWDRNPTAAQMGPYFVDNLFRFNDDMIIMPLQAATQWDALSHVYYDDLLYNGVPAGSVTSLGARRLGIEKVDGKGITSRGVLLDLVRHRGAEVFLEHGNPITPQELDDVVRAQGVTIERGDILLIRTGWWTRYLETGNKTEPYSGLDWRCAQWLHDHEVAAVASDNLQVEDPVSGVDGVFLPFHLLTLGDMGLMLGEYWDLSALAADCAADGVYEFQLVAPPLRFVGAVGSPVNPIAIK

SEQ ID NO: 2071 - protein, 273 aa, Mycobacterium paratuberculosis
MEIHRKTMSVDGLVTSYLEAGEGDPVVLLHGGEFGASAELGWERNIAALAARYRVLAPDQLGFGGSAKVIDFVDGRGMRIRHVARFCELLGVESAHFVGNSMGAINLLTDATSDSPLWPVRSAVIICGGGEIQQNEHFEALQNYDATLPAMRRIVEALFFDPAYPADDDYVRRRHESSTAPGAWEAIAAARFRRPGATPSPTPSSARAYERIGVPTLVVEGGGDKLLPAGWSAQIAKQIDGARSVVVDDAGHCPQIEQPSVVNQLLMDFLATA

SEQ ID NO: 2072 - protein, 533 aa, Mycobacterium paratuberculosis
MPVPPAGDTPSERRQLSRRGFMAAGIAGGLALAGCGQSKPDPSRNTRMAAAIATAEAARPHSGRTVTAHLTPQPVQIDLGGPVVRTLAFGDSIPGPVIRAAIGDEVAVTVANRLDHPTSVHWHGISLRNDMDGAEPATPNIAAGHDFTYRFSVPNPGTYWAHPHTGLDEDTGLYLPVIVDDPAEADYDAEWIVVLDDWTDGVGKSPAQLYGELSNPNKPPRNPPETTTTSTNPTTTETSPVTTTETTSTTPTTAAAAPPGVGSSELLGGDAGAIAYPYYLVNGRIAAFPKTFNAKPGQRIRIRLINTASDTAFRVALAGHSMTVTHTDGYPVVPAQVDALLIGMAERYDVTVTAGDGVFPLVAVAEGKNALGRALLSTAAGSTPDPQFQPGELTKRVGTVEMFTATTPVNLGRPDAGLDLPIVLGGNMIQYNWTINGEPYSKTNPLLVHEGQRPTLSFENTTMMYHPIHLHGHTFQVIKPDGSPGARKDTVMVLPKQKLAAVLSADNPGTWVMHCHNTYHQVAGMETRLDYVL

SEQ ID NO: 2073 - protein, 268 aa, Mycobacterium paratuberculosis
VVNELAGKVAIVTGGASGIGRGIVERFVAEGARVVIADIETERGERLAAELGGEAVFRRTDVSDIEQVGALVAAAVEKFGGLHVMVNNAGISSPLRRLLDDDLADFHRVMGVNVLGVMAGTRDAARHMADNGGGTIINLTSIGGIQAGGGVMTYRASKAAVIQFTKAAAIELARYDIRVNAIAPGNIPTPILGKSAGDMDPEQRERFEARIREGMREDRPLKREGTPDDVAEAALYFATDRSRYVTGTVLPVDGGTSAGKAMRSKRQG

SEQ ID NO: 2074 - protein, 225 aa, Mycobacterium paratuberculosis
MTTIGRPVRTERASSTQEAILVAAERLYAEHGMFAVSNRQVSEAAGQGNNAAVGYHFGTKADLVRAIEHKHRGPVEQLREQMVAELLESGAGGGRDAELRSWVACSVRPLTDHLEELGNPTWYARFAAQAMTDPAYYNIIVKGALSSPSLVQVVEGINRCLPDLPAEVHFERNIMARNLLMHTCADRERALAAGTSTSHRSWRAAASGLIDAIVGLWLAPVTPYE

SEQ ID NO: 2075 - protein, 425 aa, Mycobacterium paratuberculosis
LKNDDTARNNTMSDTLTSTATEQTADIPDYPMPRQAGCPFAPPPDVMALAHDKPLSRVRIWDGSTPWLITGYEQVRELFSDSRVSVDDRLPGFPHWNAGMLSTVHKRPRSVFTADGEEHTRFRRMLSKPFTFKRVEGLRPTIQQITDEHIDAILAGPKPADIVSALALPVPSLVISQLLGVPYEDADMFQHHANVGLARYATGEDTVKGAMSLNKYLAQLVEAKMENPAEDAVSDLAERVKAGELSVKEAAQLGTGLLIAGHETTSNMIGLGVLALLENPDQLAVIRDAEDPKVIASAVEELLRYLSIIQNGQRRVALEDIHIAGETIRAGEGIIIDLAPANWDARVFPEPDRLYLHRSGADRNVAFGYGRHQCVGQQLARAELQIVFHSLVRRIPTLQLAIPIEEVPFKDDRLAYGVYELPVTW

SEQ ID NO: 2076 - protein, 390 aa, Mycobacterium paratuberculosis
MTTQTSPVSLYPPGGYGAPKNRRGHAVGSDVGLPEGTVVFSADNHISLADDIFYQRFPDDLKDKAPRIWYEDGAYQVGRKGQSFLPGDFSAVLMQYDDLPGAASTNIEARIQELHEDGVEKELAFPNAVLALFHYPDKTLRELAFRIYNEYIAELQERSNGHFYGAGLINWWDPQGTRKTLDELKALGLKTFLMPLNPGKDDDGNMIDYSSTAMRPVWDEIEAAGLPVTHHIGETPPKSPTEFNSVVVGMMINIDGFRETFSKYIFGGILDDHPGLRIGWFEGGISWVPWALQDAEHLVASYQHMFNRPLQHDVRYYWDTHMSASFMVDPLGLRLIDQIGVDKVMWSSDYPHNESTYGYSEKSLKAVVDAVGPANAAQIVSGNVTKFLGL

SEQ ID NO: 2077 - protein, 392 aa, Mycobacterium paratuberculosis
LRRDTGTRLRAAMAERGVDAMILLGNNAVVYATGASWPLGDAGLSYVERPVAVVLADDEWPHLFLPFREGAAHESDLPADHLHGPVYLEFDEGVAAFARTVADLIPANAVIAVDECTGAMSRAAATLFPRGAPVDAAAIVGAAKAVKTPDELSCIRTAIRITDEAMVEVQKRLAPGIRQIDLSASFLRRAFELGATASMLEPIWQVMPPSKAEGVWTTHGDLALPLLSTARELDEGDVLWTDVSITYQGYCSDFGRTWIVGRDPSPRQQAQFDKWFEIMTAVLDVAKAGATAADLGRAAIGANGGAKPWLPHFYLGHGIGVNAAEMPMIGTDLGQEFDENFVLQAGMVLVLEPVVWEDGTGGYRSEEVLVITEEGWIRLTDYPYDPYGRHVS

SEQ ID NO: 2078 - protein, 375 aa, Mycobacterium paratuberculosis
MSVEVCPDERTLRSGRRRRALDQMAAHDLDVLVLGRQANVRYVSGAPQLWVAGTRPFGPTCVLVRETGAVHLLSTWDEGVPEDIPHENLYGISWNPANTVAALRRIDGSQTARRVGTDALSPVFAQLLPTVFPNAQLVDGELAMRAARRVKTAEEIVALRESIAVAESALAAAVSELRPGVSEQALAGVLLEASAAGGVSTPSNQDVAWATSRSHPWRRADGDGRIQDGDLVAFSAGVLAGGYVGEVGRTWPADKKHAPSGAAALHRRWDALWDKLIAACHPGVRADELMTAYRAAGEPAPPMPVARGLGMGFDPPVVSQHLPATAAGERLEPGMVLAVTGYVWEEGVGAVFGREAVLITADGPEVLTASPFWQP

SEQ ID NO: 2079 - protein, 815 aa, Mycobacterium paratuberculosis
MPRPGEANEVVTQPPLAGYTVIDLSTGIAGAYCTKLLADGGAVVVKVEPPQGDPLRTWSASGAPVPAGGDGALFSFLAGAKHSVVADPANEDDTALVHRLLAAADAVVWSGGSTVAEHHDFTPRAIQARHPHLTVTSITPFGLEGPWRDRAATEFTLQAWSGGIIGLGRGEQHRPPVFVGGQVGEYLAGAYASAATLASRWRRIHGGPGELLDLSMLETQILCLTYYPVTYFEVLGRPWRDTRRPTVPGVAQAKDGLVDVGCGTAQQWFDLCAMVGHPEWIDEDSPLSITELANIYADEIFAWMARTPVEEIRELATAFRIPYAPVANGANVTSFDQFRERGSFVRNPRDGFLQPGHPYRMHPAQLRAPHPAPRLGEHTEGYRGAELTPRPAPDGGRAALPFNGLRVLDLTTFWAGPCCTHFMAMLGAEVIHVESTRRPDGTRLIAGVPVSEDRWWEKSPIFEALNTNKKGLTLDLQSPRGRDVLRRLIATCDVIVENFTPRVLDAIGLDFATVQSIRADAVMVRMPGFGLTGPWRDNPAFAYVIESASGLSWLTGYPDRTPYDPYSIGDPCAGVHALNAILLALEHRRRTGEGVFVEAAMVDAALSIAAEQVIEYSAYGALLERAGNRGPTAAPQNLYLSADVDEFGRLDSWVAIAVATDDQWQRLCRALGSPSWAMDPELSAASGRRTHQDFIDKQLAAWCECRGRDDIVATLWDAGVPVAKVMQPHRQSELEQLTFRGFFEEVDHPVNGPARLSTVPMRSSAGPDRFHTAPAPLLGQHNQELLSGLGLSDADIATLRAEGVIGSAPAIHPAG

SEQ ID NO: 2080 - protein, 269 aa, Mycobacterium paratuberculosis
MAIDPSDILLTDRVAVVTGAGAGIGRGIAAGLAAFGARVAIWERDAQTCTRAAESIGGLGIVTDVRDSGQVDAALQRTITELGTPAILVNNAGGVFSSPLLETSENGWDALYRANLRHVLLCTQRIARQLVSVGAGGSIISLTSIEGVRAAPGYAAYAAAKAGVINYTKTAALELAPHGIRVNAIAPDITLTEGLEQLGGEAATTAMGNIVPLGRPGHVDEIASAAVFLASDMSGYLTGQTLHVDGGTQASSGWYHDPRTGDYRLGPAG

SEQ ID NO: 2081 - protein, 280 aa, Mycobacterium paratuberculosis
MDGFLSGFDGRAAVVTGGASGIGLATATEFARRGARLVLSDVDQPALEQAVNGLRGQGFDAHGVVCDVRHLDEMVRLADEAFRLLGGVDVVFSNAGIVVAGPLAQMNHDDWRWVIDIDLWGSIHAVEAFLPRLLEQGTGGHIAFTASFAGLVPNAGLGTYGVAKYGVVGLAETLAREVKPNGIGVSVLCPMVVETKLVSNSERIRGADYGMSATPEGAFGPLPTQDESVSADDVARLTADAILANRLYILPHAAARESIRRRFERIDRTFDEQAAEGWTH

SEQ ID NO: 2082 - protein, 315 aa, Mycobacterium paratuberculosis
MTEFKVGKTRGPGKRVCSPLRRADPIKSGVEVAMTGRVEGKVAFVTGAARGQGRSHAVRLAQEGADIIAVDICKPIRAGVVDTAIPASTPEDLAETADLVKGHNRRIVTAEVDVRDYDALKAAVDSGVEQLGRLDIIVANAGIGNGGDTLDKTSEEDWTEMIDINLAGVWKTVKAGVPHMIAGGRGGSIILTSSVGGLKAYPHTGHYVAAKHGVVGLMRAFGVDLGQHMIRVNSVHPTHVKTPMLHNEGTFKMFRPDLENPGPDDMAPICQMFHTLPIPWVEPIDISNAVLFFASDEARYITGVTLPIDAGSCLK

SEQ ID NO: 2083 - protein, 216 aa, Mycobacterium paratuberculosis
VTNPSEEPAWKQRAVERSIKTAKLRAAQRVQRFLDAAQAIIIEKGSTDFTVQEVVDRSRQSLRSFYLQFDGKHELLLALFEDALSRSADQIRAATESHTDPLERLQVAVQLLYEASRPDPTAKRPLFTDFAPRLLVTHPAEVKVAHAPLLALLTELMEAAGEAGKLRTTINPKRVAAMTMQTVMFIAQSSGGPDDATTHPITAEEVWDFCSRGFVA

SEQ ID NO: 2084 - protein, 403 aa, Mycobacterium paratuberculosis
VREASSGSRGSAVQLTFDADVEAFRAEFVAFLDAHLPAEAEALERPRSSSHVPEWARRWQRLLFDSGWLLPGNPPEFGGRNATLLQQYVYFEELGRRRIYQSFNPQGVGIIAASLLSFGTPEQKQRWAVPILRAEMTASLGMSEPGAGSDLASLKTRAVLDGDRFVVNGQKVWTSGAHDADVLLTFVRTDPNAPKHKGISVLLIPTDTPGVVRRPFASMCDIDEIDFNEVFFTDARVPAENLVGELNEGWRVATGSLGHERVMLWMGYVDLLHELSADFRPADALQRDRYATLVMDAHALRLLGSAALAAAARGEEDVPAQSVLKLLGSEALQRASEDALEAAGSAGLVRRAVTAQVAPLNLDSDYRSWFDRYARTFAATIAGGTSEIQRNIIAERVLGLPRN

SEQ ID NO: 2085 - protein, 89 aa, Mycobacterium paratuberculosis
MSDPQPPRNEFGVASVLLGLVGLVTCWLLLGVPFGIAAVVTGDIARRRVARGEASNPRTAMTGIVLGAVAILAGLVAISYYARMDAQNR

SEQ ID NO: 2086 - protein, 228 aa, Mycobacterium paratuberculosis
MPDIAIPLVFTLLGETGAHAPLLNDVLLCAAGEAPEGTLALPFTGGSWVLWERRDSCDSAIDELLPIHRVPQGDPLPDAALHAGWRALGWWLVGTSRAMLTLARRHAVDRVQFGRHISSFQAIRHRLAEALVAVEGAEATLQAAAECDEDPGLAALLAKAAAGQAALTTARHCQQVLGGIGFTAEHPLHHHIKRSLILDGLLGSARELTRQAGKTLVTTGSAPRLAQL

SEQ ID NO: 2087 - protein, 359 aa, Mycobacterium paratuberculosis
VARRQRSDPRARPFPAGPHEAVRPGQPRSLRRRLDAVRVAGRSRWPAEVGGLGGPAVLRAVVGEEVVGRRLAEPGPYSMLEVLAPTMIDYAPAELAAEMVPRLLRGEEHWCQGFSEPGSGSDLASLTTRATQDGDHWIVNGQKVWTSFAQFSTRCVLLTRTAPGYDGITAFFVDLDTPGITIRPLRTMHGVDEFCEVYYDDVAIPSSRMLGRPGDGWRLAMDLLPYERSSCFWQRIAYLYSRFDDLIAEVSAAGEPDESSLGAAYLALHTLRCRSRATQHRMLDGARLGPDTSIDKVLLATAEQRLYDTVRDLLPGTLELENTPWRSEYLYSRAATIYGGTAEIQRNIIARRLLDLGKE

SEQ ID NO: 2088 - protein, 148 aa, Mycobacterium paratuberculosis
MSTTRTDDLVEIQQLLARYAVTITQEDIDGLVAVFTPDGTYSAFGETYSLNRFPELVAAAPKGLFLTGTAVVDLDGDQASGTQPLCFIDHATHDMRIGYYRDTYVRTPDGWRLKTRAMTFIRRSGVHDSGRPHAIGRPAGDSAAQAAT

SEQ ID NO: 2089 - protein, 409 aa, Mycobacterium paratuberculosis
LQTIKAAGLFDVDAGEIVRPGILRVDGDRIVGVGDSGPTGADDNVIDLGEAILLPGLMDMEVNLLMGGRGEKPGLSQVQDDPPTRVLRAVGNARRTLRAGFTTVRNLGLFVKTGGYLLDVALAKAIDAGWIDGPRVVPAGHAITPTGGHLDPTMFAAFAPHALELTVEEGIANGIDEIRKAVRYQIKHGAELIKVCHSGGVMSLTGPPGAQHYSDEELRAIVDEAHRRGMRVAAHTHGADAVKHAVAAGIDCIEHGFLIDDEAIASMVEHGTFLVSTRRLAEGMDVSHAPPELQAKAAQMFPKSRTSILAAHRAGVKIAVGTDAPAIPHGRNADELVTLVEWGLPPVAVLRAATVTAAELINSSDRGRLAEGYLADVIAVPGNPLEDITVTQHVSFVMKGGKVYVHNQN

SEQ ID NO: 2090 - protein, 109 aa, Mycobacterium paratuberculosis
MATSLPAEFADLEPYLEWDLATEPERYAKRLASSMSEMQAFYDAAFPRLNDVIAYCDQYPLDDLPEDAKTLMHMMQSLVMVSFPIEAWKQPRVPDSGAAWVELIREPVI

SEQ ID NO: 2091 - protein, 427 aa, Mycobacterium paratuberculosis
VPHFPKPAAGSWTENYPELGTGPVDYTDSIDPAFFEAEREAIFKKTWLNVGRVNRLPRTGSYFTRELPSAGKGTSVIIVKTKDGSVKAYHNVCRHRGNKLVWNDFPNEETSGACRQFTCKYHAWRYSLDGDLTLVQQEEEFFDLDKSNYGLAPVRCEVWEGFIFINFDDNAAPLTDYLGPLAKSIEGYPFGEMTETYSYRAEVGSNWKLFIDAFVEFYHAPILHQGQYTKEEAAKIQKFGYEALHYELAGPHSLQSTWGGQAPPPDMSMVKPMDQVLRSGLFGPWDKPEIIEKLDLPPGVNVKRVPQWGIDSWLFYPNFMLLIWEPGWFLTYHYWPTAVDRHIFESTLYFVPPRNARERLAQELAAVTFKEYALQDANTLEATQTMIGTRAVKEFLLCDQEVLIRHLHKTTGDYVKEYQNNGHVAAR

SEQ ID NO: 2092 - protein, 177 aa, Mycobacterium paratuberculosis
MRLQPLPAEQWDEATRQALAAMRGADTNNALSTLAHHPALAKAFLRFNVHLLTASTLPPRVRELAILRVAHRRQCAYEWSHHVSMAKDEGITDEQIAAVRCFAGDGAGPFDAFDHAVLAGVDELDEKSELSDRTWAALGERLDDRQRMDYVFTVGCYTLLAMAFNTFGIQLEHAEQH

SEQ ID NO: 2093 - protein, 432 aa, Mycobacterium paratuberculosis
MNKEDMILISVDDHTVEPPDMFKNHLPKKYLDDAPRLVHNPDGSDGWKFRDTVIPNVALNAVAGRPKEEYGIEPTGLDEIRPGCYNVDERVKDMNAGGILASICFPSFPGFAGRLFATEDNDFSIALVQAYNDWHIDEWCGAYPARFIPMAIPVIWDAEECAKEVRRVSKKGVHALTFTENPAAMGYPSFHDEYWNPLWKALVDTNTVMNVHIGSSGRLAITAPDAPMDVMITLQPMNIVQAAADLLWSRPIKEFPDLKIALSEGGTGWIPYFLERADRTFEMHSAWTHQDFKGKLPSEVFREHFLTCFISDKVGVALRNEIGIDNICWEADYPHSDSMWPGAPEELWDVLSINNVPDDEINKMTYQNAMRWYSFDPFTHISREQATVGALRKAAEGHDVSIKAQGHDKDSRGGSSFAEFAANAKALTGNKD

SEQ ID NO: 2094 - protein, 388 aa, Mycobacterium paratuberculosis
MDFALTEDQELIRRSVAELAGKFDDQYWMEKDQAHEFPTEFYNAIAEGGWLGMTIPTEYGGHGLGITEATILLEEVAKSGGAMNAASSIHLSIFGMQPVVVHGSDELKARTLPAVATGQVHVCFGVTEPGAGLDTSRITTFAKRDGDRYIVNGRKVWISKAMESDKILLLTRTQAYDEVTKKTDGMTLFITDLDRSRVDIRPIRKMGRNAVSSNELFIDNLEVPVEDRIGEEGKGFQYILDGLNPERMLIAAEALGIGRVALDKAVKYGNEREVFGRPIGMNQGLQFPLADSLARLDAAELMLRKATWLYDNGKPCGREANTAKYLCADAGFTAADRALQTHGGMGYAEEYHITRYFREARLMKIAPVSQEMILNFLGANVLKLPRSY

SEQ ID NO: 2095 - protein, 384 aa, Mycobacterium paratuberculosis
MRETVIVEAVRTPVGKRNGALSGMHAADLSAIVLNELVERTGIGPELIDDVVWGCVSQVGDQSSNIGRYAVLAAGWPESIPGTTVNRACGSSQQALDFAVQAVMSGQQDVVVAGGVEVMSRVPLGAARATGMPYGPKVLARYDDFSFNQGLSAEMIAKKWGFTRTQLDEYSVRSHERAAAAQDAGAFTDQIVPVFVEDAENKVVAADEGVRRGSSVEKLAALKPAFAEDGVIHAGNSSQISDGAAALLVTTAEMAVELGLTPIVRYVAGAVTGADPVLMLTGPIPATEKVLKKAGVALSDVGVFEVNEAFAPVPLAWLAETGADAARTNPLGGAIALGHPLGASGAVLMTRMAHHMRDNGIRYGLQTMCEGGGTANATLVELVS

SEQ ID NO: 2096 - protein, 204 aa, Mycobacterium paratuberculosis
LPVARRYDTLLAKGEDRKQRILDVAQRLLTRNGWRNTTLAQIAGEAGVTPAGLLHHFESKEQLLHAVLDARDLDDDTHADRTGDLFDQIAAVADRFYRAPELVGTFTVLLVENILPEAPLHDRMLARHRAATDIVADLIRRGQADGRYRADIDPAVKAVEILAFVHGMETTWLLDPSIPLPEVFKQYAETLARDFAPPKRAETT

SEQ ID NO: 2097 - protein, 175 aa, Mycobacterium paratuberculosis
MRYRLDVVAATAVDVVRFAGGWIFDRSMAGWDVTVLLMDLAEEPDPRPLQIVGAQVLDLEEALASVHARPRPQALAAGADLFGCDARVRQGVLQALDHGVTEVTLWGETWPSELDDSVGLVQHRLSMAAQTFKAKALAAASGVDGAPQVAVDRVETFRSGLLAWPSVAADLVPAS

SEQ ID NO: 2098 - protein, 424 aa, Mycobacterium paratuberculosis
MTNEFSELDFFRGSELIENPYPYYEALRQRCPVTKESHHNVTMITGWDEACAVLNDAETWSSCISVTGPFPGFPVPLEGDDVTELIERHRDELPFSDQLPTLDPPTHTNHRSLLMRLITPKRLKENEDAMWVLADQALDTFLAPGHGEFIKGFAGPFTLLVIADLLGVPEEDRDKFVKGIRQHSGGGVGGTGEETLAHSPLEFLYGLFFDYVRDRRRQPREDVLTGLATATYPDGSIPEVEDVARVASNVFSAGQETTVRLLGAALQTLGERPDIQAQLRKDRSLIPNFIEESLRHESPVKGDFRLNRRPVTVGGVDLPAGTTVMVVQAAANRDPRRFDDPATFDPARKNARQHISFGRGIHSCPGAPLARAETRVAIERLLDRTTDIRINENIHGPANDRRYQYVPTYILRGLTELHLEFTLA

SEQ ID NO: 2099 - protein, 62 aa, Mycobacterium paratuberculosis
MRVWVDDQRCRGHGMCLTLCPEVFSLTDDGYAEAIDADVPTELESAAQEAIECCPEQAISEK

SEQ ID NO: 2100 - protein, 115 aa, Mycobacterium paratuberculosis
MLSRAGDQRKVNASKEIRVADGRKGYAILTEAIKDPEGMKAYAKAAGSAMSGATVLAVDTAPTVIEGTWHGDQTVVLEFESVDAARAWYESEGYQKAAKLRQAAADCNAVILAGF

SEQ ID NO: 2101 - protein, 67 aa, Mycobacterium paratuberculosis
VVTKKIEVDWGLCESNGVCMGINPDIFELGDDDMLTVHQEEVTPENEHDVREAVRQCPRQAISIVGE

SEQ ID NO: 2102 - protein, 401 aa, Mycobacterium paratuberculosis
VTKPKLVFDPYSEDYFNNPYEIYRRMREEAPLYYDEKEDFYALTRHVDVAAAFKDYETYSSARGCDLAMVRRGISPEQKSIIFMDPPEHRHMRSLLNKAFTPRAIQSQRETIIEVVDKYLSAADPDNFDVVQDFSGPFPVEVITRMAGVPEEYRQQVRHWIDTSLHHEPGQIEVSEAGMQANIDTAMYYFGLVQERRQDPQDDMISRLIAAEIPGENGQMRKLDDIEITGFATLLGGAGAETVTKLLGNAAVIFARHPDQWQKLQEDRDKIPGAVEELLRYEGPVQYNVRYTLKEAHVSGGVIPAGKPVFLCGAAANRDPEAFTDADTFDIERDQTEAQHLGLGYGIHSCLGAALARLESRIALERLLDFMPRYDVDWAGCRRVTMQNVAGWKNVPVKVLR

SEQ ID NO: 2103 - protein, 272 aa, Mycobacterium paratuberculosis
LMRVGFIGLGSQGGPMARRIVEGGYPTTLWARRPATLEAFADTDAKVAGSPAELAAASDLVCLCVIGDADIDELTGGEHGLLSAMQPGGVIAVHSTVHPDTCRKLAKRAAALGVSVVDAPVSGGGGAAAEGRLLVMAGGDADVVERCRPVFETYADPVVHLGELGSGQTTKLVNNLLFTANLATAATALSLAEQLGVRPERLTEVVSRSSGNSFALNALGGIGGLDQLAGVAGALLRKDVRLVVDLAEQAGAAGGAVLDAADAALALMGHPR

SEQ ID NO: 2104 - protein, 130 aa, Mycobacterium paratuberculosis
MVSNWARRDFPALAPAVRVPVHFSIAEHEKVWQNDASAMDEIAALFTGAPEFTVHRQPGAGHNISLGYTAADYHATVLSFANACAAAGPAPNVKLASRSAADGEPAEDGQPAEDGQQAAHETTAAQEEAG

SEQ ID NO: 2105 - protein, 198 aa, Mycobacterium paratuberculosis
VNGAAPRPRLVIVDGVPMSALVAEAEDPKAVLVAIHGGGTTAVYFDCPGHPSFSLLRAGATAGFTVVALDRPGYGSSAPYPEAMTRPEQRVELAYGAVDRILGQRPRGAGLFLMGHSGGCELVLRMAADERGADLLGIELAGTGRHYHPAAREILKTATRERRPAGLRELLWHPENLYPPEVLGGATVSPSAPSYEDQ

SEQ ID NO: 2106 - protein, 550 aa, Mycobacterium paratuberculosis
VSASGRPLPLVTEENEFFWTSGADGKLRLQECRSCASLIHPPAPVCRYCRSRDIGVRAVSGRATLAGFTVNHRFSLPGMPAPYVIAQVAIAEDPRVRLTTNIVECDPDRLELGQAVEVVFEQADDVWFPLFRPSAVGEPGPLPEDEIAPERFGDHVRPMLTTDKFEDKVALTGIGMSPIGRRLMQLPLALTVQACEAAIADAGLTYADIDGLSTYPGAINVAGMGEGGVTALEAALGIRPTWHNGAMETFGPGGSVIAAMLAVAGGLARHVLCFRTLWEATHAELMKQGKITPSMGRMQGWQMPFGATSAAHTLAMNAQRHFHRYGTTKETLGWIALNQRANAELNPTAIYRSPMTMEDYLGARPITTPFSLYDCDVPCDGAIAVIVSAVDAARDLAKPPVLVEAVGTQIIERTDWDQSTLTHEPQVLGQAAHVWTRTSLRPSDVDVAELYDGFSFNCLSWIEALGFCGIGEAKEFLDGGKNIARDGQLPLNTHGGQLSHGRTHGMGLLHEAITQLRGEAGDRQVADARVGVVSSGGLTPSGVILLRADR

SEQ ID NO: 2107 - protein, 132 aa, Mycobacterium paratuberculosis
LRTRRMTPSRRHRGAGSKGHPGAGDIGAPLVKAHTPHGFVGRPPGPRWRGRHVLPGKRRRVWRRGPVPVRRRRWHPALTRRPIPRHVAIALRGADSRRRCRRYRHTDERDRNDNRRTTDKPSHGGPPVGPSR

SEQ ID NO: 2108 - protein, 358 aa, Mycobacterium paratuberculosis
MTLGVSAYSGATATTRFVSPTPRPPSAVVAFRVAPGLCSKRDIKYFTLGGPLLEAEKILITGATGKIAFPIARALAAAGNEVWGVARLKDPAAREKLAAAGVKPVVLDVGAGDFSGLPEDFSYVLHAAVDTGAGDWNRCLETNAQRSGELLYHCRTAKGFVFCSTGSVYAYQGRRPLTESDPPGVPLRANYSISKVAAEAVCTWVARHFQIPLTIIRICSTYGPQGGAPADRLEAMLAGKPIRLHPDKPNNYNPIYEDDYVELGIRAMEVAATPPVVVNWAGSETVSVEEYCTFMGQLIGVEPKFEYTERAHTPLWPDVTRMHAVLGRTKVPWRDGFRRMIEARHPEITLRQADPATS

SEQ ID NO: 2109 - protein, 247 aa, Mycobacterium paratuberculosis
MQLSGRPSDEVAEVLATGRGEITTLFVSMATRHPDGNDADYLRWHTLDHRPEQHRLAAVRASLRLVSTPACRAARAVGDGPLDAVDHVMTYFFTDASGLRGFNELSTALGDAGRKVPLLPPVQRGVYDVGRKVAAPRVKVGADVLPWLPVRGAVLLVERGSAPVDPLVEVDGVAGAWSASSRRIFADSGNAQQDQSITYCFVDDDPVATAQRMRQALTARWADAGVEPLFAAPFFAVVPYEWDRYVP

SEQ ID NO: 2110 - protein, 318 aa, Mycobacterium paratuberculosis
VRIGLMVGSDKERTRAERLAGLVDDAATAERGGFTAFWMPQVPGYLDALTAVALIGQATERIEIGTAVVPIQTRHPMALAQQALTTQVACGGRFTLGIGPSHHWIVNGQLGLPYERPARLTRNYLQVLGAAFAGPGSVDVDNESYCVHSPVDVTDSFGVSILLSALGPTMLQLAGERADGTILWMADERAIGDHVVPRITAAAGGAGRPAPRVVAGVPVAVCSNSEIDDARAYAGEMLGHAEFSPNYVRLLQHGDAEDVGDTMAAGDESAVLRRLRRYRDAGATDLAARIVPLGNDARERAESRRRTHEFLSSVCPAL

SEQ ID NO: 2111 - protein, 436 aa, Mycobacterium paratuberculosis
VNTTQSTTVVTAIAPGCRPRLLTGQPGREDLAAYRGLGGYRPLADGDQLLSEVEASGLVGRGGAAFPLGVKLRTVRDNGRAAPRAGGTVVVANGEEGEPASIKDRWLLRNRPHLVLDGLRLAAAVVGAERGYVYVSDPEAAHSVESALGELDPDTLGGVTVTLSTVPAGYVAGEETAAVRALNGGPAKPTDKPPRPFEAGVGDRPTLVSNVETLANLPFLQSHGASAFRAQGTPLSPGTFLATISGAGRPPVLYELVHGTPFTELLALHGVSADAVRGALMGGYFAGLLNRSVLQTTLDHETMRRFGSGLGCGAISVLTDDCPVAVAASVLAYFDRENAGQCGSCFNGTAAMAAAGGALRDGAATTEDVDRLRRWSVLLRGRGACATLDAATNVAFSLLDQFPDDVTAHLDGSCPDCTRGAFRADRPYQAEVARQA

SEQ ID NO: 2112 - protein, 157 aa, Mycobacterium paratuberculosis
MRTAVVRVNVDPKSECTAAQLRDGMAALLGLARAAGADVADNDLAAMPASRREVELLIAADHGDAARDVAVTLCAKAFQSTPVPGVVTFISRGTDDDAHGVLSGFGLTGDIERTAGDEGFDIVYVTLREQDLERIPESRIHTALEASLNCEVHIRTR

SEQ ID NO: 2113 - protein, 288 aa, Mycobacterium paratuberculosis
VPSIEVNGGNVVYEILGDSGDLIALTPGGRFSMQIPGLRPLADALVAGGYRVLLWDRPNCGASDVQFYGQSESHMRAETLHKLVTGLGFERCILAGGSGGARDSMLTTMLYPEMVTKLVVWNIVGGIYGTFVLGSFYIIPSILAVRGTGMDGVIKVQEWRERIEENPANKQRFLDFDSGEFLKVMLRWLNAFVSKPGQTIPGVEDEMFDRITVPTLIIRGGENDMDHPKRTSLEVSCLIKGSKLIDPPWPEDAWERASEDRAAGRVQHFNMFDTWVQAAPAILEFLGS

SEQ ID NO: 2114 - protein, 113 aa, Mycobacterium paratuberculosis
VATVDEIPPGTHKLVPIGRHGVGVYNVNGTFYAIANYCPHQGGPLCSGRPRGRTIVDETAPGDSVMVRDLEYIYCPWHQWGFELATGTTAVKPEWSIRTYPVRVVGNDVVVQA

SEQ ID NO: 2115 - protein, 380 aa, Mycobacterium paratuberculosis
MTLTHMQERVPAAERIAVRCVDSDVHPVPKRGEITPYIPERWRKFFFEHRVGELIYYDAPDYAHAFAMRTDTFPPDGEFPGSDPDMAFRQLIMEAGSDIAILEPAGRTPRIGEAHQAYCSALNDWQANHWLDSRNNWHERWRGSICAAIEDPEGAVEQIEKWAGHPYMAQILIKAEPRPSWGHPKYDPIWAAATKHDIVVSCHLSRSNYEMLPTPPVGFPSYNHDFMVTYSLLAANQVMSLIFDGVFDRFPTLRIVFVEHAFTWILPLMWRMDAIYEARKSRVEIKRKPSEYVKDHIKFTTQPLDYPEDKTELTRALEWMECDKILLYSSDYPHWTFDDPRWLVKHLPKAARDAVMYKNGIATYHLPETVPVLEGQVRVL

SEQ ID NO: 2116 - protein, 366 aa, Mycobacterium paratuberculosis
VALVIEHADGTRTPVIDASVHIFFPSNKDLRSFLREPFKSRGFPDYEMDWYGAPGSEYAPNTDGPDGQYPGSDPEFVAHELFSKRGVDVAVLHPMGRGIMPDRHLGSALHAAHNEMMVSRWLDSPEFGEKFRGTIRVNPDDIAGALRELERWRSHSRVVQLGIPLQSRELYGKPQFWPLWEAAADANLPVAVHIETGEGIGFPPTPSGHTQTYEQYVSFMALNYIYHLMNMIAEGVFERFPALKFVWADGAADFLTPFMWRMDTFGRPHLEQTPWAPRIPSDYIPGHVYFVQGSLDGPGDADFAAEWFGFTGKEDMVMFGSSYPHWQCADVHKLPPALSAEQREKLCWRTAADLYGIDISVDLAAS

SEQ ID NO: 2117 - protein, 297 aa, Mycobacterium paratuberculosis
MTIGFIGLGNMGFPMASRLIREQHDVVAFDSRREALERLVAAGARPASSPKEVADGAETVLASLPTPGASLEVATGTAGVIEGARVKRYVDLSTVGSRTAMRIHDLLARRNIVAIDSPVSGGVGGAEQGTLALMVSGPRGEFDVIRTTLEALGRPFYVGDKPGAAQTMKLANNILAANVLAATAEVVVMGVKAGLDPAVMIEVLNAGSGATSASRDKFPRAILPRSFDYGFATGLMVKDVRLYLDEASALGVPAEVAETIARLWETTAREEGPEADFTTVIKPLERAAGVTVGRSAR

SEQ ID NO: 2118 - protein, 175 aa, Mycobacterium paratuberculosis
MRPGSPPPRTGTVRLTLDCRPADPGHGVRLRSGNRSLSEGPQRRRSALDRERYERGLRIRSDVLGEQYVNRALADADEFTRPLQDLVTEYCWGAVWGREELPRKTRSMLNLAMIAVLNRPNELRMHIKAALTNGVTREEIREVFLQVAIYAGVPAAVDSFRIAREAFAELDRENS

SEQ ID NO: 2119 - protein, 216 aa, Mycobacterium paratuberculosis
VAQATADVWEVMSTARTIRRFTDEPVDDATLARCLGAARWAPSGANAQGWRFVVLRSPEQRAVVAKAAAQALEVIEPVYGMSRPAPDDHSRRARTYRATYELHDRAGEFTSVLFAQAHYPTASELLLGGSIFPAMQNFLLAARAQGLGACLTSWASYGGEQLLREAVGVPEGWMIAGHIVVGWPKGKHGPLRRRPLAEFVNLDRWDAPADGLLSGL

SEQ ID NO: 2120 - protein, 346 aa, Mycobacterium paratuberculosis
MLFSPGRSRREAAPMLLEFDADQRLWQSTVRDAVTKQCPPSLVRSVAEEGVDPSPLWKSYVDQGWTELNDPESTVELAIVLEELGHATDPTPFLATMSQFAPLVGEHFDPHQSGTAVYGGVCAYRDADGWVLDGTARHVLDGDRVDRLAVVTDAGVFITAANQVSARRTAVFDPVLHVADLSLAEVRVPDSARLSVDPERAHHVALTGMAITMVGACQRILDLALEHVKSRQQFGVPIGSFQAVQHKAADMHVAVQRARALAYFAALTIAADDPRRRLAAAMAKASAGECQSLAFRHGLQLHGAMGFTWENDLQFALKRAKAGELMLGGAAEHRARIAEEYRAADF

SEQ ID NO: 2121 - protein, 391 aa, Mycobacterium paratuberculosis
VQLTFDPDVEAFRAEFAAFLDENLPPASETLDRPRSVSHMPQWARRWQRLLFDNGWLLPSQPPEYGGRNATVLQQFVYLEELSRRRIYHSFNPQGVNIVAASLLSFGSDEQKQRWAVPILRAEITASLGMSEPSAGSDLASLRTRAVLDGDHFVVNGQKVWTSGAHDADVLLTFVRTDPDALKHKGISALVIPTDTPGLVRRPFPSICSIDDKDFNEVFFTDVRVPAENLVGELNQGWLVANGSLGHERTMMWLGFADRLENMIADFQPGTEVERDQYATTIMDRQALRLLGSAALARAARGEDDVAAISVLKLLGSEAELRAMELALTSAGADGLVHPGQTGPYAHMNLDHYFASWFERYARSFSGTIAGGTSEIQRNIIAQRVLGLPRG

SEQ ID NO: 2122 - protein, 461 aa, Mycobacterium paratuberculosis
MRRGGIAMPSNHISLAHGWLPVAIQAVAGITLSLAAGWRSRRWRLLWLPSAAVLGVTTAVGAHRCISTRAPQALFVWIALAGMAIAILLLGWRGARWWRRGLSILAVPLCLLCSLLVLNQWVGYFQTVQSAWSQFTSGPLPDQTDRTTVTTLAARGAKPPHGSLVPVQIPEDASHFKHREELVYLPPAWFASYPPPQLPTVLMIGGMVNTPADWVRAGNAVDTVDAFAAAHSGNSPVLVFADPGGALDNDTECVNGGRGNAADHLTKDVVPYMISTFGVSKDPSRWGIVGWSMGGTCSVDLTVMHPALFSAFVDIDGDLTPNTGTREQTIADLFDGNADAWAAFDPATVIARHGRYTGVSGWFAVSSTGSPSPRRDVDSTAMAVAGRAATDPGDQAAAAASLCALGRANGIDCAVVAQGGHHDWPTAGTAFATALPWLAGQLGTPGVSRISLPSNVSRQAL

SEQ ID NO: 2123 - protein, 187 aa, Mycobacterium paratuberculosis
MSEDNRSSDAADDSADRPEPGRPRGRRNVKVVPIVLISLLLISGAGTAWLYFKEYLPDKRTDARVASAVVNAASDGTVALLSYSPDTLDKDFAAAKSHLSGDFLSYYNQFTEQIVAPAAKQKSLKTNARVLGAAVSDLRPDSAVVLVLVDQSTTSKDNPDPAMASSSVLVSLTKVNGKWLITKFDPV

SEQ ID NO: 2124 - protein, 295 aa, Mycobacterium paratuberculosis
MADAKKPPHDSATSDEDVKALLEEAEAEAAEAEALAAAARARARAARLRREAQAQAAKAAAETSEADEHAADDEAAETDDEVSDSVEATDADDTETTQAETKEAAKETEPKEEAAEETAEDAESESKARSRRLRLPSWSVAWKAAVIALICAFVAASGYMMWERHQTSERNQRIANFLAAARQGVVNMTSLDFNKAKEDVQRVIDSSTGQFRDDFQQRAKDFTTVVEQSKVVTQGTVNAAAVQSIDGNSALVLVAATSRITNAAGAKDEPRNWRLKVTVTDEGGQYKMSKLEFVP

SEQ ID NO: 2125 - protein, 414 aa, Mycobacterium paratuberculosis
VPDAWTDTYGGHRVAAGSHEVFELARCPAVSNDHDINGERRGYKGISIPTASRVSAVRGGILEMDDPEHRIYRTVLNPYLSPAAVKRWEPFIDEVTRAALDEKIEEGSIDFVDDLANIVPAVLTLAMLGIPLKKWKMYSEPVHAAVYTPEHSPDIERVTAMHREMGLDMVNNMLEIRENPRPGIVNALLQMRIDGEPAPDLEILGNLGLVIGGGFDTTTALTAHSLEWLSEHPEQRQLLSDERKTLLDPATEEFLRYFTPAPGDGRTFSEDFELDGTVFKEGERLWISWAMANRDPAVFHDPDEVILDRKGNRHFSFGLGIHRCIGSNVARTVFKSMLIAVLDRMPDYRCDPEGTVHYETIGVIQGMRKLPATFTPGRRIGAGLDETLEKLQRICDEQELARPITERKEAAVID

SEQ ID NO: 2126 - protein, 66 aa, Mycobacterium paratuberculosis
VKVWVDSQRCQGHTLCSMIAPDSFQLSDIDGSSSAIDEVVPADREDQVREAAQSCPEQAIMITDDA

SEQ ID NO: 2127 - protein, 233 aa, Mycobacterium paratuberculosis
MKTAVVTGGGSGIGLAVVERLRADGLNVASIDLRPSDAELAFTADVTDRSQVDAALSAIRAQLGPVTVLVNAAGLDGFKKFNNITFEDWQRVIDVNLNGVFHTTQAVLPDMIEAGWGRIVNISSSSTHSGAPYMSHYVAAKSAVNGLTKSLALEYGPKGITVNAVPPGFIDTPMLRAAEKNGFLGDIEETIARTPVRRMGTPQDIAAACAFLVSEEAGYITGQILGVNGGRNT

SEQ ID NO: 2128 - protein, 541 aa, Mycobacterium paratuberculosis
LNYRNSNVRFAGEENEIIVTATTSGGTGMPAQDTAEPVTGSSATAATADAAPAAHVDRRLLIDGRLVTAGTTFPSINPATGAVIGHAPDAGTAEAEAAIAAARRAFDGTDWATDVELRIRCLDQLHRALLEHADELRELTIAEVGATRALTHGAQLDEPIGIVRFYADLLRSYPFTEDLGEKESRGLRHHRWVEKEAAGVVGAIIAYNYPNQLALAKLAPALAAGCTVVLKGAPDTPLVTLALGELIANHTDIPAGVVNVLSSADPAAGVALTTSPDVDVITFTGSTAVGRQIMAAASQTVKRVFLELGGKSAAIILDDADFAGAALFAAFSMVTHAGQGCALTSRLLVPRSHHDEIVELIAQNFAKVRHGDPADPKTYMGPLINERQRDKVDGMVQRAVAAGATLVTGGKRLDPGFFYAPTLLTNVDPDSEIAQEEIFGPVLVVIAFDDDDDAVRIANNSIYGLAGAVFSGDQDRALAVARRIRTGSFSINGGNYFGADSPFGGFKQSGVGREMGVAGLEEFLERKTFAVVAGPAEGALA

SEQ ID NO: 2129 - protein, 401 aa, Mycobacterium paratuberculosis
MRPLEGIRVLEVAMYGFVPSAGAVLAEWGAEVVKVEHAVTGDPQRGLRQTGMLRVEGDPNPNIEHANRGKRSIGLDISVPEGKEVLYELARRSDVFLTSFLPAHRKKFGIDVDDIRTVNPKIVYARGSALGPRGAESEKGGYDMTAFWCRAGTAATITPAGMPGMIAPPGPAYGDTISGTNLAGGIAAALLKRERTGEPSVVDVSLLGSGLWSLGHTVALTNHLHQRLESPPPGVHGAPNNPLVGLYTTSDGRYISFVMMQPTKFWADVCRHVDLPELADDPRFDTAENIAANTAEAVELLTKAIATRTLAEWTERFATLAGPWAPVQDTLQAADDAQIRANEYIVRAGELELVANPVQFDVAAPQTGPAPGFAEQTDEILMELGLDWDRIIELKTAGAVT

SEQ ID NO: 2130 - protein, 260 aa, Mycobacterium paratuberculosis
LPALRLKVDMSGAMQAVGALFAMSADAVKYLFRRPFQWREFLEQSWFVARVSLAPTLLVAIPFTVLVSFTLNILLRELGAADLSGAGAAFGAVTQLGPLVTVLIVAGAGATAMCADLGSRTIREEIDAMEVLGINPIQRLVTPRMLASGLVAFLLNSLVVIIGVLGGYVFSVFVQDVNPGAFAAGITLLTGVPEVVISCIKAALFGLIAGLVACYRGLSITGGGAKAVGNAVNETVVYAFMSLFVVNVVVTAIGIKMTAK

SEQ ID NO: 2131 - protein, 281 aa, Mycobacterium paratuberculosis
VALRAAYPRLTRQLERPVALLAGIGDHALFYGKALAGMPFAATRYTREVVRLVAEISMGAGTLAMIGGTVVIVGFLTLAAGGTLAIQGYTSLGNIGIEALTGFLAAFINVRIVAPVVAGIGLAATFGAGVTAQLGAMRINEEVDALESMAIRPVAYLVSTRILAGMLAITPLYSIAVILSFVASQFTTTFLLGQSQGLYQHYFNTFLNPIDLLWSFLQAILMALTILLIHTYYGYFASGGPAGVGNATGNAVRTSLIVVVSVTLLVSLSIYGTNGNFNLSG

SEQ ID NO: 2132 - protein, 420 aa, Mycobacterium paratuberculosis
VTQNVPAGRGAIAGRPARPGHAHPPAGRNYLPPLLGLATILIIGLIFAVAVGLFQGSFTETVPVTVISQRAGLVMNPDAKVKMRGVQVGKVASIESLPNGQAAIHLAMDPSQMHFIPSNVLVDIASSTVFGAKSIQLVEPAQPSAQRLRAGQTLQGQHVMVEINTVFQELVSVLSHIDPPKLNESLGALAQAFSGRGPQLGQSLSDLDSFLARLEPSLSAFRHDLSVLPTVSNAYADAAPDLVKTAANATRISKTLVDEQHNLDALLISAIGLADIGNDVLSTNRQPLTNVLHLLVPTTDLTNEYGPALTCSFGGLITIAHGPPLSEPSINISASLTWGGERYRYPTNLPKVAATGGPKCMGLPTLPFNTNPPQFITDIGANPVGYGNPQLLINSDLLKQLLYGPIAGPPRNSAQVGMPG

SEQ ID NO: 2133 - protein, 340 aa, Mycobacterium paratuberculosis
MRTRATLIKFAIFAVVMAMLTAFLFFIFGQYRTGATNGYSAVFTDVSRLKPGQSVRVAGIRVGTVNSVSLQPDKKVVVKFDADRNIVLTEGTRAAVRYLNLVGDRYLELVDGPGSPKRLPAGGQIPVSRTAPALDLDLLLGGLKPVTQGLNARDVNALTSGLLQVFQGQGGTLDSLFTKATSFSNALADNDQTVQQLIDNLNIVIGTISKDGKQFSGAVDRLERLVSGLSDDRNTIGSAIDALDRGTASLADLLAQARPPLTGTIDQLNRLAPILDNDKDRLDAAIGKAPKNYRKLVRLGANGATIPYYLCMLELRGTDLQGKTVRAPIFRSDAGRCTEP

SEQ ID NO: 2134 - protein, 372 aa, Mycobacterium paratuberculosis
MLKYRGSGLVKAGLIGVVLAVMVILVGLSPDRFIAWATMVRYQALFTEAGGLATGNPVVVSGMKVGTVSDVKLHRGDALVTFALKGNILLGSETTAHIRTGTLLGERMLTLESAGTGTMHPMALIPVSRTSSPYSLTEAVSDLTTDTAGTNTTALNQSLDTLAATLDQIAPQMGPAFDALTRLSRTLNSRNKNLGELFKSAGDVTGVLSERSQQVNKLILNSDVLLQVLVARRQEIVDLLANTSAVAKQLTALVHDNESKLAPTLERLNSVTAMLEKNRDNISKALPGLKKFEITVGEAISSMYAYSAFVPNFLAPQLFQPFLDYLWGFRTFDTALGPGHPSPVPRSLIPWPYNGIPVCPGCTLGGRVGGSQ

SEQ ID NO: 2135 - protein, 237 aa, Mycobacterium paratuberculosis
LAALAAVVLVGLIVAGAAVLVRNTFFGQKTITAYFTTATAIYPNDEVRVSGVKVGNIKSIEPQGTQAKMTLKVDHDVPIPADAKAVIVASNLVSARYVQLSPAYRDSGPVMPDGAVIPVERTAVPVEWDEVKTQLMRLATDLGPKSGVSGTSVGRFIDSAANALDGNGDKLRQTLAQLSGVGRILANGSGNIVDIIKNLQTFVGALRDSNVQIVQFNDRLATLTSVVNDSKSDRTRR

SEQ ID NO: 2136 - protein, 219 aa, Mycobacterium paratuberculosis
VQRFIAGTRNQTSEQIARLADVTQILVDHHMDLENILHAVPNALGNFFNDYNADTGTIVGGFGIMNFANPTFSGLMVPLPVPGCTAVGAIENITAVESGKLCSLFLGPGLRVLNFNNLPIPINIFLQKSVDPSKILYSEPRLAPGGEGPKPGPPEIPPAVSAYTGLPGDPVGPPGAEPPARIPGAAMPLPPPPSTPMPPPPPPEPGVSGMLLPAQGPQQ

SEQ ID NO: 2137 - protein, 435 aa, Mycobacterium paratuberculosis
MIARVAARRVFAIGCCVMVTATGCAFHGLNSLPLPGAVGRGPGANIYHVELPNVGTMESNSPVMIDDVVVGSVGQMRVQGWHADVEISVKRDVVVPANVVATVGQTSLLGSMHVELNTPLGQQGSGRLQPGATIPLSRSSAYPSTEQTLSSLGAVVNGGGLGQIGEIIHNFSAALSGREGAVRDLITRLDTFVGTLDDQRDNIVDSIQALNRLAGTFAEQRDVVSQALQKVPPALDVLIKERPRLTAALDKLRVFSNTATRLVNDSQADLVQNLKNLEPTIRALADVGPEFGTAIAAGFVFPLTQNFVDRAVRGDYFNLHVDLDLSIPRLKRGLMLGTHWGQLDQPLVPEPGDPYYLQYTHDPLHDPLRPPWVGPGPRQIVGDPLPGPPPGAAPLPGPPPGAAPLPGPPPGAASLPDAGLGQTPPAATAPTEGGG

SEQ ID NO: 2138 - protein, 576 aa, Mycobacterium paratuberculosis
MLTRFVRIQLAIFLIAGTIGVISMVLFYIQAPTLLGIGRMTVTLELPATGGLYRFSNVTYRGVQLGKVTAVGLTPSGVKATLSLSTSPKVPADLTAEVLSVSAVGEQYVDLRPRTNSPPYLHDGSVIAMRDTKIPQPVGPMLDQVNALVQSIPKTKLGQLLDESFQGFNGSGYDLGSLIDSSQTLSRDANGVVDRTRALTEDTGPLLDTQAQTTDSIRTWARSFAGISDVMVNNDSHFRTILEKGPETANEASRLLDQIKPTLPVLLANLTTIGQIGITYHPSLEQLLVLLPSAVAIEQAAAAPNHPEGTAQGDFALTIDDPPICTVGFMPPNTWRSPDDLSDIDTPDGLYCKLPQDSPLSVRGARNYPCMGHPGKRAPTVEICNSDQPFMPLAMKQHVLGPYPLDPNLLAQGVPPDDRVTVNDRIFGPVEGTPLPPGAVPRGAPAGPRGENPPPGSVGAAVPPVPSSGPPALAPMSRMSADLPPIAPLDVPTPTELPPPPPPPPAPAAPDQVDGAAPQAAPSAFAGKASKPAPSVVVAKYDPRTGRYVGPDGKLYQQSDLVTPKAPKTWKDMLPT

SEQ ID NO: 2139 - protein, 173 aa, Mycobacterium paratuberculosis
MRSVRTLTTATLVAATAFGGLGAAATAGATTKEEVAVNGTFRATSIGDWAQRNDQYFEEPTVVQTWTISSTCDTFQECHGTVTSDLGWTAPLYMSDGQMWKVKHEVPNWERCEDGTAFTGQQTFYFYPVNEYGGYQLGSSTFAGKDKTVGPSGACGQNQWLDIAMPLRLDKLS

SEQ ID NO: 2140 - protein, 224 aa, Mycobacterium paratuberculosis
VADQRWPHARRRPAQNVESRFPAMTVEHGSSLDDVETTDKTESPSAGSARAGRLATIKLWAGRCAARWRSIVATALVAGAVGVTVSLYFVLYRPDQRVGDAAAHRAVQAASDGAAAVLSYAPESLNRDFAKAQSYLTGDFLAYYTKFTEQIAALAQQKQVTETAKVVRAAVSELHPDSAVVLVFINQTATSKQKPEPQTTASSARVTLTKVKGSWLISKLDPLS

SEQ ID NO: 2141 - protein, 298 aa, Mycobacterium paratuberculosis
MTRDRSPSPSCRSRRQCVPRAVQCAFPHVRAAREAGRRGRRAQARVISCFSVHHPEGTDADRFDAASTPTPEVDAEDEVAKAEARAEAARERLSRLRAAAGTSGDDAAAEDVEQRATKSARGRLRIPRRPGRPRWLRLPGRRAIAAGAGILLASASLGASGYMVWQHRVAAHNRQLSDEYAAAARQDVVLLMSLNAQHAREDIQRVIDACTGDLKKQLEATSGLMLQKAEESKASSKATVEAVGVESMSHDSAVVLVAAKTDVTNADNTNRPPVVWRISVGLTRDGGQLKMSKVDFLQ

SEQ ID NO: 2142 - protein, 139 aa, Mycobacterium paratuberculosis
VWQSNRVRSIVALVAALLCAGVLAAPPSLAGPTVCDYPACTPGIMPHQVLGAPCDNTTYYVFGVDDSVVPPGAQPGRLMFCGSPRRYQPRWFRSPPMAGVKEENTECQNYQNYVAQAPDGLFLVCYPHDGIMSWIRADT

SEQ ID NO: 2143 - protein, 176 aa, Mycobacterium paratuberculosis
VLDAALDLFAANGVSGTSLQMIADAVGITKAAVYHQFRTKEQIVIAVTERELGRLVPALEEAEAHDDGPQARDALLVRVIEMAVRDRRLVRTLQFDPVVVRLLAEHEPFQRFMDRLYRVLLSDAGLDGRIEAAMFSGALSTAVMHPLVVDIDDETLLDRVTDLSRRLLGLPRKPIE

SEQ ID NO: 2144 - protein, 226 aa, Mycobacterium paratuberculosis
LVLWIASFFLFPGFNPPMSPSLPADQVAAFYRDPAHLPEIRYSMILFNWFGVCLVPILTLIVLQIRRMAHRTPIFSYAMLGCAAGGPTLFLVANVCWLLAAFRPERSPELTQLLNDFGWITFTIVVPFLIGQSVILALAIYFDGQPRPVFPRWVAHFNLLVAAALVPAAFVGVSLTGPLAWDGLLSFWVKNVAIAVWIVVMGVVLGRAIYRERAENTGRAGELVSA

SEQ ID NO: 2145 - protein, 222 aa, Mycobacterium paratuberculosis
MFFIVAQVQPPPQPTWDLATQAHWFSERRLGIPFGFGVIFAITGMTAVNNALIAYSMRRMSVSRAFGYSYLVIYSLAAVPGMLLLCIALIVGTLRPERNREVLGWLYDFAFLSFDGTMGVFLIGSLIWMVAILLDKNRVFPKWFGYLNLCNALTEVVVAPCWIFRRSVLAWDGQIAWWLDMVVFGIYQVTFIVMLFQMIRREDFGTGPLPDDPAPRERGVTS

SEQ ID NO: 2146 - protein, 192 aa, Mycobacterium paratuberculosis
MTGLAERRATTRFVPGQPDMWAFVLFETLVFTAYFGFYLFYRARNPELFLHSQAHLDLRIGVFNTLVLLLSSWSVARCVQSARAGVYRAALRDVYITAAFAAVFLFFKVFEWARLVRTGNGLDSNDFFTYYFFLTGIHFVHLLIGFVALGVVVYQLRSPARRSQELVETCATYWHTVDFLWVLIFALLYVVR

SEQ ID NO: 2147 - protein, 462 aa, Mycobacterium paratuberculosis
VLSTFSISQSGGGTACRRTPPVKPSPGGRTPMSNFDSIDFFTDPSLVPDPHPYFDYLRSQNPVLRLPHYGVVAITGYEEATEVYKDPETFSNIVALGGPFPPLPVTPEGDDISAQIDAHRSSFPMFEHMVTMDPPEHTKARSVLAKLLTPSRLKQNEEFMWRLADRQLDEFLHNGECEFIAEYSKPFATLVIADLLGVPEEDHTQFRTVLGADRPGARVGALDHETVGINPLEWLDDKFCNYIEERRREPRADVLTFLAEAKYPDGSTPPVIEVVRSATFLFAAGQETTAKLLSAALQVLGDRPDIQQQLREDRSLIPAFIEESLRMESPVKSDSRLARRATTIGGVDIPAGTVVMILPGAANRDPRRFENPHEFDLRRKNVREHMAFARGVHSCPGGPLARVEGRVSIERILDRMPHIEINETHHGPAGDRRYTYEPTYILRGLSELHLTFTTADAVAPVG

SEQ ID NO: 2148 - protein, 245 aa, Mycobacterium paratuberculosis
MTSASSGASSGASSGARRIGAPDAKNRGLLLDAAERLMLEEGYAAVTSRRLASRAGLKPQLVHYYFRTMEELFLEVFRRRAEEGLAVQAQALQSDQPLWAVWRFGTDPAFTQISMEFMALANHRKDMRAEIAYYAERFRDEQQRAVAAALERYGVQNKDVPPVVWTVLMTSLSRFLVLEQAIGMSSGHAETVQLVESYLRRLEGEPKPIAGVPSSWTVHQGRIEQSTPLGPSLDTTTAPSTVRSQ

SEQ ID NO: 2149 - protein, 147 aa, Mycobacterium paratuberculosis
MTINPRTAMGVGSVASLTSLLVASGVLVGAGRAHADDPPVMDHVKYTVTAQNPIYTSIYYLDHEPAIFADYSRNPYSFTPHVDVDLAPGKPWSYELDLSKPEVYAMVVASTGTEPGTPGLHCDLTVDGAVVVSKDGPKGVLCSIRPW

SEQ ID NO: 2150 - protein, 251 aa, Mycobacterium paratuberculosis
MVDLEIDDGLAVLTIDRPHPRNAIALDTMDQLEKALDAAAGAQALVITGAGDRAFVSGGDLKELSALRTEEDAAAMARRMRAICDQLADFPAPVVAALNGHAFGGGAEVAVAADIRVAADDIKIAFNQVALEIMPAWGGAERLAALVGQSRALLLAGSGTALDAVEAERIGLVDRVLPRDVFDSAEQGWRSIARSLARRPAAEIKRVIRGVSPEEAIASFARLWVADPHWQAAERVMARNTKPRPAAGGAS

SEQ ID NO: 2151 - protein, 174 aa, Mycobacterium paratuberculosis
LSLLGTGPILAFSFRENNIIAAGPGTFIGEAGGDSVRNRFVAAGAALTVALLGACTSRPPAQLSSTASVTVDGKDRNFHIVTCRQLEWRRMIDIGADFSGAKVAVDENAQPPVVESVHIQNLSGFSGMYSRGGSGSADMSMTGDKFTISGTADGYKTDKPSEPATATFKIVVTC

SEQ ID NO: 2152 - protein, 396 aa, Mycobacterium paratuberculosis
MGQLSHREDVPFPIFDADNHLYEPPEALTKFLPKEYKDFVQYVQINGRTKIALRGVISNYIPNPTFEVVARPGAWEEYFKYGNPEGKSKRELFGEPMRAIPAFFEPGPRLEKMNELGLDRTLMFPTLASLIEERLRDDPVAIHVLIHALNQWLDEVWGFNYQNRIFTTPVITLPIVEKAIEELEWVVKRGARAILVRPAPVPGFRGPRSFALPEFDPFWERVVEYDVLVGMHSSDSGYSRYTSEWDGADQEMLPFQTNAMGILNEWRPIQDSVASWVIHGALYRHPKLKVAIVEAGSKWMTPLLDGLAEVFRKAPEAFPSDPVEMVKNRIHVSPFFEDGIDDLVNLVGVDQVLYGSDWPHPEGLAEPTYYVNALSHLPVEDQAKIMGGNLGRLVTV

SEQ ID NO: 2153 - protein, 478 aa, Mycobacterium paratuberculosis
LNSPRWQTIPEMVLSAADRFGDAEAVVDGPLRLTFQQVVERIRCAAGAFAELGVEKGDRVAVWAPNSAEWIIAAFGLLTAGGVLVPVNTRFKTEEAADIIVRARVKAVLVQKGFLGQDYAAPAGIPVIDIKSDFLSSGSPFSRPVNGTDISDIIFTSGTTGRPKGAMMNHRQTLRMYDEWATLADLREGDRYLQINPYFHTFGLKAGLITSFLRGATMLPVPVFDVDTVVDLIERERITMLPGPPTLYHSLLTVPDKSKLATLRAGVTGAADIPVELVRRIHDELPFQTLMTGYGLTEAGNVTLSRPGDSFEDVATTAGVPCEGVEVRIADDGEVLVRGYGVMQGYLDDPAGTAEAIDADGWLHTGDLGTFTETGRLRIVGRKKDMFIVGGFNAYPAEIEGFLLNHPAVAQAAVIGVPDERMGQVGKAFVVANAEVSESDLLAWCRDRMAGFKVPRTVEFLDALPLNATGKVMKDQLR

SEQ ID NO: 2154 - protein, 243 aa, Mycobacterium paratuberculosis
VVSRSDGRIQSAKDRRVSRRVAAQRHRESHERPTPLNNGDIHSMVIASDYRVPDPTRVWPLLERNKAALADIGAHHVLVYTSTHDYGRVLAMIGVHSREPIVELLRSRVFFDWFDEAGVDDIPAVFAGEIVDRFITQPPTNPRAPGVVVAAIASVNDVTLLTSEVSSAIDRFAQAGIRKTWVFQAFDDDHEVLILQEFPDEDSAREWIDHPDAAAQWMSGAGIGAYPPLFVGRFFDMMRIGAD

SEQ ID NO: 2155 - protein, 61 aa, Mycobacterium paratuberculosis
VFVCLCNGVTSQTVTEAVQCGASTTNEVARACGAGADCGRCRRTVQAILRSSSGNRTPNSI

SEQ ID NO: 2156 - protein, 563 aa, Mycobacterium paratuberculosis
VPVTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALTAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNALGVTEHLAFRVQTYGELDDALTAAARHQDRMVLVEVVLPRLEIPRLLVELVRPTSPDGSPRR

SEQ ID NO: 2157 - protein, 147 aa, Mycobacterium paratuberculosis
MALKESRDIVIEASPEEILDVIADFESMPQWSEPHQSAEVLATGHDGRPSQVRMKVKVAGITDEQVVAYTWADNVVSWTLVSSSQQKAQDGKYTLVPQGDATLVKFELVADPNVPLPGFVLKRAVKGTIDSATKALRQRVLEVKKGK

SEQ ID NO: 2158 - protein, 359 aa, Mycobacterium paratuberculosis
VSSGGPLAGVRVIELGGIGPGPHAGMVLADLGADVVRVRRPGVAAMPSEDRDLLHRGKRIVDLDVKARPQALLDLAAKADVLLDCFRPGTCERLGIGPDDCAAVNPRLIFARITGWGQHGPLAQTAGHDINYLSQTGVLSALGHADRPPLPPLNLVADFGGGSMLVLLGITAALYERERSGRGQVIDAAMVDGVSLLAQMMWTMKSTGALRDRRESFLLDGGAPFYGCYETADGKYVAVGAIEPQFFAALLDGLGLSPEEVPGQLDRDSYPRMREVFTQRFAARTRDEWARVFAGTDACVTPVLTWSEAAASEHLRARSTVITAHGVDQAAPAPRFSHTPARPVGRPPATTTPLDEINW

SEQ ID NO: 2159 - protein, 154 aa, Mycobacterium paratuberculosis
VAVKASREFVVNAPPEVVMEALTDVGVLSSWSPLHKHIEVIDRYPDGRPHHVKTTIKILGLVDKEILEYHWGPDWVVYDAKGTSQQHGQHVEYNLKPEGVGQTRVRFDVTVEPGRPMPAFIVRRASENVLDAAMKGLQELVMRAKDLRDSGEAE

SEQ ID NO: 2160 - protein, 151 aa, Mycobacterium paratuberculosis
VAVQASSEIVIDAPPEVIMEALADMDAVPSWSSVHKRVEVIDKHPDGRPHHVRVTIAVVGIHDTELLEYHWGPDWMVWDADRTAQQHGQHGEYNLSRLGDDKTRVRFTITVEPWVPLPEFWVRRARKKILHAALEGLRKRVMTPEAFGRAD

SEQ ID NO: 2161 - protein, 393 aa, Mycobacterium paratuberculosis
MTVSRLRPYATTVFAEMSALAARAGAVNLGQGFPDEDGPAEMLKAAQEAIADGVNQYPPGIGIAPLRHAIAAQRHRRYGIEYDPDTEVLVTVGATEAIASAVIGLVEPGSEVLLIEPFYDSYSPVIAMASAQRVAVPLVPHGRGFALDADALRRAVTPRTRALIVNSPHNPTGTVLGATELAAIAEVAVESDLLVITDEVYEHLVFDDHRHLPLAGFDGMAERTITISSAAKMFNCTGWKIGWACGPAHLIAGVRAAKQYLSYVGGAPFQPAVALALETQDAWVADLRDRLRARRDRLAAGLIDIGFEVHDSAGTYFLCADPRPLGYDDSVAFCAALPEKVGVAAIPLSPFCDPAGAHGPADVWNHLVRFTFCKRDDTLDEAIRRLAALRGAG

SEQ ID NO: 2162 - protein, 403 aa, Mycobacterium paratuberculosis
MSEEAFIYEAIRTPRGKQKNGSLTEVKPLNLVVGLVDELRRRYPDLDESLISDMILGVVSPVGDQGGDIARTAVLAAGLPETTGGVQLNRFCASGLEAVNTAAQKVRSGWDDLVLAGGVESMSRVPMGSDGGAWATDPETNYRIGFVPQGIGADLIATLEGFSREDVDAYALRSQQKAAAAWSGGYFAKSVVPVRDQNGLVILDHDEHMRPDTTMEGLAKLKTAFDGVGEMGGFDDVALQKYHWVEKINHVHTGGNSSGIVDGAALVLVGSEKAGKSQGLTPRARIVATATSGSDPVIMLTGPTPATRKVLDRAGLTIDDIDLFELNEAFASVVLKFQKDLNIPDEKLNVNGGAIAMGHPLGATGAMITGTMVDELERRNARRALITLCIGGGMGVATIIERV

SEQ ID NO: 2163 - protein, 715 aa, Mycobacterium paratuberculosis
MAENTIKWDKDADGIVTLTLDDPTGSANVMNEHYKESMHNAVERLVAEKDSITGVVITSAKKTFFAGGDLKSMINLGPENAGEAFDTVEAVKRDLRALETLGKPVVAAINGAALGGGLEIALACHHRIAADIKGLVVGLPEVTLGLLPGGGGVTRTVRMFGIQNAFMNILSQGTRFKPDKAKEIGLVDELVGSVEELVPAAKAWIKANPDAHEQPWDKKGYKMPGGTPSSPALAGILPSFPALLKKQLKGAPMPAPRAILDAAVEGAQVDFDTASRIESRYFTQLVTGQVAKNMIQAFFFDLQHINGGGSRPEGIEPVKINKIGVLGAGMMGAGIAYVSAKAGFDVVLKDVSLEAAQKGKGYSEKLEAKALQRGKTTEEKSKSLLDRITPTADAADFKGVDFVIEAVFENQELKHKVFQEIEDIVEPNALLGSNTSTLPITGLATGVKRQEDFIGIHFFSPVDKMPLVEIIKGEKTSDEALARVFDYTLASGKTPIVVNDSRGFFTSRVIGTFVNEALAMLGEGVAPASIEHAGSQAGYPAPPLQLSDELNLELMHKIAVATRKGIEDAGGTYEPHPAEAVVEKMIEIGRPSRLKGAGFYEYVDGKRTRLWPGLQETFNSGSTSIPLQDMIDRMLFAEALETQKCLDEGVLTSTADANIGSIMGIGFPPYTGGSAQFIVGYEGAHGIGKEAFVARAKELAARYGDRFLPPASLTS

SEQ ID NO: 2164 - protein, 200 aa, Mycobacterium paratuberculosis
MASKQTLFRIFYRIGFTPWDGHPLAQSLRDLVEGTGDAAALPAGKALEIGCGTGDCAIYLAQHGWNVTAVDFVAKPLERARAKAGAAGAAVDFVQADVTRLGQAGIGTGFELIVDNGCLHNMSDADRDAYVREVTGVAAPQARLLIVAFVPGGRFGVRGVEDAEMQRRFTADWTLLAAGPERELDGAERTPARYYLFQRR

SEQ ID NO: 2165 - protein, 286 aa, Mycobacterium paratuberculosis
VELTGVGIWSSQLRYGDPAESADAAAELDELGFPALWIPDVGGPVFDAVGHLLEATKRTVIATGILNLWMHSPAEVAESYAALTAEHGDRFLLGIGVSHAPLIDAGQPGRYRKPLAATARFLDGLDGAPRPVPIERRVLAALGPKMLKLSASRAGGAHPYLVTPDHTASARATLGHGPLLLPEQTVILTDSADEARRIGTDWLRAYLALPNYANNLLRSGFSEDDLSQVSDRLFNAIIAWGDEEAVMRRVAEHRSAGADHVCVQVLLADPRAFPREEWRRIAAASR

SEQ ID NO: 2166 - protein, 404 aa, Mycobacterium paratuberculosis
VAMRILISGASIAGPVLAYWLTRYGFEVTVVERAPTLRKTGGHAVDLFRPAMEISAKMGVLPRIEDLATGTTRLTLYREGRPQPSRIDLTKIYAASSDRHVEIMRDDLSEVYYDAARDDVEYLFGDSITAIEPDGTVTFEHCAPRTFDVIVGADGLHSNVRRLTFGDEAGLTRFLGGYLSVVSAPKTLVGPGEMVGHVGVGRFAGIYTADHLDDARAVFLFRSAAELAYDHRDTARQKELLREAFAGMHDEVDGWLAETERTPTFYFDSITQLRTDRWSRRRVTLVGDAGYCPGPAVGGSTSLAVLGAYVLAGELARADGDHLRAFAAYELQMRESVRRSRSFARAAARGVIPGSRAGVWALTRGAQLVSAMPTSLARALAKLNTKGVRMHDSMPVPDYADSDV

SEQ ID NO: 2167 - protein, 182 aa, Mycobacterium paratuberculosis
VGRPRSDTRERIQQVARELFSQRGVQRTSLQDIADRLGITKPALYYHFPSREDLVRSILVPLIEEGERFVAEHESREHTEARELLEGYFDFHYRHRRDLVLLLTELSTLIDLDLIDTVLAWRERLATLVFGKRPTLAQSTRAVVAFGGLQDCCVQFPDAPQAELRDKSVAAALDALGVRPRR

SEQ ID NO: 2168 - protein, 318 aa, Mycobacterium paratuberculosis
MDLVGIEPDEHWAVMRDLAQRADRDAGWDSLWVYDHFHTVPVPTGEATHEAWSLMAAYAAVTSRIKLGQMCTAMSYRNPVYLAKVAATADIISGGRIQMGIGAGWYEHEWRAYGYGFPSAGVRLGRLDEGVQIMRDAWRDGKVSFNGRHYQVDGAIVAPKPLQDNGIPLWIAGGGEKVTLRIAAEYAQYTNFTPEPAAFAHKSEVLAAHCRDVGTDFDAIVRSVNVNAVVGASRADDDDRLRRIRDRMAGYVGESAADAMIAGTSGADSATGTTERVIERLARLRDLGCDYVICYFPEAAYDRSGIELFEREIIPALS

SEQ ID NO: 2169 - protein, 97 aa, Mycobacterium paratuberculosis
MTVTVILELRFKPDEVAAGRELMGRALQDTRAFDGNVRTDVLVDEDDEAHWLVYEIWETVEHDQAYRAFRAGEGKLTQLPPLLAAPPVKTRYVTSDI

SEQ ID NO: 2170 - protein, 150 aa, Mycobacterium paratuberculosis
LLADSCTILEDPSMQKALAPEISTWPDESPQLIGSRCDSCAATTFPVQQWCPRCSSGEMSEVLLPRRGTLVAWTTQGFPPGAPYAGPTGKDFVPFGVGLVQLGDVIRVEGRLTENDPAKLKFGQEVELTMVPLTTDDDGNEVLTFAFQPV

SEQ ID NO: 2171 - protein, 381 aa, Mycobacterium paratuberculosis
MTNDVAIIGVGLHPFGRFDKTAMQMGAEAVQLALADAGVAWKDIQFGFGGSYEVSNPDAVTRLVGLTGITFTNVFNACAAAASAIQQTADTIRLGKYDLGIAIGLDKHPRGAFTDDPAKLALPQWYANNGQFVTTKFFGMKANKYIHDHNISQETLARVANKNFRNGALNPNAFRRKEIPVDEILNSAVLNYPLTQYMFCAPDEGAAAVIMCRADLAHKFTDKPVYVRACEIRTRRYGAYEVHATSAPLDEDASPTVYAARAAYEAAGIGPEDVDVAQLQDTDAGAEVIHMAETGLCADGEQEKLLADGATEIHGSMPVNTDGGLIANGEPIGASGLRQVHELVRQLRGEAGERQVPGNPRVGLAQVYGAPGTASATILSL

SEQ ID NO: 2172 - protein, 549 aa, Mycobacterium paratuberculosis
MSDGPLIVQSDKTVLLEVDHELAGAARAAIAPFAELERAPEHVHTYRITPLALWNARAAGHDAEQVVDALVSFSRYAVPQPLLVDIVDTMARYGRLQLVKNPAHGLTLVSLDRAVLEEVLRNKKIAPMLGARIDDDTVVVHPSERGRVKQMLLKIGWPAEDLAGYVDGEAHPISLTEDGWQLRDYQQMAADSFWSGGSGVVVLPCGAGKTLVGAAAMAKAGATTLILVTNIVAARQWKRELVARTSLTEDEIGEYSGERKEIRPVTISTYQMITRRTRGEYRHLELFDSRDWGLIIYDEVHLLPAPVFRMTADLQSKRRLGLTATLVREDGREGDVFSLIGPKRYDAPWKDIEAQGWIAPAECVEVRVTMTDNERMMYATAEPEERYRLCSTVHTKIAVVKSILDKHPGEQTLVIGAYLDQLDELGEQLGAPVIQGSTRTKEREELFDAFRRGEVNTLVVSKVANFSIDLPEAAVAVQVSGTFGSRQEEAQRLGRLLRPKSDGGGAVFYSVVARDSLDAEYAAHRQRFLAEQGYGYIIRDADDLLGPAI

SEQ ID NO: 2173 - protein, 752 aa, Mycobacterium paratuberculosis
MTDNTPGIPLGSWLAELSDERLIRLLELRPDLAQLPPGSIAALAARAQARQSIKAATDDLDFLRLAVLDALLVLQADVQPVPTAKLLALIGERAAETEILDALDDLRQRVLVWGDGALQVAADAGSGMPWHPGQVILEDSSRSAEQIAALIDDLDPAQLDVLEKLLEGSPMGRTRDAAPGAPADRPVPQLLAMGLLRRLDAETVILPRHVGQVLRGEQPGPLQLSAPDPVVSTTTAEDADAAAAGAVIDLLRELDVLLETLSAAPVSELRSGGLGVREVKRLSKTTGIDEQRLGLILEVAAAAGLIASGMPDPEPATGEAPYWAPTTAADRFAALSTAERWQLLAGSWLDLPGRPALIGGRGPDGKPYGALTDALYSTAAPLDRRLLLGMLSELPPGAGVDATSASAALIWRRPRWAKRLQPEPIADLLREAHALGLVGRGAISTPARALVDEDADPQAAIDAMARALPKPVDHFLVQADLTVVVPGPLQRDLAEELATVATVESAGAAMVYRVSEQSIRHALDIGKTRDWMHAFFADYSKTPVPQGLTYLIDDVARRHGQLRIGMAASFVRCEDPALLAQVVAAPATEDVALRTLAPTVAVSPAPIGEVLAALRAAGFAPAAEDSTGAIVDVRPRGARVATPQQRRAYRPVRRPNTESLHAVVAVLRRVTAAPFGNVRVDPALTMTLLQRAAKEQDTLVIGYLDAAGVATQRVVSPISVRGGQLVAFDSASGRLRDFAIHRITSVVSATGR

SEQ ID NO: 2174 - protein, 87 aa, Mycobacterium paratuberculosis
LGTPNLRSCGDVARPPVRMEPVADIAEGKARKNRYVDNGWPTTDPDDHAVSELVTDRTGALSPFGELVFPLPATELPYLHPVTVVNR

SEQ ID NO: 2175 - protein, 176 aa, Mycobacterium paratuberculosis
MARAPEASTASATRASGEPRSGALSHLDERGAAHMVDVSGKAPSKRTAVAAGVLRTSADVVALISTGGLPKGDALATARVAGIQAAKRTSDLIPLCHQLALTGVDVDFAVGESDIEITATVASTDRTGVEMEALTAVSVAGLTLYDMIKAVDPAARIDDVRVLRKEGGKTGMWTRS

SEQ ID NO: 2176 - protein, 160 aa, Mycobacterium paratuberculosis
MTTRSARVIIASTRASSGEYEDRCGPIITEWLAQQGFSSAQPEVVADGSPVGEALRKAIDDDVDVILTSGGTGIAPTDSTPDQTVAVVDYLIPGLAEAIRRSGLPKVPTSVLSRGVCGVAGQTLIVNLPGSPGGVRDGLGVLAGVLDHALDQLAGKDHPR

SEQ ID NO: 2177 - protein, 141 aa, Mycobacterium paratuberculosis
MTLVVRAAVTEHPIVLAQHEELVGHQSAGAVVGFVGMIRDHDGGRRVVRLEYSAHPSAGEVMAEVVAEVAERSCGVRAVAASHRIGVLSIGEAALVAAVAADHRQAAFDTCAQLVDTVKARLPVWKHQFFADGTDEWVGSA

SEQ ID NO: 2178 - protein, 250 aa, Mycobacterium paratuberculosis
MSGRHRKPTTSSVSVAKIAVTGAVLGGGAIAMAGQAAAATDGEWDQVARCESGGNWGINTGNGYHGGVQFSASTWAAHGGGEYAPSAELATREQQIAVAERVLATQGRGAWPVCGGPLSGPTPRDVPAPAGLDAPGVNGVPQAPPADAPPPAPVQLASFDRPAPPDAPAPDAPPPAPADLPPAPPADATPPAPPADAPAPDGDFHGFVPAGMPDHVSEAGYTQRLWEAIRAQDVQGNDALDALVQPAPSA

SEQ ID NO: 2179 - protein, 93 aa, Mycobacterium paratuberculosis
MGRVPVQANGISVTVRYFAAARAAAGAESETVVVVRPGTTVGELVERLAVRGSRLAEVLSRCSYLCDGIAVRDETQSLRSGDTIDVLPPFSGG

SEQ ID NO: 2180 - protein, 316 aa, Mycobacterium paratuberculosis
MPAEGLDWLPGEQLLTSDELTRLMRIAVTRLGVTSVRFTGGEPLLARHLEEVVAAAAALRPRPEISLTTNGVGLARRAGPRRTGPRQHLAGQRGPGTFCGHHPPRPARRRAGRLGRRQRSGSDAGEGERGARPRHRTRGRRAVAAVLPRIRLPAARHRTDAAGRGAPMAAGRRAECRRGAGGAAQAFSAASRPRTARIGSGPAVAGRHRPGNARRRIRCHRVGLARVLLDLRPHPVDGRRADPQLPVLDAGDGSARAAARRRSRRRRRGGVARRDVGQARRSRHQRPELHPARPPDERDRWLARWDASRSRPTASQ

SEQ ID NO: 2181 - protein, 209 aa, Mycobacterium paratuberculosis
VDREHFAAITRRDRLADVLAGLAAAKEAGLTPVKVNAVLDPGTGREDVVQLLRYCLEYGYQLRVIEQMPLDAGHQWRRDAALSADAVLAVLRKHFRLRPDPAPRGSAPAQLWLVDTGPGTPGGEFGVIASVSHAFCSTCDRTRLTADGQIRSCLFSTRETDLRGLLRGGAADDAVEAAWRAAMWAKPAGHGINDPNFIQPDRPMSAIGG

SEQ ID NO: 2182 - protein, 158 aa, Mycobacterium paratuberculosis
MLTRSSPARASPAGQSHAVGGQRDLRAGPQCGRRGHHLFEVAGQQRLAAGEPHAGDPQPGDRDAHQPGQLVGGQQLFAGQPVEALGGHAVTAPQVAAIGQRDPQIGGDAPIGVAQRAARRRRRGKRAVERPGRRSGSAWSADPARSASCGHRRSVRNR

SEQ ID NO: 2183 - protein, 135 aa, Mycobacterium paratuberculosis
MRLILNVIWLVFGGLWMAVGYLAAALVCFLLIITIPFGFASLRIASYALWPFGRTIVDKPTAGSGALIGNVIWVVLFGVWLAIGHLLSAAAMALTIVGIPLALANLKLIPVSLMPLGKQIVPVGSPVPHAPPVAA

SEQ ID NO: 2184 - protein, 138 aa, Mycobacterium paratuberculosis
VRPVPTGKVKWYDADKGFGFLSQEDGEDVYVRSSALPAGVEGLKAGQRVEFGIASGRRGPQALSLKLIEPPPSLTKARREGPAEHKHSPDELHGMVEDMITLLESTVQPELRKGRYPDRKTARRVSEVVRAVARELDA

SEQ ID NO: 2185 - protein, 642 aa, Mycobacterium paratuberculosis
MAQQTQVTEEQARALAEESRETGWDKPSFAKELFLGRFPLELIHPFPQPSDADEARTRAFLDQLRKFLDTVDGSVIERDAEIPAEYVRGLADLGCFGMKIPSEFGGLNMSQVAYNRALMMISSVHPSLGALLSAHQSIGVPEPLKLAGTPEQKRKFLPRCAAGAISAFLLTEPDVGSDPARLASTATPVDDGKAYELNGVKLWTTNGVVAELLVVMARVPKSEGHRGGISAFVVEADSPGITVERRNKFMGLRGIENGVTRLHRVRVPSENLVGREGDGLKIALTTLNAGRLSIPASATGSAKWALKIAREWSGERVQWGKPLAEHEAVARKLSFIAATVYALDAVLELSAQMADEGRNDIRIEAALAKLWSSEMACVIADEVMQIRGGRGYETAESLAARGERAVPVEQVLRDLRINRIFEGASEIMRLLIAREAVDAHLAAAGDLAKPDAGLREKAAAAVGASGFYAKWLPQLVFGEGQRPRAYHEFGALARHLRFIERSSRKLARNTFYGMARWQAKLEQRQGFLGRVVDIGAELFAMSAACVRAEAQRNADPVLGQQAYELAEAFCAQATLRVEALFQALWDNTDTGDVALTRNLQRGRYTWLEDGIIDQSEGSGPWIAHWEEGPSTEVNLARRFLTI

SEQ ID NO: 2186 - protein, 334 aa, Mycobacterium paratuberculosis
MASYVAGSGEFTRDTDYITTRITADGRDGYPVEPGRYRLVVARACPWANRAIIVRRLLGLESVLSIGFCGPTHDERSWTFDLDPGGVDPVLKIPRLQDAYFKRFPGYPKGITVPAIVDVGTGAVVTNDFAQMTLDLSTEWSAYHRDGAPELYPERLRAEIDEVNKRVYTEINNGVYRCGFAGSQQAYEAAYDRLFTALDWVSDRLADRRYLVGDTITEADVRLFTTLARFDAVYHGHFKCNRSKLSEMPVLWAYARDLFQTPGFGDTVDFVQIKQHYYIVHSDINPTGIVPKGPDLAGWLTPHGREALGGKPFGDGTPPGPPVEAERVPAGHGA

SEQ ID NO: 2187 - protein, 315 aa, Mycobacterium paratuberculosis
MGIPDWPFRGTDALAAGVVTRHRLRTEFTMVHRNVYVRRGQQLTPVTRAVAAWLWSGRTATLAGLSAAALHRTAWIDDWLPAELNRAGRDKARGIILHSDTLCDDETTMRDGMSLTTPARTAFDLGRRKDLTTAVIRLDALMHVSDVKTADVELLADRHRGARGLVQLRRVLTLVDGGAESPYETKTRLLLAGSGLPRPQTQIEVRNEWGAVLARIDMGWEEWKVGVEFDGAQHWTDPAQRTRDIDRLAELEARGWTIVRVSADMLRYRPYDILSRTRNALRASGCPLRSPNVDLLGTTQPISPNKSTFGGKDRP

SEQ ID NO: 2188 - protein, 166 aa, Mycobacterium paratuberculosis
VKPKTRRGGAVLLACLMIVLCAGAGVGTWLLVGRGGPQRPEISAYSHGHLTRVGPYLYCNVLNLEDCETPQSQGELPVSERYPIQLSVPDAIARAPWRLLQVYEDPGNTTSTIYRPGTRFAVTIPSVDPHRGRLAGIVVQLLTLAMDPAGEVRDVPHAEWSVRLTF

SEQ ID NO: 2189 - protein, 567 aa, Mycobacterium paratuberculosis
VSGRRQGDPGRVAAKPGRRPGNSAAAPHPGAANYPAGDTGDRRTRRPPPMPSANRYLPPLGHQPQPDRGAAAPPRGPVAGERITVTRAAALRSREMGSRMYWMVQRAATADGADKSGLTALTWPVVANFAVDAAMAVALANTLFFAAATGESKGRVALYLLITIAPFAVIAPLIGPALDRLQHGRRVALAASFVLRTALAAVLIMNYDGASGSYPSMVLYPCALAMMVLSKSFSVLRSAVTPRVMPPSIDLVRVNSRLTMFGLLGGTIVGGAIAGGVEFVCTHLFKLPGALFVVVAVTVAGASLSMRIPRWVEVTAGEVPATLSYRRDSEPLRRRWPEEVKNVPKKATATLRQPLGRNIITSLWGNCTIKVMVGFLFLYPAFVAKAHQANGWAQLAMLGMIGAAAGVGNFVGNFTSARLKLGRPAVLVVRCTVAVTAVALAASVAGNLMLAVIATLVTSGASAIAKASLDAALQDDLPEESRASGFGRSESTLQLAWVLGGALGVLVYTELWVGFTAVTALLILGLAQTLVSFRGNSLIPGLGGNRPIMVEQEGARRGVGSPAVVAE

SEQ ID NO: 2190 - protein, 312 aa, Mycobacterium paratuberculosis
RGVARQPTIGTAMQTQDSVTTPLEESSMATAGEWPEGLAAVLTGAADQARAAVVEFSGAETVGDYLAVGYEDPYAATHRFLAHLPGYQGWQWAVVVAAYPGADHATISEVVLVPGPTALLAPEWVPWEQRVRPGDLSPGDLLAPAANDPRLVPGYTASGDPQVDETAAEIGLGRRWVMSAEGRAEAAERWHTGAYGPDSPMARSTKRVCRDCGFFLPLSGSLGRMFGVCGNELSADGHVVDMHYGCGAHSDTPAPAGTGSPAYEPYDDGLLDVTQTPVEPTPPPETSQAEPETSEVEPETQAEPEPETETPS

SEQ ID NO: 2191 - protein, 152 aa, Mycobacterium paratuberculosis
MVAPLLRAQIDIDAPVATVWKLVSDLRRMPQWSPQCRWMKPLGPVRQGTRTINLNRRNRLFWPTTCTVVEIIPDRKLTFRVDTNNTIWSYELEPTDTGTRLIESRHAENGVTAFSNLSVKAFLGGTDNFERELLDGMNASLARIKAAAENTD

SEQ ID NO: 2192 - protein, 91 aa, Mycobacterium paratuberculosis
MSTESGPNRTAPPLPAALLRVWPFIALGALGWLAAVGAAFLVPGLHCWRPVTLAGLGVGVLGTSIFLLQLAAARRGARGAQTGLENFLEHD

SEQ ID NO: 2193 - protein, 143 aa, Mycobacterium paratuberculosis
MPDSDARLASDLSLAVMRLARQLRFRNPSSPVSLSQLSALAMLANEGPMTPGALAIRERVRPPSMTRVIASLAEMGLVDRTPHPVDGRQVLVSVSEAGAELVKANRRARQEWLAKRLSTLDDDERETLRHAADLMLALVDEGP

SEQ ID NO: 2194 - protein, 289 aa, Mycobacterium paratuberculosis
VNTDALDVRDVDDPDDPRLDDFRDLNSVDRRPDLPSGKGLVIAEGVLVVQRMLASRFRPHALLGTERRLAELRDDLAGVPVPYYRTSADVMARVVGFHLNRGVLAAARRVPEPGVAELLAGSRTVAVLEGVNDHENLGAIFRNAAGLGVDAVIFGSGCADPLYRRAVRVSMGHALLVPYARATDWPAELKTLKENGFRLLAMTPQGSACGLAEAMTAARGDRVAVLVGAEGPGLTPAALRLSDVRVRIPMSRGTDSLNVATAAALAFYERSRPVGVHRAAAGGGDGQSG

SEQ ID NO: 2195 - protein, 99 aa, Mycobacterium paratuberculosis
MDSRARLRLMKDETVPWATGLTVTAFVAAVTGVAIVVLSLGLVRVHPLLAVGLNIVAAGGLAPTLWGWRRTPVLRWFVLGAGVGVTGAWLVLLVLAVAG

SEQ ID NO: 2196 - protein, 254 aa, Mycobacterium paratuberculosis
MRELKVVGLDADSKYLICESDDPAEQFKLPADDHLRAVLRHEAEPPEQPQLEIEVTNMLSPKEIQAKIRAGASVEQVAAASGSDVSRVRRFAHPVLLERYRAAELATAAHPMLAEGPAVLTLLETVTAAFVTRGLRHDKLSWDAWRNEDNRWTVQLAWKVGRSDNVAHFCFTPGAHGGTVTAIDDAATALIDPNFELPLRPLARVAHVDFEEPAKPPAAEPAEPEEKPVHTRRGKPVIPAWEDVLLGVRSGGQR

SEQ ID NO: 2197 - protein, 374 aa, Mycobacterium paratuberculosis
MSMADQLQIPADIKPRDGRFGCGPSKVRPEQLQALSTTAAPLFGTSHRQAPVKNLVGRLRSGLAELFSLPDGYQVILGNGGATAFWDAAAFGLIDKRSLHLSYGEFSSKFAAAVAKNPFVGDPVVIKSDAGSAPEPQSDPSVDLIAWAHNETSTGVAVPVRRPVDSGDALVAIDATSGAGGLPVDIGETDAYYFSPQKNFAGDGGLWLALMSPAALARVESIAASGRWVPDFLSLPIAVENSLKDQTYNTPAIGTLALMAEQVDWMLGNGGLDWAVKRTADSAGRLYSWAEERDYTTPFVADPKLRSQVVGTIDFVDDVDAAAVAKILRANGVVDTEPYRKLGRNQLRVGMFPAVDPDDVSALTQCVDWVVERL

SEQ ID NO: 2198 - protein, 341 aa, Mycobacterium paratuberculosis
MARTRMVRRWRRNMEVRDDTEYVNMLATLSEGSVRRNFNPYTDIDWDSPEFAVTEDDPRWILPATDPLGRHPWYLAQSDERKIKIGMWRQANVAKVGLHFESILIRGLMNYTFWVPNGSPEYRYCLHESVEECNHTMMFQEMVNRVGADVPGMPRLLKWISPLIPLVAGPLPVAFFIGVLAGEEPIDHTQKNVLREGKSLHPIMERVMAIHVAEEARHISFAHEFLRKRLPHLTKRQRFWVSLYYPLTMRLLCNAITVPPKQFWREFDIPREVKKELFFRSPESRKWLSDMFADVRMLAHDTGLMENRSARLMWRLCKINGKPSRYRSEPQRQHLAAVPAA

SEQ ID NO: 2199 - protein, 566 aa, Mycobacterium paratuberculosis
MPHVITQSCCNDGSCVFACPVNCIHPTPDEPGFATSEMLYIDPAACVDCGACVSACPVGAIAPDNRLDDKQLPFVEINASFYPKRPAGQKLPPTSKLAPVIPAVPVRPRGRPLTVAIVGSGPAAMYAADELLTQDGVRVNVFEKLPTPYGLVRAGVAPDHQNTKKVTRLFDRVAGHDRFRFYLNVEVGKHLSHADLLAHHHAVLYAVGAPDDRRLDIEGMGLAGSGTATELVAWINGHPEFTALPVDLRHERVVIIGNGNVALDVARVLTADPDDLARTDIADHALAALRGSAVREVVIAARRGPAQSAFTLPELIGLTGSREVVLSAADRELVAADLANASDALTKAKLEVLSTLGDAAAPSERPRIRLAYRLTPDRILGEQRVTGVQFTLTGTDETRCLPTGLVLTSIGYRGKPIRDLPYDEAAAVVPNDGGRVVDPASGRPVPGAYVAGWIKRGPSGFIGTNKSCSLQTVQALVADFNAGELADPAAKPEALTALVRARRPDAIDAAGWRAIDAAEIARGSQDGRPRNKFTDIGDMLAAAAAAEPAPPPRRRLLARLVPSGRG

SEQ ID NO: 2200 - protein, 158 aa, Mycobacterium paratuberculosis
MAINIEPALSPHLVVDNAAAAIDFYVKAFGAEELGRLPRPDGKLAHAAVRINGFMVMLNDDFPEVCGGKSMTPTSLGGTPVTIHLTVPDVDASFQRAVDAGATVVVPLEDQFWGDRYGMVADPFGHHWSLGQPVREVSPEEMAAAMAAMAAEQGAGQA

SEQ ID NO: 2201 - protein, 390 aa, Mycobacterium paratuberculosis
LLPAGSVRPRAGCENFPMTVVPENFVPGLEGVVAFTTEIAEPDKDGGALRYRGVDIEDLVSQQVTFGDVWALLVDGKFGHGLPPAEPFPLPIHTGDVRVDVQAGLAMLAPIWGYKPLLDTDDATARDQLARASVMALSYVAQSARGIYQPAVPQRVIDECETVTARFMTRWQGEPDPRHIEAIDAYWVSAAEHGMNASTFTARVIASTGADVAAALSGAIGAMSGPLHGGAPARVLPMIEEVERTGDARGLVKKILDSGDKLMGFGHRVYRAEDPRARVLRATAERLGAPRHEVAVALEQAALAELRERRPDRAIETNVEFWAAVILDFARVPANMMPAMFTCGRTAGWCAHILEQKRLGKLVRPSAIYVGPGPRSPESVEGWDRSLTNA

SEQ ID NO: 2202 - protein, 220 aa, Mycobacterium paratuberculosis
VPGPADEHLQRMRVEYGSVEKDGSPDLDVDWLDDGWVALLRKWIDDAERAGVAEPNAMVLATVTPDGRPASRTVLCKSLDETGITFFTNYDSAKADDLAATPYAAVTFPWYQLGRQVHLRGPVSKVTAQVTEDYWSKRPRGSQLGAWASQQSRPIASRAALLEQLAQVTARFADHERVPVPPGWGGYLIAADVVEFWQGRENRLHNRIRVTGDRVERLQP

SEQ ID NO: 2203 - protein, 431 aa, Mycobacterium paratuberculosis
VADTDDIATLKYPGGETDLEIVSATEGADGIALGSLLSKTGYTTFDNGFVNTASCKSAITYIDGDAGILRYRGYPIEQLAEKSTFLEVSYLLIYGELPDKDQLAEFTKRIQLHTMLHEDLKRFFDGFPRNAHPMPVLSSAVNALSAYYPDSLDPMDTEDVELSTIRLLAKLPTIAAYAYKKSVGQPFLYPDNKLSLVENFLRMTFGLPAEPYQADPEVVRALDMLLILHADHEQNCSTSTVRLVGSSQANLFTSISGGINALWGPLHGGANQAVLEMLEKIRQSDDDVSEFVRKVKNREAGVKLMGFGHRVYKNYDPRARIVKEQADKILAKLGGDDDLLDIAKQLEEAALTDEYFIERKLYPNVDFYTGLIYRALGFPTRMFTVLFALGRLPGWIAHWREMHDEGDSKIGRPRQIYTGYTERDYVTIDAR

SEQ ID NO: 2204 - protein, 516 aa, Mycobacterium paratuberculosis
VVIGGGHNGLVAAAYLARAGLRVRLLERLGQVGGAAVSAHAFDGVGVRVSRYSYLVSLLPPRIIDDLGARVRLARRRFSSYTPDPATGGARGLLIGAPGNPFAAVGADGDAPGFAGFYQRCRLVTERLWPTLLEPLRSRRHARRHVVDGGGADAAAAWRALVEEPIGAAIADAVGNDLVRGVIATDALIGTFARLDDPSLTQNVCFLYHVLGGGTGDWDVPVGGMGALTTALATAAVRHGAEILTGAEVFAVDPSGAVRYRSGDDEHVARARFVLAGVTPTVLAGLLGQHPAPAIAGAQVKVNMALRRLPRLADGGVTPEQAFAGTFHVNETWTQLDTAYARAAAGQVPNPLPCEAYCHSLADPSILSDDLRAAGAHTMTVFGLHTPHALARGADPDTLRGQLTDRVLASLNSVLAEPIQELLLTDARGRPCIETTTTADLERTLNMSGGNIFHGGLDWPFADDDNPLDTPARQWGVATAHERIMLCGSGARRGGAVSGIGGHNAAMAVLSSLSSR

SEQ ID NO: 2205 - protein, 87 aa, Mycobacterium paratuberculosis
MTDGSKPSENDTLARIRDLVAQEKTLRAQLQRGDIDTSEEHDRLRRVEVELDQCWDLLRQRRALRESGGDPREAQVRPPDEVEGYLS

SEQ ID NO: 2206 - protein, 407 aa, Mycobacterium paratuberculosis
VIFVGDDWAEDHHDVHLMDESGARLASRRLPEGLAGIGEFHQLLARHAEEPDQVVIGIETDRGLWVEALTAADYQVYAINPMAAARYRDRHHVSGAKSDAGDAKLLADLVRTDRHNHRRVAGDSADTEAVKVLARAHQNLIWTRNRHTNALRSALREYYPGALEAFDDLHDRDALAILGRAPTPMQAANLSLSKIRSALKAAGRQRNLDTVAQDIQTALRAEQLAAPAAVTAAFGATTRATVGIIAELNRQITDLEAELATHFETHPDADIYRSLPGLGVILGARVLGEFGDDPNRYTTAKCRKNYAGTSPLTVASGRKRAVLARHVRNRRLYDAIDQWAFCALNTSPGARLFYDRRRAAGDLHHQALRALGNRLVGILHGCLRHRTHYDEHKAWAHRQTNPDSQAA

SEQ ID NO: 2207 - protein, 451 aa, Mycobacterium paratuberculosis
MKLLSRIVTRTPSLRARVAVATAIGTAIVVVIAGAVVWFGITSAWRERLDRRLDETAGFAIPFLPRGLNEIPRSPKDQDTVITVRRDGQVKSNSDVTLPPMEEGYADTYINGVRYRVRTVEVRTPQPATVEVGATYDDTIAQTNNLHRRVILICALSIGAAAVFAWLLAAFAVRPFKRLAQQARSIDADERPQVAVRGASEAVEIAEAMRGMLQRIWKEQDRTKEALASARDFSAVTAHELRSPLTAMRTNLEVLSTLDMPDEQRKEVLGDVIRTQSRIETTLTALERLAQGELSTSEDHVPVDITELLDRAAHDAMRIYPGLDVSLVPSPTCIIVGLPAGLRLAVDNAIANAVKHGGATRVQLSAVSSRAGVEIAVDDNGSGVPEDERQVVFDRFSRGSTASQSGSGPGIGAGGPAGPAARRDGRAGKQPAGRCPAGPAPARAQLMGIEQ

SEQ ID NO: 2208 - protein, 233 aa, Mycobacterium paratuberculosis
MDTAASSPRVLVVDDDSDVLASLERGLRLSGFEVSTAVDGAEALRSATETRPDAIVLDINMPVLDGVSVVTALRAMDNDVPVCVLSARSSVDDRVAGLEAGADDYLVKPFVLAELVARVKALLRRRGATATSSSETITVGPLEVDIPGRRARVNGVDVDLTKREFDLLAVLAEHKTAVLSRAQLLELVWGYDFAADTNVVDVFIGYLRRKLEANGGPRLLHTVRGVGFVLRMQ

SEQ ID NO: 2209 - protein, 424 aa, Mycobacterium paratuberculosis
MTATPRACNRDRVALQAVHFFMADMEAGMGPFLGVLLQSRGWTTGAIGAAMTLGAIVGMVTVAPAGALVDATRHKRGCVIVVGLAAVAASAVILTSRQFWTVATAQAVMCISGATIAPAMIGITLGVVGQAAFTRQNGRNQAYNHAGNMAGAALGGVAGWVFGYAGIFWLAAGFAVATIAAVLAIPAGDIDHHVARGEARAAGEAPVKAMRVLARSRPLLVLAAAMVLFHLGNAAMLPLYGLAVVATHANPFTTVASTVVVAQAVMVPASLLAMRIAATRGYWPAILIALTALPVRGVLAASVITSWGVIPVQVLDGIGAGMLSVAVPGLVARILDGTGHINVGQGAVMAAQGLGGALSPVLGGAVAQHLGFRAAFLLLAGLSLGALIIWVTFAPMLRRAARLPAAPSDRAGAPPTATADNQAK

SEQ ID NO: 2210 - protein, 396 aa, Mycobacterium paratuberculosis
MRGADFVLPTDVPEAGRPLRIVLVAPPYFDVPPDGYGGVEAVVADLADMLVARGHQVTLLGAGEPGTAARFIPLWDRTVPERLGEPYPEIMHALKVRSAITRIAKEDGVDIVHDHTFAGPMNAPIYQGLGVPTVVTVHGPIDDDLHPYYRELSGDVGLVAISDRQRQLAPELNWVGRVHNALRIDEWPFETEKHDYALFLGRYAPYKGAHLALRAAHEAGIPLVLAGKCSEPSEKEYFEDCVRPLLTDNDHVFGEADAVSKRKLLSRARCLLFPIQWEEPFGIVMIEAMVCGTPVVALRGGAVSEVVADGVTGVVCDHPDELPGAIARAQTLDPHACRRHVATNFAVAQFGSAYEAIYRNVLQHATAAPRRMRSTGLVESIETGRRACDFRQKAPA

SEQ ID NO: 2211 - protein, 706 aa, Mycobacterium paratuberculosis
MSVATAFNGGAPAQIGSGGDAVTLVEGGTFCLSNRHGDVPVGTSYGLFFRDARVLSRWELRVDGQVAEALSVEATEAFAAQFILRRAPRSGLADSTLLIVRERLVADGLRETISLHNLDKESTVVSLELHADADFADLFAVKEGRAATAGADMHVADGELVLRGRADQVRGLTVSASGDPIVLPGSLNWRVVVPPGGRWQTEVMVQPTWSNRKVRTRIPRGKDIESSAPARKIERWRDTATTVETDHAGLAQVLRQTESDLGALLIHDADGRGRPYVAAGAPWFMTLFGRDSLLTAWMALPLDVGLSIGTLQRLAALQGRRVDALTEEEPGRIMHEIRRGPASADVLGGSVYYGTADATPLFVMLLAESWRWGADEAVIRSLLPAADAALAWAEQYGDRDGDGFVEYRRATDRGLINQGWKDSFNGINDAKGRVAEPPIALCEVQGYVYAALLARAELAEGMGELAQAAQLRERAQALRTRFGEAFWLPDRGWYAVALDGRKDRVDALTSNVGHCLWTGIATDEHAAAIVERLAGEEMDSGFGLRTLATTMGAYNPMSYHNGSVWPHDTAITVSGLLRYGHIPGALALAERLATGVLDAAAAFGGRLPELFCGFPRSQFASPVPYPTSCSPQAWASAAPLLLLRSFLGLDPHVPNRALTVTPHLPAEWGRIALSNLRLGATTVQLEAEGETVKVQGLGDDWQLVTP

SEQ ID NO: 2212 - protein, 155 aa, Mycobacterium paratuberculosis
RASPPATLKSRTRHAGPGVRGLSLDETRAGDETRAARLSQPQVALDCRGSGSALLAGDAAHVHSPAGGQGMNLGITDAISLAAALAQIARGGPDTVLDAYGDAQRQRAERVLRLTRVATLPRPLRPLRNAGMRLAAGIPGVQRWLAGQLSGLGHR

SEQ ID NO: 2213 - protein, 490 aa, Mycobacterium paratuberculosis
VSRITAGQLRDAVLDENSFLRWDSEPLAVPVSAAYAQELADARAATGLDESVLTGEGRIFGRRVAVVVCEFGFLGGSIGVAAAERITAAVQRATAEGLPLLASPSSGGTRMQEGTVAFLQMVKIAAAVRLHKQAHLPYLVYLRNPTTGGVFASWGSLGHVTVAEPGALIGFLGPRVYQQLYGEPFPEGVQTAENLQRHGVIDGVVPLDELRRTLDRAMTVIADAPEPLAAPPPPEPIPDVAAWDSVVASRRPDRPGVRLLLRHGATDPVLLSGTGQGEAATTLLALARFAGQPVVVLGQQRLTGGLVGPASLREARRGMALAAELRLPLVLVIDTAGPALSAEAEQGGLAGQIAQCLAELVTLDTPTVSVLLGQGSGGPALAMVPADRVLAALHGWLAPLPPEGASAIVFRDTDHAAELAAAQGIRSRDLLASGIVDVIVPEHPDAADEPVEFARRLALAVAAEVAALREIPADERLAARLRRYRRVGLP

SEQ ID NO: 2214 - protein, 243 aa, Mycobacterium paratuberculosis
MIGVTRAEAVLTIELQRPERRNALNSQLVEELREAVLKAGDGSTRAIVLTGQGTVFCAGADLSGDAFAADYPDRLIELHKVLDATPIPVIGAINGPAIGAGLQLAMQCDLRVVSPDAFFQFPTSKYGLALDNWSIRRLSTLVGHGRARAMLLAAEKLTADVALQTGMANRIGTLADAQAWAAEIAGLAPLAIAHAKRVLNDDGAIEEAWPLHKELFDKAWGSQDVIEAQVARIEKRPPKFQGA

SEQ ID NO: 2215 - protein, 369 aa, Mycobacterium paratuberculosis
MRGTLRLVAGTASLAAGGWLVRALHGAPDALGADPASIATVTSGSPHFRDGAFVNLEPASEIKMDREQLRLIAWELIANRGGSRPPAAIPLASPGVVDADPSRLAVSWFGHSTALLEIDGYRVLTDPVWSERCSPSDIVGPQRLHPPPIQLEGLPAVDAVVISHDHYDHLDIDTVRALARTQRAPFFVPLGVGAHLRRWGIPEQRIVELDWHQSGKVDELTVTCVPARHFSGRFLDRNTTLWASWALAGPTHRAYFGGDTGYTKTFAQTGAEHGPFDLTLLPIGAYNTAWPDVHMNPEEAVRAHRDVTDDGLLVPIHWGTFRLAPHPWAEPVERLLAAAEPAKVKVAVPVPGQRIDPAAPQKPDPWWRL

SEQ ID NO: 2216 - protein, 528 aa, Mycobacterium paratuberculosis
MSKRAAVLTAVLLGLTGCGSAQQPAGAPPRPSDVPPNQVSALAIPAGRIDEAVAKVDGLVADLMRSSGIPGMAVAIVHGGKVLYAKGFGVKDVTRGQGRDNAVDTDTVFQLASVSKSVGATVVAHEVSDHVVGWDTPVVSTLPWFALGDPYVTGHVTVGDLYSHRSGLPDHAGDKLEDLGYGRRQICERLRLLPLRPFRNSYAYTNYGITAAAEAVAAAAGKTWEELSDEVLYRPLGMTSTSSRFADFLARPNRAVNHIKIGDSWQARFQRNPDAQSPAGGVSSSVHDMARWLMMLLDNGTHDGQHIASPEALLPALSPQVVSAPATTPKARTGFYGYGFNTSVDASGRTEYSHSGAFDLGAATNFVVLPSEDLAIIALTNAAPNGIPETLTAEFMDLVQYGQIREDWAALYRKAIGWLNNPLGSLVGKQPPSAPAPARPLRDYTGVYANDYWGPAVINEHDGALQLTMGPQHRTATLTHWDGDTFTFPLTGENAPPGTVSTATFTGSPAARLNLEYYDTDQLGTFTR

SEQ ID NO: 2217 - protein, 790 aa, Mycobacterium paratuberculosis
MNTGLTDAEVAQRVAHGQRNAVRQRATRSIADIVRANVFTRINAILGVLLLIVLATGSVINGMFGLLIIANSVVGMVQEIRAKQTLDKLAIVGQAKPMVRRQSGTRALPPDDVVLDDIIELGPGDQVVVDGEIVEEANLEVDESLLTGEADPIAKAVGDSVMSGSFVVAGSGAYRATRVGSQAYAARLAEEASKFTLVKSELRNGINRILQFITYLLVPAGLLTIYTQLFTTHAGWQKSVLRTVGALVPMVPEGLVLLTSVAFAVGVVRLGQRRCLVQELPAIEGLARVDVVCADKTGTLTESGMRVARVDELDGSGHDRIADVLAALAAADPRPNASMRAIAQTYSRPPGWTVTATAPFKSATKWSGVSFAGHGDWVMGAPDVLLDSGSAAAGQAERLGAQGLRVLLLGAADRAVDHPDAPGPITPVALVVLEQKVRPDARETLDYFADQGVSVKVLSGDNAVSVGAVAGELGLHGETLDARQLPSDLAQLADMLDTYTTFGRVRPDQKRAIVHALQSHGHTVAMTGDGVNDVLALKDADIGVAMGAGSPASRAVAQIVLLDNRFATLPYVVGEGRRVIGNIERVANLFLTKTVYSVLLALLVGFECLFAKALKADPLLYPFQPIHVTVAAWFTIGIPSFILSLAPNNERAHPGFVRRVLSSALPSGLIVGAATFASYLVAYHGRHATFQQQDQASTAALITLLVTALWVLAVVARPYQWWRVALVIASGLAYVVIFSLPLARKAFLLDPSNVVVTLSALGIGVLGAAAIEVAWWIRAKMLGVRPRVWR

SEQ ID NO: 2218 - protein, 62 aa, Mycobacterium paratuberculosis
MGFLDKAKDLLSQNADKVEMAIDKAGEFVDEKTQGKYSDTIHQVQEQAKKATGATETGDQQG

SEQ ID NO: 2219 - protein, 153 aa, Mycobacterium paratuberculosis
VAKLSGSIDVPLPPEVAWQHASDLSRYKEWLTIHRVWRSTLPDQIDKGTVVESIVEVKGMLNRIKWTVVRYKPPEGMTLNGDGVGGVKVKLMAKVQPKADGSVVSFDVHLGGPALFGPIGMIVAAALRGDIDQSLENFVTVFARSDPSTNGHR

SEQ ID NO: 2220 - protein, 144 aa, Mycobacterium paratuberculosis
MTRRLRPGWLVALCAVLISASAWLPWLRTTVNGGGWANAIGGAHGNLELPRGFGAGQLIVLLASTLLVAGAMMGRGLSVKVASVAALLISLLIVALTVWYYKLNVNPPVSAEYGLYVGAGGAACAVACSMVATIAVLVSGRSRR

SEQ ID NO: 2221 - protein, 539 aa, Mycobacterium paratuberculosis
LPRCSLSSQEPTMDVNAVSNPLERCYMSAFLRSVSLSMASAAAVGFVLVVGPAPTANATPCGAPEANVDPPAAPPAMPAPQPVVQPPTGRRPTHTNDQAPLPKLGPLISSLLKPSAPGRQYSAPVHPRAEGPGPDPSAPMYPQAEVLPPGPNPPTPGGAVPPNANQLRPNAAPMPQPQPQPQPAPGPPPPSIAGAPTSLVDWVTGPNGPNKTLQRFSISGTDLGIAWDNGDPANRQVLMAFGDTFGYCKVHGQQWRYNTLFRSNDHDLSHGIHIADGVPNDRYSGSPVWAPGLSKQVVNTIHKAAHETGIIPTSGMSMGRTQYMSYMSIRQWGRDGEWSTNYSAIARSTDNGQNWGIFPTSIRTASPDAIPGAGFTPGNENFQMGAFLKGNDGYIYQFGTPSGRGGAAFLSRVPPNQLPDLTKYQYWNGDNGGHWVANNPGAATPIFPGPVGEMSAQYNSYLKQYLVLYTDGGSNDVVARTAPTPQGPWSPEQPLVSSFQMPGGIYAPMIHPWSSGRDLYFNLSLWSAYDVMLMHTVLP

SEQ ID NO: 2222 - protein, 128 aa, Mycobacterium paratuberculosis
MIALEYHDDSCGLADPLTPLAAAALPDDVPASSAADVTGRRDDDGAEGHTVFDGHRPDFWTIGRPGLRDIEVCIESTRADGAISLGLVVNGLDCSGVPIDQALSLADARGDAGVCGVSCRGGGHLKAS

SEQ ID NO: 2223 - protein, 425 aa, Mycobacterium paratuberculosis
VVKRPRITTERNIAMALDQSALLEVLDALRNADAADRIKQAAETIYQALIDAELTAVIGAGPHERSASRTNQRNGSRPRTLSTIAGDLELRIPKLRSGSFFPALLERRRRVDQCLFAVVMEAYLHGTSTRKVDDLVKALGADAGISKSEVSRICADLDTEVGAFRDRPLSEQHFPYVFLDATYCKARVNHRVVSQAVVIATGVAADGRREVLGFDVGDSEDGAFWTAFLRSLKTRGLSGVQLVISDAHTGLRSAIEAILIGASWQRCRVHFLRNVLAQVPKGSAEMVAAAIRTIFAQPDAEHVREQLDTIAGMLGRQLPKVETMLREAADDITAFADFPVLHWKKIWSTNPLERLNKEIKRRTDVVGVFPNPAALLRLAGSVLVEAHDEWQVAEKRYLSETTLALLHPRSDSADQSVAVPAAITA

SEQ ID NO: 2224 - protein, 395 aa, Mycobacterium paratuberculosis; identical to SEQ ID NO: 1793

SEQ ID NO: 2225 - protein, 281 aa, Mycobacterium paratuberculosis
MTPFRTTRNHGVSRIHRPSTDHRSALTFGLRNERSPSAATKGLHGGNDENHRLRARSNRTAGTHLRHRSFDPRRREMTPGGPHRGGRGEPDDRGANRDALSHFFAGPTDDDRARLRADLLARAGQVRATGWEPYHGLWSTGEVIGVALLLGDHAELAALGETVQSALERWAFDLWGLDGGQADVDDGCEETREWFLDAAYEFGGQEAVRERSEEPAAEDIPMSELLAAESGHDVDFDPERLGELASDDALREQLSRAAESPTVRRARPRRSSYSDPRDGAK

SEQ ID NO: 2226 - protein, 525 aa, Mycobacterium paratuberculosis
MSDLDEVRTSIDAGLAARSAGGAEGQRAGGASVASALGSTQSYCFTTSATSGGGVSAVDPGERRRIRWGARAMLWQASSLKAVRCCGRVLHNDAVGDPDDGQGVVIKRREVDGRMVASLHGLMTCGSVWACPRCSAVIANTRAAEIGATVRECYRRGGRVYLLTLTMRHSRRDGLADLWDSLSTAWRSVFGTRNWTGQKERMVQRRRGLALLPEIMGDAERFDIAGVTRVVEATYGKPELGGHGWHLHIHALVFSVTSLSSGLIEGIERTLGRGVNHDWLARNVFAARIHQRWSQGLAKAGCQMPGSVAVDVREIDDEGAEYVGRYLSKATYDVAARIGLEVGAGVSTKDARAERNQTPFEVLANLAESVDARGFGIRTPRHWAVLPAGNGDWAVIDSDTGEVASITAPGQWKVWHEWEQASCGRRQITWSRRRSNPESGREMLWNDLLDSRGRSAEASDEEIAVDEVDAESVGVISRQVWYQVFAWRPGLIVDLLEAAERCGVAAVGVLSQSAGCDVAGWPPGG

SEQ ID NO: 2227 - protein, 575 aa, Mycobacterium paratuberculosis
MRPGCHLILFGYLSVLNARTSTMRAGWYWRPDIAGVMRVFEDTGEYPDHSALYRKGYVWVAVFARTTGGSADWTYLHRDSDEIRASEPITQTHALAQLAGLGIDTAMLNEREMLLDGEGFSDLDVPPLELAKQRINTWGADPNTQLWACVDFDYLKKSDRQGARQFQRPRERPVQAWVLRRGAALIAAVRPDTGSFCVIAQEQFDGTTTARKFLEVAAQVHRVLGHNLLNGDYQAIGQLVELSDELIGKTVDTQDILLRVEFARRPRIRSSRGLGLSELLRLNTGHLRSKAAGETTIWGMPVDTTPVRWKEDPIHDCQETVALWSALVAAGRVVTGRSQPESLPFDRVAIAQLQGEIPCITGRQWRAERRGEPPSGHRGVVKHHSTNQLTAALTTPISDKTLVQLQRVHWRLSAHALICESSTTDLLISAVQYMSPKLNSQLRTQIGDLCDELIEQYAVALWELTHRKEAEASVAIWQQGQEHPVPAMVWPFVQECLREHRAGARRAAHGGTPAIPSHYSDALHYFTSHTDTAALRKWLLQLHTHPAFTAWRYNSAAYRELSETPGYQQLCRLWT

SEQ ID NO: 2228 - protein, 78 aa, Mycobacterium paratuberculosis
MSEMIRTDSRGRVTLAGHPDSAYLLREEPGGVLVLEPAVVMSAAQASYLALPVADRARIEEFVDDPSTAVKRTYKRRR

SEQ ID NO: 2229 - protein, 93 aa, Mycobacterium paratuberculosis
VGIEYAPEAAAQLDALEQSADDQTWDAICDVLELIDQTPDSAQARREEITGSNGSKMWKVPVRSLSVDDLAVLWSRGSAGDYVVFVGVMPIAR

SEQ ID NO: 2230 - protein, 202 aa, Mycobacterium paratuberculosis
MTLRTETWYTSDLHIGHRLVANLRGFAETTDHDAEIAERWDRLVGDNDVVWVLGDISGGGRSSQLRALAWLADRPGTKHLVAGNHDGVHPMHVDAHKLLPAYLQTFASVQQSARRKLAGHYILLSHFPYLDADQQDVRDARFNQWKMADLGAWLLHGHIHSSRRLAGRTIHVGLDAWGLSPVSLNVIAELIQKDRTDVAGDN

SEQ ID NO: 2231 - protein, 423 aa, Mycobacterium paratuberculosis
VRGQYGYTSPALTAVRCLSDARWTRSMLELVGLSRALPTKRSAWSLLAEGAVRNRVPTRMTYLKSYVPTLISVAPAPYGANARFAGLLGQDLRQWQVAAPKLASAIGVPNVVVTEPVPGVFELQLRIVDPLSSPLEWSSVPAAHSWSLSLGIDEMGVYQSLPLANVSGVVVGGVPGSGKTAWLTSALGSFGASAAVQFAVIDGKGGQDLECLRARSCRFMNDDLELPEIAAILNDATGLVRDRIRQGNNIFGSSNFWDRGPTPQVPLVFVVIDECQAFLDPRQLVTKERKAIGAEIHASVNYLVRKGRSAGVVSILSTQKPTADSLPTDIRDNASLRVCFGVQSTYAATAVLGDGWRSDTDVSPLGMSSGVGVSFIGGHFRRFRAPFVRERVIATHSWRWSSLNRDPWELLRPELADGHVRDS

SEQ ID NO: 2232 - protein, 267 aa, Mycobacterium paratuberculosis
LIVVAGYCGLRWGELAALRWADVDLANKTLRVARAYSEEAPRGEMSPVKDHQARTVPIPAIVSEELATFRTDQKPNDLVFPSANGTPLRNRNFRRDVFDDAAEDLGLNITPHNLRDTAASLAIQAGASVVAVARLLGHESAATTLNHYAAFFPTDLDDVASRLNAAARLTIAVQRARQDREARIEGELGQQPGYIEQLEYDAAHPENAVEVDGEQASARDETEYLLSSPENARRLLEALGRDKAIHPAPSDTTEAPTTHRPERSDEQ

SEQ ID NO: 2233 - protein, 272 aa, Mycobacterium paratuberculosis
VAKDFRFGMSMRFYKSREALLDKAKRAEDAGFDILCVPDHLGAAAPFPTLTAVAMVTTTLRLSMYVLNSAFYKPALLSRDMQALDLLSDGRLEIGLGTGYVREEFEAAEIPYPSARERVDYLEHMTKYLKEHHPSTPLIIAGNGDRVLTIAARNADIIGLTGAKVRDVEDPFAERVEFVRNAAGDRFDSLELNLAITAMPRVGETEPDLKLTRSYSPELTDEQILSMPSVLSGSPRDIADTLSAYRDKYGVSSFTVQDNHIDNFAKVIAELR

SEQ ID NO: 2234 - protein, 359 aa, Mycobacterium paratuberculosis
MPARRHLYFAYGSNLCARQMAQRCPDAADPRPAVLADHDWLINQRGVATVEPLAGNQVHGVVWRISDGDLATLDSAEGVPVRYRRDRLTVHTDDGPAPAWVYIDHRVTPGPPRPGYLPKIVDGATQHGLPQRWIDFLRRWDPAGWPSPRATSPSNGLGPQSLSALLRVTGVTESSQLRSGFGFLAIHGGGLEEMTDVIAERAAAAAGASVYVVRHPAAYPHHLPSARFDPAESPRLAEFLDHVDVAVSLHGYGRDGRSTQLLAGGRNRALADHLARHVRLAGYRVITDLEDIPAELRGLHPANPVNRVRDGGVQLELSARVRGLSPRSPLPGDDGLSPVTGALIQGLADAARCWSMSDH

SEQ ID NO: 2235 - protein, 425 aa, Mycobacterium paratuberculosis
MFDYPHFLIRLWESRSTLAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 2236 - protein, 358 aa, Mycobacterium paratuberculosis
MPIPVVQLGTGNVGIHALRALITDPQFELTGVWVSSDAKAGKDAAELAGLAQPTGVLASTDLDAVLATGPRCAVYNALADNRLPEALDDYRRVLAAGINIVGSGPVFLQYPWQVIPDELIKPLEEAAQQGNSSLYVNGIDPGFANDLLPLALAGTCQSIQQIRCMEIVDYATYDSAAVMFDVMGFGKPLDDTPMLLQPGVLSPAWGSVVRQLAAGLGVSLDEVTQQHVRVPAPEDFDIASGHIAKGTAAALRFEVFGMVDGRPVVVLEHVTRLREDLCPDWPQPAQHGGSYRIEVTGEPSYAMDICLSSRKGDHNHAGLVATAMRVVNAIPAVVAAPPGIVTTLDLPLITGRGLYRPE

SEQ ID NO: 2237 - protein, 263 aa, Mycobacterium paratuberculosis
MILDRFRLDDKVAVITGAGRGLGAAIAVAFAEAGADVLIASRTESQLEAVAEQVRAAGRRAHVVAADLAHPESTAELAARAVEAFGKLDIVVNNVGGTMPNTLLTTSTKDLKDAFTFNVATAHALTVAAVPLMLEHSGGGNIIKITSTMGRLAGRGFAAYGTAKAALSHYTRLTALDLCPRIRVNAIAPGSILTSALDVVASNDELRAPMEKATPLRRLGDPVDIAAAAVYLASPAGEFLTGKTLEVDGGLTYPNLDIPVPDL

SEQ ID NO: 2238 - protein, 369 aa, Mycobacterium paratuberculosis
LKLNRFGAVLSVLSAGALVLSGCGSDNNGAGAGAGGSSSSKVSCGGKKALKASGSTAQANAMTRFVNAFEQACPGQTLNYTANGSGAGISEFNGKQTDFGGSDSPLAPSEYAAAQQRCGSPAWNLPVVFGPIAITYNVAGLNSLNLDGATAAKIFNGAITTWNDPGIQALNPGVALPAEPIHVVFRNDESGTTDNFQKYLDAAADGAWGKGAGKTFKGGVGEGAKGNDGTSAAIKATEGSITYNEWSFAQAQKLNMAKIITSAGPDAVAISADSVGKTIAGAKISGQGNDLVLDTLSFYKPTQAGSYPIVLATYEIVCSKYPDPQVGTAVKAFLQSTVGAGQNGLADNGYIPIPDAFKSRLSAAINAIT

SEQ ID NO: 2239 - protein, 326 aa, Mycobacterium paratuberculosis
VTRGTATAQLPAPTTLNARVPRRGDRLFKAIAAAAGFTIVVAIALIAVFLLLRAVPSLRVNHANFFTSAQSSTSDPHRLAFGIRDLLMVTVLSSLSALVLAVPIAVGIAVFLTQYAPRRLARPFGAIVDLLAAVPSIIFGLWGIFVLAPQLEPVAAFLNRHLGWFFLFKTGNVSLAGGGTIFTAAVVLSVMILPIVTSVSREVFRQTPHIQMEAAQALGATKWEVVRMTVLPFGRSGVIAASMLGLGRALGETVAVLIILRSAARPGHWSLFDGGYTFASKIASAAAEFSSPLPTGAYISAGFALFVLTFIVNALARAIAGGKVNG

SEQ ID NO: 2240 - protein, 302 aa, Mycobacterium paratuberculosis
MTRAVDALDRPVKTEVFRPLSVRRRITNNAATIFFLGSFVVALVPLIWVLSVVLERGWYAVTRSGWWTHSLHGVLPEQFAGGVYHALYGTVVQAGVAAAMAVPLGLMTAVFLVEYGSGRLVRLTTFMVDVLAGVPSIVAALFIFSLWIATLGFQQSSFAVSLALVLLMLPVVVRSAEEMLRLVPDDLREASYALGVPQWKTIVHIVFPIAMPGIVSGILLSIARVIGETAPVLVLVGYSRSINLDIFHGNMASLPLLIYTELTNPEHAGFLRIWGAALTLIIIVAVINVIAAATRFLAGRRR

SEQ ID NO: 2241 - protein, 302 aa, Mycobacterium paratuberculosis
MRSIWKGSIAFGLVNVPVKVYSATEDHDIKFHQVHAKDNGRIRYQRVCELDGEVVEYRDIARAYESDDGQMVIITDDDIATLPEERSREIEVLEFVPANEVDPMLFDRSYFLEPDSKSSKSYVLLAKTLAETDRMAIVHFTLRNKTRLAALRVKDFGKRDVMVIHTLLWPDEIRDPDFPILDKKVEIKPAELKMAGQVVESMAEDFNPDRYHDDYQEQLHELVQAKLEGGEAFTTEEQPKQLDETEDVSDLLAKLEASVKARSGDGKAPAKKSPAKKTAAKKAPAKKGAAKKAPAKKAASRS

SEQ ID NO: 2242 - protein, 302 aa, Mycobacterium paratuberculosis
MTRGLVIGESLIDIVEDAEYVGGSPLNVAVGLGRLGRDVDFLTYLADDDHGRRIAAYLKDAGVQLVSESRAAERTATARSTIAADGSADYEFDLDWRLSGTPPVAPPLFVHTGSIAAVRDPGCLAVAALIDTYRVSATVTFDPNVRPSLIADRELAVSRIEHLVERSDIVKVSAEDLHWIDPDRSPEQLAQTWLGLGPAIVAVTMADRGAVGYCAAGTARVPTRAVRVVDTVGAGDSFMAGLLDALWEAGLLGGDRRGALRDIGIDTLTSALDAASLSSALTIARAGADLPDRAAVQAALRR

SEQ ID NO: 2243 - protein, 470 aa, Mycobacterium paratuberculosis
MEADGINLNNATLPTLPIEAPNYDRGSVTVGIAHIGAGHFHRAHQAMYIDRLLQAGLAREWGICGVGVMPADWTMRDVLNDQDGLYTLILEKPDGSRDAHVIGSIIDYRYAPDDPESALEVLAAPTTRIISLTITEGGYRDPEGPAFAFIVEALDRRRRRGIAAPTIASCDNIENNGEIARRAVLANAEARSPELAEWVDEHVCFPSSMVDRITPSTTLQMAAEVRRDFGVNDRWPVVAEPFTAWVLEDKFADGRPPLERAGVLLVDDVAPYELMKLRMLNAGHQCLAYFAHLCGFEFVHEAARDPLFAEYLWAYFESEAIPTLPPVPGIDLYDYGHRLIERFTNPGVRDTIARLCAFSSDRIPKWLLPVINDNLANDGSVRIAAAAVASWARYAEGTDEWGKPFEVVDQLADSLIPIARSQYENPTAFIEIAGVFGDLAHQPRFVQAYSWALESLHRKGARATLEELVR

SEQ ID NO: 2244 - protein, 286 aa, Mycobacterium paratuberculosis
MKPEGLTMVREFDPAPITTLLCDADDNLFPSERPAFAASVEVINRFLARFGVAAPFTAEQLRKQAVGKNFRSTALDLAVASGVPIDQTLAQGRPEAVVASADDTAADRALCAEELEQWVLQEREQVTAHLAATLRPDPEVLAPLQDLASRYALAAVSSSALKRLAGCFSATDLDPLIPASVRFSAEDSLPVPTSKPDPAVYLHAGQVLGVAPEQGLAIEDSVAGVSSAVAAGYATVGNLMFVLPDERDCRRAELIDAGAVAITDSWRALADVLLSSAVPAAGSSLA

SEQ ID NO: 2245 - protein, 512 aa, Mycobacterium paratuberculosis
MSYIDCFSRVVARRRMRALPLSNATLPLHSQRIDVPTYDRSALQRGVVHIGAGNFHRAHQAVYFDDLACSGISDQWGVSAISLRSHDVKDLLSAQDGLYTVVQRGHDHQTARVVGSIGSVHYAPNDGAAVRAALTDPRTRIVSLTITPNGYFLDPVTREFDADHPDVRADLVASGCYGTAWGYLTEALEQRRRAGIAPFTVLCCDNIPDNTQAARTALVSFAALKNPGLARWIDRHVAFPSTMVDRITPQTSDSEREFVERTFGVADNWPVLTEPHSQWIIEDAFSDGRPPLDEVGVQFVTDVSDHKLIKTRLLNGTHIALACLATLAGYRRTDEAMKDPVIFDYVERLMRDEVQPLLPPVPGMNTPDYRDTLLTRLGNPRMSDQLSRLARRGSTKIASFLLPSLHEAIAQDRPHTLLMLALAGWARYLRGYDLNGRKIRIDDPEADLLTKLANMAGNNPDPLLRHEILADLRLVPGFSERLGEMVASIDEHGVIATLRQSLQDDSRELVAR

SEQ ID NO: 2246 - protein, 764 aa, Mycobacterium paratuberculosis
MNAPRAWPAEPTATPRVKLTNADKVLYPATGTTKADVFDYYTRIADVMIPHIAGRPVTRKRWPNGVDQESFFEKQLASSAPDWLPRASVTHRSGTTTYPIIDSATGLAWIAQQAALEVHVPQWRFVAEWTRSRAEELKPGPATRLVFDLDPGEGVTMAQLAEVARAVRDLIDGIGLQTFPLTSGSKGLHLYTPLTEPVSSKGATVLAKRVAQQLEKTMPKLVTSTMTKSLRAGKIFVDWSQNNGSKTTIAPYSLRGRDHPTVAAPRTWDELDDPALRHLRYDEVLTRVARDGDLLAELDDNQTPVPDRLTKYRSMRDASKTPEPVPDAKPAAGQGNTFVIQEHHARRLHYDFRLERDGVLVSWAVPKNLPDTPAVNHLAVHTEDHPLEYGGFEGVIPKGEYGAGRVVIWDSGTYDAEKFQDDEVIVNLHGRKISGRYALIQTQGDQWLAHRMKDQNVFEFDTIAPMLATHGSVSALKASQWAFEGKWDGYRLLVEADHGTLRVRSRRGREVTGEYRELRSLAKALEEHHAVLDGEAVVLDKRGVPNFHEMQNRGKSARVEFWAFDLLYLDGRSLLRARYRDRRKLLEMLASGGALTVPELLPGDGDQALRQSAERGWEGVIAKRRDSTYQPGRRSSSWIKDKHWNTQEVVIGGWKAGEGGRSSGIGSLLMGIPGPGGLHFAGRVGTGFTERDLANLKKTLAPLRTDQSPFDAPLPRSEAKGVTFVEPVLVGEVRYSEWTPDDRLRQSSWRGLRPDKEASEVVRE

SEQ ID NO: 2247 - protein, 645 aa, Mycobacterium paratuberculosis
VKWVTYQGDDGERVGVLRDDTIYAMGSGVTLLDLIARGAEGLRHAGEEAQRSPAATVPAARARLLAPIPRPPSIRDSLCFLDHMRNCQAALGAGRVLADTWYRVPAFYFACPATVLGPYDDAPTAPGSAWQDFELEIAAVIGTGGKDLSVEQAEQAIIGYTIFNDWSARDLQQLDSQLGIGQAKGKDSGVTLGPYLVTPDELEPYRRNGKLDLRVTASVNDTVIGSGSTAQMDWTFGEVISYASRGVTLVPGDVIGSGTVPTCTLVEHLDPAALESFPGWLHDGDVVTLRVEGLGETRQTVRASGAPHPLAARPNPDAPPAAPRVNRAAARVPYTRGLHQVGDRVWAWTLPDGGYGWSNAGLIAGDGASLLVDTLFDLALTREMLTAMRPITASAPITKAVITHSNGDHTHGNQLLDPAVRIIAAHGTAEEIAHGMAPEMLAMAQTADLGPVATRYTRERFGHFDFSNITLRNADETFDRSLAVEVGGRRVDVLNLGPAHTAADSVVHVPDAGVLFGGDLLFIGCTPIVWAGPIANWVAACDAMIALDAPTVVPGHGPVTDPDGIRAVRGYLVHIAEQAEAAYRKGLSWSEAADTIDLGEYATWLDAERVVVNVYQRYRELDPHTPQLEAMALLVMQAEWLARRS

SEQ ID NO: 2248 - protein, 307 aa, Mycobacterium paratuberculosis
HARMTRSEGDTWNLASSVGATATMVAAARAAATRRPRPVLTDEYAEPLVRAVGLDVFTKLASGELDPDDLERDVGFARMVDTFAARGRFYDDYFAAAGKAGVRQVVIVASGLDARPYRLSWPAGTTVYEIDQPEVIAFKTATLSRIGAAPTAELRTIGIDLRQDWPAALQDAGFDPAQPTAWLAEGVLIGFLPPEAEVRLLDSITPLSAEGSRFAADYGSLNDASQASTEQARRTTEGWRRRGLDMDIAALTYPGKHTDVAAHLGADGWATTTFGLADLFAAAGLPELTEAEQGPAATLSFVRAIKS

SEQ ID NO: 2249 - protein, 287 aa, Mycobacterium paratuberculosis
MRACYAGSLNCRGVAYGSPMPAVEFATLDDDIACITLNRPERLNAIDGSLIDGVHEALDMLDNGDHRVAVLTGAGRGFCAGADLSGTGRPWTRNKPTTPAFKVNYDAQVRLASLYTRIYELDIPVIAAVNGVAVGGGLAFALVSDIRVGSEQARFGSVFIKAGFSSMDMGTSYLLPKIVGAGVARELMLTGRIIDAAEAYRIRLVHEVVAPDQLMPAALRLARSIAENNAYGVWQTKIGLNAALDAPSLRHAIELENRTQILSGFTNNPAEAALAHREKRAPRWDPL

SEQ ID NO: 2250 - protein, 288 aa, Mycobacterium paratuberculosis
VRFTYAEAMTDFRYYIPLAKAAEAAGYHAMTIADSIAYPFESDSKYPYTPDGSREFLDGKEFIETFVLTSALGAVTSKLRFNFFVLKLPIRPPALVAKQIGSLAAMTDNRVGFGVGTSPWPEDYELLGVPFARRGKRMDECIEIIQGLTTGEYFEFHGEFYDIPKTKMTPAPTKPIPILVGGHADAALRRAARLDGWMHGGGDPEELDHLLAKLKRFREEAGKTGPFEIHVISADAYTPDGIKRLEDKGVTDVIVGFRIPYIKGKDTEPLDTKIRNLEMFAENVIAKV

SEQ ID NO: 2251 - protein, 254 aa, Mycobacterium paratuberculosis
MSRVAESAGSLAVSTRTDDAATVLTVDGVLDPASSTLLRDRIIKATLDQTRAVVIDVSALKVNAESTWSTFMATYWQLGNTPHVPLVLVCAKKAAREAIARSGITHFMPVYSSQKAALKALGPNSRRIVRRADAQLPADLTSLRESRRLVREWLTTWSQSKLIPVALVVVNVFVENVLEHTASVPVMRVEAQGTTATIAVSDASNTPAVRLPSPVKGIDVSGLAIVDALSRAWGSTPTASGKTVWAIIGPENQL

SEQ ID NO: 2252 - protein, 306 aa, Mycobacterium paratuberculosis
VGSRLRPIPQTHRGDRHRRRRRAPPRPAGAHRGVGPGVRSCSPPGGARDTALANPRPTPAASDTATARAGDRAVADPGGDPLGRADADGAHHHVDAIIYGTGFAIPAHVADDTITGAGGLPLRRAWPDGTEPFCGVAVRGFPNYFFASGPDPGPQARYIVECLKLMQRTGSRRIEVRASSQQVFNERAQLRPVEPPPVASAFDLSASTPAGDDTYDGAATLEIAGDRHPVRVRLTGHLDPIDGRYHWQGTVFGSPSQPLPGDLLGQARAATLTVGQRSAPARIVERTPWGTHTVAGIGAPPYPGHR

SEQ ID NO: 2253 - protein, 307 aa, Mycobacterium paratuberculosis
MTRAETIRSDARPTGPSREEFSERLLKGSVKKSYEPVVDIDWDAPLDPDKFFLPPRLVSLYGTPMWDEMTREQQIELSRQELVNTLSAGIWFENMLNQSLLRTILHEDPTSRSTHYKLTELGDETRHMVMFGKAIERVGAKPVQPKRFHRYIINALPLAFQRGSMLWVAALIGEEIFDSLQRQMMDDPELQPIIQRLMRIHVTEEARHIQFARDGARKRVAEMPRLNRWFMANINGLGGYFFNYLFSNPVPYARAGLDPKRARKTARTSAHRREIQIAGFAPLAAFLTEVGLMGPLARRGWKRSRFL

SEQ ID NO: 2254 - protein, 271 aa, Mycobacterium paratuberculosis
LRSRLGPCGIDSAMWATEASQEGRLGRHIHVIGIGAGDPDYLTVQAIEALNDTQVFFAMDKGEQKSDLVALRREICSRFIRQPGYRFVELRDPKRSDRADYRDAVAEWHAARAQIWADAIAAELGPHGVGGFLAWGDPSLYDSTLRILDTVAGHVEFTFDVIPGITAVQALTARHRIPLNEVGEPVLITTGRQLRAHGISGSAVVMLDADCSFQRCAPETRIWWGAYLGTADELLVAGTVGEVGPRIAALRAQARARHGWIMDTYLLRPAH

SEQ ID NO: 2255 - protein, 287 aa, Mycobacterium paratuberculosis
VPELPEIEALADHLRRHAVGLPIGRVDVAALSVLKTFDPPISALHGQTVVGAERWGKYLGLRTEGLFLIAHLSRAGWLRWSDRLTAAPLRPGKGPIALRVHLGTPGAAPGFDLTEAGTQKRLAVWLVDDPARVPGIAALGPDALDLDVDALADLLAGNTGRIKTVITDQKVIAGIGNAYSDEILHVAKISPFATAGKLSDKQLATLHDAMVTVLTDAVSRSVGQGAAMLKGEKRSGLRVHARTGLPCPVCGDTVREVSFADKSFQYCPTCQTGGKILADRRMSRLLK

SEQ ID NO: 2256 - protein, 253 aa, Mycobacterium paratuberculosis
MLPEMTRQKILITGASSGLGAGMARAFAAKGRDLALCARRADRLDELKAELSQRYPAITVAVAALDVNDHEQVPKVFAELSDELGGIDRVIVNAGIGKGAKLGSGKLWANKATIETNLVSALVQIETALEMFHKNGSGHLVLISSVLGNKGVPGVKAAYAASKAGLSSLGESLRAEYAKGPIKVSVLEPGYIESEMTAKSNSTMLMVDNETGVRALVAAMEREPGRAAVPWWPWAPLVQLMRVLPPRLTKMFA

SEQ ID NO: 2257 - protein, 554 aa, Mycobacterium paratuberculosis
MTSVHTLPDITATPAWDALRKHHDRIGDTHLRQFFEEDPDRGRELTVTVGDLYIDYSKHRVTRETLRLLVDLARTAKLEERRDQMFAGVHINTSEDRAVLHTALRLPRDAELIVDGRNVVADVHEVLDAMGEFTDRLRSGEWTGATGKRISTVVNIGIGGSDLGPVMVYQALRHYADAGISARFVSNVDPADLIATLADLDPATTLFIVASKTFSTLETLTNATAARRWITDALGDAAVAHHFVAVSTNKRLVDDFGINTDNMFGFWDWVGGRYSVDSAIGLSVMAVIGREAFADFLSGFHIVDRHFQTAPLESNAPVLLGLIGLWYSNFMGAQSRAVLPYSNDLARFAAYLQQLTMESNGKSTRADGSPVTTDTGEIFWGEPGTNGQHAFYQLLHQGTRLVPADFIGFSQPIDDLPTAEGSGSMHDLLMSNFFAQTQVLAFGKTAEEIAAEGTPADIVPHKVMPGNRPSTSILANRLTPSVLGQLIALYEHQVFTEGVIWGIDSFDQWGVELGKTQAKALLPVITANNSPAPQSDSSTDALVRRYRSERGRTS

SEQ ID NO: 2258 - protein, 106 aa, Mycobacterium paratuberculosis
MRPQSPDDDDDAESAEMNTETVDPREATDIDQLRREIDRLDAEILAAVKRRTEVSQAIGRARMASGGTRLVHSREMKVIERYSELGPDGKDLAMLLLRLGRGRLGH

SEQ ID NO: 2259 - protein, 774 aa, Mycobacterium paratuberculosis
MSVHVTDAKPVSEAEQLLEGLNPQQRQAVVHEGSPLLIVAGAGSGKTAVLTRRVAYLIAARGVGVGQVLAITFTNKAAAEMRERVVRLVGNRARAMWVSTFHSTCVRILRNQASLIEGLNSNFSIYDADDSRRLLQMIGRDMGLDIKRYSPRLLANAISNLKNELIDPAAAVANLTDGSDELSRTVASVYGEYQRRLRAANALDFDDLIGETVAVLRAFPQIAQHYRRRFRHVLVDEYQDTNHAQYVLVRELVGTDTEDGVPPGELCVVGDADQSIYAFRGATIRNIEDFERDYPDATTILLEQNYRSTQNILSAANSVIARNSGRRDKRLWTDAGAGELIVGYVADNEHDEARFVAEEIDALAQKGEITYNDVAVFYRTNNSSRSFEEVFIRAGIPYKVVGGVRFYERKEIRDIIAYLRVLDNPGDAVSMRRILNTPRRGIGDRAEACVAVYAENTGASFADALVAAAEGKVPMLNSRAEKAIAGFVELLDDLRGRLDDDLGDLVESVLERTGYRRELESSTDPQELARLDNLNELVSVAHEFSTDRANAAALDESLDAADDEDVPDTGVLAEFLERVSLVSDSDEIPEDGAGMVTLMTLHTAKGLEFPVVFVTGWEDGMFPHMRSLDDPVELSEERRLAYVGITRARQRLYLSRAIVRSSWGQPMLNPESRFLREIPQELIEWRRTAPAPSFSAPVSGAGRFGTPRAAPTRAAMSKRPLLVLAPGDRVTHDKYGLGRVEEVSGAGESAMSLIDFGSSGRVKLMHNHAPISKL

SEQ ID NO: 2260 - protein, 207 aa, Mycobacterium paratuberculosis
VALWSATTLVEVTAPNDPPSGPRPSEPAAEPSPPSDTRTRIIRRAPTGPIPVTPDSPTTHFAPQPPSYRGGPRAGRTGYSGLPALEPSDRTAVAACAVAIVSGWATSVVATDLIAGWWRSDRLFCIAVGFLALVFAATTVSGVIGLLQRRSVSRYLLLAGALVAFLTYIGVFIAGARVAWVVHLLPVLPIATVVLVLLPQAKRWLDA

SEQ ID NO: 2261 - protein, 375 aa, Mycobacterium paratuberculosis
MVTIRGHFRLSQHRFARSSAVTTGVVRVGRAAGARSAEPHRTEVTEILPLDGFDFDDLDFCDDAGDHGDLDFSTDSPFDNEAQVLLAPELDDLNETDDLRPLWLAAPVTEVLPRTTVAARTERRPERPRGADVVGVARRGGQHRKQPTSAARGRLLISAMAAGATAAAAHTATSHADTPKTDAVLTANASSLTGGAGGSNTVRGPQVIAAEPAATAALHNQELAKGVAFANDRAQREARLQQPLYVMPTKGIFTSNFGYRWGVLHAGIDLANSIGTPIYAVSDGVVIEAGPAGGYGMLVKLRHADGTVTLYGHINTALVSVGERVMAGDQIATMGNRGNSTGPHLHFEVLQGGTERIDPVPWLAKRGLMVGNYAG

SEQ ID NO: 2262 - protein, 406 aa, Mycobacterium paratuberculosis
LRHRPPRGLVVESSEDRESMDLFEYQAKELFAKHNVPTTPGRVTDTAEGARDIAAEIGRPVMVKAQVKTGGRGKAGGVKYAATPEDAYTHAKNILGLDIKGHVVKKLLVSEASDIAEEYYISFLLDRANRTYLAMCSVEGGMEIEEVAATEPERLAKVPVDAVTGVDLATARSIAEKGHLPAEVLDAAAVTINKLWELFVAEDATLVEVNPLVRTPDNQILALDGKVTLDANADFRQPGHAAFEDRDATDPLELKAKEHDLNYVKLDGQVGIIGNGAGLAMSTLDVVAYAGEKHGGVKPANFLDIGGGASAEVMAAGLDVILHDKQVKSVFVNVFGGITSCDAVANGIVTALNMLGDEANKPLVVRLDGNNVDQGRRILAEANHPLVIQAETMDSGADKAAELANK

SEQ ID NO: 2263 - protein, 300 aa, Mycobacterium paratuberculosis
MSIFLNKDSKVIVQGITGGEGTKHTALMLKAGTQVVGGVNARKAGTTVSHVDPVGKDVELPVFGTVSEAMKETGANVSVVFVPPKFAKDAIIEAIDAEIPLLVVITEGIPVQDSAYAWAYNVDKGQKTRIIGPNCPGIITPGEALAGITPANISGPGPVGLVSKSGTLTYQMMYELRDFGFSTSIGIGGDPIIGTTHIDAIEAFEKDPDTKIIVMIGEIGGDAEERAADYIKANVSKPVVGYVAGFTAPEGKTMGHAGAIVSGSSGTAAAKKEALEAAGVKVGKTPSETAALAREILQSL

SEQ ID NO: 2264 - protein, 507 aa, Mycobacterium paratuberculosis
MNLDPNTPVIVGVGQFTERIEDSGYRGMSSVELATEAARAALHDCGADATALAAAVDTVAAIRQFELSGRTPAPMGKSNNYPRSVARRIGAAPARAVLEPIGGQGPQHLVTEFAGIIAAGDAEVVMIFGSENTSSIRYFADREKPDHSETVEGSLEDRGFGYEGLFDDYTVAHGLIGAPAQYGLLENARRARLGLSVADYRRRMGELFAPFTKVAAKNPSASAPVERSVDELITVTPSNRMICDPYPRLLVARDQVNQGAAALLMSVAAARRLRVPEERWVFLHGHADMVDQPLLDRLDLTYNSASVLAVQEALAGAGIGIDDVSTFDLYSCFPVPVFNFCDGTGLATDDPRGLTLTGGLPYFGGPGNNYSLHGIAETVSEMRDRPGQFGLVAANGGIMSKYSVGVYSTTPVNWKPDNSAALRAEVAARPTVPVTVRADGRATIETYTVRYDWPVRTGIIIGRLDDGSRFLALTEDPELVGLLSDGEPLGTSIVVTATEKDNRATLA

SEQ ID NO: 2265 - protein, 282 aa, Mycobacterium paratuberculosis
MDYGLVLFTSDRGISPAAAAKLADDHGFATFYVPEHTHIPIKREAAHPTTGDASLPDDRYMRTLDPWVSLGAACAVTSRVRLSTAVALPVEHDPITLAKSIATLDHLSGGRVSLGVGFGWNTDELADHGVPAGRRRTMLREYLEAMRALWTDEEASYDGEFVKFGPSWAWPKPVQPHIPVLVGAAGNEKNFKWIARSADGWITTPRDFDIDEPVKLLQDTWAAAGRDGAPQIVALDFKPDAEKLARWAELGVTEVLFGLPDKSEDEVAAYVERLAGKLAALV

SEQ ID NO: 2266 - protein, 298 aa, Mycobacterium paratuberculosis
MTYSPGSPGYPPAQSGGTYAGATPSFAKDDDGKSKLPLYLNIAVVALGFAAYLLNFGPTFTIGADLGPGIGGRAGDAGTAVVVALLAALLAGLGLLPKAKSYVGVVAVVAVLAALLAITETINLPAGFAIGWAMWPLVACVVLQAIAAVVVVLLDAGVITAPAPRPKYDPYAQYGQYGQYGQYGQQPYYGQPGGQPGGQPGGQQHSPQGYGSQYGGYGQGGAPTGGFGAQPSPQSGPQQSAQQQGPSTPPTGFPSFSPPPNVGGGSDSGSATANYSEQAGGQQSYGQEPSSPSGPTPA

SEQ ID NO: 2267 - protein, 466 aa, Mycobacterium paratuberculosis
VTRVEDNRAAGARQARDLVRVAFAPAVVALVIIAAVTLIQLLIANSDMTGALGAIASMWLGVHQVPVSIGGRELGVLPLLPVLLMVWATARNTARATSPHSSWLVIRWVVASALGGPLLMTAVALAVIHDASSVITELQTPSALRAFLSVLVVHAIGAGIGVWSQVGPRALAASSLPYWLGDSLRAATAGVLALLGLSGFVTAGSLVVHWATMQELYGITDSIFGEFSLTVLSMLYAPNVIVGTAAVAVGSSAHIGFATFSSFTVFGGDIPALPVLAAVPRPPLGPVWVALLIIGASSGVAVGQQCARRPLPPVAAMVKLLAASVAGALVMSLLAFAGSGQLGNFGPVGVDQGALLVGVFFWFAVVGGATVVMSGGIRRPTRRLKPRPAPAAPVAEEHDSVFGEAVGPVGDVAGVDEVAVEGVDEVAAGGVDESPGDAGEREGDEGDPGERGPGDAGDAGERRPGE

SEQ ID NO: 2268 - protein, 209 aa, Mycobacterium paratuberculosis
VVEPLHVPPNAPARVVVLASGTGSLLSSLIDAAVGDYPARVVAVGADRDCLATQIAAAASLPSFTVRLGDHPDRAAWDAAITEATAAHSPDLVVSAGFMKILGPQFLSRFYGRVINTHPALLPAFPGAHGVAEALAYGVKVTGCTVHLVDAGTDTGPILAQQSVPVLDGDDEQTLHERIKVTERKLLVDVVAAIATGGLTLVGRKATIG

SEQ ID NO: 2269 - protein, 533 aa, Mycobacterium paratuberculosis
MKGDQPMSTDDWRENAKRPIRRALISVYDKTGLVELAQGLTEAGVEIVSTGSTAKVIAEKGIPVTRVEVLTGFPEVLDGRVKTLHPRVHAGLLADLRKPEHAAALEQLGIAAFELVVVNLYPFTETVDSGAGIDECVEQIDIGGPSMVRAAAKNHPSVAVVVDPLGYDGVLAAVRHGGFTLAERKRLAALAFQHTADYDIAVATWMESTLAPEHPPTTFPKWLGRSWRRSAMLRYGENPHQQASLYSDPGAWPGLAQAEQLHGKEMSYNNFTDADAAWRAAFDHEQTCVAIIKHANPCGIAISSISVADAHRKAHECDPLSAFGGVIAANTEVSVEMAEYVSTIFTEVIIAPAYQPAALEILTRKKNIRVLVASEPLTGGTELRPISGGLLVQQRDELDAHGDNPANWTLATGAPADPATLADLVFAWRVCRAVKSNAIVIAAGGATIGVGMGQVNRVDAARLAVERGGDRVRGAVAASDAFFPFPDGLETLTGAGVKAVVHPGGSVRDDEVTAAAANAGITLYLTGARHFAH

SEQ ID NO: 2270 - protein, 246 aa, Mycobacterium paratuberculosis
MPVMGVTNASILSTMRSGEDPTAPASFLLSFRAVADRPTFPFRYTDGWSRPFSRGIEMREITKRTAAFSVALAAFALIGGACSKSNNAGQTTSSASSSATSSATSGTSASAAPSESTGTSGAPSSTQINGANGTPYTVEGPILAKYNALDDKARKDLGAPTGNEQKNPDGGVYQQFDGGVIVSKTQAYVVWGKIRDKWNQLGGSQGQLGYPTSDEVDTPDGAKKSTFEHGTITWKPGDAEATVTTG

SEQ ID NO: 2271 - protein, 463 aa, Mycobacterium paratuberculosis
VTSPSNLPRTVGELRAAGHRERGVKQEIRENLLARLAEGGDGEAIWPGILGFDDTVLPQLERALIAGHDFVLLGERGQGKTRLLRALVGLLDEWTPVIAGAELGEHPYSPITPESIRKAATLGDDLPVEWKHRSERYTEKLATPDTSVADLVGDIDPIKVAEGRSLGDPETIAYGLIPRAHRGIVAVNELPDLAERIQVSMLNVMEERDIQVRGYTLRLPLDVLVVASANPEDYTNRGRIITPLKDRFGAEIRTHYPLELSAEVGVIAQEAHLSAHVPDYLMQIIARFARYLRESNSVDQRSGVSARFAIAAAETVAAAARHRGAVLGETDPVARVVDLGTVIDVLRGKLEFESGEEGREQAVLEHLLRRATADTASRVLGGIDVGSLVAAVEGGSAVTTGERVSAKDVLAAIPSLPVVDKIADKLHARSEGERAAALELALEALYLAKRIDKVSGEGQTVYG

SEQ ID NO: 2272 - protein, 683 aa, Mycobacterium paratuberculosis
LRWRHCIWPSESTRCPGRARPSMANRGHSSRYSAYTGGPDPLAPPVDLREALEQIGQDVMAGTSPRRALSELLRRGTKNMPGADRLAAEANRRRRELLRRNNLDGTLQEIKKLLDEAVLAERKELARALDDDARFGELQLDALPASPAKAVQELSEYNWRSSEAREKYDQIKDLLGREILDQRFAGMKQALQGATDEDRQRVSDMLNDLNDLLDKHAKGQDSQQDFDDFMAKHGEFFPESPRNVEELLDSLAKRAAAAQRFRNSLSAEQRAELDALAQQAFGSPDLMQALNRLDAHLQAARPGEDWGGSEQFSGDNPFGMGEGTQALADIAELEQLAEQLSQSYPGATMDDVDLDALARQLGDQAAVDARTLAELERALVNQGFLDRGSDGQWRLSPKAMRRLGETALRDVAQQLSGRRGERDHRRAGAAGELTGATRPWQFGDTEPWNISRTLTNAVLRQAGTATLDGPDGRLKITVDDVEVSETETRTQAAVALLVDTSFSMVMENRWLPMKQTALALNHLVCTRFRSDALQIIAFGRYARTVTAAELTGLEGVYEQGTNLHHALALAGRHLRRHPNALPVVLVVTDGEPTAHLEDFEGAGTTVFFDYPPHPRTIAHTVRGFDEMARLGAQITIFRLGSDPGLARFIDQVARRVEGRVVVPDLDGLGAAVVGDYLRSRRRR

SEQ ID NO: 2273 - protein, 265 aa, Mycobacterium paratuberculosis
VSKVPTIELNDGARIPQLGFGVYQIKPDETAAAVRAALDIGYRHIDTAEMYGNEREVAQGIRDAGLDRSEVFVTSKLNNGFHEPDAARRAFDATLNALGSDYVDLFLIHWPLPTLYGGDFVSTWRVLEEFARDGRARSIGVSNFQVAHLERLAAETDTVPAVNQVEVHPYFTNEKVRGYAREHGLAIEAWSPIAQGGVLGDAVINRIADGLGRTAAQVVLRWHIQRGDIVFPKTVNPDRMKSNFELFDFELDERAMEAISALDRG

SEQ ID NO: 2274 - protein, 212 aa, Mycobacterium paratuberculosis
LQQKLDVVGSWVMSNSTQRDAEDTRDEPSRAADTDRIQIAQLLAYAAEQGRLQLNDYEDRLTRAYAAKTYEELDQLRADLPGAPISPRRGGKPNPAPSTLLLALLSGFERRGRWNVPKKLTTFTLWGSGVVDLRYADFTSTEVDIHAMSIMGVQSILLPPEVNVEVHGRGVMGNFDRDVPGQGTPGAPTVHIRGFSLWGGVGIRRKARRPRP

SEQ ID NO: 2275 - protein, 263 aa, Mycobacterium paratuberculosis
MDALVDYAGPAATGGPVARLTLNSPHNRNALSSALVSQLHQGLRDASSDPAVRVVVLAHTGGTFCAGADLSEAGSGGSPSSAYDMAVERAREMAALMRAIVESRLPVIAAIDGHVRAGGFGLVGACDIAVAGPRSSFALTEARIGVAPAIISLTLLPKLSARAAARYYLTGEKFDARRAEEIGLITMAAEDVDAAVDQLVADVGRGSPQGLAASKALTTAAVLERFDRDAERLAEESARLFVSDEAREGMLAFLEKRSPNWTS

SEQ ID NO: 2276 - protein, 388 aa, Mycobacterium paratuberculosis
VTDSSFIENEERQALRKAVAEWASNYGSEYYLRKARAHEHTDELWSEAGKLGFLGVNLPEEYGGGGAGMYELSLVMEEMAAAGSALLLMVVSPAINGTIISKFGTEEQKKRWLPGIADGTLTMAFAITEPDAGSNSHKITTTARRDGSDWILKGQKVFISGIDQAQAVLVVARTEEAKTGKLRPALFVLPTDAPGFSATPIEMELISPERQFQVFLDDVRLPSDALVGAEDAAIAQLFAGLNPERIMGAASSVGMGRFALARAAEYVKTRQVWGTPVGAHQGLSHPLAQCHIEVELAKLMMQKAATLYDAGNDMGAAEAANMAKYAAAEAATRSVDQAVQSMGGNGLTKEYGVAAMLASARLGRIAPVSREMVLNFVAQTSLGLPRSY

SEQ ID NO: 2277 - protein, 663 aa, Mycobacterium paratuberculosis
MGITRVLVANRGEIARRVFATCRRLGVSTVAVYTDPDAGAPHVAEADARVRLPNTTDYLNIEAIIGAARAAGADALHPGYGFLSENADFATAVADAGLTWVGPPVDAVRAMGSKIESKKLMAAAGVPVLDELDPDTVTEAQLPVLVKASAGGGGRGMRVVHELSALRGEVEAARREAQSAFGDPTVFCERYLPTGHHVEVQVLADAHGTVWAVGERECSIQRRHQKIIEEAPSPLVERTPGMRAKLFEAARLAAGAIGYTGAGTVEFLADDDGEFYFLEMNTRLQVEHPVTEETTGLDLVELQLAVADGARLDAEPPAAQGYSIEARLYAEDPARGWQPQAGVVHAFAVPSVRAEFGSLGRRIGIRLDAGITDGFAVSIHYDPMLAKVISYAPTRRQAALVLADALTRTRVHGVRTNRDLLVNVLRHPAFLDGATDTAFFDTHGLAELAAPLGDAAAVRLSAVAAALADAARNRAHAPVLGAVPSGWRNLPSGFQLKDYRDDEGHEHRVQYRFTRTGLVLPDDPSVQLVSATADDVVLRTDGVEHNFSVRRYHGADADVYVDSARGPVHLTVLPRFPEPGSTVEKGSLVAPMPGNVIRLGAAIGDTVTAGQSLIWLEAMKMEHTIADPVDGVLAELNVKTGQQVEVGAVLARVEAPQSEGDAQ

SEQ ID NO: 2278 - protein, 531 aa, Mycobacterium paratuberculosis
MTVLQSALDRKAPGFTEAASAALAKLEEIDTELANALAGGGPKYVERHHARGKLTARERIELLVDQDSPFLELSPLAAWGSSFKVGASTVTGIGVVEGVECMIVANDPTVKGGTSNPWTLKKILRANQIAFENRLPVISLVESGGADLPTQKEIFIPGGRMFRDLTRLSAAGIPTIALVFGNSTAGGAYVPGMSDHVVMIKERSKVFLAGPPLVKMATGEESDDESLGGAEMHARVSGLADYFAVDELDAIRIGRRIVARLNWVKQGPTPKAVTEPLFDTEELIGIVPADLRIPFDPREVIARIVDGSEFDEFKPLYGSSLVTGWARLHGYPIGILANARGVLFSEESQKATQFIQLANRSNTPLLFLHNTTGYMVGKDYEEGGMIKHGSMMINAVSNSTVPHISLLIGASYGAGHYGMCGRAYDPRFLFAWPTSKSAVMGGAQLAGVLSIVARAAAEARGQQFDEQADAAMRAAVEGQIEAESLPLVLSGMLYDDGVIDPRDTRTVLGMCLSAIANGPIEGTSNFGVFRM

SEQ ID NO: 2279 - protein, 382 aa, Mycobacterium paratuberculosis
VNLWTTPEREQLRKTVRSFAEREILPHVDEWERSGELPRELHRSAGAAGLLGAGFPESVGGGGGDGADAVIICEEMHQAGAPGGVFASLFTCGIAVPHMIASGDQRLIEEFVRPTLAGEKIGSLAITEPGGGSDVGHLRTSAVRDGDHYIVNGAKTYITSGVRADYVVTAVRTGGPGAAGVSLLVVEKGTPGFEVTRKLDKMGWRSSDTAELSYTDVRVPVSNLVGAENTGFAQIAQAFVSERIGLAAQAYSSAQRCLDLTVQWCRDRETFGRPLISRQSVQNTLAEMARRIDVARVYSRNVVERQLAGETNLIPQVCFAKNTAVEAGEWVANQAVQLFGGMGYMAESEVERQYRDMRILGIGGGTTEILIALSAKLLGFQS

SEQ ID NO: 2280 - protein, 573 aa, Mycobacterium paratuberculosis
MASPPGPPGDPGAVRIANCSGFYGDRLSAMREMLTGGKVDYLTGDYLAELTMLILGRDRMKHPERGYAKTFLTQLEDCLGEARDRGVRIVANAGGLNPAGLADAIRDLAARLRLDVRVAHVEGDDLLARAAELGLGSPLTANAYLGAWGIVDCLGDGADVVVTGRVTDASVIVGAAAAHFGWERSDYDRLAGAVVAGHVIECGVQATGGNYSFFTEVPDLTHAGFPLAEVHADGSSVITKHPGTGGLVSVDTVTAQLLYEITGARYANPDVTARMDTVELSSDGPDRVRISGVRGEPPPPTYKVSLNSIGGFRNSMTFVLTGLDIEAKAELVRRQLQSALAVKPAELQWSLARTDHLDADTEEAASALLHCVVRDPDPANVGRQFSSAAVELALASYPGFHVTAPPADGQVYGVFTAGYVDADKVPHIAVHADGARVDIPCATDTLELAPVDDPALPEPLPDGPVRRAPLGTIAGAPSGDKGGSANVGVWVRTDEQWRWLAHTLTVERLTELLPEAAEFAVTRHLLPNLRAVNFVIDGILGQGVAYQARFDPQAKGLGEWLRGRYLDIPESLL

SEQ ID NO: 2281 - protein, 57 aa, Mycobacterium paratuberculosis
MAVPKRRMSRANTRSRRAQWKAEKTELVGVTVAGQRHKVPRRLLKAARLGLIDLDRR

SEQ ID NO: 2282 - protein, 228 aa, Mycobacterium paratuberculosis
VRILVVDDDRAVRESLRRSLSFNGYSVELAHDGVEALDMIASDRPDALVLDVMMPRLDGLEVCRQLRSTGDDLPILVLTARDSVSERVAGLDAGADDYLPKPFALEELLARMRALLRRTKPEDDAESVAMTFSDLTLDPVTREVTRGQRRISLTRTEFALLEMLIANPRRVLTRSRILEEVWGFDFPTSGNALEVYVGYLRRKTEADGEPRLIHTVRGVGYVLRETPP

SEQ ID NO: 2283 - protein, 511 aa, Mycobacterium paratuberculosis
LRAPLRATPSLSLRWRVMLLAMSMVAMVVVLMAFAVYAVISAALYSDIDNQLQSRAQLLIASGSLAADPGKAIEGTAYSDVNAMLVNPGHAIYTAQQPGQTLPVGSPEKAVIHGELFMSRRTAGDQRILAVHLQNGTSLLISKSLKPTEAVMNKLRWVLLIVGGVGVAVAAVAGGMVTRAGLRPVARLTEAAERVARTDDLRPIPVFGSDELARLTESFNLMLRALAESRERQARLVTDAGHELRTPLTSLRTNVELLMASMEPGAPRLPEQEMVELRADVLAQIEELSTLVGDLVDLTRDDAGQVVHEPVDMSDVIDRSLERVRRRRNDIHFDVDVTPWQMYGDAAGLSRAVLNLLDNAAKWSPPGGHVGVTMRQLDPSHVELVVSDHGPGIPPQERRLVFERFYRSTSARAMPGSGLGLAIVKKVVLNHGGMLRVEDTVPGGQPPGTSFYVLLPGRSLPPAGHSTPAGESETDQAEAATDPAVPVAGDTANSRESANVISVDSQSARAR

SEQ ID NO: 2284 - protein, 488 aa, Mycobacterium paratuberculosis
MTNDPRYSPPPQQQPGYPPAPNQTAPVPSHAGSSGYAQGQQPYQQQFDWRYRSQPSQTTQFRSPYEPFGNAGPGRVPGGTGTGPLPGMHPGMPAPPEPQKRSRAGLLTVGAVAIAVVSAGIGGAAATAVEMGTHATGSGGGRIAGAAPSVPAANMPPGSVEQVAAKVVPSVVMLETDLGRQSEEGSGIILSTDGLILTNNHVVAAAAGPPKGPAAPPVVPLPPGGPGGGPGAGTPKTTVTFSDGRTAPFTVVGADPTSDIAVIRVQGMSGLTPISLGSSSDLRVGQPVVAIGSPLGLSGTVTTGIVSALNRPVSTTGESGNQNTVLDAIQTDAAINPGNSGGALVNMNGQLVGVNSAIATLGADSPDAQSGSIGLGFAIPVDQAKRIADELIATGKASHASLGVQVTNDKGTPGAKVVDVVSGGAAASAGLPKNVVVTKVDDRPINSADALVAAVRSKAPGDKITLTFSDPAGGGSRTLPVTLGKADQ

SEQ ID NO: 2285 - protein, 185 aa, Mycobacterium paratuberculosis
VRVDEPSAAGLSELGYTVAPMETGAELVVGRALVVVVDDRAAHGDEDHSGPLVTELLTEAGFVVDGVVAVAADEVEIRNALNTAVIGGVDLVVSVGGTGVTPRDVTPEATREILDREILGIAEAIRGSGLSAGIIDAGLSRGLAGVSGSTLVVNLAGSRYAVRDGMATLNPLAAQIIGQLSSLEI

SEQ ID NO: 2286 - protein, 151 aa, Mycobacterium paratuberculosis
MLKGFKEFLSRGNIIDLSTAVVIGTAFTALVTTFTDSIIKPLINRIGVNQKSDIGILRISIGGGQTIDLNNVLSAAINFVIIAAVVYFLVVLPYTTLRKRGEVEPADDAQVVLLTEIRDLLAQTNGDSSGKHGSVSTTPPPEYGPRAEAES

SEQ ID NO: 2287 - protein, 226 aa, Mycobacterium paratuberculosis
VGESSLNPSVLSRLPVWLRPDWTRTVLARRIAAGALVVLAAIAALRSDPAGDYAPVVVAEHDLRPGAALTAADVRLEKRLAATVPEGSPAEIGAVLGSTLAGPARRGEVLTDVRLLGSRLAEAAVGSKAAAGARIVPLHPADGALIDLVRPGDVVDVLAAPANTSAETTHAAPKVLATDAVVVLVSAREKIQAAGADRVVLVALPAGVANTVAGAALGQTVTLTLH

SEQ ID NO: 2288 - protein, 108 aa, Mycobacterium paratuberculosis
VPTYSYQCTECDDRFDIVQAFTDDALTTCKHCSGRLRKRFNSVGVVFKGSGFYRTDSRESGKKPAGSTNGSSSSDSSSSTSDSSGSSAKSGSGEKAVSSPAPAAAAAG

SEQ ID NO: 2289 - protein, 232 aa, Mycobacterium paratuberculosis
VRGTTTFGHDIVHTITRIDFAEWMWRRRRPGCHGLPMATTGKAALRERLLAARRRVADDVRAAEARMLREQLEFMVTSGSTVCAYVPVGAEPGSVEMLDMLLRRAGRVLLPVARTAADNTPLPLCWGEYRPGTLTTGRWGLLEPAQPWLPASALADAALVLVPALAVDRRGVRLGRGRGFYDRSLGDRDPRARLVALVRDAELLDELPAEPHDVPMTHALTPQRGWVTLGAR

SEQ ID NO: 2290 - protein, 302 aa, Mycobacterium paratuberculosis
MSCPNVVVPRTAIVPAAGLGTRFLPATKTVPKELLPVVDTPGIELVAAEAAEAGAERLVIVTSEGKDGVVAHFVEDLVLESTLEERGKTAMLDKVRRAPRLIKVESVVQSEPLGLGHAIGCVEPRLADDEDAVAVLLPDDLVLPTGVLGTMSKVRAHYGGTVLCAIEVTPEEISAYGVFDVEPVPDDDPDVLRVKGMVEKPKAEDAPSMFAAAGRYVLDRAIFDALRRIDRGAGGEVQLTDGIALLISEGHPVHVVVHRGSRHDLGNPGGYLKAAVDFALDRDDYGPDLRQWLVARLGLSEQ

SEQ ID NO: 2291 - protein, 425 aa, Mycobacterium paratuberculosis
VEEQQARITAAAVAPRPIRVAIAEAQGLMCAEEVVTERPMPGFDQAAIDGYAVRSVDVLGVGEVGAEGLPAPLDDSVDDARDGLVLPVMGTVEAGSRTPSRLQPRQAVRVQTGAPLPTLADAVLPLGWTDGGTQRVRIYRGAPSGAYVRRAGDDVQPGDVAVRAGAVIGAAQVGLLAAVGRERVLVHPRPRVTIMALGGELVDISRTPGNGQVYDVNSYALAAAARDAGAEVNRIGIVGGGPRELRDIVEGQINRAEVIVIAGAVGGAAAEAVRQVLSELGEIEVVRVAMHPGSIQGFGQLGREGVPTFLLPANPVSALVVFEVMVRPLIRLSLGKRQPMRRIVQARTLSPITSVAGRKGYLRGQLMRDQDSGEYLVQALGGAPGASSHLLATLAEANCLVVVPSGAEQIRTGEIVDVAFLAQRG

SEQ ID NO: 2292 - protein, 217 aa, Mycobacterium paratuberculosis
VNLLRNNSRHPGWPMSVGPLRVPAGVVRLRAVRLRDGAQWSRIRLADRAHLEPWEPSAEGDWTTRHAVAAWPALCSGLRAEARQGRMLPYVIELDGCFCGQLTIGNVTHGALRSAWIGYWVPRSATGGGVATAALALGLDHCFGPVMLHRVEATVRPENAASRAVLAKVGFRQEGLLQRYLEVDKAWRDHLLMAITVEEVSGSVASTLVRAGNASWV

SEQ ID NO: 2293 - protein, 373 aa, Mycobacterium paratuberculosis
LVITTRPRWPPMGFAGDGNRREQVIMPSIPQSLLWISLVVLWLFVLVPMLVSKRDAVRRTSDVALATRVLNGGANSRLVKRGGPAAGHRSDPHWTRPEDSDADLDEEHDVAADEPGDQDDDADTDELSRRRPVVMRMATAEPAEPDYLDVDVVEDSAALPVGARGSAAENNDEQPAEDDDVDTEAVAKGGDEQDSYEYVDDSSGLEEPAAEGDEADEEAPAPMPRNASRRRRFDTKTAIAISARKYAFRKRVLMAMAVVLVGSATAAFKISPTAWWVCGAATTVTLLYLGYLRRQTRIEEKVRRRRMQRMARARLGVENAYAREYDVVPSRLRRPGAVVLEIDDEDPIFEHLEYAMPMRTFGWPRDLPRAVGE

SEQ ID NO: 2294 - protein, 50 aa, Mycobacterium paratuberculosis
MAMATRDDNPQKVEQRSLAVRKAAAKAAVAASEKTGRPVDPRVKKLAENR

SEQ ID NO: 2295 - protein, 107 aa, Mycobacterium paratuberculosis
HTCTGCGLETRYSYGRTCLGCGQQTRRPYGSWPDRHPRAAVAFAAPARIVYLGERNPTAAMALGVPGTLIALAAVAAYPFVFVPALILLSVALLASARYLETHSSSR

SEQ ID NO: 2296 - protein, 208 aa, Mycobacterium paratuberculosis
VAEQLAAESGPPAVTIRALSEATAISNGAIYHAFGSRGGLLGHVWLRAGKRYLSFQRAAVAKALSRGVSGEAAVDAVVAAAECPATFSHEHPASARFLLRVRRDELLGAADVPAELADELRRLDDDLAHLFIELAEKVWGRRDQQAVGAIRTCVVELPTALLIDAHALHDAAALQRLAAAVRAVLALTPPTTSTKPKPRPTLTKGAPR

SEQ ID NO: 2297 - protein, 164 aa, Mycobacterium paratuberculosis
MTSKTGSAPISTNLKIWNMLQRLPFGNRIFSQAVCFKAPYFSTVHPVIVELRPGLCRAKAPNRRGVHNHLGSFHAIASCNMAELVAGVMTEVTVPPTHRWIPAGMTVEYKAQARTAVTATARLDAIPEFTDEPFELVVPVDVSDAEGNVFVTARITMHVSPRPR

SEQ ID NO: 2298 - protein, 207 aa, Mycobacterium paratuberculosis
VCDDHAMRRHGWSGDIPADDEEAVARILTATRRAIDERGTVSVSQVASTLGVTRQTIYRYFPTHEALLGATALSAVEGFLDRLAAHLGSITDPTGAVVEGIAYTFEQLAHDRYLSLVFQPGKASAFTAGVTSDIAISFGRSILQRFEVDWGAAGFAGTGLDELVEVMLRTLQSLIVDPGRPPRTGAELRRFLQDWVAPAVRAHAISR

SEQ ID NO: 2299 - protein, 409 aa, Mycobacterium paratuberculosis
LTIQTVMIVWSGRLTAKEKRVAPINSPVSGTDEALTRRGLRHALDKTTDLAERELRVPLHYYRDPKITEIEEAQILRRVPLAIVPSAQLPNTNDYVVRSVLGDSLLVTRDRSGASHVLLNYCRHRGAMPACGSGNTARFVCPYHAWTYKNTGELFSVPGKAGFDSMNTKDYGLVELPSEERHGFIWAVLTADATIDLDAHLGDFGAELALWNYSSYGYHTQREFTSEVSWKGALEAFAEGYHFPYVHGQSLIGQNTLANTMVYDEFGKHHRIGFPFTWITNAATDPAASLEPLANMGVIYWVYPNLILANSPVGLEIIDMLPAGAPTRCTVRHSWMARVPAADDEMRAAYDAVFEGVHAAVRDEDFAMLPQCGEGVRHGQHDHMIIGRNEIAVQHMIRVFAHELGVALA

SEQ ID NO: 2300 - protein, 377 aa, Mycobacterium paratuberculosis
MAHRDRDSTDELLQELLWTYGPCGQEDAVRAVIARELEPVVDDLWTDDAGNLIGYVAADASRGDAGAPDHRHRTAAIPGTATRVMAHMDELSMIVKRVEPDGTLHLTQLGTMYPGNFGLGPVAVLGDNETLTAVLTLGSEHTTKESSRIWETKPDQGDRSLDWHHVYVFTGRSTDELAAAGVHAGTRVCVDRSKRSVVEIGDYVGAYFLDDRAAVTALLNAARMLRERGQRPADDVYLVFTANEEIGGVGGAYASATLPGDLTLALEVGPTEREYTTSVAGGPIVGYSDALCVYDKSVADRLLKIATDRGLTPQPAALGAFESDASHAKASGLTARAGLLCLPTLSTHGYEVVARSAIDDMAAIVVDFVLQPGRPNG

SEQ ID NO: 2301 - protein, 338 aa, Mycobacterium paratuberculosis
MTRPRIRARAPLRISFAGGGTDVPPFPTTEGGCVLSATIDRYAQGSLAPRTDRRVSIESVDFKTTHEMTLDSEILYDGSLDLIKAAVRRFGRDGTDGYDLVLRSSAPPGSGLGSSSTMMVALTGLLAEHYRVPMGEYETAQLACAIEREDLGIAGGMQDMYAATFGGFNFIEFTDRVIVNPLRIRDETAFELELSLLLCYTGITRDSARVIEDQTRRATTGSDDTLAGLRAQKELAVAMKAALLTGKLNDFGALLGEAWTEKKRMSPYITNERIDDLYELALKNGALGGKLTGAGGGGYILLFCDFAKKHRLIEALEGAGAAVTEFAFESKGLTTWQA

SEQ ID NO: 2302 - protein, 205 aa, Mycobacterium paratuberculosis
MAGMTGPDVVPPSVELVQRRLAETIAVKQQMQNGVVAAQAVEVARAMIDCLRAGGKVILFGNGGSAQDAGHLAAELMGRFAFDRPGLAAMSLPDATAAITAIGNDYSYDEVFARQVLAAGRAGDVVVGLTTSGNSANVVRALEAARQAGMTTVTLTGAGGGKVADVAQICIRIPSDDTGRIQEASLHLGHSICEMVEAALFPRPS

SEQ ID NO: 2303 - protein, 205 aa, Mycobacterium paratuberculosis
LRNGRSGTVSPAVLTATMPAPELRDVRTVFLDRDGTVNVKAAEGEYIKSPAELVLLPGAARALAALNAAGLRTVLVTNQRWLSEPTAAPADFAAVHDRLVRLLADRGARIDAAYHCPHPANSCDCRKPGPGMLLRAAAEHDVDLAASVMIGDSDVDMVAGRAAGTKTILIRPGARQAVAEADFVVDDLAAAVELILNAGKTPPAG

SEQ ID NO: 2304 - protein, 330 aa, Mycobacterium paratuberculosis
VAGLTGARADELATMDIFAGCPAEDLAPLARRLRPLRAPAGQVLMRQGEQAVEFLLISSGSAEVKHVGDDGVVITEHTSPGMIVGEIALLRDIPRTATVTTAQPLTGWTGDTEAFASMVHIPGVMPRLLRTVRQRLAAFITPIPIQVRDGTHLLLRPVLPGDSERTVHGHIHFSSDTLYRRFMSPRLPTPALMHYLSEVDYVDHFVWVVTDGADPVADARFVRDENDPTVAEIAFTVADAYQGRGIGTFLISALSIAAEVDGIERFSARMLSDNVPMRAIMDRYGAVWQREDIGVITTVIDVPHRRDLPFRKHEADEIRRVARQVIETVG

SEQ ID NO: 2305 - protein, 104 aa, Mycobacterium paratuberculosis
VDFPRDLLGACQQWSETAGHTTVRVRLTDGSHIDGVETLGMVADITSSVESGTEIDSRSYTFIAYLGDYYAFTTLTTDPGAAVPVLPPQFAADLLAKTVSTLRS

SEQ ID NO: 2306 - protein, 223 aa, Mycobacterium paratuberculosis
LGRLATMSKLLRAVAAVCVLAGCSSATHPAKVDIAKVADVKPSFGPDYKVSDTGERGIDPKLLAGRKLPDGLTFDPAQCAKVASGPDLPADLQGNMAAVTAEGRGNRFVVIALETSKALPFNDPGKDCAKVTFSGAQLRGGVQVVDAPQIDSARTLGVHRVLQALTPGGPRTGELYDYSAQFGDYQVIVIANPLVIPNQPVAPVDTQRARDLLVKAVASVRAQ

SEQ ID NO: 2307 - protein, 177 aa, Mycobacterium paratuberculosis
VRLRQPQRRAAAAAPQRERAGGAQADDRHHGVLGTAAADGVAMPGHAVRAVPITAQPHRGERLAEFAGVDVVEPAAQPGQHRMRRLVDREVVKAHQPRHVDHPVVHLPAFLPPRHRRQQGIEQIIGVGEPAGADFDEGAVAELPALGVLEQGALNRDLHATQFIAHPFDPEAAAAGV

SEQ ID NO: 2308 - protein, 400 aa, Mycobacterium paratuberculosis
VVELGTNSEVGALRVVILHRPGGELLRLNPRNVDQLLFDGLPWVARAQEEHDQFAELLRSRGVEVLLLSDLLTEALTHSGAARMQGVAAAVDARRLGVPLAQELSAYLRGLEPARLAQVLMAGMTFNELPADTRTDVSLVLRMHHGGDFVIDPLPNLVFTRDSSIWIGPRVVIPTLALRARVREASLTDLIYAHHPRFTGVRRAYESRTAPIEGGDVLLLAPGVVAVGVGERTTPAGAEALARSLFDDDLAHTVLAVPIAQRRAQMHLDTVCTMVDTDTVVMYANVVDALSAFTIQRTPSGVEISEAPFLEAAATAMGIDKLRVIDTGLDPVIAEREQWDDGNNTLALSPGVVVAYERNAQTNMRLQEAGIEVLTIAGSELGTGRGGPRCMSCPVARDPL

SEQ ID NO: 2309 - protein, 508 aa, Mycobacterium paratuberculosis
VPVVSPGPLVPAADFGPTDDVRGWVVTGVVTLVAAVTRFVNLGSPTDGGTPVFDEKHYAPQAWQVLHNHGVEDNPGFSLVVHPPVGKQLIAIGEALFGYNGVGWRFTGALLGVVMVALVVRIVRRISRSTLVGAIAGVLVICDGVSFVASRTALLDGILTFFVVAAFGALIVDRDQVRQRLHTALLQGRSADTVWGPRLGVRWWRFGAGVLLGLACGTKWSGLYFVLFFAAMSLAFDVAARRQYQVTRPWLGVVRRDLLPTGYALGFIPAAVYLAGYAPWFASETAIDRHEVGQTIGPRSVLPLPDAIRSLWHYTAKAFQFHAGLTNSAGNYHPWESKPWSWPMSLRPVLYAIDEQNVPGCGAQSCVKAEMLVGTPAMWWLAVPVLVFALWRMLVRRDWRYAAVLVGYCAGWLPWFADIDRQMYFFYAATMAPFLAMAIALICGDILYAPTATGVLRANSERRTLGLIAVCCYVALVVTNFAWLFPVLTGLPISQQTWNMEIWLPSWR

SEQ ID NO: 2310 - protein, 278 aa, Mycobacterium paratuberculosis
MTTGRLLLGATPLGQPSDASPRLLDALARADVVAAEDTRRVRTLAKALDVAITGRVISMFDRVEAARVDSLLEAIRSGATVLVVSDAGMPVISDPGFRLVTACVQAGLPVGCLPGPSAVMTALAVSGLPAEKFCFEGFAPRKKAARRGWLDSLADERRTCVFFESPRRLPACLQDAVERLGGERRAAICRELTKVHEEVVRGTLDELAAWAGDGVLGEITVVLAGATPRTDLPSLVAEVEQRVADGARIKDACGEVAAAQPGVRSRQLYDAVLKARRD

SEQ ID NO: 2311 - protein, 430 aa, Mycobacterium paratuberculosis
LTRPEPAPLCQTRAVRIDRLGDLGPAPQVLRAVGDVTRRLGLPPPAALTGDWFDALAVIAPSLPVRPVPPGDVFAVGTARTPQPPHVGGGWIGYLSYPDGGADAKPNRIPEAAGGWTDCVLRRDRDGQWWYESLTGAPMPRWLAGALAAPAGPPRPCRIDWDVADRAAHRDGVLACLEAIRAGEVYQACVCTQFRGTVGGAPLDFFVDGVARTGPARAAYIQGEWGAVASLSPELFLRRRGTVVTSSPIKGTLPLDAWPSALRASAKEVAENIMIVDLVRNDLGRVATVGTVSVPELLVVRRAPGVWHLVSTVSAQVPTELPTSALLDAAFPPASVTGTPKHRARQLLSKWEPATRGIYCGTIGWASPVAGCELNVAIRTVEFDAAGGAVLGVGGGITADSDPDAEWAECLHKASPIVGLPSIAAASSAG

SEQ ID NO: 2312 - protein, 307 aa, Mycobacterium paratuberculosis
MTRAPTGSEHADRFTLLRPLLFTIAYEMLGSATEADDVLQDSYLRWSTVDLATVRDTKSYLAQLVTRQALNALRAGARRREEYVGPWLPEPLLLDEQDPSTDVVLAESISMAMLVLLETLSPDERAVFVLREVFGFDYDEIAEAVGKPASTVRQVAHRAREHVRARRKRHPGAGQAIDPKRNAELTAQFLATAASGDVEALMAMLAPDATWTADSGGVVSAARRPVVGAEKVARAITGLFRKAAEYATLRVDTVTCNGAPAVLLYLGDRLEGVITVEIAADKITNFYVMRNPHKLAALATARDVSRG

SEQ ID NO: 2313 - protein, 415 aa, Mycobacterium paratuberculosis
LRANLSRGSGLRCLKGTRPHEQETAMTEVTRSKTHVVVVGGGYAGTLAANHLRQRPDIDITLVNPRPVFVERIRLHQLVADTGTATADYATLLGEGIELIVDTVDHIDATARRAVLTSGAGLDYDYLIYAVGSTGAVAEVPGCAEFAHSVADLESAQRLHYALADLPLPAPITVVGGGLTGIETASELAELGRPVTLICGPVLGPSLSPRGRRSVAKRLRRLGVGVLKSVTVTEVRWNEVVLSDGVVLPSAATVWTAGFSVPDLAARSGLRTDPLGRLLTDETLTSIDDDRIVAAGDAAAPSGRPLRMSCQAAGPLGAQAANTVLGRIAGTEPAPLNQAFVGQCISLGRAAATFQLARTDDTPINAYLGGPAAAKLKEAICRGTLWAIRREAAKPGSYRWLKGGQRVPADERVGV

SEQ ID NO: 2314 - protein, 569 aa, Mycobacterium paratuberculosis
VVGGCPRVRSDALTMVCSSGKRALAAVICIAAVLSGCGGKPDPGPLSAMVSPAIPPTAQEIPNPLRGQYEQMLNPLFPQGNSAQQRYSPWPASYDASLRVSWRQLQPVDPRTLPPDAPDDRKFDFSAIDDALAKLGARNMRLTLGVYTYRSCCNDTYPDNTAIAIPDWLRPSSTSYPPPNQAPGVTQVVPNFNDPDYLNGVTALLAALGRRYDGDERVSVFEFSGYGDFGENQLGYPRDSLGAPGPAPDDSVAKLGYYSQFRDQSITKASIAQLVAANTNAFPHTQLVVAPQNPEIVRQLLADDVTKKLSAPVGIRADCLGVQSPLPEWAEANDSHYVRSNDAVVAAIKQRLGSGLVISQWCRPPKGADSRSYYEKGLHDVIRYHVSMTSSADFPDRDATSAMDPELYLLWGQANTSAGYRYSVEAKPGSQSIQGKVASISVVWTNYGAAAATEHWVPGYKLVDFSGAIVRSLPATVNLKTLVHDESSTSREEPVPESATESVHVDVTGLAPGHYTLRATVDWQQHKPDASHVVNYAPMALARDGRDGAGLYPIATLDIPSDAGSASGH

SEQ ID NO: 2315 - protein, 622 aa, Mycobacterium paratuberculosis
VSEDSVPRSLDLVVTSVATALMEATASTARSVSETVLAQLVEQFDVDASFLHHHDAAGPVPVAEWPRRTDAAGPMAALRSEDVESVLAQCERQRRPVVSSPDRVDGWLRRWLQRDKAAGAPSVAAAPLVSGDATTGVLGFVKFGARRWKPEEINTLEAVAALFAQLQARIAAEERLRYLAEHDDLTGVYNRRALVAHLTERLAAGNPGPVAVFYLDLDRLKPINDYLGHTAGDWFIRVFAQRIEECAGEQSMIARLGGDEFVVIPHQPMASEAAEAFARRLSTLLCDRLTIGGHVISRTVSIGLAVGTPGADNCTDLLRRADEAVLTAKRAGGNQTAVSTDDMSLKRAFRNDIELHLQGDIESEGLLLHYLPEVDLWTGAVVGAEALVRWRHPIWGLLLPDSFIGVAESTNLGAELGGGVMRSACADFSRWRANGVGHGAMLRINVSPIQLISRGFVETVADTIGEFGIDAGSVCLEITERAVVHDTETTRKTLSELKEVGVQIAIDDFGTGYAVLSHLKSLPVDMLKIDAGFVREVGTDAGDLAIVRAIIGLAEAFGLEVVAEGVETPAAALTLMQHGCHRAQGFLLSRPIPGEAMEALLSARWMPMPFLADREASSMGSI

SEQ ID NO: 2316 - protein, 264 aa, Mycobacterium paratuberculosis
MALARSAKRWLAPAAKRLAPRRFWRRKFRILDRLGRSRPDVQLVASLCDPHRVSLDIGADLGEFTIAMAASSRSVIAFEPRPAQARDLAAMFDAVGAAVRVEAVALSDEPGTIAMRVVESEPGRSTIDTDNSLGDLTGDQIRVIDVPVKRLDDLNLDDVGLVKIDVEGHELAVLRGAPETLARNRPAIVVEAEERHHRGAVAGITRLLTGLGYSGYFELDGARRPIAEFDPAVHQDPANAGSRQDGWTGRGPYVNNFVFLPDER

SEQ ID NO: 2317 - protein, 541 aa, Mycobacterium paratuberculosis
VCLALLLDGCGQRGDLGPLSLIASPAIPLSVQDVPNPLRGQYEDLLQPLFPQGNPAQRRYPAWPASQDASLRVPWRQLQPTDPSSLPPDAPDDRKFDFSVIDDALAKLASRNMRLTLRVVAYNSCCDTVYPNNTNIAMPDWMRPAATNYTGPQRYWWSPGVTQVVPNWNDQNYLNAFGQLLAALGRRYDGDERLSVFEFSGYGDFSENHISYLRDSLGAPGPAPDESVAKLGYFSQFRDQNITAGSIRQLVEATVKAFPHTQLVTTALNPEIVRQLIADDVTKRLSAPVGIRADCLGVQDPLPAWAERDGSHYVQTKDPLVGALRDRMAAAPVITEWCQLPAGTDPRSYYEKGLRDVMKYHVSMTSSFNFPAVDASTPMDPALYLLWAQANVVAGYRYSAEARQGSQSLADGKATLDVTWTNYGSAAATENWVPGYRLVDFSGAVVRTLPARVTLKTLVPGPDGAGKEPAPVSSVETVHIDLAGVSPGHYTLCAAVGWQQHKPGAEHVVNYPPMRLARDGRDGNGCYPLATLNLAREASTA

SEQ ID NO: 2318 - protein, 487 aa, Mycobacterium paratuberculosis
MDFRTFVRILGAHWKLALTALLACTVGAAFVTALQTKHYQSSATVLISFSGATDLNEVYSGTETAQERLSSYAQIAGGHIVAERAIRQLQLPMSADDLLSQTQVKYTPKSVMFTISVKDTDPARAAALAGAMANQFSALLPTIAPNTGPNTVGAQATAGPRPEVAETTPPPGQPPEAPAAVGPTGKPWPLARATMVEPPRVPNVPVSPVPLRNMVIGFIAGLLLAIAVALTREAGDRTVRTRAKLEELSGLPTLAELPGRRGGTPRFGTDTAFDDAVRGMRTRLLRAMGPDARQVLVTGPFGGEGTTTTAMNLALALAEMGEDALLVEGDSRRHVIAGLLRVESGEGLASALANPAAAAEVVKPTPISRLFILASRSARRESLPPSAYLPEVVDRVVQELSSRFDRIVIDGPPVLATADTGLLSGAVPATVLVVRAKRTTADELQDALTALRAAGAHVVGTVLTDARQSLHIRAADRAYRSKVSRPA

SEQ ID NO: 2319 - protein, 496 aa, Mycobacterium paratuberculosis
VIPIPYLRARHRLAVDGVLLAMFVFGCFVFGVLSVRRTTEGVLLTAALFCVVVYWVKPEGMVGVTLFGAFAALPEGLHVGKVFGPLTIYAYHLAAFLAICYLIPAAKPRSSDFLLPGILAVTAVCSTVTGFLVGNSALVVTRESTTMLEMALGFVLALFVVYSGHVIWSIRVMIAILWFSAGMAIVSSLYSIRLAGRAESLEGTTGAGQAMRIILSTQTPATAVLSALVAAPIVGRVRPRLYLALGPPALSISLLSFSRNTLISMGVAAAVALLGSLSWAAVRRTIVAATVGATLVAVTVPGSLFLLQRSKTGAWLADQYVAFSQRVLGGVTSSALAVDDSALERLREINLLKETIASAPLFGHGLGYVYQPPTGDDEFHRYLYPAYSHNFYLWWLAKAGAVGMAAFVLFALTPVILALRCTSGPAKIAAAVAAGLLAISAVWPLPEMPMDALGLGMALGAAMGYAGLRRRERQLDDRCAAPGPTSNSPVGVGTSS

SEQ ID NO: 2320 - protein, 337 aa, Mycobacterium paratuberculosis
MIAVTHVGPDRYSIGGTQSVIRVIHDNNIGADRIRVLSTWNGPNQVKNLWLTARAGTTLARSAAESIVHFHVSNGGAWLREGPLIRLASAKGFRVIVTLHGSDFPEFARSRPRFVAATLRHADKVILLSEQARAALLEVAPTVRTAVVPNPIVVDEEAPGAGSTPPVVLFAGTVGRRKGVDRLVAAWKLLLAEGIEGRCRIIGPIDDYVPPATERLTVEGPIPPDRVRALLRSVRVVALPSFAEGMPMILTEALAGARPFVATPVGGTAQIAPDPGMLVPVDDVPALADAIGRYLRDPELAQRDGLRGQQHIAATRSPRVIDAELRRIYQGCDVAAG

SEQ ID NO: 2321 - protein, 317 aa, Mycobacterium paratuberculosis
LRRVELAGGQLTVSAMGFGCGALMQSPSRKDRMAVLSAALDSGITHFDTARMYGLGRAEAELGTFLRTVDRDSVTIATKFGIDVGGAARRLGRFQAPARALLKKAPTLRRIVKRQQEPPATARVYDAAGAARSLERSLTALGVDYVDILFVHAPRPQDTVAAAQLCEFFERARGQGKIRAWGVSQDEGLEVDFARAFAPHGISQLRSDLLDPAPRAADLAFAVLRRPHAALSTALRADPELAGRWRRALQLDPLAPGVLARLILAASATATGCRAIIYSTTRPPRVAEAAAAVAAPDAETVARFLALVTEFRGGRAG

SEQ ID NO: 2322 - protein, 560 aa, Mycobacterium paratuberculosis
MIRGARDFTPGMTITTDVAVVGSGPIGIVTALELAASGVQVVLIESGAQRPDRAAQQLAEFDSRHDDYFHSRSGLTVRRQVGGTSALWGGRCVKFDRIDFEHRLITEQAPWPIGYDDVEPYLQRACDWAACGRAVFNARDIPELAHRDLVAGLPDGAVRSTDLERWALPTRFGRHYRKALRRTAGLTLWTGLTCTEIVTEPAGGRVDHLVVKTLPGAQGKVVATDYVIATGGLEATRLLLASDRYHPGGLGNTGGHLGRWYMAHVEGRVARVQFSTDRVIHGYERDGDGVYVRRRFTFDPGLLREAGMSNAAIWLVNPPISDPSHGSGILSGVYLTLISPLGRFLLAAAIREAHTKTDGPPRILAHLRNIAADLPGSIGFAVAFCYARFVRRGRKAPGFFVRSADNRYLLQYHGEHLPHWESRVELSDERDSLGMKRIRTRMHFSDADYASVRTAIGVIDEHLRRHGAGRVEWLTDDVEASVRGYMRRRAGFHQAGTTRMSASPKDGVVDPQLQVHGVRGLYVAATSVLPTSSQANPTLLGIALGVRLAEHLAASRAYPG

SEQ ID NO: 2323 - protein, 295 aa, Mycobacterium paratuberculosis
VSMDRVLFGDNQFFGVNHMSEEKARAQAIRFQHLGPVLDTLDAAYREGIRTFVCTTHDRVGEICDHFRANRSRYPDYVFYPCMPYAHKYANAVTEFGMLDALRRFLPDDGAVRSMFKGGVALAGKDIEPIMQLLVDAEMKMFAGLSTPVIFIQNVVTDLLLGLGMHDAFRFFSDHVRLKYGAEPGFITMNLPRLLDALDGQGIENPIVCANFNKIGFRMCGGIELYEKTIRERRCRLIAMSVLASGAIEPRAAIEYVCRQPQIQSIVFGASSGANIRQTKSLIDEFWPVSARSTN

SEQ ID NO: 2324 - protein, 387 aa, Mycobacterium paratuberculosis
LPMRQWKRVKARSMIRTAVVGLGKMGLSHLAILRTHPDLDVVGVCDSAGYLRDILGKYTGLDCYDDLDRMLTHTRAQAVVVAVPSRLHAPMVEKALARGLHVFCEKPFVLDVRDGERLVTLAETNRLVTQVGYHCRFIGAFREAARIVASGGLGQVHHVRAEAYGPVVLRPKGSTWRGVKEEGGGALYDYACHAIDLMNFIAGVPHSVDGVVRHSVFSRDVDDEVYCTLRYDNGASGQLCVNWSDESFRKMSTKISVWGTNGRLVADRQECQIYLRETHPGLPELGPGWTIRYTTELTDEVWYYLRGEEYSAQIDYFAQSVKNNRRDGENTFRSALAVDRVVAMITGAALAGRPASPALPAVNGSPRGAFRREIAARIKKLAAMRAS

SEQ ID NO: 2325 - protein, 151 aa, Mycobacterium paratuberculosis
MGRLLLIASSGGHIYEMFCLREFWQDKDRFWVSFATADARYLLRDEPEVYWAAHPTVRSVPNLLRNLVLALRLLTRHRPAMILTTGSGVAAPFIWLAWLLRIPAVFVESVTRITELSLTARMVKPFASHLLVQWPELAERIPAAEYHGRIV

SEQ ID NO: 2326 - protein, 161 aa, Mycobacterium paratuberculosis
VIFVIMGMEVHPFDRLARAVDELARTDAVGEEFFVQLGTCRFEPRHARFERFLSFGDVCEQIRRASVAVTHAGAGSTLLCIEQGKHPVMVPRRSSRGEHVDDHQLPFAEKLATAGLATVVRETTELPAAIAATRSRSAPADALGRARELTGWLETFWRGLA

SEQ ID NO: 2327 - protein, 352 aa, Mycobacterium paratuberculosis
VNSPRVLWLSPWTRPAVRVQAEALQRHGAEVLLVTSDQHPESDAARDYELVLDPRFRTAATWLPTLRAWRRVRRFRPDVVLAELVRDPRWIALAGWAPRIQVVHDDRPHDPDELTPAYERAVFDRWGARSAATIAYSDYVAAAISARRDVAGTPVRVVPLASDLDLDRVPPFVGPEGRRDFVMFGRLNPYKNVDVVLAAWQRHVVGGGWRGDNLVLIGDGPLDVKTLPKHTRWRNGSFRYADVIPTLAAAKGSIAHYRRASQSGVQSLSMQLGVMPIVSTAGALPEYQPPGCAPIGIDDVAGLAAAFDLLADPVTAARHGAEAARHYQRRCAVDLVAERILDVVAEVLARRG

SEQ ID NO: 2328 - protein, 600 aa, Mycobacterium paratuberculosis
MTSKADRAYLKRSAGGAIALPAERPLALLIVTDGDRDRTNTCLASVAEHLPDLPVYAYGAEVATKYPGVHCVSGPLDVSPAVAFNVLAEHAPPDADLLLLPAGTRLLGPLTRTRELLRRPGVAAVSPMAPEASARRRTPENLVTRRPPCLAINRTAWNALGAFDEEFFGYGEAADWQARAHAAGWRVLTVDERGVEHTATGPQRLTDAAHRRNRDLARANAALLLEHRRGVHRADAYLAGAAAWGRLRRPNRRRTELPSVVITTNRLVYGGAERQKALLATELDRRGYPVTIVCVQRFGPLIAEIPDTVRVIRQPWWAPIIDVADGPAVLISGDTNTEVGFATLWRAAGRGRRWMVAPHVPPEPDRPIYSRPLTAAMRRADGFIVLAQRHWDMLLDQHRLCGRHFIAPNGVVVTGDPAPRRRADGAPLHLVMLSRIVEHKNPHLLIEALRGLAEIPWRLSIFGDGPDRQRLEAGTPAALRDRVRWHGWAAGPGPALADADLLCVPSRSEAFPLVIVEAMARGVPVAASAICAVPEMLDFGRAGFLVEPVTVSGWRECLARIMADPDALPAVGRRGQQRMRKHYTVQAMADAYLDAIGAVL

SEQ ID NO: 2329 - protein, 491 aa, Mycobacterium paratuberculosis
MSEPTAAAAVVPSVPLARMAHAFSVQLICRALGMLASVVSVAMTARYLGPGRYGQLTIAVAFVAMWTSFADLGIATVIVRRVTSGRGDLERLVRINSGLALLYCVPLAALAAGSGLLIYHDTEVRVMLVVLSGGLLLQTMTTRFEPVFLATVRFSAVAISDVTARVGTLAMVACLVAAHANVIWFAVAQLIPPAVQLLIQGAAAMRHISVRPLFAPREAADLLRESLPLIGFLIVGLLYCRADGVILSLLSTHSEVGVYGLALTIAFNTIVVSLIFHKSTLSTATELFARDVAAFAGFLRRSVELMSFVAVPVAVVGALLAGPLIGLFGKSAFIERGTPTLALLFVAAALRFVGGTLGQGLVASHHQRVLLWLTVATLALNVGLNLALAGRYGAVGPGVALVCTELFNMAVSTWWLRRHCGYRTPVAFVLRLLVPTGASVVVALLLSGHHVILVLTAAAVAYLTTSAVFGPITWSSLASLRASLREKQPAA

SEQ ID NO: 2330 - protein, 513 aa, Mycobacterium paratuberculosis
MPARWSPKHRPAALTTVARDGTGGRPAVAGAPTSAAGTAVRRWQDHYSQGLRVTDSVIVFVSVLFAQYVRFGEVANTSGYSDPVMTLFSVLFALLWLSALAVFQTRSTRIIGSGIDEYRRIGSASFWTFGIIAMVTLLAKVDLARGYLAIALPVGTLGLLASRSLWRQHISRQRAHGHCQTTVFAIGDRQAVTHLAHELVRDPRNGCTVVGVCIPGYGPPRGEILTVAGHEVPILGDETDAVAAICSTGADTVAVTRTEHFGVHGIRELMWQLETMDVDLVVSPGVMDVAEARLTLRLTAGLPLLHVEKPQYEGTQRFQKQAFDMVFSLAALIAAAPVMLAAALAIKLTSKGPVFYPSERIGLDGKPFTMLKFRTMTDGADTQLEQLLSVNEGAGVLFKMRQDPRVTPVGRILRRFSIDELPQFINVIKGDMSVVGPRPPLRREVESYDGDVKRRLLVKPGVSGLWQVSGRSDLSWEESVRLDLSYVDNWSMAGDLMIIAKTVKAVLTSHGAY

SEQ ID NO: 2331 - protein, 190 aa, Mycobacterium paratuberculosis
VKYTPTKVAGVTIIDLELRRDHRGFTWRSFCARDFAAHGLNLDVAQTNIVFNYTRGTVRGLHRTVPPHAEATLLRCTRGAIVAAAVDVRPDSLTYGDHVMIELAADDHRTLFLPPYVAHGFQTLVDDTEVTYHTSGRHAAAEEQGLRWDDPEFGVTWPIPVTVISEQDASWPSAQTRLAPMEQVAPCLSR

SEQ ID NO: 2332 - protein, 422 aa, Mycobacterium paratuberculosis
LHGRCGAAPAPPPPPRSCAGPGADVIDFGALPPEVNSARMYAGPGPLSLTAAAVAWDALAAELHAAASCYRSVIAGLTTGRWLGPSSLAMASAFAPYMAWMAGAAGRAAETAGQARLAVEVFEAAFAMTVPPPAVAANRVQLATLIATNFFGQNAAAIAATEAEYAEMWAQDAAAMYEYAAGSAAACAVTPFTPPPDTTDEAGVARQAAVVGQVTTQAELNHTVSKIPTTLQGLSSPMTAGLDTVTDTGSGAAGGAAAGAANSTTSSIMTGLASGIPGAIPSAFSAAATPLYGMSSILGIAQTAQGLAKAAGDGVAAAASGVASAASSGAGALGSLGSGVLGTLGKAAALGPLAVPASWTSVIPAAHSAVSALPTINLAGANVPPSVMGSLPRLAAASGKTLGPRYGVIPTVMTRPPSAGYA

SEQ ID NO: 2333 - protein, 406 aa, Mycobacterium paratuberculosis; identical to SEQ ID NO: 1515

SEQ ID NO: 2334 - protein, 240 aa, Mycobacterium paratuberculosis
VPHHRPHGGAELSSTMTTHSTDGRADATRQQILRAASHQFARRPYHDVGLDDILAEAELTKGAMYFHFKSKHALAVAIIESQTASGAVAVQDLLTRGLSGLETLIDFSYLIAVKDIKTDLVRSGLNLMESVGLSDGLQEKLFDRWIKALARVAEQAKGEGDINEHCDPQDIGRLMVSLHMGLRKTSNLDDPERFLRDLEKCWSLLLTGILQPDRTEYFQQFLRRRAALAINTSSTDDDES

SEQ ID NO: 2335 - protein, 231 aa, Mycobacterium paratuberculosis
MARQVRSEATRQKILDSAIEVFGEVGYAAAGWSTIIERTGMTKGALYHHFDSKESLASNIIEEGSDRLLSAFRNVCGSSSPGLENLVHGTFTIVEVLRSDKMVRAAAQLATALSGFNGAASRFYANLVLETAQEARRAIKEGDLRDDIDPDVLSASLMGTIFGARLIASTISGHGRIGDIIGDPTARLHQIWSLLLPGIVSQASLPYFEQFLRREGMRHATANPAAQPEGE

SEQ ID NO: 2336 - protein, 697 aa, Mycobacterium paratuberculosis
LPGCRFGRHDRISVIGVEALSTMHTVPVKLRKSLGRVIALAGVVGFLVNSVPESWAAPADPSAPSDSTASTTTTTTTLSMPDLGSSSTLEFWGLTSTQQLSLPVLHGLTPTALNATVELPINLRSGLLTVTQGERTIARLNLPTTDQAPLVVPLNGAEVTGNWLNVTLRAYLVPLDGYCLYPESPLRLVNGTVNYTGTELPPTTVSHFLPPVLRKLTIYLPQSPSTAESDTAIQLATAAAAHYGKQAPDIVVVPLQEGQAAPPAPPQSLERQVVIKEGPDNGLSLQGSTGVPWLLVSGPLNRTDESDTALLFSDLSDMALASKVAVESPKPKPQLPSDSATLRELGQSVVNATSLQPRVSIGLDQTRFGRSVHSVRVHLQGSYTPTPSNIAGQIAVTVGRETIDHWPTDGHGTIDRWVDVPDRLLQRYTSLDLVLDVASNVGHCGDFYTAGPGNQLLTLNINGDSVIQSSPAAPPVPDGFQSMPQSLLPRLQVGIAEHSFVDTVRALDLLVGLQRISAIPIDTTVTTVKQAIDSSNPALLISADGWNQSDVTLPVAAGPSGPITVNAVNSGDKPTKLTLDPVLRFASLQTVFHHGRSLLIATSNGAAGQLDELIRWLKSDTDKHWQRLNGVAVVSVPGQDPVTVDHPPLAAGASAAGAGHHSDLDWLWWFGAGWLAVAVVGAGVILWRVRRESWRRR

SEQ ID NO: 2337 - protein, 338 aa, Mycobacterium paratuberculosis
LRAIATRATVKNAAAALLCAAGVDALARRRHRDTLAILMFHGVEDRPPSPPCWHVSGAALFRRQLRYVRAHFNVLALEDALDRLAGGTLPPRALAITFDDGTRNLATHAMPVLRELELPAAVFLATGPIGTDRTLWPDRLWLAIAHSPAREIDLTPWGLGTRPLKSNIERGAAYTVVVEKLKKLPDPQRIAALDEILCVLGHHDDGDGGPFRMLSWEQIRQLAADPLVTLYPHTVTHPILARCDDAKLHREITESCATIERETGSPPTVFAYPNGRLQDFDERAKDVLRARGVRWALSTAPGFADRSCDPLALPRLAVGGDASLNYFKLLVSGGLPRR

SEQ ID NO: 2338 - protein, 519 aa, Mycobacterium paratuberculosis
MRPFYVTTAITYPNGDPHVGHAYEYIATDAIARFKRLDGFDVRFLTGTDEHGLKMVETAAAEGIGTAELARRNSDVFQRLQERLNISFDRFIRTTDPDHHEASKAIWRRMQAAGDIYLDSYSGWYSVRDERFFVESETKVLDDGTRVAAETGAPLTWTEEQTYFFRLSAYTDKLLAHYEANPDFIAPEVRRNEVVSFVSGGLRDLSISRTSFDWGVKVPDHPDHVMYVWVDALTNYLTGVGYPDTESEMFRRYWPADLHMIGKDIIRFHTVYWPAFLMSAGIELPRRVFAHGFLLNRGEKMSKSVGNIVDPITLVDTFGVDQLRYFLLREVPFGQDGSYTEDAIITRINTDLANELGNLAQRSLSMIAKNLHSVVPEPGDFTGDDRELLQTADGLLPRVRASFDSQAMHLGLEAIWLMLGEANKYFSAQQPWVLRKSESEADQTRFRTVLYVTCEVVRIAALLVQPVMPESAGKLLDLLGQGQDRRAFDALGARLAPGTVLPPPTGVFPRYQAESEKVD

SEQ ID NO: 2339 - protein, 284 aa, Mycobacterium paratuberculosis
VRVSSNRRERQAPPAPEPLAPLIDAHTHLDACAAGPETGAAGVRAIVDRAAAVGVQAVVTVADDLDSARWVTRAAEWDPRVYAATALHPTRADALDDAARAEIERLVAHPGVVAVGETGMDLYWPGRLDGCAEPAVQREAFAWHIDLAKRCGKPLMIHNREADAEVLDVLAAEGAPDLVIFHCFSSDAAMARRCVDAGWLLSLSGTVSFRNARALREAVPLIPPGQLLVETDAPFLTPHPHRGTANEPYCLPYTVRAIAELVDRRPEELAAVTTDNARRVYGLA

SEQ ID NO: 2340 - protein, 372 aa, Mycobacterium paratuberculosis
LTKLHQNPSPMLRLVVGGLLVVLAFAGGYAVSVCKTVTLTVDGVAMRVTTMKSKVIDVVEENGFVVDDRDDLYPAADVAVHDAGKIVLRRSRPLQISLDGHDSKQVWTTASTVDEALAQLAMTDTAPAAANRGSRVPLAGMALPVVSAKTVRINDGGAVRTVHLAASNVAGLLSAAGAPLAESDQVAPPASAPIVDGMEIQVTRNRIQQVTERMPLPPNARRIEDPDMNMSRQVVEDPGSPGTQDVTFSVATVNGVETGRLPIANTVITPARESVVRVGTKPGTEVPPISDGSIWDAIAGCEAGGNWAINTGNGYYGGVQFDQGTWERNGGLRFAPRADLATREEQITVAEVTRERQGWGAWPVCSGRAGAR

SEQ ID NO: 2341 - protein, 318 aa, Mycobacterium paratuberculosis
VASVQRKSWCALTIRLLGRTEIRRLAKELEFRPRKSLGQNFVHDANTVRRVVSTSGVSRSDHVLEVGPGLGPLTLALLDRGAHVTAVEIDPVLAERLPHTVAEHSHSEIQRLTVLNRDVLTLRRDELAEPPTAVVANLPYNVAVPALLHLLAEFPSIRTVTVMVQAEVAERLAAEPGGKEYGVPSVKVRFFGRVRRCGMVSPTVFWPIPRVYSGLVRIDRYPTSPWPTDPAFRRQVFELVDIAFGQRRKTCRNAFVDWAGSGNESADRLLAASIDPARRGETLSIDDFVRLLQRSADRGGTDREGTSPPTAGQGAPAR

SEQ ID NO: 2342 - protein, 316 aa, Mycobacterium paratuberculosis
MSDGNTAAAWVPTGSVTVRVPGKVNLYLAVGDRREDGYHELTTIFQAVSLLDEVTVRNADVLSLDIVGEGADKLPTDERNLAWQAAELMADHVGRAPDVSIMIDKSIPVAGGMAGGSADAAAVLVAMNSLWELNVPRRDLRMLAARLGSDVPFALHGGTALGTGRGEELATVLSRNTFHWVLAFADGELLTRKVFAELDRLRRAGDPPRLPGPGPVLAALAAGDADQLAPLLGNEMQAAAVSLNPGLRRTLRAGVQAGALAGIVSGSGPTCAFLCPSAAAAVDVGTEVSGVGVCRTVRVASGPVAGARVVPAPTEV

SEQ ID NO: 2343 - protein, 125 aa, Mycobacterium paratuberculosis
LWGSPVTMPVFAVRALRYIFSVNLLTKTSSVPALAPAPEISCSARRATPRRRRVSTVRRRFGLGSVMRRRPRQRRGARSSDKRESGPKNLVGPDSSIVRRNARRTMRLSVSAQRFPSPRIILNSS

SEQ ID NO: 2344 - protein, 544 aa, Mycobacterium paratuberculosis
VSRFTEKMYRNARTAKTGMVTGEPHNPVRHTWGEVHERARRIAGGLAAAGIGPGDAVGVLAGFPVEIAPTAQGLWMRGASLTMLHQPTPRTDLAVWAEDTMNVIGMIEAKAVVVSEPFLVAIPVLQEKDIKVLTVADLLASDPIDPVEVGEDDLALMQLTSGSTGSPKAVQITHRNIYSNAEAMFIGAQYDVDKDVMVSWLPCFHDMGMVGFLTIPMYFGAELVKVTPMDFLRDTLLWAKLIDKYKGTMTAAPNFAYALLAKRLRRQAKPGDFDLSTLRFALSGAEPVEPADVEDLLDAGKPFGLKPSAILPAYGMAETTLAVSFSECNAGLVVDEVDADLLAALRRAVPATKGNTRRLATLGPLLQDLEARIVDENGDVMPPRGVGVIELRGESVTPGYLTMGGFIPAQDENGWYDTGDLGYLTEEGHVVVCGRVKDVIIMAGRNIYPTDIERAACRVEGVRPGCAVAVRLDAGHSRETFAVAVESNAFQDPAEVRRIEHQVAREVVAEVDMRPRNVVVLGPGTIPKTPSGKLRRSNSVTLVT

SEQ ID NO: 2345 - protein, 191 aa, Mycobacterium paratuberculosis
VAEPLLVVGLGNPGDNYARTRHNVGFMVADLLAARMGSKFKAHKRSGAEIVSGRLAGRSVVVAKPRCYMNESGRQVGPLAKFYSVPPGDIIVIHDDLDLDFGRIRLKIGGGEGGHNGLRSVANALGSKDFQRVRIGIGRPPGRKDPAAFVLENFTSTERADVPTICEQAADATELLIELGLEPAQNRVHAW

SEQ ID NO: 2346 - protein, 219 aa, Mycobacterium paratuberculosis
MAKQALNQLTAAVRTETGKGASRRARRAGKIPAVLYGHGTDPQHLELPGHDFAAVLRHAGTNAVLTLDIDGKEQLALTKALDIHPIRRTIQHADLLVVRRGEKVVVEVTVVIEGDAAPGSLVTQEASTIEIEAEALSIPEQFTVSVEDAEPGTQFTAGQIALPKGVNLISDPELLVVNVVNAPTAEELAEEGAGEVTEEPAAAEAEEAGEEEAAEAESE

SEQ ID NO: 2347 - protein, 289 aa, Mycobacterium paratuberculosis
MTGWTAADLPSFAQRTVVITGANSGLGAVTARELARRGATVIMAVRDTRKGEAAARTMAGQVEVRELDLQDLSSVRRFADGVSGADVLINNAGIMAVPYALTVDGFESQIGTNHLGHFALTNLLLPRLTDRVVTVSSMAHWPGRINLEDLNWRSRRYSPWLAYSQSKLANLLFTSELQRRLTAAGSPLRALAAHPGYSHTNLQGASGRKLGDALMSAATRVVATDADFGARQTLYAASQDLPGDSFVGPRFGYLGRTQPVGRSRRAKDAGMAAALWALSEQLTKTEFPL

SEQ ID NO: 2348 - protein, 219 aa, Mycobacterium paratuberculosis
VNRLRGCAAVAAAVALAVATAGCAPKPPDYQSILSKTPTTTTTTSATAKPVPLSQYLQSIGVTGQQVAPASLPDLTVSIPTPPGWAPFSSPNISPQTVMISKGGKFPTARLVVFKLSGDFDPAQVIKHGNDDAQLFENFKQLDASGAPYNGFPSSMIQGSYDLDGMRLHSWNRIVIATGSPPAHQRYLVQLTITSLADQAAAESTDIEAIIHGFVVAAK

SEQ ID NO: 2349 - protein, 115 aa, Mycobacterium paratuberculosis
MAQGATIYHNPRCSTSRKTLELLRDNGFEPNIVEYLKTPPSRAELVKMIRDAGIDVRTAVRKRESLYDELNLAEASDEQLLDAMIEHPILIERPFVVTPKGTRLARPIDAVREIL

SEQ ID NO: 2350 - protein, 326 aa, Mycobacterium paratuberculosis
LSHDWTDNRKNLMLFSGRAHPELAEQVAKELDVHVTAQTAREFANGEIFVRFHESVRGCDAFVLQSAPAPVNSWLMEQLIMIDALKRGSAKRITAVMPFYPYARQDKKHRGREPISARLVADLLKTAGADRIVTVDLHTDQIQGFFDGPVDHMRGQNLLTGYIRDNYPDGNMVVVSPDSGRVRIAEKWADALGGVPLAFIHKTRDPRVPNQVVSNRVVGEVAGRTCVLIDDMIDTGGTIAGAVKLLRDEGAGDVIIAATHGVLSDPAAERLASCGAREVIVTNTLPIGEEKRFPQLTVLSIAPLLASTIRAVFENGSVTGLFDGDA

SEQ ID NO: 2351 - protein, 490 aa, Mycobacterium paratuberculosis
MSSPGDTAVLVLAAGPGTRMRSDTPKVLHPLGGRSMLSHLLHAIAKVAPQHLAVVLGHDHERIAPLIADWADDLGRPIDVALQERPRGTGDAVRCGLSALPDDYAGVLVVTSGDTPLLDADTVADLIAGHTATRAAVTVLTTTLSDPSGYGRILRTQDNEVTAIVEHADATESQREIREVNAGVYAFDTAALRSALNRLSADNAQQELYLTDVIAILRGDGLPIRARHVDDSALVAGVNNRVQLAQLGAELNRRIVAAHQLAGVTVVDPATTWIDVDVTIGRDTVIHPGTQLLGRTQIGGHCVVGPDTTLTDVSVGDGASVVRTHGTGSSVGAGATVGPFAYLRPGTVLGDDGKLGAFVETKNATIGTGTKVPHLTYVGDADIGEHSNIGASSVFVNYDGESKRRTTVGSHVRTGSDTMFVAPVTVGDGAYTGAGTVVREDVPPGALAVSAGPQRNIEGWVRRKRPGSAAARAAEAAEKAAGGRPAGEAE

SEQ ID NO: 2352 - protein, 204 aa, Mycobacterium paratuberculosis
VRAPRARMTGSERRQQLIGIARSLFAERGYEGTSIEEIALRANVSKPVVYEHFGGKEGLYAVVVDREMSALLDGITSSLTNNRSRVRVERVALALLTYVEERTDGFRIMIRDSPAAISSGTYSSLLNDAVSQVSSILAGDFARRGLDPDLAPLYAQALVGSVSMTAQWWLDTREPKKEVVAAHLVNLMWNGLTHLEADPRLQDE

SEQ ID NO: 2353 - protein, 444 aa, Mycobacterium paratuberculosis
LLDILPSLGHAAPPRFDPAIWPVTAHPDEEGRLCVGGVPLGDVADEFGTPAYVVDEADFRCRARRYRRALRGVEVVYAGKSLLSTAVARWAREERLGVDVCSAGELATALAGGVDPARIVMHGNAKSPEELREAVRVGVGRIVLDSTIEIAYLAGLARRRQPVLIRVTPDIDIHGHRAVTTGVSDQKFGFTLAGDHAADAVRRVLAHPILDLVGLHCHLGSQVSDPALYGEAIRRMIAAMADIRARHGVILTELNIGGGHAIPYASGDPELNLDQLADVIEDALDEACAAERFPRPQIVVEPGRAISGRAGVTLYRVCSVKTQGGGRTFVAVDGGMSDNPRVSLYGARYAVALANRHPLGLKQRVTVAGRHCESGDEIARDVELPADLRPGDLLAVACTGAYHHSMASNYNMVGRPPLVAVSEGRARELVRRETVADLLARDRG

SEQ ID NO: 2354 - protein, 1221 aa, Mycobacterium paratuberculosis
MTAPGAARPETPIAGLVELALTAPTFQQLIDTAAASPADLSLVGPASTRLFVASALARLGPLLVVTATGREADDLTAELRGVVGDAVAVFPSWETLPHERLSPGVDTVGARLTVLRRLAHPDDARLGPPLQVVVTAVRSLLQPMTPQLGLVEPVTLSVGQEIEFEHVIARLVELAYSRVDMVGRRGEFAVRGGILDVFPPTAEHPVRVEFWGDEVSEMRMFSVADQRSIPEIAVDTVISVPCRELLLTEDVRARAAELAAQHPASEPAITGSVSDMLAKIADGIAVDGMEALLPVLRPGKQVLLTDQLADRTPVLLCDPEKIRTRAADLIKTGREFLEASWSVAALGTLENQAPIDVEQLGGSGFAELDEVRAAAVRGGHPWWTLSQLSDESAVELDVRAAPSARGHQHDIDGIFAMLRAHVSTGGHAAVVAPGTGTAHRVVERLAECDTPAAMLESGAAPRAGVVGVLKGPLHDGIVIPGANLVVITETDLTGSRVAAVEGKRLAAKRRNTVDPLALTAGDLVVHDQHGIGRFVEMTERTVGGARREYLVLEYASSKRGGGSDKLYVPMDSLDQLSRYVGGQAPALSKLGGSDWANTKTKARRAVREIAGELVSLYAKRQASPGHAFSPDTPWQAEMEDAFGYTETVDQLTAITEVKSDMEKPIPMDRVICGDVGYGKTEIAVRAAFKAVQDGKQVAVLVPTTLLADQHLQTFTDRMAGFPVTVKGLSRFTDAAESRAVIEGLADGSVDIVIGTHRLLQTGVRWKDLGLVVVDEEQRFGVEHKEHIKSLRTHVDVLTMSATPIPRTLEMSLAGIREMSTILTPPEERYPVLTYVGPHDDKQVAAALRRELLRDGQAFYVHNRVSSIDRAAARVRELVPEARVVVVVAHGQMPEERLERTVQGFWNREYDILVCTTIVETGLDISNANTLIVERADTFGLSQLHQLRGRVGRSRERGYAYFLYPPHAPLTETAYDRLATIAQNNELGAGMAVALKDLEIRGAGNVLGVEQSGHVAGVGFDLYVRLVGEAVEAYRAAADGQTVTTAEEPKDVRIDLPVDAHLPPDYIASDRLRLEAYRRLAAAGSDDEIDAVVEELVDRYGALPEPALRLVAVARLRLLCRAAGITEVSAPSAATVRLSPITLPDSAQVRLKRMYPAASYRATTSTVQVPIPRAGGVGAPRLRDVELVQMVANLVTALQGKPQTDVGTGTPVAAMASEEGRG

SEQ ID NO: 2355 - protein, 333 aa, Mycobacterium paratuberculosis
VIVILCDPRRPSLVPVEAVEHLTGEVQYTEEMPIAVPWSLPAVRPVHSGDPDDPAPVLLSSDRDHPAVTARLAAGARLISAPDAPRGERLVDAVAMMDKLRAGPWESEQTHESLRRFLLEETYELLDAVAGGNAEALRDELGDVLLQVLFHARIAEDAPQSAFTIDDVAAALIRKLGNRVPGVLAGQTISLEEQLAQWEERKAAEKPRKSVMDDVHTGQPALALAQKVIGRAEKAGLPADLIPPQVTSIAISADVDAESALRTAVLDFVATVRGVERSIAAARRGTSVPDEFDIAPLGEISEQEWRQHWPAGDTDPEPAPAEQLTDDAGGDEN

SEQ ID NO: 2356 - protein, 264 aa, Mycobacterium paratuberculosis
MHGTMVGRKLVQASFRGAQESMVSPRRWMRAAAVIGATAIVLASSCTWQLSLFIPDGVPPPAGDPVPPVDTHASGRPADQLRDWAAQRAAGLEIPVIALEAYAYAARVAEVENPKCHIAWTTLAGIGQVESHHGTYRGARLAPNGDVSPPIRGVRLDGSGGTLRIVDNDEDVTDEDGVTRAMGPMQFIPETWRLYAVDAHNDGRVSPDNIDDAALAAAGYLCWRGKDLATPRGWITALRAYNNSGVYARAVRDWATAYAKGHPL

SEQ ID NO: 2357 - protein, 429 aa, Mycobacterium paratuberculosis
VPIIEQVGAREILDSRGNPTVEVEIALTDGTFARAAVPSGASTGEHEAVELRDGGERYGGKGVQKAVQAVLDEIGPAVIGLNADDQRLVDQALVDLDGTPDKSRLGGNAILGVSLAVAKAAADSAELPLFRYLGGPNAHILPVPMMNILNGGAHADTAVDIQEFMVAPIGAPSFAEALRWGAEVYHSLKSVLKKEGLSTGLGDEGGFAPDVAGTTAALDLIGRAIESAGFKLGTDVALALDAAATEFYSDGTGYKFEGSTRTAEQMAEFYAGLLGAYPLVSIEDPLSEDDWDGWAALTASIGDRVQLVGDDVFVTNPERLEEGIEKGVANALLVKVNQIGTLTETLDAVALAHHSGYRTMMSHRSGETEDTTIADLAVAVGSGQIKTGAPARSERVAKYNQLLRIEEALGDAARYAGDLAFPRFALETR

SEQ ID NO: 2358 - protein, 225 aa, Mycobacterium paratuberculosis
LPAKPDPKRRSPASRPGKAGDSVRRRRAAKPSQTVTARKTARARHEPAAEPIVRQAAESVEQRSEQRLGFTARRAAVLAAVICVLTLTIAGPVRTYFAQRTEMNQLAASEAALRRQIADLEQRKAKLADPAYIAAQARERLGFVKPGDIPFQVQLPPTAAEPTQPGSPSAKPVNNDPWYTSLWHTIADAPHLPPANPAVPQAPPAEPGPPGPVPPPAPNPAGPGG

SEQ ID NO: 2359 - protein, 162 aa, Mycobacterium paratuberculosis
VVDRADLDAVARQLGREPRGVLAIAYRCPNGEPGVVKTAPKLPDGTPFPTLYYLTHPALTAAASRLETTGLMREMTERLSQDAELAAAYRRAHESYLAERDAIEPLGTTFSAGGMPDRVKCLHVLIAHSLAKGPGVNPFGDQALSILAADPALAGVLQEGRW

SEQ ID NO: 2360 - protein, 316 aa, Mycobacterium paratuberculosis
MVTGRLAGIDCGTNSIRLLIADVRDGRLRDVHRETRIVRLGQGVDATGEFAPEAIARTRAALSDYADLLKQHGVQRVRMVATSAARDVGNRADFFSMTADVLGAVLPGAVAEVITGADEAELSFRGAVGELDSAAGPFVVVDLGGGSTEIVVGGSDGVTASHSADIGCVRLTERCLHSDPPTPEEVALARQVVRERLEVALGVVPVEGARTWVGVAGTMTTLSALAHDLPAYDSAAIHLSRVSGRDLLAVCERLIGMTRAQRAALPPMHAGRADVIAGGAVVVEELARELRARAGIDELTVSEHDILDGIVLSIAG

SEQ ID NO: 2361 - protein, 108 aa, Mycobacterium paratuberculosis
VWDGSAMNRLLLKGIELRYVLAMQLAVHGPADIGELIKALDWHGFCVQGRPSKAVSDALRWEIVHGRVRRLGRGRYGPGGMPRSTEHRIHQRVLALREAARCRCEAGT

SEQ ID NO: 2362 - protein, 226 aa, Mycobacterium paratuberculosis
MTRVLVIDDEPQILRALRINLSVRGYEVVTASTGAGALRAAAEHKPDVVILDLGLPDISGIDVLAGLRGWLTAPVIVLSARTDSSDKVEALDAGADDYVTKPFGMDEFLARLRAAVRRNTAASEMEQPVVETESFTVDLAAKKVTKNGSEVHLTPTEWGMLEVLVRNRGKLVGREELLKEVWGPAYATETHYLRVYLAQLRRKLENDPSHPKHLLTESGMGYRFEA

SEQ ID NO: 2363 - protein, 858 aa, Mycobacterium paratuberculosis
MMVDVTDVRDHHPKRGELRIYLGAAPGVGKTYSMLGEAHRRLERGTDLVAGVVETHGRAKTAELLEGIEIIPPRYIEYRGGRFPELDVPAVLARHPQVVLVDELAHTNTPGSKNPKRWQDVEELLDAGITVISTVNVQHLESLNDVVAQITGIEQKETVPDSVVRQASQVELIDITPEALRRRLSHGNVYAPDRIDAALSNYFRRGNLTALRELVLLWLADQVDTALAKYRAENKITDTWEARERVVVAVTGGPESETLVRRASRIASKSSAELMVVHVIRGDGLAGLSESRMAKIRELASSLDASLHTIVGDEVPAALLEFAREMNATQLVIGTSRRSRWARLFEEGIGPRIVELSGKIDVHLVTHEESKRGFRASSLAPRERRVASWLAALIVPSVICAVTVTWLDPYLDTGGESALFFVGVLLVGLLGGIAPAALSAVLSGLLLNYYLIAPRHSFTIAEPNSAITELVLLLIAVAVAVLVDFAAKRTREARRASQEAELLTLFAGSVLRGADLETLLERVRETYAQRSVSMLRESEDARAGGTKTQVVACVGRDPCVSVDAADTAIEVGGPDSSEFQMLLAGRKLSARDRRVLSAVARQAAGLIRQRELAEEASRTEAIVRADELRRSLLSAVSHDLRTPLAAAKVAVSSLRAEDVAFSPTDTAELLATIEESIDQLTALVGNLLDSSRLAAGAIHPDLRRVYLEEAVQRALVSIGKGATGFFRSAIDRVKVDVGDAMVMADAGLLERVLANLIDNALRYAPNCVVRVNAGQVGDRVLISVIDEGPGIPHGAEEQIFEAFQRLGDHDNTTGVGLGMSVARGFVEAMGGTITATDTPGGGLTVMVDMAAPQSEGAA

SEQ ID NO: 2364 - protein, 291 aa, Mycobacterium paratuberculosis
MTLSNFIRLHWAALRALLVLTVITGLAYPLLVWVVAQFPGLRDHAEGSILTANGKPVGSRLIGQLFTDKDGNPLPQYFQSRPSAAGTGYDPTSSGGSNLGPESIVDAPGKPGLLTTVCSRSAAVAKLEGVDGSRPFCTGGGVGAVLSVIGPRDERGNVTHPARVVSVNEPCESTPTPFVSLYEGVRVECAKTGEDYSLGQIVPIRGAAPAAPAVPADAVTAGGSGLDPNISPAYADIQVARVAKVRHVRPEQIRELVAQNSSGRALGFFGEPCVNVLQLNLQLDHRYPVTS

SEQ ID NO: 2365 - protein, 245 aa, Mycobacterium paratuberculosis
VLGVIHLKDVVKQGMRERFDEMRRMGIRTVMITGDNPLTAKAIADEAGVDDFLAEATPEDKLQLIKREQAGGKLVAMTGDGTNDAPALAQADVGVAMNTGTSAAKEAGNMVDLDSDPTKLIEIVEIGKQLLITRGALTTFSIANDIAKYFAIIPAMFVALFPGLDLINVMRLHSPQSAILSAVIFNAIIIVLLIPLSLRGVRYTPSSASKLLSRNLYIYGLGGIVAPFIGIKAIDLIVQFVPGMS

SEQ ID NO: 2366 - protein, 506 aa, Mycobacterium paratuberculosis
MTVTAIDPAEQAHPAPSAGTKRVQGGLLDPKMLWRSTPDALRKLDPRTLWRNPVMFIVEIGAAWSTVLAIVGPTWFAWLTVIWLWLTVLFANLAEAVAEGRGKAQAETLRRAKTQTMARRLRDWAPGSTGIEEAVSATALQQGDIVVVEAGQVIPGDGDVVEGIASVDESAITGESAPVIRESGGDRSAVTGGTTVLSDRIVVQITQKPGESFIDRMIALVEGANRQKTPNEIALNILLAALTIIFVFAVATLQPLAIYSKVNNPGVPDTQALNTSGVTGIVMVSLLVCLIPTTIGALLSAIGIAGMDRLVQRNVLAMSGRAVEAAGDVNTLLLDKTGTITLGNRQAAAFIPLAGVPPEELADAAQLSSLADETPEGRSVVVFAKQHFGLRARTPGELSQAQWVAFSATTRMSGVDLDGHSLRKGAASSVAEWVRSQRGSVPHQLGEIVERHLRRRRHTTGRRRERRRPGTGARCHPPQGRGEAGHAGTVRRDAADGHPDGDDHRR

SEQ ID NO: 2367 - protein, 556 aa, Mycobacterium paratuberculosis
VSSTTAGLIFLAVLVAALVAVHVPLGDYMFRVYTTDRDLATERTIYRLIGVDARSEQTWGAYARGVLAFSSVSIIFLFVLQLVQGKLPLHLHDPATKMTPSLAWNTAVSFVTNTNWQAYSGETTQGHLVQMAGLAVQNFVSAAVGMAVAVALVRGFARRRTGELGNFWVDLVRGTLRILLPISIVGAVLLVAGGAIQNFHLHDQVVTTLGGTAQTIPGGPVASQEVIKELATNGGGFYNANSAHPFENPTAWTNWLEVFLILVIGFSLPRTFGRMVGNPKQGYAIASVMASLYLLSTGFMLWFQLQHHGTVPSAVGAAMEGVEQRFGVPDSGVFAAATTLTSTGAVDSAHDSLTSLGGMITMFNMQLGEVAPGGTGSGLYGMLVLAVITVFVAGLMVGRTPEYLGKKINPREIKLAASYFLVTPLIVLTGTAIAMALPGERAGMANSGPHGLSEVLYAFTSAANNNGSAFAGLSANTEWYNTALGLAMAFGRFLPIVLVLALAGSLARQGSTPDSAGTLPTHRPQFVGMVAGVTLIVVALTFLPMLALGPLAEGIH

SEQ ID NO: 2368 - protein, 512 aa, Mycobacterium paratuberculosis
MTRDRDTASGGFPRWFPSSLRRQLLFGVLAVVSVVLVTVGFVSVLSLRGYVNAMSDADVAESLDAFSHQYTKYRNGEHVSPHPGTPPIQQAILEFTGQTPGNLIAVLRNGAVIGSAVFSEDEPRPAPPDVVRDLAAQSWKDSPPRTEILGRLGPYRVNSTVNGSDVLVVGVSHNLADRIIARKQLTTVALTASALLLTAGLTVWVVGYTLRPLRRLAAIAAHVAAMPLTDDDHRITVRVQPQDTDPQNEVGIVGHALNRLLDNVDSALAHRVDSDLRMRQFITDASHELRTPLAAIQGYAELTRQDSSTLPPTTEYALARIESEARRMALLVDELLLLSRLGEGQDLQSEDVDLTEVVSDAVNDAMVAAPTHHWVKDLPDEPVWVRGDQARLHQLVSNLLGNARVHTPPGVTVTTAIRCHRGGREAPFAELTVTDDGPGIDADLLPNLFERFVRADKSRSDGSGHGLGLAIVSSIVKAHHGSVGVESTAGRTVFRVRLPLIGGPGTLGVAGL

SEQ ID NO: 2369 - protein, 257 aa, Mycobacterium paratuberculosis
MTVMSGQSAAQRPRQAILGQLPRIYRADGSPIRVLLVDDEPALTNLVKMALHYEGWVVDIAHNGREAMAKFDRAAPDVLVLDIMLPDVDGLRILERVRQSDAYTPTLFLTARDSVMDRVTGLTAGADDYMTKPFSLEELVARLRGLLRRASQQPAPTAETLKVGDLVVDTASREVTRGDTPVSLSSTEFELLRFLMRNPRRALSRTEILDRVWNYDFAGRTSIVDLYISYLRKKIDSGREPMIHTVRGVGYMLRPAE

SEQ ID NO: 2370 - protein, 98 aa, Mycobacterium paratuberculosis
MATRFMTDPHEMRAMAGRFEVHAQTVEDEARKMWASSMNIAGAGWSGQAQATSYDTMGQVNQAFRNIVNMLHGVRDGLIRDANNYEQQEQASQQILSS

SEQ ID NO: 2371 - protein, 98 aa, Mycobacterium paratuberculosis; identical to SEQ ID NO: 2370

SEQ ID NO: 2372 - protein, 382 aa, Mycobacterium paratuberculosis
MVLDFAAVPPEITSALMYAGAGSGPLMAAATAYANLSAEVSSTASQWESIISLLTTEQWTGGGSAAAAAAAQPIVSYLTTTAAALEQASAQATASAAAYEAAFAATVPPPVIAANRSLLATLVATNFLGVNSAAIAATEAQYAEMWVQDATMMATYQAASAAAGVLQPVTPLTSTTNPGAAAAVDNGAVAFDATNSTAQTAGLDLSSLITSPPTDGLLQSIDDLLGTPSFLNATNGAINTAAWWVCATIPNAVSLGKTLGTVPAIPFSLTDSVAPAAGAAITPGMMVGSVTGAGASAAVGEASAVGGLSVPASWSAAAPATSLASSAAPLEGSGWTVASEAEPVTAMPGMPGAAAAAKGAGAYGSGPRYGFKPIVMPKQVVV

SEQ ID NO: 2373 - protein, 174 aa, Mycobacterium paratuberculosis
VAAGLQRPVQRRSGRHVRPLEQRRQHRQHRYRQLGVGHLEPARPGRRRAAGHLRRRRRRRRRPGHLDRTGGTGVGGAGVGGVAGMGAMPAAAMGQATTVSKLSVPPSWAGATPVVGSSSAPLQTVGWTAAAPQAGVGTVVPGMPGVGTMARNSAGFGAPRYGVKPIVMPKPATV

SEQ ID NO: 2374 - protein, 403 aa, Mycobacterium paratuberculosis
VSEDARADGVSRQYDRWQYPPPVTDLDAWTTNHWDWFDPFWAHRLLWPDREYRPDLDILIAGCGTFQAAVYAYTNRAAKVVAIDVSRTALDHQQFLKDKHRLHNLELHRLAIEEVAALDRDFDLIVSTGVLHHLADPLTGLTALGRCLRPDGALGVMLYASYGRIGVEMLASVFRDLGLSQDEASVELVKEAVAALPADHPVHTYLKGARDLSTDGGLVDTFLHARQRSYTVEQCLELVAAAGLAFQGWLRNSPYYPHDALFGSAATQFQSALNRLPDTTLWSVMERLQPANATHFFLACRPERPRERYRIDFSSPTYLGYVPVLRTACLLSGDQIHLPGAKLTLTPAQLPFVQQVDGRRSIAEIIDGVAGAGRDDRAREFGRRLFESLWRLDFLAMGLAPGR

SEQ ID NO: 2375 - protein, 263 aa, Mycobacterium paratuberculosis
MLFGLAPWIVYWVLVGNVPFVAAVLVALALAAVSLGLGGVLRRRWQLFDFASVAVLLVLAVLAFTLSESFLQRWILPLSNAGIFLAALAGMLIGKPFVAEFAAAEQAPDVAKTELFGRIVKILGWIWVATFAGMTVSSAIPSVLQGSAGAAPAYMLDTKTPLSFLCYWIIPFALLGLAAVVSRLLPDRMLIGIDDLERETSFVAYDEATIDELYFLAQEHANREVGPGKEAYAVKVGGMGTPLTGDESRKSWPSTYKVRDKRR

SEQ ID NO: 2376 - protein, 256 aa, Mycobacterium paratuberculosis
MPAEPDYPQMAAARGRIEPAPRRVRGYLGDVLVFDTTAARYVWEVPYYPQYYIPLADVRTELLRDENHAQRVQFGPSRLYSVVAGGRTCESAARVFDADGDGPLAGTVRFEWDPLRWFEEDEPIYGHPRNPYARVDALRSHRHVHVEREGITLADTSSPVLLFETGLPTRYYIDPTDVDFAHLEPSATQTLCPYKGTTSGYWSVRVGDVVHEDLAWTYHYPLPAVAQIAGLIAFYNEKLDIVVDGTPLPRPHTQFS

SEQ ID NO: 2377 - protein, 395 aa, Mycobacterium paratuberculosis
VNPGANSPRPYRRLRHLATRADKHSKGGTSVSDANGPTARFGIDNTAVVKVPVHHGPISDIDVSPDGRRLLVTNYGRDTVSVIDTHTCRVASTIAGLSEPFAVAMSAADPNYAYVSTATAAYDAIEVIDVVTNWRIATHRLAHSLSDLAVSPDGRYLYASRNAVRGADVAVLDTTTGELEVIELAAAAGTTTACVRVSADGRRLFIGVNGPNGGGLAIIETRTRTDGRRVGGRSRLVGTVELGLPVRDVALGNDGNTAYVASCGPVVGSVLDVVDTRAATIVSTHKINEITGPLTRMTLSRDGERAYLISDDRVTVLGTRTQDVLGEVRVTKHPSALVESPDGHYLYVADHSGVLSVARLSSGTAPAAPCSGADEDDDATTGWLPELAPWEPVLA

SEQ ID NO: 2378 - protein, 549 aa, Mycobacterium paratuberculosis
MRRRCAVDGTMQDFPLTITAIMRHGCGVHGARTVTTATGDGYRRTSYRELGDQAAQLANALRGLGVTGDQRVATFMWNNAEHLAAYLAVPSMGAVLHTLNIRLFPEQIAYVANEAEDQVVLVDASLVKLLAPVLPGLHTVHTVIVVGDGDTEPLRTSGKTVLRYADVIGAEPAEFDWPRIDENSAAAMCYTSGTTGNPKGVVYSHRSSFLHTMAACTANGIGIGASDSLLPIVPMFHANAWGLPYAALMAGADLVLPDCHLDPRSLVRMVEDLRPTVTGAVPTIWNAVLHHLEDEPDHDMSSLRLVVCGGSAVPVSLMRTFEEKHGVQIRQLWGMTETSPLATMAWPPPGTPEDQHWAYRGTQGQPVCGVQMRIVDDDGRVLPNDGTAVGEVEVRGPWIAGSYYLGRDDSKFDSGWLRTGDVGRIDERGFVTLTDRAKDVIKSGGEWISSVELENCLIGHPDVVEAAVVGVPDERWEERPLAVVVVKDGASVDADQLRKFLADKVVRWSLPERWTFVDEIPRTSVGKYDKKAVRSRYADGGYRVIEARD

SEQ ID NO: 2379 - protein, 157 aa, Mycobacterium paratuberculosis
VADSLVVAQSVVAPVAASDAFGRTLPMPLPTLFNRWYGPFPPIREVRGQTGDWDAAGRQRIVHLAGGASMREELTSVDPPRSFGYRLSGITGPMALLVNHVLGEWVFTPAAGGTEITWRWDIHPRSPLTAWALPLLGRMWKGYARRALDNLVALLTR

SEQ ID NO: 2380 - protein, 295 aa, Mycobacterium paratuberculosis
MCRLFGLHAGTRACTATFWLLDAPDSLAEQSRRNPDGTGLGVFDEHARPQLRKEPIAAWRDAAFAREAHQLTGTTVIAHVRYATTGSLDVRNTHPFLQDGRIFAHNGVLEGLDVIDARLREVGVDGLVLGDTDSERVFALITAAIRARDGDITAGLVDAVRWLAEQVPIYAVNLLLSTATEMWALRYPHTHQLYVLDRSADAARQPEFDLHTIRIHARSQQLCTRPSVVFATERMDADPRWRLLEPGELAHVDAGLRVSRRLVLPDPPRRLLRRDELSTPVRDSQHALPDTRRTG

SEQ ID NO: 2381 - protein, 289 aa, Mycobacterium paratuberculosis
VTTKRALVLAGGGIAGIAWETGVLRGIADESPAVARLLTESDVLVGTSAGSAVAAQLCSGHTLDALFDRQVAASSPEIDSGVDVEAITELFLTALAEPYDDSEDKTRQQLRRIGAVALATDTVPAPVRRRVIAARLPSHRWPRRALRLTAIDVDSGELTVFDPASGVDLVDAVAASCAVPGAWPPVAIGGRRYMDGGVASSVNLGVAADCDVAVVLVPSGVDAPSPFGAGPAAEIAAFPGRGLAVFADDRSLAAFGPNPLDPGCRVPSARAGREQGRREAAAVAGFLGV

SEQ ID NO: 2382 - protein, 356 aa, Mycobacterium paratuberculosis
VPEERRSAPTRVALALGSGGARGYAHIGVIEALQARGYDIVGVAGSSMGALVGGLQAAGRLDEFAEWAKSLTQRTILRLLDPSISAAGVMRAGKILDAVRDILGPVAIEDLRIPYTAVATDLLAGKSVWFQRGPLDEAIRASIAIPGVIAPHTLDGRLLADGGILDPLPMAPLSAVNADLTIAVNLSGSEAITRREAEPAATAEWLTRMMRSTSALFDTAAARSLLDRRTARAVLSRLGGPSGDADAWPDNPEEPDQPVLADDDDEAVELPGAATDVPKLGSFEVMNRTIDIAQAALARHTLAVYPPDLLIEVPRSICRGLEFHRAVEVIDAGRALADQALDDLEDGDDDSPAVER

SEQ ID NO: 2383 - protein, 151 aa, Mycobacterium paratuberculosis
VRWRGDRSRRRGAVVLVGIVLGVVAAAPGCSHGAPRGAPTPAPARQTGIPAGPAAAPPGAVGLSPGGVTTRVDIPADSTEEEYYQACHAAKEWMDAQPKTGASLFEPYLAMVQASPSGTAGSWNTPWSALTPARQAAVIVAARAAANDECG

SEQ ID NO: 2384 - protein, 195 aa, Mycobacterium paratuberculosis
VPAATLAALRPPFPSSPSPGPTRLRVPDLLYATDQAADDVLSGRCDHLLPPGGIPASRRWFTRIHGDEELDVWLISWVPGHPTELHDHGGSLGALTVVSGSLNEYRWDGRALRRRRLDAGDQAGFPLGWVHDVVWAPRPVSGPVSRRAVAAAQAAPTLSVHAYSPPLTAMSYYDITERKTLRRQRTELTDQPEGS

SEQ ID NO: 2385 - protein, 146 aa, Mycobacterium paratuberculosis
VMSRIDVVLRSARRRFRRLPAVEVPDAVRRGAVLVDIRPQAQRVREGEVPGALVIERNVLEWRCDPTSEARLPEAVGDDVEWVIICSEGYTSSLAAAALLDIGLHRATDVIGGYHALAGAGVLSRLAGGPVGAPLANTGAGERRWI

SEQ ID NO: 2386 - protein, 594 aa, Mycobacterium paratuberculosis
MSEPGSATDTDTGDEPAQQQTAPDGTRTGAQTAVAEHPAPKAPAPGTQQPEKPWWVRHYTFTGTTVGLVFIWFSLTPSLLPRGAIFQGLVSGISGAIGYGLGVFAVWLYRYLWAKPSSPPPPRWAWKILIPVGAVGMVLMAIWFHVWQDKVRDLMGVAHLKWYDYPVAGVLSLVVLFTCVEIGQFTRWLVSFLVGRLDRIAPFRLSATIVVALLVVLTITLLNGVVLKFAMRTMNNTFASANNEMSPDTAPPKTPLRSGGPESLVSWESLGHQGRVFIEGGPRVEQLTAFNGAPATEPIRAYAGLNSADGITATAELATRELQRTGGLRRAVVAVATTTGTGWINEAEATALEYMYNGNTAIVSMQYSFLPSWLSFLVDKENARHAGQALFEAVDRLVRQLPEAQRPKLVVFGESLGSFGGEAPFMSLNNVLARTDGALFSGPTFNNTIWTDLTSTRDAGSPEWLPIYNDGRNVRFVARAANLARPKDPWDHPRVVYLQHASDPIAWWTTDLLFARPDWLKERRGYDVLPETTWIPVVTFLQVSADMAVAQNVPDGHGHHYVADVADAWASVLSPPGWTPDKTDRLRPLLHANG

SEQ ID NO: 2387 - protein, 263 aa, Mycobacterium paratuberculosis
MTDSTDRTFETILVEREERVGIITLNRPKALNALNTQVMNEVTAAATDFDADPGIGAIIITGSAKAFAAGADIKEMAELTFADAYGADFFAPWGKLAAVRTPTIAAVAGHALGGGCELAMMCDVLIAADTAKFGQPEIKLGVLPGMGGSQRLTRAIGKAKAMDLILTGRTIDAAEAERSGLVSRVVPADDLLTEAKKVATTISQMSRSAARMAKEAVNRAFETTLAEGLLYERRLFHSTFATADQTEGMAAFVEKRAPNFTHR

SEQ ID NO: 2388 - protein, 350 aa, Mycobacterium paratuberculosis
MGGEGVTDGSDEVLTEVDGNVGLITLNRPKAINSLNQPMIDALSAVLTDWARDDKVRAVLLSGAGERGLCAGGDVVSIYHSARKDGVEARRFWRDEYQLNAQISEFAKPYVAVMDGIVMGGGVGVSAHANTRVVTDTSKVAMPEVGIGFIPDVGGVYLLSRAPGGLGLHAALTGAPFSGADAIAMGFADHYVPHADVEAFRRAVVADGVESALAKYAVEPPPGELAAQRDWIDECYAGQTVEDIVAALRAHGASPAHDAADLIATRSPIALSVTLAAVRRAADLPTLKDVLVQDYRVSSASLRSHDLVEGIRAQLIDKDRNPQWSPARLADVTAADVEAYFAPVDDDLSF

SEQ ID NO: 2389 - protein, 283 aa, Mycobacterium paratuberculosis
VRETSNPVFRSLPKQSGGYAQFGTGAAPMQGYQADPYAAPYATPYQETRASRPLTIDDVVTKTGITLAVLAASAVVSYFLVLSNVALAMPLTLVGALGGLGLVLVATFGRKQDSPAIVLSYAVLEGLFLGALSFVFANFSVSSANAGVLIGEAVMGTFGVFFGMLVVYKTGAIRVTPKFTRMVVAALFGVLALMLGNFVLAMFGVGGGAGLGLRSGGPLAIIFSLVCIGIAAFSFLIDFDAADQMVRAGAPEKAAWGIALGLTVTLVWLYIEILRLLSYLQND

SEQ ID NO: 2390 - protein, 125 aa, Mycobacterium paratuberculosis
LTPLARIVSTGVSGLSPEIMGLGPIEATKKALARAKMSVSDIDLFEINEAFAVQVLGSARELGIDEDKLNVSGGAIALGHPFGMTGARITTTLLNNLQTHDKTFGLETMCVGGGQGMAMVIERLS

SEQ ID NO: 2391 - protein, 280 aa, Mycobacterium paratuberculosis
MPEAVIVSTARSPIGRAMKGSLVSMRPDDLAVQIVRAALDKVPALNPHQIDDLILGCGQPGGESGFNLARVVAVELGFDFLPGTTVNRYCSSSLQTSRMAFHAIKAGEGDAFISAGVETVSRFPKGSADSWPDTKNPLFSEAQERSAAAAEGAEEWHDPRADGKLPDIYIAMGQTAENVALLTGISREDQDHWGVRSQNRAEEAIKSGFFEREITPVTLPDGTTVSTDDGPRPGTTYEKIRELKPVFRPNGTVTAGNACPLNDGAAAVVITSDTKAKSSA

SEQ ID NO: 2392 - protein, 324 aa, Mycobacterium paratuberculosis
VTIRVPRRSAIALATAGALASTGTAYLGARSLLVGQATHARTVIPKSWDIPPRADGVYTRGGGPVQRWHRGMAVDLHLMIFGDSTAAGYGCMCADEVPGVRIARGLAEQTGKRIRLSTKAIVGATSKGVCGQVDAMFVAGPPPDVAVIMVGANDVTALNGVSQSAQRLGLCVRKLRNRGAVVIVGTCPDLGFISAIPQPLRSLAHERCLQLARAQTATVRAAGGVPVPLAQLMAPQFRATPEAMFSADGYHPSAPAYALAADALLLALCEALGEQVERPPLNQPVPSAQPVLGQRHTRSSVMSRLWRRPAPGAAPSSCPEVGSD

SEQ ID NO: 2393 - protein, 357 aa, Mycobacterium paratuberculosis
VLSMTAPSEVSGPQSPVRVHDVLKARRARIRKFAISDGAPVEVLESGPSVAARLANLTSRLTIRPILAVGSHAPNLPWPWGLIDLTARVLLPVSATVRETVALPHASAQLVRAPGVLPADGTRRVVVYLHGGAFLTCGANSHGRLVEALSTFADAPVLVVNYRLLPKNSVGMALQDCHDAYQWLRLRGYQPDQIVLAGDSAGGYLALTLAQRLQREGEEPAALVMISPLLQLAKEPKQAHPNIDTDAMFGAGAFDALAELVAGAAAKNIVDGKPEEIYEPLEHIEPGLPRTLTHVSGSEVLLHDARLAASRLAAAGVPAEVRVWPGQIHDFQLAAPMVPEARRSLRQIGDYIREATG

SEQ ID NO: 2394 - protein, 468 aa, Mycobacterium paratuberculosis
MRIAQHISDLIGGTPLVRLNSVVPDGAGIVAAKVEYLNPGGSSKDRIAVRMIDAAEASGALKPGGTIVEPTSGNTGVGLALVAQQRGYKCVFVCPDKVGEDKRNVLMAYGAEVVVCPTAVPPEHPDSYYSVSDRLVTEIEGAWKPDQYANPEGPASHYATTGPEIWADTDGKVTHFVAGIGTGGTITGAGRYLKEVSGGRVRVIGADPEGSVYSGGTGRPYLVEGVGEDFWPQAYDRTVPDEIIAVSDSDSFNMTRRLAREEAMLVGGSCGMAVVAALRVAEQAGPDALVVVLLPDGGRGYMAKIFNDAWMSSYGFLRTRLDGSTDQSRVGDVLRRKSGELPDLVHTHPSETVRDAIGILREYGVSQMPVVGAEPPVMAGEVAGSVSERELLSAVFEGRAKLADAVSLHMSPPLPMIGAGESVSAAGKALRDWDALMVVEEGKPVGVITRYDLLGFLSEGPRGSGGRR

SEQ ID NO: 2395 - protein, 241 aa, Mycobacterium paratuberculosis
LPMTDQPPPGGAYPPPPSSPGSPGGQPTPHPGGQQPPPPPGGSYPPPPPPGGSYPPPPPPSGGYAPPPPGPAIRTLPTQDYTPWLTRALAFVIDILPYVVVHGIGTAILVATQQTACITDVTQYAVNQYCATQNSTLGLVAQWLASIVGLFYLIWNYGYRQGTTGSSVGKSVMKFKVVSEVTGQPVGFGMSVVRALAHFVDAIICFIGFLFPLWDSKRQTLADKIMTTVCLPLDGSESPPS

SEQ ID NO: 2396 - protein, 388 aa, Mycobacterium paratuberculosis
MSDDGNAHPEFSGLATKAIHAGYRPDPATGAVNTPIYASSTFAQDGVGALRGGYEYARTGNPTRAALEATLAAVEAGSHGRAFASGMAATDCALRAVLRPGDHVVIPNDAYGGTFRLIDKVFTRWNVEYTPVPLHQLDAVAAAITPRTRLIWVETPTNPLLSIADIAALAQLGHQHSAKVLVDNTFASPALQQPLTLGADIVLHSTTKYIGGHSDVVGGALVTNDAELDDAFGFLQNGAGAVPGPFDAYLTMRGLKTLVLRMQRHTENASAVAQFLAGHPAVSAVLYPGLPGHPGHDVAARQMSGFGGMVSVRMRGGRQAARKLCANTRVFILAESLGGVESLIEHPSAMTHASTAGSQLEVPDDLVRLSVGIEDVDDLLADLDRALS

SEQ ID NO: 2397 - protein, 164 aa, Mycobacterium paratuberculosis
MTDTSVTWLTQESHDRLKAELDQLIANRPVIAAEINDRREEGDLRENGGYHAAREEQGQQEARIRQLQDLLNNAKVGEAPKQSGVALPGSVVKVYYNGDKSDTETFLIATRQEGVNDGKLEVYSPNSPLGGALIDAKVGETRSYTVPNGSTVEVTLVSAEPYHS

SEQ ID NO: 2398 - protein, 141 aa, Mycobacterium paratuberculosis
MTETRPSERYGRSPLSRIPRRWVIAALGVLVVAAGLAVAVVGYHRFGTSDVKATMVGYRVLDDQTASITISVTRSDPSRPVDCIVRVRSHDGGETGRRELLVLPSGAATVEVTTTVKSFQPPVVADVYGCGTDVPGYLRPS

SEQ ID NO: 2399 - protein, 290 aa, Mycobacterium paratuberculosis
VSELRLMAVHAHPDDESSKGAATLARYADEGHRVLVVTLTGGERGDILNPAMDLPEVHGHIAEIRRDEMAKAAEILGVEHTWLGFVDSGLPKGDPPPPLPEGCFALVPLEEAIEALVRVVREFRPHVMTTYDETGGYPHPDHIRCHQVSVGAYEAAGDYRRFPDAGEPWTVSKLYYNHGFLRARMQLLHDEAVKHGHEPPFKKWLEHWDPAHDPFESRVTTRVECSAYFSQRDDALRAHTTQIDPDHDFFAAPIAWQQRLWPTEEFELARSRVPVRLPEDDLFAGIEPDA

SEQ ID NO: 2400 - protein, 106 aa, Mycobacterium paratuberculosis
VNHLLVLSGAVADGAPHHTGPDFGKASPVGLLIVVLLLISTLFLLRSMNRQLRKVPESFDPQHPEPDQAADEGTDAVDAEDAPDADPGPDHANGSPRPPGSDDEPG

SEQ ID NO: 2401 - protein, 671 aa, Mycobacterium paratuberculosis
MSPADPSATNTLGRATSPYLRQHADNPVHWQQWTPQALADAAARDVPILLSVGYAACHWCHVMAHESFEDPDVAAAMNSGFVCVKVDREERPDIDAVYMNATVALTGHGGWPMTCFLTPDGRPFFCGTYYPKDAFLQLLSAVSATWRERRGEVEEASDRIAGELRKMTSGLPAGGADLATALCDEAVAAILADRDTVHGGFGGAPKFPPSALLEALLRSYERTGSAAVLQAVAHTGAAMARGGIYDQLGGGFARYSVDNAWVVPHFEKMLYDNALLLRLYAHWARRTCDPLAARVTAETARFLLDDLADGDMFTSSLDADADGREGSTYVWTPAQLTEVLGPDDGRWAAAVFGVTETGTFEHGSSVLRLPADPPDTPRFDRVRAALLAARRGRIQPGRDDKVVTSWNGLAITAFTEASVALDDPGLADAARRCARSVLDLHVVDGRLRRASLGGVVGDSAAILEDHAMLATGLLALYQLSAEDSWLTAATDLLDTALAHFADPQRPGRWFDTADDAERLMLRPADPLDGATPSGASSVTEALLTAAHLVGGERAERYLRAATDALRAHAVLLERAPRTAGHWLAVAEAAVRGPLQIAVACDPARSALLADARRLAPGGAIVVGGPRDSSELLAGRDRVAGADAAYVCRGRVCDLPVTRTPELAAALGAPSP

SEQ ID NO: 2402 - protein, 127 aa, Mycobacterium paratuberculosis
MPNDAKTDAIRNTVHRYIELVAKGGADDLVELYADDATVEDPVGGEVHIGRQAIHGFYSALDNLQRECELLTLRVAGNEAAFHFRLTVTAGEHRMVIEPIDVMVFDGNGKVAAMKAYWSPDDDVSRP

SEQ ID NO: 2403 - protein, 257 aa, Mycobacterium paratuberculosis
MSSQTSTAPNPEPDHEAIVPGNTVEQLFEGAAQVLGKPRMRGWIHFYSAWLAVITGATLVSVSWAAASPRAGHSTLIYAAATVALFAVSATYHRVKWKTEAARTRMKRLDHSMIFVFIAGSYTPFARLVMPQNTGVVVLCIVWGGALAGIALKVCWPTAPRWLGVPLYLLLGWVAIWYAPTILHQAGVAAMVLLAVGGVLYSVGGIFYALRWPDPWPSTFGYHEFFHALTAIAAILHYIAMWFAVFYTGDHAWLATP

SEQ ID NO: 2404 - protein, 264 aa, Mycobacterium paratuberculosis
VFVEIIPPRLKEPLYRIYEMRLRQELGAAKADLPRHIAVLCDGNRRWARDAGYDDVSYGYRMGAVKIAEMLRWCQAAGIEMTTVYLLSTENLQRDPDELAGLIEIITDVVEEICAPANRWSVRTVGDLELLGEEPARRLRGAVESTPVEASFHVNVAVGYGGRREIVDAVRSLLSKELANGATAEELIDAVTVDAISENLYTSGQPDPDLVIRTSGEQRLSGFLLWQSAYSEMWFTEAHWPAFRRVDFLRALRDYSQRHRRYGK

SEQ ID NO: 2405 - protein, 456 aa, Mycobacterium paratuberculosis
MAALSAVVFTLSAWLGLYLAARDPRKPVLVLAAIGLCGFALVVGLDAVRTASPAHAPLLSRVEIYLTAVPGVAWFAVLVELSRPPDGWRSRTREVLLVAGVAALTLLGAALAGSVDGPLRPGHWLMMAAISVSTLGAMAVALRRPRRPRPAVGLAVTATLFFALANAILIIPLGLVPSWLALASTSCDVLGLGVAVALWDAFDEGHALRADMLRSFAGSVAVAVLFGGQALIGLAVTRADPGARTALTVLLFTSLAIAITVQVLADPLAGLLDRLAFSKSPALRADRAALRHTGAALPLRQEHPLDGVDDVTFARLTRRALGHYGDLTKLVASPLTALPVIDERLAARGAPDQPIERATELKAVLADAIARLKPRDGGDFGTTEEWRHYNSLYFPYVVGVRAYAQNATASGLDPTARQAWQWFVTEVPQRSLHNWQNAAARLIAADLRGRVPVPSE

SEQ ID NO: 2406 - protein, 141 aa, Mycobacterium paratuberculosis
MSTVSGVSGVTVRPLYDSTDSLLRFAVRADATLTGLCGLAVAVAADPLSSLTGLTSFQEYIGGAFFVLYGLVVFSLGALPDLRRAGISIVAANAVFTLAAIVAAGVLPLTGAGVALTLASAAYTAAFAAVQYAGVRRLETA

SEQ ID NO: 2407 - protein, 312 aa, Mycobacterium paratuberculosis
MPRLSEPSPYVEFDRKQWRALRMSTPLALTEEELVGLRGLGEQIDLLEVEEVYLPLARLIHLQVAARQRLFAATAEFLGEPQQNPDRPVPFVIGVAGSVAVGKSTTARVLQALLARWDHHPRVDLVTTDGFLYPNAELDRRNLMHRKGFPESYNRRALMRFVTSVKSGSDYACAPVYSHLKYDIIPGAKHVVRHPDILILEGLNVLQTGPTLMVSDLFDFGIYVDARIEDIEQWYISRFLAMRSTAFADPESHFHHYAALNDTKAVAAAREIWRSINRPNLVENILPTRPRATLVLRKDADHSINRLRLRKL

SEQ ID NO: 2408 - protein, 426 aa, Mycobacterium paratuberculosis
MSAPLADIDPDIAGLLGQELGRQRDTLEMIASENFVPRAVLQAQGSVLTNKYAEGLPGRRYYGGCEYVDVVENIARDRAKALFDADFANVQPHSGAQANAAVLHALMTPGERLLGLDLANGGHLTHGMKLNFSGKLYDVGFYGVDPTTHLIDMDAVRAKALEFRPKVIIAGWSAYPRVLDFAAFASIADEVGAKLWVDMAHFAGLVAAGLHPSPVPHADVVSTTVHKTLGGPRSGLILGKQEYAKSINSAVFPGQQGGPLMHVIAAKAVALKIAGTEEFADRQRRTLSGARILAERLSGADVAAAGVSVVSGGTDVHLVLVDLRNSELDGQAAEDLLHEIGITVNRNAVPNDPRPPMVTSGLRVGTPALATRGFGGAEFSEVADVIATALAGGRGADLAALRDRVTRLARDFPLYEGLEDWALVGR

SEQ ID NO: 2409 - protein, 275 aa, Mycobacterium paratuberculosis
MAERPVANALTLELEPVVEANMDRHLSTEELWFAHDYVPYDRGENFAFLGGRDWDPSSATLPRPLTDACEIMLLLKDNLAAHHRELVEHFILEDYWGRWLGRWTAEEHLHAIALRNYLVVTREVDPTANEEARVQYVMKGYRADTYSQVETLVYMAFTERSHAVFCENLSAKLEEPILSGLVDRISRDERRHELFFSNLVAHCLEYTRDETIAAIAARAAELQVPGADIDAYQDKLRNVAEAGVFTENDLRQVISDRIRAWGVADEPALKPFVIG

SEQ ID NO: 2410 - protein, 433 aa, Mycobacterium paratuberculosis
VTDIRTYVIDTSVLLSDPWACSRFAEHEVVVPLVVISELEAKRHHHELGWFARQALRLFDDLRLLHGRLDQPIPVGTQGGSLHVELNHTDPAVLPAGFRSDSNDSRILSCAANLAAEGKRVTLVSKDIPLRVKAAAVGLAADEYHAQDVVASGWSAMHELETAAEDIDALFTEGEIDLAEARDLPCHTGIRLLGGSSHALGRVNPDKRVQLVRGDREAFGLRGRSAEQRVALDLLLDESVGIVSLGGKAGTGKSALALCAGLEAVLERRTQRKVVVFRPLYAVGGQELGYLPGSESEKMGPWAQAVFDTLEGLASPAVLDEVLSRGMLEVLPLTHIRGRSLHDSFVIVDEAQSLERNVLLTVLSRLGTGSRVVLTHDIAQRDNLRVGRHDGVAAVIEKLKGHPLFAHITLLRSERSPIAALVTEMLEEIAGPH

SEQ ID NO: 2411 - protein, 291 aa, Mycobacterium paratuberculosis
VAKRPDTLAWRYWRTVVGVLAAVAVLVIGGLTGHVTRADDLSCSVVKCVALTFDDGPGPFDERLLQILKDNDAKATFFLIGNKVAANPAGAKRIADAGMEIGNHTWEHPNMTTIPTEDIAAQFTKANDAIHAATGRTPNLYRPAGGLSNPVVRQTAGQLGLAEILWDVIPFDWANDSNTAATRYMLMTYIKPGSVVLFHNTYSSTVDLVYQFIPVLKANGYRLVTVGELLGPRAPGSSYGSRENGPPVNGLRDIPASDIPKLPDTPSPKPMPNFPITDIPGQNSGGPNNGA

SEQ ID NO: 2412 - protein, 501 aa, Mycobacterium paratuberculosis
VPSTRAAAEERKSARRWLFRYGLDMSLSYVLAVGEAAAILIPLRGHTSVGVNADFARQNTGPVLALIALGIIGVAVAGALSLAPTLRWYVAGEEPTPQQRDAVMKLAGRQSAILVTAWAVSGGIFLLLNVAGGARLLLPIALGALLGGSAAAGTGMLLAQRTLRPIMRAATLGAEPRLAVPSVYARLVLLWFLCSAFPIAVIAALVVLRSYGWLVEKSASLDVPILVVSLAALVLGLPTMILTSRSISDPIGEVVDAMAEIEHGRMETYVGAYERSQIGRLQTGFNRMVAGLAERDRLRDLFGRHVGADVAQRAIEEGASLSGDVVEAAVLFIDLVGSTQLAESRPPQEVAEVLNDFFRIVVNAVDEHHGLVNKFAGDAALAVFGVPLPTNQPASAALATARTLGTQLRQLPVDFGIGVSAGRVFAGNVGAENRYEYTVIGDAVNEAARLADLAKTADRRILCSAAAIEAAGEAERGHWAECYSTVLRGRSETTHVSAPTG

SEQ ID NO: 2413 - protein, 351 aa, Mycobacterium paratuberculosis
VTAVDDSKDGFSMTAPPGGIYGPGSYGSNPYGQEPNWGGQPPGGQPPGGQPQGGPYPQPGQYPAGGPYPYPPPGGGYPYPGGPYPGGPYPGAPYPGPGQPFGPGGPYSPGPPPGGPGSKLPWLIVAGLVVLAVIALVATLVVMKGGHGSKPSGATPSSTSTSVSQPKNSAQNATDCTPNVSGGDMPRSDSIAAGKLSFPANAAPSGWTVFSDDQGPNLIGALGVAQDVPGANQWMMTAEVGVTNFVPSMDLTAQATKLMQCLANGPGYANAMPTLGPIKTSPITVDGTKAVRADADVTIADPTRNVKGDSVTIIAVDTKPVSVFIGSTPIGDSASAGLIGKIIAALKVAKS

SEQ ID NO: 2414 - protein, 470 aa, Mycobacterium paratuberculosis
MATDDGDTDYRIERDTMGEVRVPAKALWRAQTQRAVENFPISGRGLERTQIRALGLLKGACAQVNKDLGLLAPEKADAIIAAAAEIADGRHDDQFPIDVFQTGSGTSSNMNTNEVIASIAAANGVTVHPNDDVNMSQSSNDTFPTATHIAATEAAVRHLIPALQVLHDALASKAREWHTVVKSGRTHLMDAVPVTLGQEFSGYARQIEAGIERVRATLPRLGELAIGGTAVGTGLNAPDGFGAKVVETLIASTGLSELRTATNSFEAQAARDGLVEASGALRTIAVSLTKIANDIRWMGSGPLTGLAEIALPDLQPGSSIMPGKVNPVIPEAVTQVAAQVIGNDAAVAVGGLSGAFELNVYIPMMARNILESFKLLTNVSRLFAERCISGLSANVEHLRELAESSPSIVTPLNSAIGYEEAAAVAKQALKERKTIRQTVIDRGLIGDKLSLEELDRRLDVLAMAKVKPQD

SEQ ID NO: 2415 - protein, 359 aa, Mycobacterium paratuberculosis
MTVEGDRSSAATGRAPAQGRPRGEAPDRNLALELVRVTEAGAMAAGRWVGRGDKEGGDGAAVDAMRELVNTVSMRGVVVIGEGEKDHAPMLYNGEEVGNGDGPECDFAVDPIDGTTLMSKGMPNAISVLAVADRGAMFDPSAVFYMNKIAVGPEAAHVLDITAPIAENIKAVAKVKALSVRDMTVCILDRPRHAKLIDEVRETGARIRLITDGDVAGAISACRPHSGTDMLAGIGGTPEGIIAAAAIRCMGGAIQAQLAPRDDEERQKAIDAGYDLDQILTTEDLVSGENVFFCATGVTNGDLLKGVQYYPGGCTTQSIVMRSKSGTVRMIEAYHRLSKLNEYSAIDFTGDSSAAYPLP

SEQ ID NO: 2416 - protein, 247 aa, Mycobacterium paratuberculosis
MVADCPRSGSVRENWDTWRMTEQPSLNASSPGESAAAAGPVPRPEKPRLLQDGRDMFWSLIPLVIGCVVLAGLLGMCSLQLHNRPGPIPPYDAAAALRADAATLGFPVRQPALPAGWQANSGHRGGIQNGRTDPSTGQRLNAPTSVVGYISPTGMYLSLTQSNADEDKLINSIHPSAYPTGTVDVAGTSWVIYQGSGQSGADAEPVWTTRLTGAGGATQIAITGAGSAEQFRTLASATQSQPPLPVR

SEQ ID NO: 2417 - protein, 267 aa, Mycobacterium paratuberculosis
MTAPEADLSGWSVAPFSGGGYTHDVYRKGVGPGVVLIPELPGIHPGVLALGNHLVDNGFTVAMPSLFGEPGKPVSPGYLVAGMTRACVAREFAAFATNKQRPVSLFLRALARDLNASTPGDGVGVIGQCFTGGFALAAAVDESVLAPALSQPSVPFPLGATRRRDPGVSEAELATVADRCANEGLCAMGLRFSEDWTSPRERFTALKQRLGDAFEVIEIDSRPGNEHGFGKTAHSVLTLEVREVDGHPAYEARKRVVEFLTQRLGAR

SEQ ID NO: 2418 - protein, 514 aa, Mycobacterium paratuberculosis
MAVDDLVVETGYGPVRGVAADGVKAWKGIRYAAPPIGDLRFRAPQPPERWTEVADATVFGPACPQPVFPNMPLDLGAPQGEDCLRLNVWASADTQPGDAKPVMVWLHGGAYVLGSSSQTLYDGRRLVSHGDVVVVTVNYRLGALGFLDLSSLNSAGRSFDSNVGLRDVLAALKWVRDNITAFGGDPRRVTLFGESAGAGIVTTLLASPAAAGLFAAAIAQSSPATSVYDRDRAGRVAEAFLGKLGITASESRRLIDMPMAAILAASQQVFDEVPVRNPGTLAFVPIVDGDVLADYPVKVAQQGGSHPVPLIIGTNQHEAALFRLMRSALMPITPHAITSMFNQIAAEQPDLQLPTEKQIGSAYSRFRRRARYLSIATDVGFRMPSVWLAEGHARVAPVYLYRFDYSTPLLRLLMVKAAHATELPYVWGTLGAPKDPTLKLGGSKTAKAVSKRVRTRWINFAAHAKPAGPAGSPEWAPYQEQDRACLIIGKNDVLAHDVDAKARAAWGSEMVSFR

SEQ ID NO: 2419 - protein, 366 aa, Mycobacterium paratuberculosis
MIGPMGDPSLTAELGRVLVTGGSGFVGANLVTTLLERGYQVRSFDRAPSPLPAHPHLEVLQGDITDAGVCAAVVEGIDTIFHTAAIIDLMGGASVTEEYRQRSFAVNVGGTENLVRAGQAAGVQRFVYTSSNSVVMGGQNIVGGDETLPYTDRFNDLYTETKVLAERFVLGQNGVDGMLTCAIRPSGIWGRGDQTMFRKLFESVIAGHVKVLIGRKSARLDNSYVHNLIHGFILADQHLTPGGTAPGQAYFINDAEPINMFEFARPVVEACGVNWPRVRVNGPIVRAAMTGWQRLHFRFGIPAPLLEPLAVERLYLDNFFSIAKASRDLGYQPLFTTEQAMSECLPYYVGMFEQMKRQALAGKASA

SEQ ID NO: 2420 - protein, 82 aa, Mycobacterium paratuberculosis
MANNKKDEQAAAATPISRLGYEACRDELIEVVRQLEQGGLDLDASLNLWERGEQLAKRCEEHLAGARKRIEDALAAGEADDD

SEQ ID NO: 2421 - protein, 415 aa, Mycobacterium paratuberculosis
VTRAATSEPNSAENPFPVRAVAIRVAGWIDRLGTVWVEGQLAQVSLRPDSKTVFMVLRDPAADMSLTVTCPRDLVLNAPVKLAEGTQVVVCGKPSFYTGRGTFSLRLSEIRAVGVGELLARIERLRRLLDAEGLFDPRLKRPIPFLPNMIGLITGRASAAERDVKTVAAGRWPAVRFAVRNTAVQGPNAVAQIVEALRELDRDPEVDVIVLARGGGSVEDLLPFSDETLCRAIAACRTPVISAVGHEPDNPLCDLVADVRAATPTDAAKKVVPDTAAEQRLIDDLRRRSAQALRNWVSREQRALAQIRSRPVLAEPLRALTARAEEVHRARSAIRHDVTRLTAAETERIGHLRARLATLGPAATLARGYAVVQTVGAGGPHVLRSVGDAPAGTRLRVRVADGAVAALSEGPTDGE

SEQ ID NO: 2422 - protein, 198 aa, Mycobacterium paratuberculosis
MATAPYGVRLLVGAATVAVEETMRLPKTILMYPMTLASQAAHIVMRFQQNLAELVIKGDSTLESIFPPKDEKPEWATFDEDIDDAADGYANPADGSEGERRAEGRFALYSVADAHDDASALTRSARPSAKPAAEASVPTPAVVTELDYSALTLAQLRARLQSLSVDELEALLAYEQATKGRAPFQTLLANRITRATAK

SEQ ID NO: 2423 - protein, 332 aa, Mycobacterium paratuberculosis
MPPTVDMGIPGASSSVAVNPTRKRVLLAEPRGYCAGVDRAVETVERALEKHGPPVYVRHEIVHNRHVVSTLEKAGAVFVEETDEVPEGAIVVFSAHGVAPTVHAAAAERNLHTIDATCPLVTKVHNEARRFARNDYDILLIGHEGHEEVVGTAGEAPDHVQLVDGVAAVDNVRVRDEDKVVWLSQTTLSVDETMEIVERLRQRFPKLQDPPSDDICYATQNRQVAVKAMAPECDLVIVVGSRNSSNSVRLVEVALGGGAGAAHLVDWADDIDPAWLEGVTTVGVTSGASVPEVLVQGVLERLAECGFDVVQPVTTAQETLVFALPREIRSAR

SEQ ID NO: 2424 - protein, 402 aa, Mycobacterium paratuberculosis
VSAQRASSTVESAHHSIHPNIPGLPWYAAVLVAVTATAIGYGIDAGHKELTHVFAGFYIAGCVAAVLAVRQDGIFTTIIQPPLILFCAVPGAYWLFHDAKVGRLKDLLINCGYPLIERFPLMLGTAGAVLAIGLVRWYFGHGQRSTTAAGSDDAAAGPSVDVQSLVGGLVAKVRAALHPDSDGDTTEESAQRRRTRRSGSSSRTRRTARSTRSSASSSRTRSRHARPPLDDAAEPAERPERQRRATRRSAASARNYDTAGRNYDAAEPPRRTRRRPRPDADPELRGQTPREPRREPRPRRSPYERPVPRSSRFDGYDPPSGPENLGRYDSRYDTPEPPYEPRRRRPASTGANGTHHPISQVRYRGAAAPGQPREPHTERRTRSRTPGRTQGRPPTESWEYDA

SEQ ID NO: 2425 - protein, 357 aa, Mycobacterium paratuberculosis
VSLSLGIVGLPNVGKSTLFNALTRNNVVAANYPFATIEPNEGVVPLPDPRLDKLAEMFKSERIVAAPVTFVDIAGLVKGASEGAGLGNKFLAHIRECDAICQVVRVFADDDVTHVAGQVDPRSDIEVVETELILADLQTLERAVGRLEKEARTSKERRPVYEAALAAQETLNGGKTLFSAGTDTSLLRELNLLTTKPFLYVFNADESVLTDPARIAELRELVAPADAVFLDAAIESELIELDDESAAELLESIGQTERGLDALARAGFHTLRLQTFLTAGPKEARAWVIHQGDTAPKAAGVIHSDFEKGFIKAEIVSYDDLIAAGSMAVAKAAGKVRMEGKDYVMADGDVVEFRFNV

SEQ ID NO: 2426 - protein, 314 aa, Mycobacterium paratuberculosis
MEAFVTIVLIGLAAIVLYRVILYILKERYFASEEFLAHKKKIASVVAEHNEVADYVSEIRSGGSFRLGASSAGAQAHLASFQNTSHWNYRRDRNVANYEAPDVHNCSLQVVRNAKADPLKYVMKYFGIKADEAHLAEVENLGDSITRLEDAVNNLAQREASITKSFNPPAFILKHYFGEFMKHVGVELSPIRVPYPVYVFEYVSAGGNSSQRTTVTLDTPAIDALIETLSQKIRWRKSAAGQRALMTSRLRNSIKVRDHYTCRYCSVSLAAEPHLLLEVDHIVPISKGGMSTPDNLQTLCWRCNRTKSNKVATA

SEQ ID NO: 2427 - protein, 123 aa, Mycobacterium paratuberculosis
MILVDTSVWIDHLHVADKRLIEFLTNDAIGCHQMVIEELALGAIRRRADLLRLLSNLRAFPLLTHAEVLHLVECHRLWGRGLSAIDVHLLGSVALVDGARLWTRDKNLKAAGWDVGIAIVDEL

SEQ ID NO: 2428 - protein, 146 aa, Mycobacterium paratuberculosis
MSFVEEKLLPQVLRVHDTVYRKTNGWIGHRTLWIPSLLLHTVGAKTGKPRTTSLTYARDGENYLVVASKGGAPEAPGWYPNLKAKPEAEINVGPKRFAVTARIVPPGDADYARLWEIVNKNNQNRYAEYQKRTSRPIPVVVLTPKS

SEQ ID NO: 2429 - protein, 91 aa, Mycobacterium paratuberculosis
MAPFIAAAVEISDPQHPARVRAREYKTSVAARLSETAREAGAADPELLAEQLALLLDGASVRTRALGTDAFRTAAGIAAALVERAIPPTAR

SEQ ID NO: 2430 - protein, 132 aa, Mycobacterium paratuberculosis
MKFVSTRIITADVQRLVGFYEMVTRVSAVWANELFAEIPTPAATLAIGSDQTVPLFGAGSAEPAANRSAIVEFIVDDVDAEYERLREQLTEVVTEPTTMPWGNRALLFRDPDGNLVNLFTPVTPEARAKFKV

SEQ ID NO: 2431 - protein, 117 aa, Mycobacterium paratuberculosis
VAAEHWAEPPEESERRSDALDQREKALARREADVRRREWLAGRRDRVADQREQIADERERLADEREQLADEREGTVAERERARLRRIDERVKRTRARANREQAEVDREIAESERDDA

SEQ ID NO: 2432 - protein, 167 aa, Mycobacterium paratuberculosis
MSLINQVSGTPYISGGDSPAGTDCSGLASWIANAATDRPVFGDRFNTGNEEAALLARGFQYGTAPNALVIGWNGGHTAVTLPDGTAVSSGEHGGVHVGGAGAYQAGFTHHMFLPMPPEDGGAPPPPDAPPPPPDAPAPPPDAPPAPPEAPAVLIDAPAPVPPPPPGP

SEQ ID NO: 2433 - protein, 81 aa, Mycobacterium paratuberculosis
LPPRAEEGNLWFEWSRSLDDPAEYVLVEAFRDGDAGSAHVNSDHFKRAMQELPQALKSTPKIISQTVEATGWSRMGEMTVD

SEQ ID NO: 2434 - protein, 309 aa, Mycobacterium paratuberculosis
MQTIPDLVGGVGPAFPLVADHQHAAGDDAGRTGQPEPLPHAAHATRLGVVVIDWIPAWPYPREAGRGGGDVGENCSGRRAYTMLTLNQALEETRTGDLWLFRGGSGPDRAIQTLTNSPVNHVGMTVAIDDLPPLIWHAELGDKLVDLWTGTNHRGVQLNDLHQSVLQWTQRYRQRCWLRQLTPPATREQENRLLRVIARMDGTAFPTTMRLTGRWLRGRLPTAYDWARGIPVVDKKIRETMRRRKERQRLGLEAAYCAETVAITYEEMGLLTTEKYSNWFDPGSFWSGDKLPLTPGYALGDEIEIAVDR

SEQ ID NO: 2435 - protein, 223 aa, Mycobacterium paratuberculosis
LLAGGREAVKTVWNTANLVRKEGFGAAVRSSIEELADWAEVERPDLARVTPDGRVVILFTDIEESTALNERIGDRAWVKLISSHDKLVSDLVRRQSGHVVKSQGDGFMVAFARPEQAVRCGIELQRALRRNANRKRHEEIRVRIGIHMGRSVRRGDDLFGRNVAMAARVAAQAAGGEILVSQPVRDALSRSDGIRFDDGREVELKGFSGTYRLFAVLASPDPD

SEQ ID NO: 2436 - protein, 469 aa, Mycobacterium paratuberculosis
LADDDSHPSDLLVIFGITGDLARKMTFRALYRLERREELEHPIIGVASDDITLDQLLDRAREAIKATGETFDDAVFDRLAGRLSYLSGDVTDAGLYSELAKKIGGDSRPLYYLEMPPSLFAPIVENLAKADLLERARVAVEKPFGHDLESARDLNARLRAVLDEDQILRVDHFLGKQPVEELQYLRFANNALAKLWDRDSISEIHITMAEDFGIEDRGKFYDAVGAVRDVVQNHLLQVLALVAMEPPVGAGADDLNDKKAEVFRAMPSLDPEHCVRGQYRGYTEVPGVAKDSTTETYVALRAEIDNWRWAGVPIFLRAGKALPHKVTEVRMFLHHVPGFSFLPNRRPPEPNQIVLRIDPDPGMRLQLSAQVGDSWHDVHLDSSFAVDLGEPVRPYERLLYAAFNGDRQLFAREDAIEETWRIVQPVLDKPSRIHQYEQGSWGPEAAQALVHGRHAWQQPWLPQSTSTKR

SEQ ID NO: 2437 - protein, 340 aa, Mycobacterium paratuberculosis
MQLGMIGLGRMGANIVRRVVKGGHECVVYDHNPDAVKAMAGEEKTTGVSSLQELAAKLSAPRVVWVMVPAGTITTGVIEELATTLEPGDIVIDGGNSYYRDDIRHSKTLSEKGIRLLDCGTSGGVWGRERGYCLMIGGDEEAFAHAEPIFATVAPGVDAAPRTPGRDGEVTRSEQGYLHCGPSGAGHFVKMVHNGIEYGMMASLAEGLNVLRNADIGKHAQEGDAETAPLSNPEFYQYDFDIPEVAEVWRRGSVIGSWLLDLTAIALHESPELKEFSGRVSDSGEGRWTSIAAIDEGVPTPVLTTALQSRFASRHLDDFANKTLSAMRKQFGGHAEKPAN

SEQ ID NO: 2438 - protein, 309 aa, Mycobacterium paratuberculosis
VETHRVVGPRKSAYATYVTSEPMSTVSSSPETVEFAGVDGITLVADEWNRGSDGAGRPSILMLHGGGQNRFSWKNTGQTLADEGLHVVALDSRGHGDSDRSPQADYQIETLTADVLRVLDAIGRPVTIIGASMGGLTGILAAHRAGPAKVTRLVLVDVVPRFEKDGSARIRDFMISGLDGFDSLEQAADAVAAYLPYRSKPRSPEGLKKNLRLRDGRWYWHWDPAFMTKPGDDPELRTESFEQAAKNLSIPVLLIRGKLSDVVSPEGVRHFLATVPRAEFVELSNAGHTAAGDDNDAFSDAVVAFVKRR

SEQ ID NO: 2439 - protein, 157 aa, Mycobacterium paratuberculosis
MPSITPSLWFDDNLEEAATFYTSVFPNSHIEGFNRTTEAGPGEPGTVLSGSFVLDGSRFIGINGGPHFRFSEAVSFTVHCKDQDEVDYYWDRLSDGGEESQCGWLKDRFGLSWQIVPDRLFELIGDPDRSRAAAATQAMYGMRKIVIAELERAAASS

SEQ ID NO: 2440 - protein, 284 aa, Mycobacterium paratuberculosis
VKMAEPGWIDVTGPAGDLKALTWGPPDGPLALCLHGFPDTPYGWRKLAARLADAGWRVVAPFMRGYAPSAIPSDGSYHVGALMDDALRVRAAAGGTDNDVVIGHDWGAIAATGLAAMPDSPFAKAVLMSVPPSAAFRRRGGSAAERGRLAAHLARQVFRSWYILYFQLPWLPERSASWVLPLLWRRWSPGYRAEEDLRHVDAAIGAPESWRAALGPYRATIRNTAPPAQYATLHRLWTEEPVLPCLYLHGRDDGCMTSAFAHQVEKVLPPGSEVDIVEHAGHFL

SEQ ID NO: 2441 - protein, 413 aa, Mycobacterium paratuberculosis
MTGHRMAAVDAQFYWMSAKIPNDEFLLYAFDGEPADYPAAADQLRRRADAEPALSIRVRDRGRLRYPHWVPAAVAPEQVVRHELAEHSWDGCLAAVAGLADDQLDLRRMAWRLHVFGPVHGIPGVRGPGTVAVLQVAHALADGARAAALAARLFGRAAPVPEVPVPRPGWLPWRAAVAARTHCQLVRDTRAGRLAPGAGPRPLLPTNARPAGVRSLRTLVRHRAQLPGPTATVAVLGAVAQALSDLLGDQADSLGAEVPMAKPGAPQAYNHFGNVVVDLHPRLGAQARAERIAAGLAAGRRRFEHPATRAADRAFAAVPAALLRWGVDQFDADQRPDQVAGNTVVSSVNRGPADLSFGGARVVLTAGYPALSPVMGLTHGVHGIGDTIAISVHAAASAVPDVDAYLALLDAAL

SEQ ID NO: 2442 - protein, 201 aa, Mycobacterium paratuberculosis
VTELAVLQAIRLKGRVSRADLAATLGTDPDEIAGTVERLSAAGLVTGDATLWITPAGSARLTALLAEERRGIDAAAMAAVYDDFRAINADFKRLVTDWQLKDGAPNRHDDAEYDDAVLARLDDAHARVTPVIEAAAAQLPRLNRYAAKLAAALDKVRAGDTAWLTRPLIDSYHTVWFELHEELIVAVGLTRQEAARSGDAQ

SEQ ID NO: 2443 - protein, 560 aa, Mycobacterium paratuberculosis
LPESAATPRRGCTTARTAPGSGAHRNASRDRDAAPTEQSVVLLDGTSSHPRELLGNKGHGIEVMRRHHLPVPPAFCLTTAVGLRYLADPAATMDAVWDDVLDRIGWLQAQTSRTFGRGPHPLLVSVRSGATQSMPGMMDTLLNLGINDSVEQALAAEHGPAFARDTHRRFREMYRRIVGVERPVPSDPYTQLRAGIEAVFASWNSPRARAYRAHYGFADRHGTAVVVQAMVFGNHGPNSGAGAFFSRNPITGDDEPFGEWLPGGQGDDVVSGSVDVEPIAALRDEQPAVYDQLMAAARTLERLDRDVQEIEFTVEDGALWLLQTRAAERSAQAAVRSALQLRREGLIDDAETLRRVTPAHVRSLLMPALQPEIRLAAPLLAKGLPACPGVVSGTAYADVDEALHAAERGEPVILVRDHTRPEDVSGMLAARGIVTEVGGAASHAAVVSRELGRVAVVGCGAGVAAMLAGRRITVDGAEGEVREGELSLSAWSENDTPELRELAEIARLISPLRAHSGGDHPRLDDDSESAVRAALAAGQTDVVSPTPLLVMLTALRQGAP

SEQ ID NO: 2444 - protein, 169 aa, Mycobacterium paratuberculosis
MTPYDVGLLILRLVLGVTLAAHGYNKFFGGGRIPGTARWFESIGMKPGKFHATVAASTEMAAGLGLAAGLLTPIPAAGFVSLMLVAAWTVHRPNGFFIVKEGWEYNLVLAASAVVVATLGAGRLSLDWLVFGKNWMDGWNGLLISLLLGLAGAIGQLVIFYRPPAKQTG

SEQ ID NO: 2445 - protein, 582 aa, Mycobacterium paratuberculosis
MGFLKPELPQLDMAEWSKGTRSDKIRPMAKHWAEVGFGTPVALHLFYVVKILLYILGGWLFASATRGLGGFTHVASWWSEPIVFEKVVLYTMLFEVIGLGCGFGPLNNRFFPPMGSILYWMRFGTIRLPPWPDRVPFTAGTKRKPVDVALYALFLLLTLAALFADGTGPVPELGTTIGLLPAWKIVLILLVLAVLGLRDKVIFLAARGEVYASMAVTFLFGAPDMIVGSKVVFLVIWMGAATSKLNKHFPFVISTMMSNNPLVRPRWLKRRFFEKFPDDLRPGRLSRWIAHLSTAIEMLVPLPLFFCHGGWPVTVAAVVMVCFHLGILVSIPMGVPLEWNVFMIFGVLSLFVAHTGIGLGDLRHPVVVAVLFVVIAGIVVLGNMFPRKISFLPGMRYYAGNWDTTLWCIKPSASEKISRGIVAIASMPQAQLERFYGSPEAAQIPLYMGYAFRGFNTHGRALFTLAHRAMAGQNEDDYVITDGERICSTAIGWNFGDGHMHNEQLIAALQERCHFEPGEVRVVLLDAQPIHKQTQAYRLVDAATGEFERGIVRVADMVVRQPWDDDVPVQVVSDDAPSVTPE

SEQ ID NO: 2446 - protein, 756 aa, Mycobacterium paratuberculosis
VTPQAFTATVVGSPRIGPKRELKRATEGYWAGRTGRAELEKVAATLRRDTWAGLAAAGLDSVPVNTFSYYDQMLDTAVMLDALPERARQVSDDLDRYFAAARGNSDVAPLEMTKWFDTNYHYIVPEIAPTTKFALNPDKVLSELKEALAQGIPARPVVIGPITFLLLSKGVDGAGAPIERLEELVPIYAELLSLLADNGAQWVQLDEPALVTDMCADAPALAEAVYNKLGSASNRPAIYVATYFGDPGASLAGLARTPVEAIGVDLVYGPDTAVAAVPELAGKTVVAGVVDGRNVWRTDLAAALDKLTTLLGSAARVAVSTSCSTLHVPYSLEPETDLDDALRSWLAFGREKVAEVVTLARALRDGREAVADEIAASNAAVASRKSDPRLHNDRVRARIDSIVASGSHRGDPAQRRASQDARLHLPPLPTTTIGSYPQTSAIRKARAALRSGEIDQAEYERRMKKEIADVITLQEQLGLDVLVHGEPERNDMVQYFAEQLEGFFATQNGWVQSYGSRCVRPPILYGDVVRTHPMTVEWISYAQSLTDKPVKGMLTGPVTILAWSFVRDDQPLADTANQVALAIRDETVDLQAAGIAVIQVDEPALRELLPLRRADQDEYLRWAVGAFRLATSGVADSTQIHTHLCYSEFGEVIGAIADLDADVTSLEAARSHMEVLDDLNAVGFSNSVGPGVYDIHSPRVPSTAEIAESLRAALRAVPAERLWVNPDCGLKTRNPDEVSASLKNMVAAAHEVRAGV

SEQ ID NO: 2447 - protein, 209 aa, Mycobacterium paratuberculosis
MARVVIVGGHGKVALQLSAILTQRGDAVTSLFRNPDHADDVAATGAKPVVADIERLDTDALAGHDAVVFSAGAGGGNPARTYAVDRDAAIRVVDAAARSGVKRFVMVSYFGAGPDHGVPQDDPFFPYAESKAAADAHLRVSDLDWTILGPGRLTLDPPTGRIAVGRGKGEVSRADVASVAAAALADDSTIRRTIDFNNGDVPIAVALAG

SEQ ID NO: 2448 - protein, 280 aa, Mycobacterium paratuberculosis
MTIVDRLRYDGKRALVVGGATGMGAAAAKSAAELGAEVIVLDYAPVTYDVAKSIQVDLRDPASIDAALEQLDGPVHAVFSAAGIAEGTTDLMAINFLGHRYLIERLLERNQLPSGSAICFISSVAGMGWENDLDLLNEFLATPDFATAQEWVKAHEPEGIIHYGFSKKVVNAYVATQGYPLLKKGIRINAICPGPTDTPLAQANADLWLTFAQDYRDETGSKVHTPEQMGDVMAFLNSAAAFGINGITLLVDYGHTMASLTGAYPPGKPIIDIIMGRVKL

SEQ ID NO: 2449 - protein, 429 aa, Mycobacterium paratuberculosis
MAKAESLRAGSTADSPTRRAEILATAASLIASSGLRTSLQEIADAAGILPGSLYHHFESKEAILVELTRRYQEDLERIGRAAQARLDEPDSRPVPEQIIELGSAIANCAVEHRAALQMSFYEGPGTDPELTKLTRQRPVAIQEAMLQTLRAGRWSGYIKPDIDLPTLADRICQTMLQVGLDVMRHTASADPVAELLCRIILQGLASRPPSDTALDRSKAFAAANEVIETWSDDSDADPGDKAALVRAVARAEFGRRGYEVTTIRDIAAAAGLGTGTVYRVIGSKDELLDSIMRSFGKKVEAGWVSVLRSDATPTEKLDALSWVNVNALDQFSDEFRIQLAWMRLSPPTANPGWSYATRLRQMKSLLSEGLRTGEIAIAAPSTAMLARCLIALQWIPENILAEIGKRPALLHVRDTVLRGVAVRGAAVDN

SEQ ID NO: 2450 - protein, 216 aa, Mycobacterium paratuberculosis
VMNVEYLLTATPSARKSLDLDAPVDPGDIRECLRIGLQAANGSNAQSWRWLVVGDPALRARIAELYRDAYLRRVGGRLLAGLMPAGTPESRIMSSTEWLVENLARVPMLVIPCYEPYLPRIDGDESFHLATLYGSIFPPVWNFQLALHTRGYGTCITTLHLHHEDEVAQLLGIPPTYVQGCLLPVGRLRAGRTFRPARRRPIQEVIACDRWDAPPL

SEQ ID NO: 2451 - protein, 366 aa, Mycobacterium paratuberculosis
MNLELTDEQVALRDTTRRFLAEKAPIAHHVRRLLDDPTGIEPAVWRGLADLGCTGLLVPEQHGGAGMTMVEAGIVAEELGAALYPGPWLSTAVAAPRALIRLCAGGDTAAGLLRGIADGTTHVAVCFLDTPPMAATREGETTALHGQARAVPDAAAADVLLALAEDAGDTALFAVNTGSAGVAVTPEHHIDPTHKQSRVTFDAAPARRLATASADDVAAVVDDVLIAACADALGAARAVMDLAVEYAKTRTQFGQPIGSFQAVQHLCVDMYETVELARSGVIHALWVSDAPDGDERHLAALRAKAFAGRLAGVADTAIQVFGGIGYTWEHDAHLYLKRLLGYSAFLGGPDRYLTEVGARLAKRGSP

SEQ ID NO: 2452 - protein, 389 aa, Mycobacterium paratuberculosis
VSGKMDFCYPAEVERFRTELRDWLSDNLTDELVKARRSGGRDDAAFEMLRAWNQTMADAGWAAVSWPREYGGRGATVLEQLVYTEETTRARAPLPLNVIGLNNIAPAIMQYGTEAQKQRLLPRMMRADDIWCQGMSEPDAGSDLAALRTRAVRDGDDFVVTGQKIWTSLGHRADWCQLYVRTDPDAPKHKGISCLIVDMTLPGIEARPRVTLGGDADFAEVFFHDVRVPADALLGPLNAGWQVATTTLSHERAGAARLYAEMQVRLEELVDDLAAAGTGALDDPVTLRRLGELAVRIKYLEVLCQRSISATLHGGSELVALGSASLAKTVWGEIGQDLAALAFDVLGSRDDGRAWANYRLTSRSLTIAGGTTQINKNITAQRVLGLPRK

SEQ ID NO: 2453 - protein, 607 aa, Mycobacterium paratuberculosis
LTAVQPDSTVGTDIWSTSRRLSMGDDACADQWQALGMLASALAGRAVAVAGLPPGEPAWTDGQTIYVDAGAPGALKSLAVQASMIAAGSLRPDVVGRLLRHRKLAQRYLTVEGHRALVANAPVLPRVLASLGDRGVAGRSDSPRASLALAAARVALPDPAPEFGVIRAGKVLAACGRAARPDQPDDKAAPAHVPRRDGAADLAELDDAAVDDSDDPDLFTSPVGGGGALGKWLKKLLSSARKTGTGGGPPGADSPTHRTDSGKRGAYAVASLASAPADEGNDEDPADGVRYPEWDVARGSYRPAWCTVREVEPAITARATLAVDDAIAVRRPLARLGMGLHRRHRQPQGDDIDIDAAVEARVEVRAGSVPDEAVYLDSLRRRRDLSVLLLLDVSGSAAEPGTVGRTVHEQQRAAVADLAVALHDLGDRVALYAYYSQGRRAVSMVPVKRFHDQLNAQVIRRLNSLEPGAYSRLGAAIRHGSAILEARGGTSRRLLVVLSDGLAYDHGYERAYGAADARRALTEARRRGTGCVCLTVGAGTDVQSLRRVFGTTAHATMARPDQLAGVIGPLFRSALRAAEVRRRTAANARAGTATSRRPHTSAHVGAG

SEQ ID NO: 2454 - protein, 304 aa, Mycobacterium paratuberculosis
VPVPRHPAGRTHRRTWAPANRREAMVDQSGLAYVHAAEARPYYRAVGSEEAVFKAAYRQGLALVLKGPTGCGKTRFAEAMAYDLGRPLITVACHDDLTTADLVGRYLLRGDETVWVDGPLTRAVREGAICYLDEVVEARQDTTVVLHPLADHRRQLPIERLGITLDAAPGFGLVVSYNPGYQSVLKDLKDSTRQRMVAIEFDFPAADVEEGIVAHEAGVDAATAAELVRFGQAIRRLETAGLREVASTRVLIAAGRLVAEGLSLPEAARAAIAGPLTDDVAVGKALGEMIGIYFGSGGSLGSDD

SEQ ID NO: 2455 - protein, 372 aa, Mycobacterium paratuberculosis
MSYESSAEPIKVGYLMDFALPPGFPEEMKADFTRCFDLVFAEAAEQGVLDRPVQMIYREVEGLPKGSVKAVIDAFGELVDEGCLVVFGPHITDNCVPTREAIEERFKVPALSVTGTDDWLGEWTFSFPQGSMTDEPIFIADLVAKRGLSEIGVLVEQNLIGESYLKNLRSACRRKGIRIVAEAAIAQIAQDINEAVRTLHDAKSEAIVHLGFGFGIVFINPALQAVDWDPPRFTTTAFQNAWVNPIMWNAFMGWVGVDQYDEDNRIGQDFLDRYAAKYGGRRPEYCVPVVNCDVAATLVRAFADAHPLSPRGVKEALERVKMMPAASGAPGTRVSFGKWTRRAWMGAGYLVARTLDADGVNSHLVDRFGEEG

SEQ ID NO: 2456 - protein, 381 aa, Mycobacterium paratuberculosis
MSTEQTTSPAAQRESAAPRRTGTRGWGGWVAGAGLAAFALFFIANCRVALDPRVADPNVQGRPRPVKFIFGLDYMTFIQISTVVMLIVLVVVFVRGWRRNPGSPAMLMFLCTTLIVWQDPIMNWAPFAVYNPDLIHWPESWPLVSLSPTVEPFVVFGYVTFYFGPYFPAVWILRRLQAKYGPQSFFARHPLVSLGVLTCAIGFVFDAWLEIQLVHMGMYIYSQVIPWGSVFTGTTFQFPLIWESFSVTFVMVPAAILCYRDDTGKSVAEKLAAKAKLFPARPVLGTFLVMFVIINVSYFAYGAWFAVIKATKAATSVACPWPYPEAKVYDPQGFYEKAGAQGPYSVGIWSTWMSGQPHGRPDVQPPPPGAGACATTAVGHG

SEQ ID NO: 2457 - protein, 352 aa, Mycobacterium paratuberculosis
VRAPARPPRSGMAEPRSVVITGASRGLGFASALRMYREGWRVVAAMRTPDQGMPLLRRAIRDGTGQDPDDDRLIGVQLDLTDSASVAAAAKAIEEAVGAPSAIVHNAGISAAGMVEETDTALWQRMFATSVLGPVALTQALLPSMRAAGRGRIVLVSSAAGVRGQPGTAPYSAAKGALERWGESLAGEIAPFGLGVTVLVAGTYDTEIITDAGTTDDRNFSGPYARLHTTMNTRGRLAVSFARRPERFTDGLYKALDDRAPFRRRGVGPDASVLLAANRILPASGMHHLSRVVLGIPRQGSMRDGAWPLTHGQRAMVLVARVLPQPVLQRLAALAGRFSSPKSAARQGDQEG

SEQ ID NO: 2458 - protein, 404 aa, Mycobacterium paratuberculosis
MEQLFDDLEDFGAFDDAVSGDVRDPYTELARLRREEPIQRLDTSGMPHEESKPVFIVYRHEDAQQMLRDNETFSSAAVIAAFGPVLGERVMLGIDEPVHGRLRSLVSKAFSQKALARWEDELVGRVGNSLIDRFAGNGKADLVKEFTFDYPSRIIAGLLGLPEQDYPQFQRWSISLLSWILNPERGLAASAALCDYFAPILAARRAEPKDDLISGLAQAEIDGEKLEDEEIYSFLRLLLPAGVETTYRALGSLLLALLSDPEQLDAIRGDRSLLPQAIEEGVRWEPPLLTITRVATRDTELGGVPIPAGSTVMPMLGAANRQEDRYPDPDRFDIFRAPKSHLGWGHGVHVCLGMHLARLEMRTAVNLLLDRLPNLRLDPDADDPHIRGQVFRSPTSVPVLFDPQ

SEQ ID NO: 2459 - protein, 350 aa, Mycobacterium paratuberculosis
VTDMTEAVKVRFEPKMMIDGKLVDGQAGTFTNINPATEEPLGEVADASKEDMHRAIDAARRAFDETDWSTNRELRKRCLLQLHEAIESEKEELREELILEVGSPRAITFGPQLDAPLEDGLKYPARLIDEYAWETDLGDKVISLTGTLTTRKVWREPVGVVGAIVPWNFPFEVTLNKLGQALGTGNTVVLKPAPNTPFNATRLGRLIAEKTDIPAGVVNVVTASDHFVGEELTLSPKVDLISFTGSTVVGQRIMEKGAATMKRLFLELGGKSATIVLEDADFGMACAIGIAPCMHAGQGCANPTRMLLPRSRYDEGVAILKGIYENVTCGDPQDPGPFAARSFRRCSATA

SEQ ID NO: 2460 - protein, 146 aa, Mycobacterium paratuberculosis
MGYIRKGVEEGATALVGGPDAPTGFDKGYYVRPTLFTDVDNSMTIAQEEIFGPVLCVIPFDDEEDAIRIANDSKYGLAGNVMSGSLERSLSVARRIRAGFMGVNGGAPYGADTPFGGYKYSGVGRQNGVAGFDQYTEIKSVAYPAG

SEQ ID NO: 2461 - protein, 382 aa, Mycobacterium paratuberculosis
MAEAVIVEAVRSPIGKRNGGLSGVHPAELSAQVLNGLVDKAGVDPGIVDDVIWGCVMQAGEQALDIGRTALLTAGWPETVPGVTVDRQCGSSQQSIHFAAAGVIAGHYDVVVAGGVESMSRTPMGASLANGGRPYPQAFLDRYQGQIPNQGIGAEMIAEKWGFDRTALDEFSLASHEKAAAAQDSGAFDDQIVGIKDQDGNVVLKDEGIRRGTPMEKMASLKPAFKEDGVIHAGNSSQISDGSAAILFMSAEKAKELGLKPIAKVHTATLAGADPVIMLTAPIPATQKVLKKSGLSIDDIGVYEVNEAFAPVPMAWLKDIGADEKKLNPNGGAIALGHPLGGSGARIMTTLLYHMRDKGIRYGLQTMCEGGGQANATIVELL

SEQ ID NO: 2462 - protein, 263 aa, Mycobacterium paratuberculosis
VTDAPGALAERRGNVMVITINRPEARNAINAAVSIGVGDALEEAQHDPEVRAVVLTGAGDKSFCAGADLKAIARRENLYHPDHPEWGFAGYVRHFIDKPTIAAVNGTALGGGTELALASDLVVADERAQFGLPEVKRGLIAAAGGVFRIAEQLPRKVAMRLLLTGEPLSAAAARDWGLINEVVEAGSVLDAALALASAITVNAPLSVQASKRIAYGVDDGVVVGDEPGWDRTMREMRALLKSEDAKEGPRAFAEKREPVWQAR

SEQ ID NO: 2463 - protein, 338 aa, Mycobacterium paratuberculosis
LMAYDADLLVVGGGPGGLATALHARRLGLSVIVAEPREAPIDKACGEGLMPGGLAALTALGVDPAGMPFQGIAYLSEHRRAQARFRDGPGRGVRRTTLHAALAARAKEQDTEWIRARVSSVAQDAHGVSAAGVRARWLVAADGLHSTVRRAVGIAATAGTPRRYGVRWHYRVPAWSEFVEVHWSRWGEAYVTPVEPDLVGVAILSRGRPDLGWFPGLAARLRAAERGRPRGCGPLRQVVSRRVAGRVLLVGDAAGYEDALTGEGISLAVKQAAAAVRAIVDERPASYEAAWHRITRDYRLLTRALVLASTPRAVRRAIVPAGALLPGAFRAGVNILAR

SEQ ID NO: 2464 - protein, 166 aa, Mycobacterium paratuberculosis
MYCLLVLAVGLERVAELLVSTRNARWSFTQGGKEFGRSHYPVMVFIQTALLAGCLVEPWALHRPFLGWLGWPMLAVVAASQGLRWWCITTLGRRWNTRVIVLPQAPLVRDGPYRWLHHPNYVAVVAEGLALPLVHTAWLTAAVFTLANAALLRVRLRVENSALGYT

SEQ ID NO: 2465 - protein, 349 aa, Mycobacterium paratuberculosis
VGESPSITGVAVKFPPNRYTQSEAIRALTDIAGPEFRRFAHSSGVEFRNTALRLPRYRELSGFSEANDAYLEVALDLGEQALVAALDRGKVKPSEVDIVFSTTVTGLAVPTLEARLATRVGLRPDVKRVPLFGLGCVAGAAGVARMHDYLRAFPDQTAALLAVELCSLTIQRHDTSIANLVATSLFGDGAAAVITEGARRAGAEHTGPRILATRSRIYPDTEEVMGWKIGGDGFRIVLSADVANIAEKYLGEDVRDFLADHGLAPRDVTTWVCHPGGPRVIEAVESVLDLPADALDHTRNSLRENGNLSSVSVLDVLAANLADPPAPGSIGLMIAMGPAFCSELVLLAF

SEQ ID NO: 2466 - protein, 461 aa, Mycobacterium paratuberculosis
LIHVPVTTGPRRWFKRASPRRARNATAGIRPENRPDVTDAVGTPPTRAVGTPPTRAVGTPPPYAVGTPARRRAGLGSGVMRVLVTGATGYVGSRLVTALLAGGHDVLAATRNPLRLKRFGWFEEITPVPLDAADPASLRSAFAGCGPVEVVYYLVHAIGQPGFRDADKAAAANLAAAAKDAGVRRIVYLGGFVPAGEVLSEHLTSRAEVAEALAVPDGPELVWLGAAMIIGAGSTSFEMMRYVGDRFPLMPIPSWMDNPIDPISIRDVLHYLLAAADRDLVPAGAYDISGPDTTSYRRLLKTYARLSGRWHTGLPVGRVDTGLASLVTGVALPVPPGLAGDLVESLDHPMVASGSDLRQRVPDPPGGLLGVDDAIARALDDRSYRRPRPVNALADPHHLADTDPGWAGGDARRIRQLAGRVTPAIARPTLGLVNKVPGPVAGAVRTGLDILIALTPKVRPA

SEQ ID NO: 2467 - protein, 240 aa, Mycobacterium paratuberculosis
MSQSTSPYHTSVFAELRRAITNVAVPHNEPPTIVRRRRVVVAITLVLGAAVLGYSLRRHPGESSFYWLTLGLAAVWTVGALSSGPLHLGGICWRGRNQRPVITGTTVGLLLGGAFVVGGLIAREIPAVSALITRVLLFAHHGWLPLVVAITVINGIAEELFFRGALYTALGRYHPVLISTLLYTAATMAAGNPMLGFAAVILGTVCALERRASGGVLAPVLTHCGWGLIMVLALPPVFGL

SEQ ID NO: 2468 - protein, 270 aa, Mycobacterium paratuberculosis
MPSSAIATLAPVAGLDVTLSDGVFSVTINRPDSLNSLTVPVITGIADAMEYAATDPEVKVVRIGGAGRGFSSGAGISADDVSDGGGVPPDEIILEINRLVRAIAALPHPVVAVVQGPAAGVGVSIALACDVVLASENAFFMLAFTKIGLMPDGGASALVAAAVGRIRAMQMALLPERLPAAEALAWGLVTAVYPADEFEAEVDKVIARLLSGPAVAFAKTKLAINAATLTELDPALQREFDGQSVLLKSPDFVEGATAFQQRRTPNFTDR

SEQ ID NO: 2469 - protein, 360 aa, Mycobacterium paratuberculosis
MAGPLQGLRVVELSGIGPGPHAAMILGDLGADVVRIDRPSGAPGGVVKDAMSRNRRIVTADLKSDQGRELVLKLVAKADVLIEGYRPGVTERLGLGPQDCAKVNDRLIYARMTGWGQTGPRSQQAGHDINYISLNGILHAIGRANERPVPPLNLVGDFGGGSMFLLLGILSALWERQSSGKGQVVDAAMVDGSSVLVQMMWQMRASGMWTDARGTNLLDGGAPYYDTYECADGRYVAVGAIEPQFYAAMLAGLGLDGADLPGQNDVSRWPELRAALTEKFASRDRDHWAKVFADSDACVTPVLAFGEVQTEPHITERNTFYEVDGGLQPLPAPRFSRTAPQTPRPAAPVTDATAILDEWV

SEQ ID NO: 2470 - protein, 254 aa, Mycobacterium paratuberculosis
MEIKDAVAVVTGGASGLGLATTKRLLDRGAQVVVIDLRGEDAVRELGDRARFVQADVTDEAAVGKALDTAESMGPLRINVNCAGIGNAIKTLSKDGPFPLDAFKKVVGVNLIGTFNVLRLAAERIAKTEPIGPGTSPERGVIINTASVAAFEGQIGQAAYSASKGGVVGMTLPIARDLARELIRVVTIAPGLFKTPLLGSLPEEAQASLGKQVPHPARLGDPDEYGALAVHIVENPMLNGEVIRLDGAIRMAPR

SEQ ID NO: 2471 - protein, 48 aa, Mycobacterium paratuberculosis
MVAHTLSVMWIDDTSADVIKVDFEALYHGDVLVEGETSEQFDELQAAS

SEQ ID NO: 2472 - protein, 800 aa, Mycobacterium paratuberculosis
LSRTIQRPAQWGAPAAEGLTMLQKIARVAIAAPRRIIALGVLVFLAAAVFGIPVAKSLSPGGFQDPDSESARAIGVLTDKFGQSGQQMLILVTAPGGSNSDPARRVGTELVGQLQRSPLVYNVSSPWTAPPQASADLVSRDGKSGLIVVNLKGGENFVQNNAQTLADQFVHDRDGVTVRAGGAAMQYAQINTQNQADLLVMEMIALPLSFLVLIWVFGGLLAAALPMALGALAVVGSMSVLRLITFTTEVSIFALNLSTALGLALAIDYTLLIVSRYRDELAEGHDRDQALIRTMATSGRTVLFSAVTVALSMSATVAFPMYFLKSFAYAGVATVAFVATASIVITPAAIVLLGDRLDALDVRRLLRRALRRAQPVRKPVEQLFWYRSSKFVMRRWAPVGLIVVGLLLLLGLPFFSVKWGFPDDRVLPRSASAHQVGDRLRSGFAHDSATSVPVVIPDAAGLSPADLDDYAAALSRVPDVSAVSALGGTFTGGTRVGPPAGATGLGDGSAFLTVSSTAPLFSTANDVQLKRLHEVPGPAGRSVEMGGVAQVNRDSVDAVTDRLPLVLGLMAAITFVLLFLLTGSVLLPAKALACNFLSLTAAFGALVWIFQDGHLGALGTTPSGTLVANMPVLLFCIAFGLSMDYEVFLLSRIREYWLASGAARPARPTPKRAHAANDESVALGVARTGRVITAAALVMSMSFAALIAAHVSFMRMFGLGLTLAVFADATLVRMVVVPASMHVMGRWNWWAPKPLAWLHDRFGISEAADEEPRLAEPALGPVGSVGLPGGAVAEPVPNIG

SEQ ID NO: 2473 - protein, 215 aa, Mycobacterium paratuberculosis
VHTGMTTVVVDNPFFARIWPVVATHETAAVRALRRENVAGLTGRVLEVGAGIGTNFPLYPETVDEVIAVEPEPRLADRARAAAQVVPVRVVVTGETAEAVGGDEPFDAVVCSLVLCSVRDPQGVLRRLYSLLRPGGQLRYLEHIASACARGRFQRFVDATLWPRLFGNCHTHRDTERSIVEAGFDVDASRREWTLPAWSPMPVSELLLGRAHRPA

SEQ ID NO: 2474 - protein, 237 aa, Mycobacterium paratuberculosis
MRIAVLSGAGISAESGVPTFRDDKNGLWARFDPYELSSTQGWRDNPQRVWGWYLWRHYLVADVAPNAGHRAIAAWQDHAEVSVITQNVDDLHERAGSRPVHHLHGSLFEFRCARCAKPYTGELPAMAEPALEVQPPVCGCGGLIRPDIVWFGEQLPDEPWRRAVEATESADVMVVVGTSAIVYPAAGLAELALSRGAAVVEVNPEVTPLSASATLSIRETASQALPGLLQRLPALLN

SEQ ID NO: 2475 - protein, 121 aa, Mycobacterium paratuberculosis
VELGDWLRVDMKAGKPLFDQLRTQVIEGVREGALPPGTRLPTVRELAGQLGVAVNTVARGYRELESAAIIETRGRFGTFVARYDPTDAAMAAAAREYVRVARGLGLDKADAVRYIESVPDE

SEQ ID NO: 2476 - protein, 186 aa, Mycobacterium paratuberculosis
MVVTGPGWWNRGMTEYAAFLRGVNVGGVNLKMADVKKALTDAGFTAVRTVLASGNVLLQSKAGAAAVRAKAEAALRERFGYDAWVLVYDLDTVRRVVDGYPFEREVDGYQSYVTFVADAAVLDELAALPAGPDERIRRGPDPLGVLYWQVPKGSTLDSTIGKTMGKPRYKSSTTTRNLRTLVKVLS

SEQ ID NO: 2477 - protein, 147 aa, Mycobacterium paratuberculosis
MGRQVFDDKLLAVISGNSLGVLATIKRDGRPQLSNVQYHFDPRSLVIQVSITEPRAKTRNLRRDPRASILVDADDGWSYAVAEGTAELTPPAAAPDDDTVQGLIALYRNIAGEHPDWDEYRQAMVTDRRVLLTLPISHVYGMPPGMR

SEQ ID NO: 2478 - protein, 74 aa, Mycobacterium paratuberculosis
MAASSAREGSQSSKSSGGAGSSKSDDDTKRRFREALDRKMAKSTGGSEHKDGAGKQSRAHGPVESRREFRRKSG

SEQ ID NO: 2479 - protein, 191 aa, Mycobacterium paratuberculosis
VPKLQLVQEPAADALLDENPFALLVGMLLDQQVPIETAFAGPKKIADRMGGLDAATIADYDPDKFAALCSERPAIHRFPGSMAKRIQALAQLLVDRYGGDAAALWTAGEPDGKELLRRLKGLPGFGEQKARIFLALLGKQYGVTPPGWREAAGEFGKAGTYLSVADIVDARSLGQVRSYKKQMKAAAKAAK

SEQ ID NO: 2480 - protein, 48 aa, Mycobacterium paratuberculosis
VKTHITCPCGEAIVGKDEDELVELTQAHLASVHPGLEYDRDAILFMAY

SEQ ID NO: 2481 - protein, 363 aa, Mycobacterium paratuberculosis
VATTWILSKGLAAVVTASVAALGLCPGAAADPAAAPQPAPPPNAAPQLPGLPALSQLSPLIQQAATDPQQATQLLMAAAQAFSHNPTAPTESKNVAAAVNQFVAEPGSPVPNGVTPPDGAPVQHVPATGIEPGLQAHLPTGIDPAHAAGPAPAAAAPSAPAPVAAPAATPPSAPAPAAAPAPGPVQPATVPAAAPVPPPPAPAAAAPATPGAPDAAPAPAAAPGFGADAPPTQDFMYPSIGTNCLADGSSAIATALSVAGPAKIPAPGPGPGQTAYVFTAVGTPGPAEEQKLPLNVTWVNLTTGKSGTVALKPRPDINPDGPTTLSAIADTGSGSIMSTIFGQVTTKERQCQFMPTIGSTVVP

SEQ ID NO: 2482 - protein, 232 aa, Mycobacterium paratuberculosis
MPTIWTYLRAAAVVVGSSAALLTGGIAHADPVPTPPVPNIPQQLISSAANAPQILQNLATALGATPPAPPATPGISFPGVPAAGSPVTASSPAAVPSIPGLPQAAAPSAPSTATGGIPGMIQGLTGAQPSAAAPAAPASSSIPGLPAIPGLSAPAAPATPPAPQLPQAQVNMPAMPAGLPVSVPAQVTLPKDLPALASGQAPGAPAAPAAPAAPAPAASPAGPVAPLLAALP

SEQ ID NO: 2483 - protein, 437 aa, Mycobacterium paratuberculosis
LKTGHLGTEATAARAPIAKVGRIDTTSAAPAAPSTRRAADALAVAAPLLLVASVAARLAWTYLVPNGANFVDLHVYLGGAAALDHPGTLYSYVYADQTPDFPLPFTYPPFAAIVFYPLHLLPFGLVALGWQLATIAALYGAVRISQRLLGVPAGAHGRRVAMVWTAVTIWIEPLRSTFDYGQVNVLLMTAVLWAVYSTRWWLSGLLVGLAAGIKLTPAVTGVYLAGARRWAATMFSAVIFLATIGISVLVVGDQTRYYFTELLGDAHRVGPIATSFNQSWRGGLSRILGHDVGFGPLLVTAVAGTAVLAVLAWRALDRSDRLGRLIVVEVFGLLLSPISWTHHWVWLVPLMIWAIHGPVRAWRGARLVGWGWLALTVIGVPWLLSFAQPNIWQIGRPWYLAWAGLVYIVAAVATLVWIAAAGRRAGHQVTAPSVTPA

SEQ ID NO: 2484 - protein, 109 aa, Mycobacterium paratuberculosis
VDRAPLPQKRLEDRAMAVLTDEQIDAAMPDLDGWERADGALRRSIKFPSFLDGIDAVRRVAEHAESKDHHPDIDIRWRTVTFALVTHSEGGITQNDVDMARDINGIVGS

SEQ ID NO: 2485 - protein, 314 aa, Mycobacterium paratuberculosis
MASDGIPSARTPPALPAQRTQFPCRTTTLLRFRGDRGILDGGRCGLCQALLQNGGWHMITEPATAFSRVFRGYDPAAVDAYVEALLAKQKLLIDEVQNLRAQRNESGDQLAALRIEVACLKDEVAHLSDTSPTPYAIQHRMTKMLRRTLEEISRMQAEAQAEAESMIAAAAAQVEASHREHQELLADMAAQREALETEREDAKKELEAELATMRAEAQAAIDEARQEAERECARLLAEAKQKADDLDERARRTVEEANQQRIMILEELMDVARDLQGLPASLQSAYQERTSPSEASVVVPLDPKNQAPGPAVAS

SEQ ID NO: 2486 - protein, 130 aa, Mycobacterium paratuberculosis
MPTQIVVAGALIRGSRLLVAQRARPPELAGRWELPGGKVAPGETERDALARELAEELDLRAGDIAVGDRLGGDIAVDGGMTLRAYRVRLLRGRPDARDHRALRWITAAQLHDLDWVPADRGWLGDLARVL

SEQ ID NO: 2487 - protein, 1230 aa, Mycobacterium paratuberculosis
LTATPHVGGVLEELLERSGRFFTPGEFSADLRTVTRQGGREADVFYRDRWSHDKVVRSTHGVNCTGSCSWKIYVKDGIITWETQQTDYPSVGPDRPEYEPRGCPRGASFSWYSYSPTRVRYPYARGVLVEMYREAKARLGDPVLAWADIQADPERRRRYQRARGKGGLVRITWAEATELIAAAHVHTIKTYGPDRVAGFSPIPAMSMVSYTAGSRFFELIGAPMTSFYDWYADLPVASPQVFGDQTDVPESGDWWDAAYLMMWGSNVPITRTPDAHWMAEARYRGTKVVTVSPDYADNTKFADEWMPCAAGTDGALAMAMGHVILSECYVQKQVPFFTDYARRYTDLPFLIKLEERGDMVPGKNLTAADLGEAVENAALKPALLDETTNSVAVPHGSLGFRYGESGVGKWNLDLGDLVPALSVRAAPTEDGDTALVHLPSFDTVDGEGTTVARGVPVRRVGKHLVCTVFDLMLAQYGVERPGLPGEWPTGYDDATQQNTPAWQEAITGVSAAQAIRVAREFARSAEESGGRSMIIMGGGICHWFHSDAIYRAVLALLMLTGSMGRNGGGWAHYVGQEKVRPLTGFQTMAMATDWVRPPRQVPGASYWYAHTDQWRYDGYGADKLASPVGRGRFAGRHTIDLLASAVAMGWSPYYPQFDRSSLDVADEARAAGRDVAEYVAEQLGRRNLKLAVTDPDNPVNWPRVLTVWRANLIGSSGKGGEYFLRHLLGTDSNASAVPPEDGVRPVDVTCEGDIPEGKLDLMMSIDFRMTSTTLVSDVVLPAATWYEKADISSTDMHPYVHAFSAATDPPWETRSDFDAFGAIARAFSTMAKEHLGARTDVVLTALQHDTPDAMAYPDGAEHDWLRSGATPVPGRTMGKLTVVGRDYAAVYDKWRTLGPLVDKFGLTTKGVTVHPFREVEELAARFGVLKSGVAAGRPAITTAARMADVLLLLLSGTTNGRLAVEGFHELEKRTGQRLVHLAEGSEDKRISYADTQARPVPVVTSPEWSGSETGGRRYAPFTINIENLKPFHTLTGRMHFYLAHDWVEELGEHLPVFRPPLDMARLFGQPRLGACEDGVGLTVRYLTPHSKWSFHSTYQDNLYMLSLSRGGPTMWMSPGDAAKIQVRDNDWVEAVNANGIYVCRAIVSHRMPDGVVYVYHVQERTVDTPRTETNDKRGGNHNALTRVRIKPSHLAGGYAQHAFAFNYLGPTGNQRDEVTIVRRRSQEVVY

SEQ ID NO: 2488 - protein, 538 aa, Mycobacterium paratuberculosis
MKVMAQLAMVMNLDKCIGCHTCSVTCKQAWTNRSGTEYVWFNNVETRPGQGYPRTYEDQERWRGGWIRDKRGRLRLRDGGRFQKLLRIFANPKLPVIGDYYEPWTYDYENLTTAPAGDTFPTAAPKSLISGEPMKVSWGPNWDDNLAGSPEILAEDPILKKVSEEVKLSLEQTFMFYLPRICEHCLNPSCVASCPSGAMYKRSEDGIVLVDQDRCRGWRMCVSGCPYKKVYFNHKTGKAEKCTLCYPRMEVGLPTICSETCVGRLRYLGVVLYDMDRVLEAASVENDTDLYRAQCDILLDPNDTDVIAGARAQGIPDEWIEAAQRSPVYALIHTYRVALPLHPEYRTMPMVWYIPPLSPVVDAVSRDGHDGEDLGNLFGALDALRIPMQYLAELFTAGDTAVVEGVLRRLAAMRSYMRDINLGRETQPHIPHSVGMTEEQIYEMYRLLAIAKYEERYVIPTAFAPQARDLEQMGCSLTGDGGPGMYESEPVAVETFHALKQRGGPTEAEPGSTRPRVNLLNWDGGQVPAGMFPEAQRR

SEQ ID NO: 2489 - protein, 212 aa, Mycobacterium paratuberculosis
MQDRLVWQAASLLLAYPDDGFGGRLDTVEELLGHVSGPAGTLLGQTAAALHGREPMAAAMDYVATFDMRRRATMYLTYWTAGDTRNRGREMLAFATAYREAGVQPPSNEAPDHLTVVLEFAATVDPDAGRRLLIAHRVPIDVLRCALADAKSPYEPAVAAVCQTLPAATDQEARRAERLARQLLEAGPPAEAVGLQPFTLTVPPRAEGTPGV

SEQ ID NO: 2490 - protein, 243 aa, Mycobacterium paratuberculosis
VFSNVLFWDISPYVTLSVLIVGTWWRYRYDKFGWTSRSSQIYESRLLSIASPIFHFGILAVFAGHVMGLFIPPRVTHMLKMSDHLYHMQAVIAGSAAGFATLAGVGLLIYRRFTRPAVSAATTRSDKVMYVVLVLAIVVGLYCDLIGTGPHGGEFHYRYTVGLWFRRIWILQPHGEVMVNAPLDYQLHALIGMVLFTLWPFTRLVHVFSAPVVYLFRPYIVYRSREVAAKDQLVGTAPRRRGW

SEQ ID NO: 2491 - protein, 678 aa, Mycobacterium paratuberculosis
VQPGRRHADGARPGCTLKRPGFTLDERTRAARVIQPVRYRWPRAARISDVPFRNVAIVAHVDHGKTTLVDAMLRQSGALHHRGDDTQERILDSGDLEKEKGITILAKNTAVHRHHPDGSVTVINVIDTPGHADFGGEVERGLSMVDGVLLLVDASEGPLPQTRFVLRKALAAHLPVILVVNKTDRPDARIAEVVEASHDLLLDVASDLDDEAAKAAEHALGLPTLYASGRAGVASTEQPADGEVPAGENLDPLFDVLLEHIPAPSGDPEAPLQALVTNLDASTFLGRLALIRIYNGKLRKGQQVAWMREVDGLPVITSAKITELLATEGVERSPTDEAIAGDIVAVAGLPEIMIGDTLADPDHAHALPRITVDEPAISVTIGTNTSPLAGKVPGHKLTARLVRNRLDQELVGNVSIRVVDIGRPDAWEVQGRGELALAVLVEQMRREGFELTVGKPQVVTRTIDGQLHEPFEAMTIDCPEEFVGAITQLMAARKGRMEEMTNHAAGWVRMDFIVPSRGLIGFRTDFLTITRGTGIANAVFDGYRPWAGEIRARHTGSLVSDRAGTITPFAMIQLADRGQFFVEPGQDTYEGMVVGINPRAEDLDINVTREKKLTNMRSSTADVSETLAKPLELDLEQAMEFCAADECVEVTPEIVRVRKVELDATSRARSRARAKARG

SEQ ID NO: 2492 - protein, 647 aa, Mycobacterium paratuberculosis
VVGRAAVRLLDTLISVPRRVRRVFMVLGGLVSVVGLVLSACTVNPPPAPQSTDTPHNSVPPPPRVSQIIMGIDSIGAGFNPHLLSDLSPVNAAISALVLPSAFRPVPDPNTPTGSRWEMDPTLLVSAEVTSQNPFTVTYKIRPEAQWTDNAPIAADDFWYLWHQMVSQPGVVDPAGYDLITGVQSLEGGKQAVVTFSEPYPAWKELFNNILPAHIVKDVPGGFAAGLARALPVTGGQFRVESIDPQRDEILIARNDRYWGPPAKPGLILFRRAGAPAALADSVRNGDTQVAQVHGGSAAFAQLSAIPDVRTARIVTPRVMQLTLRATQPKLADTQVRKAILGLLDVDLLAAVGAGSDNTVTLDQAQIRAPSDPGYEPTAPPAMTTPAALALLEGAGYKVEPNTSASPATPAPGPPNTGPPEVIRGRISKDGQQLSLAIGVAANDPTAVAVANTAADQLRNVGIAATVLALDPVTLYRDALNDNRVDAIVGWHQAGGNLATRLAARYGCPALQSTQVPASTEPTPTSPAPGGPAPSTGPATRSATPTSTAPPSRPADPNALVQAPSNLTGICDRSIQSNIDAALNGTKNINDVITAVEPRLWNMSTVLPILQDTTIVAAGPSVQNVSLSGAVPVGIVGDAGQWTKTGP

SEQ ID NO: 2493 - protein, 230 aa, Mycobacterium paratuberculosis
MKRTLPAAVVRLLRREAADRNAHGYYQEMPQLTDRTGSRSRRRGEVLERALYEATLAELTEVGYGGLTMEGIAARAHTGKAALYRRWDTKCELVHAALVFALPPVPELRSGRSARENLLAMFTAQRDLLAGKTAFPGIEVIQQLLHEPEMRAIFADAVVRPRLKIVESILQSAVQDGDLDPKSITPLTARIGSALINQHFLLNGSPPNRRELALIVDTVIPPRDSDRAAD

SEQ ID NO: 2494 - protein, 300 aa, Mycobacterium paratuberculosis
MAETPRLLFVHAHPDDESLGTGATIAHYTAAGADVRVVTCTLGEEGEVIGERWAELAVDRADQLGGYRIGELTAALRELGVGEPCYLGGAGRWRDSGMPGTPRRRRQRFIDADEREAVGALVAIIREQRPHVVVGYDPAGGYGHPDHVHVHTVTTAAVAAAGAGNFPGEPWAVPKFYWSVFATRPFEAAVQALTPEDLRPGWSMPSAEQFTFGYADEHIDAVVAAGPHAWAAKRAALAAHATQVVVGPTGRACALSNNVALPILDEEHYVLVAGAAGARDERGWETDLLAGLEFGAAPRR

SEQ ID NO: 2495 - protein, 162 aa, Mycobacterium paratuberculosis
LAGPARQPAVGYRLDTLQHRQRSDLTETKPRVASGEDSGATDPAIRFVVLALLAVDGVLSALAGALLLPLYIGTVPFPISGLISGLLNAALVWAAGRWTRSPRLVALPLWTWLLTVAVISMGGPADDVILGGRGVMAYGALLLLVLGVAPPVWVLWRRGRGG

SEQ ID NO: 2496 - protein, 867 aa, Mycobacterium paratuberculosis
VLLTPGEEPTALPDPVVPARASSRATPKATASALRRVLRRARDGVALNIDEAAVAMTARGDDLADLCASAARVRDAGLQSAGRRGPGGGLPITYSRKVFIPVTHLCRDNCHYCTFVTVPGKLRARGAGLYLEPDEILDIARRGGELGCKEALFTLGDRPEDRWPEAREWLEARGYDSTLSYVRAMAIRVLEETGLLPHLNPGVMSWSEMARLKPVAPSMGMMLETTSRRLFETKGLAHYGSPDKDPAVRLRTLTDAGRLSIPFTTGLLVGIGETPAERADTLHAIRKSHKEFGHVQEVIVQNFRAKEHTAMAAVPDAGIEDYLATVAVARLVLGPGMRIQAPPNLVSRDECRALIAAGVDDWGGVSPLTPDHVNPERPWPALDELAAVTAESGYELVQRLTAQPKYVQAGAAWIDPRVSGHVRALADPVTGLARDVNPVGLPWQEPDDVGSSGRVDLNAAIDTQGRNSETCSDIDSAFGDWESIRAHVHELAAQGARAPERLDSDVLAALRSAERDPAGCTDSEYLSLATADGPALEAVAALADSLRRDTVGDDVTFVVNRNINFTNICYTGCRFCAFAQRKGDADAYSLSTEEVADRAWEAHVAGATEVCMQGGIDPELPVTGYADLVRAVKARVPSMHVHAFSPMEIANGVTKSGLSIREWLISLREAGLDTIPGTAAEILDDEVRWVLTKGKLPTSLWIEIVTTAHEVGLRSSSTMMYGHVDNPRHWVGHLNVLRDIQDRTGGFTEFVPLPFVHQSSPLYLAGAARPGPTHRDNRAVHALARIMLHGRISQIQTSWVKLGVQRTQVMLNGGANDLGGTLMEETISRMAGSEHGSAKTVAELTAIAEGIGRPARQRTTDYTPLAA

SEQ ID NO: 2497 - protein, 239 aa, Mycobacterium paratuberculosis
VDGARRRRPPGRKRRGAGPGARRSPGGRAGGHPRFRGAGRPAARPERRRPVGRAGRPDGHPQRGRGGRRSHPRRHRRGLDRPHHEGAVVRRAHARRTRPARLGHHRGLRQRRGLPGGAGRAVDDHAQRARGRPAAAGEGGQATATRRAGRSPAARRRHRRRGAGRRSGADQHRVRRAAGPGHPGNRRGRAGAAAVGAQARRPVTHPQPRRTAGPGTGALPARRLLNGFRRPGALRSCYR

SEQ ID NO: 2498 - protein, 110 aa, Mycobacterium paratuberculosis
MRLSLSKLGVAVGSAAVALTAAAGVASADPMDAIINTTCNYGQVIAALNASDPAAAQQLNSSPMAQSYIQRFLASPPAKRQQMAQQIQGMPAAQQYINDINQVAVTCNNF

SEQ ID NO: 2499 - protein, 329 aa, Mycobacterium paratuberculosis
MSHRNAPLSETGRLRLARCVVDEGWSLRRAAERFQVSVTTAERWARRYRELGEAGMADRSSRPHHSPNRTPTRTERRIIKVRVIRRWGPARIGYLLGIHPSTVHRVLTRYALAKLRWLDRSTGRIIRRMEPAGCGDLVHVDVKKLGKIPAGGGWRMLGRAIGGHNSNADKSSGVFSKHRNPIRGYHYLHTAIDGYSRLAYSEVLDDEIKETAAEFWTRANAWFAECGISVRKVLTDNGSCYRSRVFAQALGDIEHRRTRPYRPQTNGKVERFHRTLADEWAYARLYRSDTERCEEFTTWLHTYNHHRGHTALGGQPPASRVPNLSGQYN

SEQ ID NO: 2500 - protein, 108 aa, Mycobacterium paratuberculosis
VTYTIAEPCVDIKDKACIEECPVDCIYEGARMLYIHPDECVDCGACEPVCPVEAIYYEDDVPDQWSQYTQINADFFAELGSPGGAAKVGLTENDPQVVKDLPPQGEGD

SEQ ID NO: 2501 - protein, 372 aa, Mycobacterium paratuberculosis
VPHQLRKRRPAVSAALPEFPWDTLAEAKALAGSHPDGIVDLSVGTPVDPVAPVIQQALAAAGSASGYPATAGTARLRDSAVAALARRFGVVGLTEASVLPVIGSKELIAWLPTLLGLGPADLIVVPELAYPTYDVGARLAGAWVLRADSLTQVGPQSPALYYLNSPSNPTGRVLGVDHLRKVVAWARDRGCLVASDECYLGLGWDAQPLSILHPQVCDGDPTGLLAIHSLSKSSSLAGYRAGFVAGDAELIAELLAVRKHAGMMVPTPVQAAMVAALDDDAHERTQRQRYERRRAALLPALRSAGFAVDHSEAGLYLWVTRGEPCRDTITWLARRGILAAPGEFYGPRGAQHVRVALTADDERIAAAVRRLA

SEQ ID NO: 2502 - protein, 796 aa, Mycobacterium paratuberculosis
VLVTSSTGNLRIPLSFGDVAKRVFLGKPLITEDIASEKLSNGVALGALSPDAVSSVAYGPEQILIELLPHAGLAAFLLLLPITGVILLILVLVAASYRQVVMAYTRAGGSYIVARDNFGPRVAQIAAAALLIDYVVTVAVQSAAGTVAVVSAIPVLGPYSLAITVGVVLVICYANLRGLREAGMPFAVATYSFIVMVGLTIVIGVVRAVIGNLPIYDPAHLAGTVPVHQGNGLVLGATILVLLRAFANGGSSLTGVEAISNTVDYFRKPQGRNARRVLTAMASILGFLLAGVAYLAHVTHATPYLTEYPSVLSQIGHAVYGGGVVGDIFFVMVQASTAAILFTGANTSFNGFPALASFVAEDRFLPRQLTKRGHRLVFSNGIITLTALSVALLVATGGSVNALVPFYAIGVFSGFAMAGYGMTKHHLTHREAGWRHRLTINLSAAVLSTIVVGIFAVAKFTEGAWLVVVVFPLLVFVLTRLNREYRAEAAILEMFRTDRPELVKYARHKVLVFVDSVDLAVIEALRYGRGLRADELVAVHFMVDPAHAAQLRNRWDHFSLDTPLRIVDCPDRRISRSAQLMVAKVRDEHPNTNVTVLLPRRTFARLLGRLLHDRTADKVARAVSQIPDAAATIVPYDVESRIREAYPDTFEQRIAKELDKIQAWVSQDEDQKVAAYEHPARSSAVIMVAGLISGQRATIEGRVSEVEDVAERGGTRRRIVVGDSSGEITVIFHHGHGGADIQPGQLLRISGKARQAGQRELSMVDPAYEVIEDPAREAEESGDSEESGDSQRADKK

SEQ ID NO: 2503 - protein, 763 aa, Mycobacterium paratuberculosis
LPAATATPVAVIGMACRLPGGIDSPQRLWEALLRGDDLVGEIPADRWDADLYYDPEPGVPGRSVTRWGAFLDDVGGFDCDFFGMTEREATAVDPQHRLLLETSWDAIEHAGLDPASLAGSQTGVFVGLTHGDYELLSADCGAAEGPYGFTGTSNSFASGRVAYTLGLHGPAVTVDTACSSGLMAVHQACGSLGGGESDLTLAGGVVVTLEPRKSVSGSLQGMLSPTGRCHAFDVNADGFVSGEGCVMLLLKRLDDARRDGDRILAVLRGTAANQDGRTVNIAAPSETAQVAVYRKALQAADIDATTVGLVEAHGTGTPVGDPIEYSSLAAVYGTDGPCVLGSVKTNFGHLQSASGPLGMMKAILALQHGVVPRNLHFTRLPDEMARINTELFVPQENTQWPSNGHHPRRAAVSSYGMSGTNVHAILEEAPAPEAAGSAAPEAVGPLLFPLSSTSAEQLRVTAARLAAWLDEQAGDALAGPTGWGLRDLGYTLTRRRAHRPVRTVVSASGFAELRTELRAVADGDIPYQPAVGQGDRGPVWVFSGQGSQWSQMGAELLDKEPVFAATIAAVEPLIAAESGFSVTRALSAPPAVTGIDKVQPTIFAMQVALAETMKSYGVRPGAVIGHSLGECAAAVVAGGLSLGDGVKVICRRSRLMARIAGRGAMASVELPGQQVLSELSIRGISGVALSVVASPTSTVVGGGAEAIRELVAAWQQQDVMAREVAVDVASHSPQVESILDELVEVLAELEPTAPEVPYYSATL

SEQ ID NO: 2504 - protein, 1336 aa, Mycobacterium paratuberculosis
VRFAAAVQAALKDGFRVFGELAPHPLLTHAVEQNAASLDVPIAALAAMRREQELPLGLRGFVGDLHSAGALVDFSVQYPAGRLVDAPLPTWSHRRLMLRRESVQRAHGSSVQAVHPLLGAHVHLREEPERHVWQGEVGTDAHPWLADHQIHGVAAFPGAGYCEMALAAAAATLGERAEVRDVTFEQTLLLAGRTEVSSTATVTGPGRLEFTVDTHEDGERIRRAGAVLHALPPEHGGETGPPAHDVATLIADHPSRIEGAELRKAFGAIGIQYGPAFSGLAAVLVGDRDVGTVLAEVALPGAIRSQQSGYGAHPALLDACLQSVIAAPELQRAAAGGLLLPVGVRRLRNYHSTRNAHYCLTRITSSRPGECEADVDVLDQSGTVLLTVEGLRLAGAASEHEHAQRLLDERLLTIEWEARELPEAPQGEPGSWLLLSACDAASNGDDALTTQLADVLKTDGAQCRTVSLPPGAVGTEELRSLLSGGEPGGNGHRPLQRLTGVVVVAAASEAGHPAAPRRGRDYVSHLATVARELSELPGESPRLFVLTRNAAVVVAGDAPNLTQAGLRGLMRVIDAEHPHLSATQIDVDDATDPGHVARQLQSRSGEDETAWRDGQWYTARLRPGPLRPADRRTTVVDHGRDGMRLHIRTPGDLESLELTAFDRVPPGPGEIEVAVASSTINFADVLVAFGRYPMFEGYQQQLGGDFAGVVTAVGPGVTEHRVGDRVGGLSGNGCWGTFVLADARHAVTLPPEIPLRDAAAVPTASATAWYGLHDLARIAPTDKVLIHSGTGGVGQAAIAIARAAGCEIFATAGSPQRRQLLRDMGIEHVYDSRSLEFAEQIRRDTDGYGVDVVLNSLPGAAQRAGIELLALGGRFIELGKRDIYRDSQLGLFPFRRNLSLFAVDLALLTHSHPHTVRRLLTTVYQRTAAGELPMPRTTHYPLQDAAAAVRLVAAAGHTGKVVLQVPRTASSVAALPPEKVRPFRADGAYIITGGLGGLGLFLAGEMACRDGDVGAGRIVLNSRSQPGEQARRAIERLRAAGADIAVECGDIAEPDTAERLVTCATATGLPVRGVLHAAAVVEDATLTNVTDDLIDRCWAPKVYGAWNLHQATAGQPLEWFCLFSSAAALVGSPGQGAYAAANSWLDAFARWRHARGAPATAIAWGAWSQVGRATALAEDAGVAITPAEGFRAFETLLRHDRPYAGYAPIMGTPWLTSFAQRSPFAEAFRSAGQGRPDAGKFLAELRALPREEWPSAIRRLVSGQLSLLLRRTIDPDRPLSDYGLDSLGNLELRTRIETETGVRISPATITTVRGLAEHLCDELADLPAAPPAGAPR

SEQ ID NO: 2505 - protein, 81 aa, Mycobacterium paratuberculosis
MAICDTCGNDYDKAFTVTWTDGRSATFDSVECAAVELAPTCEHCECRILGHGVESGGAMFCGAHCARQAGNHDVSDRGAAG

SEQ ID NO: 2506 - protein, 67 aa, Mycobacterium paratuberculosis
MKKTVEIEVDVNMIDDAIRRFHLADAREAVNLALRTLIDDAGPGHHDGEFGDLGPWRGPEDIATNTG

SEQ ID NO: 2507 - protein, 357 aa, Mycobacterium paratuberculosis
MAEKGSPMLDFGALPPEINSARMYSGPGSGPLTAAAAAWEELAAQLESYAAGYSATLAELRGPAWSGDAAAAMAAAVEPYVAWATGTAARAGQAAAQARAAAAAHEAAFAATVPPHVVAANRIQLATLIATNFFGQNAPAIAATESCYAEMWAQDATAMYGYAAASSAATTLTPFTHPPRTTTAHGQAAQAAAVSHAADSQPPGWSSLVDSVSGFNTVVTTPGQSFFAAARTLLGWGQFGTGLNLANIQAAKAAAGAVRLPAAVAGPSVSGGLGRAATVGRLSVPPAWPAANPVAPLGETVMRQPGGMVRLVSGSAPDSPAGPGIPPALRTADRSAGVPVLRNGRRAFRMPRPAYGG

SEQ ID NO: 2508 - protein, 395 aa, Mycobacterium paratuberculosis
MLDYGALPPEINSTRMYAGPGSAPLIAAAAAWDVLANALETAARGYSAVITRLHGESWSGSASVAMAGAAAPYFAWLAEAGTQAEEAAGQARAAAAAYEAAFGATVPPAVVTANRALFAQLVASNILGQNTAAIGEAEGAYAEMWAQDAAAMYGYAAASSGATRLRPFDEPPRTTNADGPGAQAAAVARSATGSAANQSHASLSRAMSAVPHQLQTLSGAGSSGSSSSSSGSSALSAVDNFNTLTAPVNLGDGISRTVTSGGTFGTGLFRSNLQSAGEAFKAVPGAAAAAGTSTAAGVPGPAVAGAGTATTVGRLSVPQSWAATNPAAGTVAEPLWLSDAELDGGPSWHEGPAAGMWNGAPAAGASSSLLSRPSVNNVLRVAPRQFKMPRPSAGG

SEQ ID NO: 2509 - protein, 230 aa, Mycobacterium paratuberculosis
MSNNITWHEHKISRGEREQLNGHKGCVIWFTGLSGSGKSTVANVVEQKLYERGIRSYLLDGDNVRYGLNAGPDLLEERHGPEFAQRFGLGFSAQDREENIRRIGAVAKLFCEAGIIALTAFISPYVRDRDAIRATLDDGDFQEIFIDTPIEICEKRDPKGLYKKARAGEIKGFTGIDDPYEAPPRPELRLDGAAKDAETLAEEVIAHLERVGVIATDGLAHTRGRDEVTA

SEQ ID NO: 2510 - protein, 419 aa, Mycobacterium paratuberculosis
MNYTGHNGKPLVERVSTENAAARIEGLPRVPISKATAHEVISLSYGFFTPLTGFMGRREVDATLDEFALPDSTLWSIPIVFDMSADDIAERDVKEGASVVLDYLGVPMAILDVTEIYEYDLERMAEKTYGTTDPRHPGVKKTLGYHNRFIGGDITLINEPVFNEPFKSFWLTPRQHQDALAAKHWHRVVAHQTRNVPHTGHEALMKQAWLAANEDQPVDSLNTGVLVNAIIGQKRVGDYIDEAILLAQNALRTSGYFRENVHMVSFTLWDMRYAGPREAIFHAILRTNLGCTHHMFGRDHAGVGDFYHPYDSQNILKQYRNQLGIKPVFLRENWYCPVCLEVTNSALCGHEAQAQSFSGSLIRSILTDEVKPTQKVMRHDVFEVVMECAAKHGQGSPFVTEEYLANRLPVFTLNQLEGS

SEQ ID NO: 2511 - protein, 110 aa, Mycobacterium paratuberculosis
MSSDHDNNGKAIKINVWINEERLEALANAGMAELANEAFAGMKLLEIHTTEEQKNIVLQRFPGAKYDSPTTRSIELLPKQAKDRLLELSIAMHSTGPDVMGRFLEETEPA

SEQ ID NO: 2512 - protein, 579 aa, Mycobacterium paratuberculosis
MHGSSVVSLMRERAGLQPDDVAFRYTDYEQDWAGVAETLTWAQLYQRTSNLAREVARHGDTGDRAVILAPQGLSYIVAFLAAIQAGLIAVPLSVPQPGSHDERVSAVLADTGPAVVLTTAAAAATVTEYLRRPDTGPAPAVVEIDSLDLDEPNSSSIRISAAPDIAYLQYTSGSTRLPAGVMVSHRNLQVNFQQLMAAFFPDFDGVAPRNTVCVSWLPFYHDMGLVQGVIAPILGGYPADLTSPVAFLQRPARWIQAMSRADPVFSAAPNFAFELAVRKTTDADLAGVDLGNIISIVSGAERIHPATLRRFCKRFAPYNFHEHMMQPSYGLAEATVYVASRAEAGGPEVVHFEPEKLSAGSAQRCPAQTGSPLLSYGAPTSPTVRIVDPDTNTERADGTVGEIWVNGENVAQGYWRKPEETRRTFGGVLVNPSPGTPRQPWLRTGDLGFISAGELFIVGRMKDLLIVYGRNHYPEDIESTVQAVTGGRVAAISVPADETEKLVTIIELKRRGDSDEDARRKLDAVKNEVTAAISNSHGLNVADLVPVAPGSIPTTTSGKIRRAACVEHYLRGAFIRLDG

SEQ ID NO: 2513 - protein, 585 aa, Mycobacterium paratuberculosis
MTAPIWMASPPEVHSSLLSAGPGPGPLLAAAAAWSSLSVQYAESADELVTLLGAVRAGDWDGPTAGAYLAAHAPYLAWLARASTDSAAVAAQQEVAAAAYTAALAAMPTLPELAANHAAHAVLTATNFFGINTIPIAVNEADYARMWVQAATVMGTYQDVAAAALAATPHTEPAPRVMAAAAPAARAAQSSSYPPDTQDQWLDWLEKTGFVDFYNRYIQPLIDQLMNNPFFRSLFSGFDPWLPSLGNPLSFLNPFNIAFALGYPMDFGSYFGYLAQMFSFVAADLAAAFASGNPATIAWTLLFTTIEVIGTVITDTIALIKTLLEQMIVLIPAILPLLTVSVVPLVVPTLVGGLAGLTGLAGLHAIPVPPFVPAPNARPGGAGTESAARAGTGPVPRAGAGPDVRGGARRGRTRRAAAHPVGAAGGHPAQPRLPGRRPDRGRAAGRERRRPQTRGGRARKRRGPRGGAAGGRVDAAAPPPGRGQTARPRLRVSGSRAVDDRLAAGCADAGVRRNRGQTRGRRTGGTKRAGARRVRRRPARADDAGHLGWIETVTCTTLLACTSLRCPGPHARPARRRAGAKTPER

SEQ ID NO: 2514 - protein, 530 aa, Mycobacterium paratuberculosis
MAGVGLGQLLLALDATMVSLVDAPRGLDQPVASAALIDSDDVRLGLAAAAGSADVFFLLGVGDDEALRWIDTQARDRVPVAVFVKEPSDALVGTAVAAGSAVVAVDPRARWERLYQLVNHVLEHHGDRADAADDSGTDLFGLAQSLAERIHGMVSIENAQSQVLAYSASNDEADELRRLSILGRAGPPEHLEWIGQWGIFDALRSGTQVVRVAERPELGLRPRLAVGIHQPDPDARRPPVFAGTIWVQQGAQPLADDAEQILRGAAVLAARIMARLAARPSTQARRLQQLLGVTDSETLAPVDLTAIAAELGLAADGCAALIGWAAAEGASRHTRLTDVIALSASAFRHDAHVAGHGSRTYVLLPQPPNRSVSSWVRGTIAALRAELGVQLRAVIAAPVPGLSAVAAARAEVDRVLDSAERHPLSFGQVTSLAEARTTVLLDEIVTLVGRDERLVDPRIVALHDREPVLAQTLRTYLDAFGDIAAAAHALRVHPNTVRYRVRRIEKLLSVSLADPEVRLLFALALRVAER

SEQ ID NO: 2515 - protein, 546 aa, Mycobacterium paratuberculosis
MDAITGISEVPVPANEPVHDYAPRSAERARLRAELAALAGHPIDLPHVIGGRHRMGDGERIDVVQPHRHAAKLGTLTNAVHADATAAVDAAMAAKSDWAAMPFDERAAVFLRAADLLAGPWREKIAAATMLGQSKSAYQAEIDSPCEQIDFWRFNVAFARQILAQQPISGPGEWNRSDYRPLDGFVYAITPFNFTSIAGNLPTAPALMGNTVVWKPSITQTLSAYLTMQLLEAAGLPPGVINLVTGDGFAVSDVALADRRLAGIHFTGSTATFQRLWYQVGTNIGHYHCYPRLVGETGGKDFIVAHASARPDVLRTALIRGAFDYQGQKCSAASRAFIAQSVWRRMGDEFLAETAALRYGDVTDLTNFGGALIDRRAFVKNVDAIERAKGAPHVTLAVGGEYDDSEGYFVRPTVLLSDDPADESFATEYFGPLLSVHVYPDDDYQRILDVVDTGSRYALTGAVIADDRAAVLAAQDRLRFAAGNFYVNDKPTGAVVGRQPFGGSRGSGTNDKAGSPLNLLRWTSARTIKETFVPATDHTYPHMAAD

SEQ ID NO: 2516 - protein, 320 aa, Mycobacterium paratuberculosis
MAGLFAHTLRPAILAAGRRPGLRRAAEALPVTRRVVHRFIAGETIDSALDSVTALRDSGRCVSVDHLGEDVSDADDADAAVRVYLELVDRLGCLGDGAAVRPLEVSLKLSALGQSLDRDGEKIARENAWAICAAAQRAGVWVTVDAEDHTTTDSTLRIVRDLRREFDWLGVALQAYLRRTLGDCEEFAAAGARVRLCKGAYDEPASLAYRDPAAVTDSYLRCLRVLMAGSGYPMVASHDPAIIEAAPSLARESGRGTGEFEYQMLYGIRDDEQRRLAEAGHTVRVYVPFGTQWYGYFMRRLAERPANLTFFLRALAARRH

SEQ ID NO: 2517 - protein, 200 aa, Mycobacterium paratuberculosis
MSTDATPATDTRELIVAAAFTCFGRQGLQKATIVDIAKQAGVSRSTIYEYFSDKAAIVEACAEHASERFYREMAKAMDRGGTLEERLCAAAVFVTQARRVIASEKYFDEDAISLLLTKDAAVLLRECVEFFAPYLAAARLTGEVRKDLDVEAAGEWFARILFSLFSTPSPTLNLDDPDVTAEFVRAHVVRGFASERPRRR

SEQ ID NO: 2518 - protein, 389 aa, Mycobacterium paratuberculosis
MSSILPGAAAIVGIGQTEFSKESGRSELQLACEAVSAALDDAGLTSSDVDGMVTFTMDSSDEIDIARNVGIGDLSFFSRVHHGGGAAAGTVVHAAMAVATGVADVVVCWRAFNERSGFRFGGSGRNMAETPLFMAHYAPFGLLTPAAWVALHAQRYMSTYGVTNEDFGRIAVVDRKHAATNPDAWFYQRPITLEDHQNSRWIVEPVLRLLDCCQESDGGVALVVTSVERARDLRRPPAVIAAAAQGAAADGEMMTSYYRDDITGLPEMGVVARQLWRDSGCKPQDIQTAFIYDHFTPFVFVQLEELGFCGRGEAKDFATVERLSLGGEFPINTNGGLLGEAYIHGMNGITEAVRQVRGTSHNQVADVEHVLVTSGTGVPTSGLILAPAG

SEQ ID NO: 2519 - protein, 153 aa, Mycobacterium paratuberculosis
MTRTANRTLRWQDISVGEEVTPLEIPITTTMIVAGAIATRDFMPVHHDRDYAKKQGSPNLFMNILTTNGYCVRFLTDWAGPEAMVKKLSIRLGVPCFPDDPLRFTGSVTGKTRGPAGPPPAENFVEVTFKASNSLGDHVSGTAVLSLLDGAGS

SEQ ID NO: 2520 - protein, 373 aa, Mycobacterium paratuberculosis
MDFSFTEEQETIGKLARDLFERRATPERLTELEVGDTRHDAALWEELAAADLLGAALPEAVGGSCASGGGFVELGVLLAEVGYGVAPVPAYATLVLGADSIARHGSSEQQQRVLPGVIAGSRILTAGLAEPGRSDPARPATTARRDGPNWRLDGAKELVPAAQLADTMLIPAVLDDGDVGLFLLAADAAGVEIRPVPTTNREPHADVFLAGARVSETDRIAGIGLVESLLTRALVALCAIQLGVVERALRIAAKYTTGREQFGRPIGSFQAVQQRMADAFIDVEAIRWTTWQAAWLVAHGRPADRAARIAKFWAAEAGARVAATAQHVHGGIGIDVTYPLHRYFLWAKHNELTLGPASAQLAHLGATYSEGHA

SEQ ID NO: 2521 - protein, 134 aa, Mycobacterium paratuberculosis
MAARLAPAITADTEFFWNGLRENKLLIQRCSGCGQLRHPPRPMCPHCRSLDWEAVESSGRGTVYSYVMPHEPKFPFFEYPYIVVLVELEEGVRLVSNLTGIDPAEVTPGLPVEVYYQTFDGSQNLVLHQFRPSA

SEQ ID NO: 2522 - protein, 181 aa, Mycobacterium paratuberculosis
VTDSETVSAKVRALVGQPTGGTGKPSLAPDPVNQPMIRHWAYAMADMNPVYLDPEFAASSRFGGIVSPPVMLQTWTMPSPKLEGIGERGGAPVEIDSSPTAFLDEAGYTSTVATNSEFEIERYPRLGDVISATTVYESVSDEKKTALGTGFFLTWLTTYTDQNGEVLGRQRFRVLRFRPAG

SEQ ID NO: 2523 - protein, 394 aa, Mycobacterium paratuberculosis
MDLEYTPEQQQLRAEIRATLQTVMTPERVAAVSEQMDGGPAVRECVRALAAANLLGVGWPKEYGGRGFSAIEQFIFAEEARRVSAPIPLVTLNTAGPTLMHYGTDEQKRRFLPAILDGTVEFAIGYSEPGAGSDLASVHTTAVRVGDEYVINGQKMFTSGAAYADYIWLAVRTDPDAKKHKGISILIVPTSSPGFSWQPLHTMPGISTFYTFYDDVRVPVSALVGAENQGWQLITTQLNFERAALGNLGALEPLFDKTLDWALSTELDGGRVIDQPWVRSALARVEAQVAAYKLVNLRVNAAMTKGALNMGEASAAKVFGTELTQQVARELLEVLDGNGVRRGAEAPLRGALESAYRQAVINTFGGGANEIQRDIIAMAALGMPRAPRDLRAAN

SEQ ID NO: 2524 - protein, 398 aa, Mycobacterium paratuberculosis
VQTHPPLRSPSFPLHSPDFYAGNPYPAYRELRATAPVCWNDVTNFWALLKYEDIRFVSSNPALFTSTRGITIPDPQLPNPVQQGSLIFTDPPRHRQLRKLINSGFTRRRVSVLEPKIRKIVRGILDGIERGAVHEFAEQIAAPLPTRMIAELIGAPPDDWEQFRAWSDAATGTADPEIELDPAVAAGQLYEYFQRLIAARRARPRADLLSVLAEAEIDEHRLTDEDLLNFAFLLLVAGNETTRNLIALGTLALIAHPDQYRLLVEEPARIPLAVEEMLRWNSPVVHMARTATADVEIRGQRIRAGEVVVMLYGSANRDEDVFGPDSEEFDVTRHPNPHIAFGCGEHSCVGAQLARLEATVFFEELLRRYPRIELVGEVDRMRATMVPGVKRMPVRMGA

SEQ ID NO: 2525 - protein, 486 aa, Mycobacterium paratuberculosis
MADPPALVQTYQLYIDGQWVEPQDGRYDDLSPSTEAVIATAPDASVAQVDDAIAAARRAFDSGPWGRMSAEQRARCLNQLGEALTKHADDFFALSQTEWGCIGNERIMQIDGAGFMSLHAAQLATQLVDQEVAGISAGTTLLRHVPLGVVAVLTPWNFPHCLNVMKLNHALAAGNTVVLKPSPLTPLAGLALARLIDEHTDIPPGVVNVVTPSGVEAAKLLTTDPRIDMVSFTGSSAVGRQVMSAAGDTIKRILLELGGKSASIVLDDANVTDEMLEQMLFQSCSLHAGQACILHSRLLLPDSLHDDVVDRLAALAREVKVGDPTDPDVQMGPLISAAQRDRVEAHIAGARSDGATLVTGGGRPAGLDVGYYVEPTILSGVEPNSTIAQEEVFGPVLSVLRYRDDDDAVAIANNSRYGLSGAVWGDDVDRAVGVARRIRTGQIAVNGISPAGAPFGGFRLSGLGREGGGIGGLHQYMEPMAIGVPA

SEQ ID NO: 2526 - protein, 763 aa, Mycobacterium paratuberculosis
VTAPLAGLHVVEIASEISGPYATKLLVDLGAEVIKIEPPAGDPLRRWGPFASGVVDPDRSGLFEYINAGKHAATLDFSETADVAAARELIARAHLLIDDSGPATLQGYGLGPDDLQRINPNLVLLRISGFGQTGPFRRRPATPLTLQAASGWISSRDPQRPPVQVGARIAEYVAGAYGALGALTALRSHPAGHVTEVDVSQLESLLSTLPYPMLMAQRMRRLGLPANLRSAPMLGVVRAADGWVGINCLTGQHWLDVCAMLGLPEFGEHQLAIMLGGPERADFFAKAEPVLAGQTVAEIVELAQALRIPAAPVNDGATVLDCPQYAERGFFVDTGSFRRPGPPFRFSKTPVPQPRPAPLSGASRTTWTGDGRALHRAPGPLPFAGLRVLDLTTYWAGAYLTCYLGAFGADIVKVESIQRPDGHRYSGAFAYEGDDWYERSPIWQGTNLNKRDLTLDLTSPRGLDLARRLAARADIVVENFSPRVVENFGLDYDSLTALNPDVIVVRMPGYGLHGPWRDYVGWALNFEQTAGMSAVTGFPDGPPCNPQGPADPIVGVHAGVALLAALEHRNRTGAGQLVEVAQIEVAAAVTATPVIEYSMTGVVRPREGNRRRGCLQGVYPTNEEEVWVALSVPGRPIDHDAFDELVAAWTRTQTAAAIVETLQAQGIAAERVITGDQMYDPELIGAQLDVRGYYEELEHRITGPHRYPGWPFRIAPGPRRHHRTAPPTLGQHNDEVLRELGLSEAEIADLRQQRVIGERVLNA

SEQ ID NO: 2527 - protein, 302 aa, Mycobacterium paratuberculosis
MAIEIARPKLEGNVAVGEDRQIGFAEFGDPQGRAMFWLHGTPGARRQIPVEARLYAENHKIRLIGLDRPGIGSSTPHRYQNIRAFGEDLRTIADTLGIHKMAVIGLSGGGPYALASAAVLPDRVVAAGILGGVAPFLGDEGITSGLMNLGKRVAPLLKLGGDPLRIGASLVVRAIRPVANPALYLYAAISPEGDRRLLTRPEFGAMFLDDLLNGSRKQLAAPFNDIILFTQDWGFRLDQVKVPVRWWHGDSDHIVPFAHGQHVVSLLPDAELFVLPGESHLGGLGRGEEILSTLTKIWDEQN

SEQ ID NO: 2528 - protein, 473 aa, Mycobacterium paratuberculosis
VLLTSLNPSAVTATDIPDAVRIDGTVLSRADLLGAATSVAERVAGAGRVAVLATPTAATVLAVTGCLIAGVPFVPVPADVGAAERRHMLADSGVRAWLGPLPDEPDGLPHVPVRLHARSWHRYPEPSPDATAMIIYTSGTTGLPKGVVLSRRAIAADLDALAEAWQWTADDVLVHGLPLFHVHGLVLGLLGSLRIGNRFVHTGKPTPAGYAQARTDFGGTLFFGVPTVWSRVVADDAAARALRPARLLVSGSAPLPVPVFDRLAGLTGHQPVERYGASESLITISTRADGERRPGWVGLPLTGVQTRVVDDDGNPVPHDGETVGKLLVRGPMMFDGYLNRPDATAEAFDADGWYRTGDVAVVDDAGMHRIVGRESVDLIKSGGYRIGAGEIETALLGHPGVAEAAVVGMPDEDLGQRIVAFVVPAGRVNPDDLIDHVAQQLSIHKRPREVRVVDALPRNAMGKVLKKQLLSDG

SEQ ID NO: 2529 - protein, 444 aa, Mycobacterium paratuberculosis
MGEPSVRATTPGTPMRRIAAACLVGSAIEFYDFLIYGTAAALVFPAVFFPRLGPTVATIASMATFATAFLSRPLGAAVFGYFGDRLGRKKTLVATLLIMGASTVSVGLVPSTASIGIAAPLLLTVLRLLQGFAVGGEWAGSVLLSAEYAPTDRRGWYGMFTLLGGGTAGILASLTFLAVNLTMGEHSPAFMHWGWRVPFLISSGLIGIALYVRLNIDETPIFVEEKARHLVPKAPLTELLRLQRREIILVAGSFVGGMGFIYLGNTFLVMYAHNHLGYSRSFIWGIGALGGLTSMACVACSAWISDRVGRRRVMLWGLVACLPWAFVVIPLIDTGRPVCYVVAVLGMFGTAAVANGPTAAFVPELFATRYRYSGAAVAMNLAGIVGAAVPPLLAGTLLATYGSWAIGLMMASLVLASFVSVYLLPETRGAALDAAAAAEKVAAR

SEQ ID NO: 2530 - protein, 317 aa, Mycobacterium paratuberculosis
VTTAAGAAGVGLATLAADGSILDTWFPAPELTGPGTSGTSRLALSDVPPELTALIGRDDDRGTETVAVRTVIGSLDDVAADAYDAYLRLHLLSHRLVAPHGLNAGGLFGVLTNVVWTNRGPCAIEGFEAVRARLRRHGPVTVYGVDKFPRMVDNVLPTGVRIADADRVRLGAHLAPGTTVMHEGFVNYNAGTLGASMVEGRISAGVVVGDGSDIGGGASIMGTLSGGGTEVISIGKRCLLGANAGLGISLGDDCVVEAGLYVTAGTKVITPEGKQLKARELSGGNNLLFRRNSLTGAVEVVARGGTGITLNEDLHAN

SEQ ID NO: 2531 - protein, 406 aa, Mycobacterium paratuberculosis; identical to SEQ ID NO: 1515

SEQ ID NO: 2532 - protein, 278 aa, Mycobacterium paratuberculosis
MSFVTTRPEALLAVASMLEGLGSSMDAQNAAAAAPTTSIAPAAADEVSALQAAQFSAYGTWYQQVSAQAKAIHQTLVQNLDTNADSYGATEAANRVNTSAAALQGLAPNVIPNAAPAADPPPAGTTSLGTSIGWAQNVGAAASDFITLGEGQFAPVPGAAGIPNFNPGLTAATTAGPPAPAAPAAAAGAPVLASMGRGPSIGGLSVPPSWAPGGVAPAANATPAQLVGAGFTSAAPDTAPVTAVPGGVPSMATAGRGGYGLGAPRYGVKPTVMPKPAI

SEQ ID NO: 2533 - protein, 383 aa, Mycobacterium paratuberculosis
MTFDFGALPPEVNSTRMYTGAGAAPMMAAAAAFSNLADELSTTAAATQSAIANLTGEEWMGPSAAAMVTAVQPYVQWMHTTAGQLQQAAAQAMASAAAYETAFAMTVPPALVAANRAQLAALIASNVLGQNAAAIAATEAQYGEMWAQDAAAMYGYAASSATAGKLSPLTSPAPTNQPGGLGAQAAAVSGATATSAQTSGLQGTVANVPNVVRTLAAPADPPGLTALDNLLGNPVVNNVGNAGFDVVSWNVFNTIVSNILYNHTLDTAAAAGVAGEVGGAVGGGALVGAAAPATAGVGAAPVLASMGSAATVGELSTPATWSAPTPEPAATTVGATEWASPAEEPHTAWATGMPAVASAGRGGYGMGPRYGVKPKVMPTRLPV

SEQ ID NO: 2534 - protein, 354 aa, Mycobacterium paratuberculosis
VLDLTGDPVALTAALVDIPSESRDEARLADEVEAALRSQTSGFEIVRNGNAVLARTDRGRRSRVLLAGHLDTVPVAGNLPSRREDGDLYGCGTADMKSGDAVFLHLAATVADPAHDLTLVMYDCEEIDAAANGLGRIQRELPDWLSADVAILGEPTGGYIEAGCQGTLRVVVSAAGTRAHSARSWLGDNAIHKLGAVLQRLAGYQARSVDIDGCTYREGLSAVRIDGGVAGNVIPDAAAVTVNFRFAPDRSPAEALQHVRDVLDGLDVHIEQTDAAAGALPGLSQPAAKALVEAAGGRVRAKYGWTDVARFAALGIPALNFGPGDPNLAHRRDERVAVAAITAAADLLRGYLSG

SEQ ID NO: 2535 - protein, 138 aa, Mycobacterium paratuberculosis
LSRAETRHGTKSALFAPELGVARAHRLALMRDAHGAVAAARDAARMAERGGQRAVAVRVWHEAVRLGDTRAAEPLARLCDEIDCAAARIALAHARALAAGDEAALLAVSGELTSIGMRAAAADAAAQARRGAAAQPLR

SEQ ID NO: 2536 - protein, 605 aa, Mycobacterium paratuberculosis
VPIRWNVPRQATAAERLDAALADTAAAAGAVVLGPDGIGKSTLARVAAERFAAAHPGTRVRWVTGTPTERAVPFGAFSHLVRIAEIGKPAALLRAARASLGDAGLLLVVDDAHQLDVLSATLVYQLARAGAARLIVTARADGAPDAIAALWDDGLLTRIDVEAPDAPTSPGEIDAFLAELTPPAHAVLEYLAVAEPLSVTDLNALAGDGAVAEAQRWGAAETRMRGGTSDDPVVYTAHPLFAERVRAALDPDDARQRRTELVTVLERHPSDRLSDRLRLVSLALDSDAPPRAADVVDAARQALRLGDLALGERLARAALRRSGGLAARLAPGACAGLAGPRPGGRRAAGRGRLHRLDRGRADGLGPAAGGEPVLDAQRAGAGHRLPAHRPQPRRGPRPAHHPGRAQRHLRDERGQRRARRQGRRRGARLARRRRPGGGLVGQRGRVVRGAAGAVRRRRAVGAASVGRRTSRAAALHHRAGADHHAVAGGPARAGPRTRAAVHRFRRAAAAGPRDRRGAAGARAARRGRIRFCGRVIGSGRGHLGAHRLLVGAVVADPAGHRAGPAGRHRRHGKGIEPGRNPAWHQVGAVRARARGGAGASAGPDA

SEQ ID NO: 2537 - protein, 187 aa, Mycobacterium paratuberculosis
MPAERDSSAAWAVCVYCASGPQHPELLGVAAELGEAIAERGWTLVWGGGRVSAMGAVASAARARGGRTVGVIPTVLMRREIADADADELIVSDTLHERKQIMEDRADAFIALPGGIGTLDEVLDAWTTGFLGLHAKPIVLLDPIGHYEGLWLWLSGLLDSGYITQAAMDRVVLVDKVGAALEACAPG

SEQ ID NO: 2538 - protein, 592 aa, Mycobacterium paratuberculosis
VSDRDGGARTAVKLTDIAARVPTVLADLPVIARGTLTGLLAQPGSHKSIGTVFQDRAARYGDRVFLRFGDQQLTYRDANAAANRYAAVLAARGVGHGDVVAIMLRNSPNTVLAMLAAVKCGAVAGMLNYHQRGEVLAHSLGLLDAKVLIAETDLVSAVAECGGSGSTETLTAEDLERFAVSAPATNPASASAVQARDTAFYIFTSGTTGFPKASVMTHLRWLKALAAFGGIGLRLKSSDTLYCCLPLYHNNALTVALSSVINSGATLALGKSFSASKFWDEVIANDATAFIYIGEVCRYLLNQPAKPTDRAHRVRLIAGNGLRPEIWDEFTQRFGIARVCEFYASSEGNAAFINVFNVPRSTGIFPLPLAYVEYDPDTGAPLRGDDGRVRRVPPGQPGLLLSPVNRLQPFDGYTDPESSEKKLVRNAFRDGDCWFNTGDVMSPQGLGHAAFVDRLGDTFRWKGENVATTQVEAALASDGSVEDCTVFGVEVPRTGGRAGMAAIKLRDGAEFDGRSLARTVYEQLPVYALPLFVRVVDSIEQTTTFKSRKVELREQGYGPEVKDPLYVLAGRDEGYVPFYDEYPDEVAEGKRP

SEQ ID NO: 2539 - protein, 307 aa, Mycobacterium paratuberculosis
VRPGPARPRPTRHHRPVQSTFCGRPVAGDRALIMAIINRTPDSFYDRGATFSDDAARAAVHRAVAEGADVIDVGGVKAGPGQDVDADTEIARLVPFIEWLRDAYPDQLISADTWRAEVAKVACAAGADLINDTWGGVDPALPEVAAEFGAGLVCSHTGNALPRTRPFRVSYGTSTRGVVDDVIAQVTAAAERAVGCGVAPDRVLIDPTHDFGKNTFHGLLLLRHVGDLVNTGWPVLMALSNKDFVGETLGVELTERLEGTLAATALAAAAGARMFRVHEVAPTRRVLEMVASIQGTRPPTRTVRGLA

SEQ ID NO: 2540 - protein, 329 aa, Mycobacterium paratuberculosis
MTTSDLVAGELAGDGLRDTRPGDTWLADRSWNRPGWTVAELEAAKAGRTISVVLPALDEEDTIGSVIDSISPLVDGLVDELIVLDSGSTDDTEIRAVAAGARVVSREQALPEVPIRPGKGEALWRSLAASRGDIVVFVDSDLINPHPMFVPWLVGPLLTGDGVHLVKSFYRRPLNVGDAGGGAGATGGGRVTELVARPLLAALRPELGCILQPLGGEYAATRELLTSVPFAPGYGVEIGLLVDTFDRLGLDAIAQVNLGVREHRNRPLAELGAMSRQVIATLLSRCGIPDSGVGLTQFVADGPEGQSYTQHTWPVSLADRPPMQAIRPR

SEQ ID NO: 2541 - protein, 116 aa, Mycobacterium paratuberculosis
VALVLLYLVVLVLVAIVLFGAASLLFGRGEQLPPLPRGTTATVLPAYGVTGSDVDAVKFTQVLRGYKTSEVDWVLDRLARELEALRGQLAAAHAAAGEQQSGGQSAEPDDGADRQD

SEQ ID NO: 2542 - protein, 193 aa, Mycobacterium paratuberculosis
VSDDEPIRCGWATARSGPDFELYRDYHDREWGQTVRDGVALFERMSLEAFQSGLSWLTILRKRENFRRAFSGFDIDAVAGYTDADVQRLMADPGIVRNRAKIEATIANARAAAELGGGTQLAELLWSFAPAPRSRPADASEIPSATAESTAMAGELKRRGFRFVGPTTAYALMQATGMVDDHIRGCWVPAAVR

SEQ ID NO: 2543 - protein, 557 aa, Mycobacterium paratuberculosis; identical to SEQ ID NO: 1700

SEQ ID NO: 2544 - protein, 390 aa, Mycobacterium paratuberculosis
MRVAMMTREYPPEVYGGAGVHVTELVTQLRRLCAVDVHCMGALRPGAAGVQVHQPDPRLQGANPAMSTLSADLMMANAAAQASVVHSHTWYTGMAGHLAALLHDIPHVLTAHSLEPLRPWKAEQLGGGYRISTWVEHTAVLAAHAVIAVSSAMREDILRVYPALDPSAVHVIRNGVDTDVWYPAGPVQTGSMLAELGVDPARPLVVFVGRITRQKGLAHLVAAAHRFSPEAQVLLCAGAPDTPEIADEIRDAVAALARGRTGVFWIREMLPIGELREILSAASVFVCPSVYEPLGIVNLEAMACAAPVVASDVGGIPEVVADGVTGSLVHYDPRDPAGYQAGLAEAVNELIADREKAQRYGRAGRQRCVEEFSWAHVAEQTLEIYRKVCA

SEQ ID NO: 2545 - protein, 404 aa, Mycobacterium paratuberculosis
MREAPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRLHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 2546 - protein, 564 aa, Mycobacterium paratuberculosis
VPPTRMTALDRPWRRPGALRYALNRIRGVAKPPVTVTDPPADLHVERDVAVPTRDATVLRINVFRKPDAGPRPVILSIHPYGKDNLPKRRGNRWTFSAQYRILRQPRPVTFSALTGWEAPDPAWWTAQGFVVVNADSRGCGRSEGTGNLLSHREAEDTYDLVQWIAGQPWSDGNVVMLGVSYLAISQYAVAALQPPALRAICPWEGFTDAYRDLMFPGGVRELGFIRMWSRNVRRDTRQAYDLQDMQDRHPLRDEFWRSLVPDLSAITVPMLVCGSFSDNNLHSRGSLRAFTHSSSTHARLYTHRGGKWATFYAEEALAEQLSFFRGVLDGAPAARSVRLEVREDRDTVTAVREESEWPLARTRWRALHLGDAGVLRTDPAAQPGRVTFGTRSRAACFTWNVPDDVELTGPMAARLWVELHGCDDANLFVGVEKWRPGRFRDRFVAFEGSYGYGRDRVSTGWQRVSLRALDSRLSRPGQPVAACTDPQPVAAGEVVAVDVALGPSATLFRAGEHLRLVVAGRWLCPTNPLTGQIPAAYQNSPRGRVSLHWGPRRDAHLLIPEIP

SEQ ID NO: 2547 - protein, 225 aa, Mycobacterium paratuberculosis
VMKTGLRVTATSVWGILSWILILLLPAGTLHYWQAWVFIAVFTVATIVPAAYLARTNPAALQRRMRAGPRAEPRTAQKFIITGSFLGLFAAMVFSALDHRFGWSSVPAWLSLLGDVLVATGLGIAMLVVIQNSYAAATVTVEAGQTVVSSGLYRFVRHPMYTGNVIMMIGIPLALGSYWGLLFVVPGTALLALRMFDEEKLLLQELPGYPDYTQKVRYRLAPYLW

SEQ ID NO: 2548 - protein, 547 aa, Mycobacterium paratuberculosis
MSATTLNRPSASASPAPLGGSHFSGTLQMLRLYLRRDRISLPLWVLLLSVPLSTVYVGSIEKVYPTAAARAGFAASIMASPAQRALYGQVYSDSLGAVGIWKAGMFHVLIAVAVILTVIRHTRADEENGRTELVDSTAIGRYAGLTAALTLSFAASIATGAIGAAGLLGTDVPAGGSLAFGAALAWSGLVFTAVAAVTAQLSPSARFARGAAFAVLGTAFTVRAVGDAGPGGLSWLSPLGWSLLVKPYAGDRWWVLVLHLVTTAGLTVLAYRLLAGRDVGAGLIAERPGPATAAPRLGNAFGLAWRLDRAALLLWTAGLALYGLLIGSVVHGIGDELGDSGQARDIVARMGGTSALEDAFIAVAFAMMGMVAATFAVSLTLRLHQEESSQRAETVLAGAVSRTRWLASHLVIALAGSGVAMLASGTVAGLVYGIAAGDVGGKLAMVVASAAVQLPAVWLLSAVTVCVFGVAPRFAPVAWGVLIGFVALYLIGSLAGFSQWLLHLEPFAHIPRVGADFTAVPLLWLLAIDIGLTILGAMAFRRRDLRC

SEQ ID NO: 2549 - protein, 257 aa, Mycobacterium paratuberculosis
VKADGGTVRLLGGDPWTQAVELHRQIAYVPGDVTLWPSLTGGEIIDLLARMRGGIDKKRRAELIERFDLDPHKKARTYSKGNRQKVSLISAFSSRARLLLLDEPSSGLDPSMENVFQQCVAQARDRGTTVLLSSHILAETEALCERVTIIRAGKTIESGSLSSMRHLSRTSIKAEMTGDPGDLRRIKGVEDISIEGNTLRAQVDSESLGELIRVLGDARVRSLVSQPPTLEELFLRHYDTSGTDGQRRAHEAEVSLS

SEQ ID NO: 2550 - protein, 267 aa, Mycobacterium paratuberculosis
MRSADLTAAARIRDAAIEQFGEHGFGVGLRRIAEAAGVSAALVIHHFGSKEGLRKACDDHIAEQIRESKTEALQTNDPAVWFGQLAEIEEFAPLIAYVLRSMQTGGDLAKMLWRQMIENAEGYLEEGVRAGTIKPSRDPRARAKYLGITGGGGLLLYLQMHDNPTDLRAVLRDYSRDMILPALEIYTEGLMADRTMYDAFLAAEDQGDSPWQLTVLRPSRSAGSPRTSVRCGHWTVSTSPCGREKSTVSWGPTAPASRPRSASCWDW

SEQ ID NO: 2551 - protein, 244 aa, Mycobacterium paratuberculosis
VSAGSGSGAPVGLRGELEYAAGMDGTDAEAPGQTAPSRAESLVAHAEASISEDALLAAARERAVDIGAGAVTPAVGALLSLLTKLSGGKAIAEVGTGAGVSGLWLLSGMSDDGVLTTIDIEPEYLRLAKQAFAEAGIGPSRTRLIGGRAQEVLTRLADEYYDLVFIDADPIDQPDYVVEGVRLLRPGGVIVVHRAALGGRAGDPAARDAEVVAVREAARLIAEDERLTPALVPLGDGILAAVRD

SEQ ID NO: 2552 - protein, 251 aa, Mycobacterium paratuberculosis
MDRGARETGNTEWQLPVAANDEMPLIGMPNSEELIITTLLSPSSMSHAHDPSADGWAEPSDGLQGTAVFDATGDKTAMPSWDELVRQHADRVYRLAYRLSGNQHDAEDLTQETFIRVFRSVQNYQPGTFEGWLHRITTNLFLDMVRRRSRIRMEALPEDYERVPADEPNPEEIYHDSRLGPDLQAALDSLPPEFRAAVVLCDIEGLSYEEIGATLGVKLGTVRSRIHRGRQALRDYLAAHPDHDALRASSA

SEQ ID NO: 2553 - protein, 133 aa, Mycobacterium paratuberculosis
MNGKELAMPDRGHVFRRAFSWLPAQFASQSDAPVGAPRQFGSTEHLSVEAIAAFVDGELRMNAHLRAAHHLSQCAQCAAEVDDQSRARAALRDSRPIRIPANLLGMLAEIPYESPDTPDRLADRDARDRRRRP

SEQ ID NO: 2554 - protein, 504 aa, Mycobacterium paratuberculosis
VTSDPGYDQAKDSANRLAPRPISRPPVDPASRREFGRPAGLRGSFVAERVRPKKYREQSEFRPSEQPADPVLQEAFSRPDGSPETLQRHPVDSGALAAEKDGVEPDHADDPWRDPGAPAALGTPAVAPSPSRSALGYGGKLGVRDVLFGGKVSYLALLVLLLIALVIGLIGGVVGRKTAEVAEAFTTSKVTLSTNGNGEAPAGRFAKVAAATAGAVVTIESKSDQEGMQGSGVVIDGRGYIVTNNHVISEAANNPSQFKTTVVFNDGKEVPANLVGRDPKTDLAVLKVDNVDNLSVARLGDSDKVRVGDEVLAAGAPLGLRSTVTHGIVSALHRPVPLSGEGSDTDTVIDAVQTDASINHGNSGGPLIDMNSQVIGIDTAGKSLSDSASGLGFAIPINEAKEVAQTLIRDGKIVHPTLGVSTRSVSNAIASGAQVANVKAGSPAQKGGVLENDVVVKVGNRKVADADEFVVAVRQLTIGQDSPIEVVRDGRHVTLTVKPDPDGS

SEQ ID NO: 2555 - protein, 131 aa, Mycobacterium paratuberculosis
MLGSLSWEHMLVLVVVGLVVLGPERLPGAIRWTSNALRQARDYLSGVTTQLREDLGPEFDDLRVPLSELQKLRGMTPRAALTKHLLDGDDSFLTGAFDRPVNGAAAQPPPAPAPPPEPHRSGQTPFDADAT

SEQ ID NO: 2556 - protein, 386 aa, Mycobacterium paratuberculosis
VMSRHDSSDSAADLSAAVRAALGKVIDPELRRPITELGMVKSIDTEPDGAVHVAIYLTTAACPKKTEISDRVTRAVADVPGTGAVKVTLDVMSDEQRTELRKQLRGDAREPVIPFAQPNSLTRVYAVASGKGGVGKSTVTVNLAAAMAARGLSVGVLDADIHGHSIPRMMGTTDRPTQVESMILPPIAHDVRVISIAQFTQGNTPVVWRGPMLHRALQQFLADVYWGDLDVLLLDLPPGTGDIAISVAQLIPNAEILVVTTPQLAAAEVAERAGSIALQTRQRVVGVVENMSGLTLPDGSTLQVFGEGGGQQVAERLSRAVGAEVPLLGQIPLDPALVEAGDSGTPLVLSAPDSPVGKALRAVADSLSSRRRGLAGVSLGLDPTRR

SEQ ID NO: 2557 - protein, 454 aa, Mycobacterium paratuberculosis
VRIGGSRGADPAAATVRQRALRNTRKPIFGIAMITPLVFAGAVSATGPSLPVRTPPVHAAVTPVAAVSPTFPDLAGPAVVAIDRGPTAFHVAEPALSAPPPAAIVNAPGALGIPSIALAAYRNAEQKMAVAAPGCGVSWNLLAGIGRIESGHAGGGAVDARGTAITPIYGPSLDGTLPGNEVIIQSAAGNRVTYARAMGPMQFLPGTWARYASDGKGDGVADPQNLFDSTLAAARYLCSGGLNLRDQSQVLTAILRYNNSMPYAQNVLGWAAAYATGVVPVDLPPMTGPPPPLGDAHLEHPEGLGPNLPMNINGLPLDDPLARVPLIDLSSPALGSPQPMFPWMTPTPQQAPTQVPGCTVICISSQGSPPAGPPPFGAPPPFAPPPSGPPPFAPPPSGPPPFGPPPPDAGPVPAPPAGVAPQAAPSPPAGPAPQAPSPAAAGPAPNAPKKPGPV

SEQ ID NO: 2558 - protein, 180 aa, Mycobacterium paratuberculosis
VSKSTAVRRLYTPRTSRRYSPRLDPETVGQITESIARFFGTGRYLLLQTIVVAVWIVVNVFAVRLRWDPYPFILLNLAFSTQAAYAAPLILLAQNRQENRDRVALEEDRRRAAQTKADTEYLARELAAVRLAVGEVVTREYLRHELDDLRELLAELRPQSADGEPVSDADNREQTAKKSR

SEQ ID NO: 2559 - protein, 435 aa, Mycobacterium paratuberculosis
MGSVNRVYIARLARILVLGPLGESVGRVRDVVISISIVRQQPRVLGLVVDLATRRSIFIPILRVAAIDPNAVTLSTGSVSLRHFEQRPGEVLAIGQVLDTVVKVNDPELPELAGVDVVVTDLGIEQTRTRDWMVTRVAVRPQRRLRRRGPVHVVDWRNVQGLTPSALALPGQAVAQLLEQFEGRKPVDVADAIRGLPPKRRYEVLKALNDDRLADILQELPELDQAEVLSQLGTERSADVLEEMDPDDAADLLGVLNPTDAEMLLKRMDPGDSASVRRLLTHSPDTAGGLMTSNPVVLTPDTAVAEALARARDPDLTAALSSMVFVVRPPTATPTGRYLGCVPLQRLLREAPAELVGGIVDSDLLTLRPETPLVAVTRYLAAYNLVCGPVVDDENHLLGAVTVDDLLDHLLPPDWRVDMQELDTAGRLEGLGGSG

SEQ ID NO: 2560 - protein, 69 aa, Mycobacterium paratuberculosis
LAIASLIASFTGLLCGIGSVVAIVLGAIALDQIKRTRQDGFGLAVAGIVIGIATLVVTLVVVLFALHTH

SEQ ID NO: 2561 - protein, 174 aa, Mycobacterium paratuberculosis
MTSPFQPGQVPGAPPPGAGGRRGVPGLPTPPRGWPVGSYPTYAEAQRAVDYLSDQQFPVQQVTIVGVDLMQVERVTGRLTWPKVLGGGVLSGAWLGLFIGLVLGFFSPNPWGALATGLVAGVFFGLITSAVPYSMARGTRDFSSTMQLVAGRYDVLCDPQNAEKARDLLARLAI

SEQ ID NO: 2562 - protein, 470 aa, Mycobacterium paratuberculosis
VVIGRGRVRRAGAVALATLTIAAASSACVAGPRGLVISFYTTATDGATFAAIAQDCTRQFGGRFAIQQISLPRAPGEQRLQLARRLTGRDRTLDIMSLDVVWTAEFAEAGWALPLSDDPAGRAEADATVDTLPGPLSTARWHDRLFAAPVTTNTQLLWYRPDLVLQPPRTWDAVVTEAARLHAAGRPSWIAVQANEGEGLVVWFNTLLASGGGRVLSEDGRRVTLTDTPAHRAATVNALRILKSVATAPGADPSITRTDEGTARLAVEQGRAALAVNWPYALASMLDNAVKGGVPFLPLNRDPRLAGSINDVGIFVPTDEQYRIAYQASQKVFDFAPYPGAAPGLPAKVTIGGANLAVASTTRHRAEAFEAIRCVRSLQHQKYVAIQGGLPPVRTSLYSDPQFQTKYPMYTIIRRQLTDAAVRPATPVYQTVSIRLAATLSPITGIDPERTADQLSVEVQKAVDGKGLLP

SEQ ID NO: 2563 - protein, 311 aa, Mycobacterium paratuberculosis
VTATLGETRPTPTSSAAPSVLGRTSEQRLALVLVAPAAILMLAVTAYPIGYAVWLSLQRNNLAAPHDTAFVGLSNYATILSDRYWWTALAVTLGITVVSVSAEFVLGLALALVMHRTLIGKGLVRTAVLIPYGIVTAVASYSWYYAWTPGTGYLANLLPHGSAPLTAQIPSLAIVVLAEVWKTTPFMSLLLLAGLALVPEDLLKAAQVDGAGAWRRLTRVTLPIIKPAVVVALLFRTLDAFRIFDNIYVLTNGANNTGSVSMLGYDNLFKGFNVGLGSAISVLIFGCVGLIALVFVKVFGAAAPGGDVDGR

SEQ ID NO: 2564 - protein, 268 aa, Mycobacterium paratuberculosis
VLWAVIDTLVVVYALLPVLWIFSLSLKPTSTVKDGKLIPSAISLENYRGIFRGDFFSSALINSVGIGLITTAVAVLLGAMAAYAVARLDFPGKRLLIGATLLITMFPAISLVTPLFNIERFLGLFDTWPGLILPYITFALPLAIYTLSAFFREIPWDLEKAAKIDGATPAQAFRKVIVPLAAPGVVTAAILVFIFAWNDLLLALTLTATKAAITAPVAIVSFSGSSQFEEPTGSIAAGAVVITVPIILFVLIFQRRIVAGLTSGAVKG

SEQ ID NO: 2565 - protein, 392 aa, Mycobacterium paratuberculosis
MAEIVLDHVSKSYPDGATAVRDLNLTIADGEFLILVGPSGCGKTTTLNMIAGLEDISSGELRIGGERVNEKAPKDRDIAMVFQSYALYPHMTVRQNIAFPLTLAKMKKPEIAQKVAETAKILDLTDFLDRKPSQLSGGQRQRVAMGRAIVRHPKAFLMDEPLSNLDAKLRVQMRGEIARLQKRLGTTTVYVTHDQTEAMTLGDRVVVMHSGVAQQIGTPDELYENPANLFVAGFIGSPAMNFFPATLTPIGLKLPFGEVMLTPEVQQVIAEHPEPDNVIVGARPEHLSDAALIDGYQRIRALTFEVKVDMVESLGADKYVYFSTAAWAAHSTQLDELAAEADAHENQFVARVPAESKAAIGQTVELALDTTKLMVFDADSGVNLTVAPSGSP

SEQ ID NO: 2566 - protein, 140 aa, Mycobacterium paratuberculosis
MTEPTAEIADPVRGPRAEIVLRLRDPGPVTGIARSLAILAASPAVEGAVLVAGALIDLGSPLWASPSARVPFTAVLLGRSDIPDLPLPPPRDPVQFLSATPITATEAAWVRLKGAEAMRQAWDNDGVDVLDPNRPAAQPD

SEQ ID NO: 2567 - protein, 236 aa, Mycobacterium paratuberculosis
LATTSQLLTAVSRKQLAGLVKSGMLIRVCHGVYAPNVPDVSDALDAAQLRVGRPVVACMGTAAALYGFDTERTTRIHVLDPGIRMRPSPKIMVHQRIGAPLRRVKGHLATMPAWTAIEVARALRPARALATLDAALRVGACTAAELDAAAREQHGRRGIVKVRELLAYADGRAESPMESEARLLFIGSGLPMPELQYSITDRHGRRWRADFAWPAHDPVGLIARINGHLAAPRVAG

SEQ ID NO: 2568 - protein, 366 aa, Mycobacterium paratuberculosis
VFQGFDALPEVLRPIAHQPHPQPAPEAPPARATLVDCAVYDDGNRLPGVFGYADALDKVREIESQGREGFVWVGLREPNQTEMQEVADVFGLHALAVEDAVCAHQRPKVERYDDTLFLVLKTVNYVPHESVVLAREIVETGEIMVFVGRDFVVTVRHGEHGGLSEVRKRMDGDPEQMRLGPFAVMHAIADHVVDHYLEVSSLMLADIDSIEGLAFAPGSKIDVEPIYLLKREVVELRRCVNPLSSAFHRIQTENKDVISKEVRRYLRDVADHHSEAADQIASYDDMLNSLIQAALARVGMQQNNDMRKMAAWAGILAVPTMIAAIYGMNFHFMPELNWTWGYPAVMAGMAVVCLVLYFQFRNRNWL

SEQ ID NO: 2569 - protein, 329 aa, Mycobacterium paratuberculosis
VSASPLKVAVTGAAGQIGYSLLFRLASGSLLGPDRPIELRLLEIEPALKALEGVVMELDDCAFPLLSGVEIGADPNKIFDGANLALLVGARPRGPGMERSDLLEANGAIFTAQGKALNEVAADDIRVGVTGNPANTNALIAMSNAPDIPRERFSALTRLDHNRAISQLAKKTGAKVTDIKKMTIWGNHSATQYPDIFHAEVKGKNAAEVVGDQNWIENDFIPTVAKRGAAIIDARGASSAASAASATTDAARDWLLGTPAGDWVSMAVISDGSYGVPEGLISSFPVTTKDGDWTIVQGLEIDEFSRSRIDKTTAELADERNAVTQLGLI

SEQ ID NO: 2570 - protein, 403 aa, Mycobacterium paratuberculosis
LKRVSELLESIQSRAEQGAITDAEIFAAHVGGKLSVSLTSPLDTQRALSIAYTPGVAQVSRAIAADHRQAAHYTWANRLVAVVSDGSAVLGLGDIGPAASLPVMEGKCALFQAYGGLNAIPIVLDTKDPDEIVETLVRLRPTFGAVNLEDISAPRCFEIERRLIEALDCPVMHDDQHGTAIVVLAALMGASKLLGRDMSSLKVVVSGAGAAGVACTNLLMAMGVSDITVLDSRGILHAGRDDMNDVKAALSRRTNPAGLTGSLAEAIRGADVFLGLSGGVVPEEMIAAMAPNGIVFALSNPDPEIHPQIAAKYATVVATGRSDFPNQINNVLAFPGVFRGALEAGARRITEKMMVAAAEAIFSVVSDDLAPDRIVPSPLDTRVGDAVATAVALATEVSDAPAG

SEQ ID NO: 2571 - protein, 289 aa, Mycobacterium paratuberculosis
VRIGRLVAPLLTALLAVTGCTTDTGDRRAHAEVVVGSRPDASSTLLAGIYVAALRSYGFAARPATAGDPTAQLDSGAFTVVPAFTGRVLQSLQPGATAMSDKDVYRAMIAALPEGIVAGDYTTAAEDKPVLLVSRATAQAWGGSDVSADLSTLPRHCDGLVVGTVAGHPAPPAVGSCRLAAPHEFPDGATMFAAVRAGQLTAGWTTTADPGTPADLVALADGKPALIRAENVAPLYRRNALSERQLLAINEVAGVLDTAALVDMRRQVDTGADPQAVAGGWLAEHPLGR

SEQ ID NO: 2572 - protein, 283 aa, Mycobacterium paratuberculosis
MQGFAGKVAVVTGAGSGIGQALAVELGRAGAKLAISDVDTAGLAQTAEQLAAIGAPVKADRLDVTEREAFLAYADAVNEHYGRVNQIYNNAGITFIGSIEDSRFKDIERVVDVDFWGVVNGTKAFLPHLIASGDGHVINISSALGLFSAPGQAAYVSAKFAVRGFTEALHQEMLRAGHPVRVTTVHPGGIKTAFARNATGVEGLDHAELASLFEEQQAKTTPQRAAQLILDGVRRNKARVLVGPDVKAMDLLVRAAGPNYERLLAGPVMGRVKEFVTRLLPKR

SEQ ID NO: 2573 - protein, 274 aa, Mycobacterium paratuberculosis
MQGFAGKVAVVTGAGSGIGQALAVELARSGAKVAISDVDLEGLAHTEEQLKAIGAQYKADRLDVTEREAFLAYADAVKEHFGKVNQIYNNAGIAFTGDVEVSQFKDIERVMDVDFWGVVNGTKAFLPHLIASGDGHVVNVSSVFGLFSVPGQAAYNSAKFAVRGFTEALRQEMAAAGHPVAVTTVHPGGIKTAIARNATAAEGLDQAELAKLFDKRLAKTTPQRAAQIILDAVRKKKARVLVGSDAKALDILVRLTGSGYQRLFGPVMSRLLPN

SEQ ID NO: 2574 - protein, 1247 aa, Mycobacterium paratuberculosis
VSNISSPFGQNEWLVEEMYRKFRDDPSSVDPSWHEFLVDYNPEPTGDSVLAAPASTDGPSAPAPAAPQTAQPALPAQTAPPAQTAQPARPAPQPAAAPGNGASTRPAKPATPPPAEGDELQTLRGAAAAVVKNMSASLEVPTATSVRAIPAKLLIDNRIVINNQLKRTRGGKISFTHLLGYALVQAIKKFPNMNRHYAEIDGKPTAITPAHTNLGLAIDLQGKDGKRSLVVAGIKNCETMRFAQFVTAYEDIVRRARDGKLTAEDFAGVTISLTNPGTIGTVHSVPRLMNGQGAIIGVGAMEYPAEFQGASEERIAELGIGKLITLTSTYDHRIIQGAESGDFLRTIHEMLLSDGFWDDIFRELSIPYLPIRWSTDNPDSIVDKNARVMELIAAYRNRGHLMADIDPLRLDGSRFRSHPDLEILNHGLTLWDLDRVFKVNGFAGAEYKKLRDILGLLRDAYCRHIGVEYTHILDPEQQEWLQQRVETKHVKPTVAEQKFILSKLNAAEAFETFLQTKYVGQKRFSLEGAESVIPMMDAAIDQCAEHGLDEVVIGMPHRGRLNVLANIVGKPYSQIFSEFEGNLNPAQAHGSGDVKYHLGATGVYLQMFGDNDIQVSLTANPSHLEAVDPVLEGLVRAKQDLLDHGADDQGDEKAFSVVPMMLHGDAAFAGQGVVAETLNLTHLPGYRVGGTIHIIVNNQIGFTTAPEHSRSSEYCTDVAKMIGAPIFHVNGDDPEACAWVAKLAVDFRQKFKKDVVIDMLCYRKRGHNEGDDPSMTNPAMYDVVDIKRGVRKSYTEALIGRGDISMKEAEDALRDYQGQLERVFNEVRELEKHGVGPSESVEADQMLPAGLATAVDKALLARIGDAFLALPEGFTAHPRVQPVLEKRREMAYEGKIDWAFAELLALGSLVAGGKLVRLSGQDTRRGTFSQRHSVIIDRNTGEEFTPLQLLATNPDGTPTGGKFLVYDSPLSEYAAVGFEYGYTVGNPDALVLWEAQFGDFVNGAQSIIDEFISSGEAKWGQLSNVVLLLPHGHEGQGPDHTSARIERFLQLWAEGSMTIAMPSTPSNYFHLLRRHALDGIKRPLIVFTPKSMLRNKAAVSDIKDFTEIKFRSVLEEPTYEDGIGDRGKVSRVLLTSGKLYYELVARKNKDNRDDVAIVRIEQLAPLPKRRLGETLDRYPNVREYFWVQEEPANQGAWPRFGLELPELLPDKLTGLKRISRRAMSAPSSGSSKVHAVEQQEIIDTAFA

SEQ ID NO: 2575 - protein, 198 aa, Mycobacterium paratuberculosis
MRARRNRFPNRFFSTSSAAARTDSGRPKVSARALAQVIERSSRIQGPAAEAYVTRLRNAHPDAGPAEILAKLQKRYLAIVTAGGVAVGAAATIPGIGTLSALSAAAAETVTFLEATAFLVLAAAVVYDIPADHRERRRALVLAVLVGDNSERAVAQLIGPGRTQGGWVSESLAALPLSSMSRLNSRLLKSWVRRYTLR

SEQ ID NO: 2576 - protein, 671 aa, Mycobacterium paratuberculosis
MTTATPRTPGGGRRAPSGPAPGAHRWDLITRSSAHSQNPWNPLWAMMIGFFMIMVDSTIVAIANPTIMADLHIGYDTVVWVTSAYLLGYAVVLLVAGRLGDRFGTKNLYLIGLAVFTVASVWCGLAGSAAMLIAARVVQGVGAGVLTPQTLSTITRIFPPERRGVAVSVWSATAGAASLVGPLAGGVLVDGLGWQWIFFVNVPIGVLGLALAYWLVPVLPTQSHRFDLVGVGLSGVGMFLIVFGLQQGQAAHWQPWIWALIVAGVGFVTVFVFWQSVNVREPLIPLVIFADRDFSLCNIGVAIISFAATAMMLPLTFYAQAVCGLSPTRSALLIAPMAIANGVFAPFVGKIVDRYHPRPVLGFGFSLLAIALTWLTFEMSPATPIWRLVLPFFAMGVGMAFVWSPLTATATRNLSAQLAGAGSAVYNSVRQLGAVLGSAGMAAFMTWRIGAEMPGQPAGGGEDSAGPVLPEFLRGPFAAAMSQSVLLPAFIALFGIVAALFLVGFRPWAHRDGGTDAFGPDDYGGDYDDDYDDDDAYVELILVREPEPEAQQRAGQPRRPQPAPAPPADVRRRDPVESRRSVLDERPAQVQPIGFAHNGSHVDGGKRLRQVAVRRAPKPGPPADRFTRPPRRHHPGPAGHHLGEGESLRGQHHRPDPDDDPTGYGRHSSGN

SEQ ID NO: 2577 - protein, 1140 aa, Mycobacterium paratuberculosis
VAEVFVTGDSIVYSASDLAAAARCEFALLRDFDAKLGRGPAVTVEDDLLIRTATLGAEHERRELARLRERFGDAVAVIGRPAYTPAALTAASEATRRAVADRAPVIYQAAMFDGRFLGFADFLVRDGERYQVVDTKLARSEKVTALLQLAAYADALAAAGVPVAPEAELRLGDGTAVRHRVCDLVPVYRSARARLQRLLDEHRAGGAAVRWDDENVTACFRCAVCVEQLRATDDVLLVAGMRVSQRDKLFDAGISTVAELAAHRGPVPELAARVVAKLTAQAKLQVRERETGVPQVEIVDPQPLALLPEPDPGDLFFDFEGDPLWTADGREWGLEYLFGVLEAGPSGRFRPLWAHNRAEERKALTDFLALVANRRRRRPNMHIYHYAPYEKTALLRLAGRYGVGEDQVDELLRSGTLVDLYPLVRRSIRVGADSFSLKALEPLYMGSRLRAGEVTTAAGSITSYARYCELQADGRADEAVAVLKEIEDYNHYDCRSTQELRNWLMLRAYESGVLPVGAQPVGDGNTVDDRDELAATLSAFTGAAGIDERTPQQTAVALLAAARGYHRREDKPFWWAHFDRLNFPIDEWADNTDVFVAEQASVCVDWQTPARARKPQRRVRLRGELARGELRTEVFALYDPPAPPGMTDNPDRRAAGRATVVEADDPALPTEVVVLERVTSDGKPFHQLPFALTPGPPIPTTALRDSIEATVAAVAAGLPRLPDSAVVDVLLRRAPRTRSGAALPRSADTVADIASALTDLDSSYLAVHGPPGTGKTHTAARVIVRLVAEHRWRVGVVAQSHATVENLLDCVIDAGLDPRRIAKKRYDRQAPRWQEIDGNAYAAFLADTPGCVIGGTAWDFANANRIPPGSLDLLVIDEAGQFCLANTIAVAPAAANLLLLGDPQQLPQVSQGTHPEPVDTSALDWLVVGQRTLPDERGYFLDRSYRMHPAVCAAVSALSYEGRLHSDACTAARRLDGCPPGVRLLSVDHQGNSTESPEEADAIAAAVTGLLGASWTDEHGTRALTASDVLVLAPYNAQVALLRRRLGSAGLDGVRVGTVDKFQGGQAPVVFISMTASSVDVVPRGISFLLNRNRLNVAVSRAQYAAVIVRSPTLTEYLPGTPAGLIELGAFLALTQPDLR

SEQ ID NO: 2578 - protein, 223 aa, Mycobacterium paratuberculosis
MTGLYYDPWNREIDADPYPIYQRLRNEAPLYYNERHDFWGLSRYDDVDAALRDPLRLSSAKGDILDVVKADPVMPPGVFINEDPPLHTIHRALVARAFTPKKMRTLEDKIRAFCVASLDMVADSDRFDFVEDLGAELPMRTIGMLLGIPDADQPSVREHARATLQNDTGGPMPIRKDHYFDGDMFSDYVEWRKRPEWEIDMDNARRSRTSTVRGWDSMPAIVT

SEQ ID NO: 2579 - protein, 184 aa, Mycobacterium paratuberculosis
MTTTDIDLEALRRDLQYVKDKIEIRDLIHTQARGHDRHDVSLMTSVYTDDGVDEHGPTVKAAADYGDWANAAHSAAFDQHSHNITTHSCEIDGDVAHSESYVIVQARRGNALIMMGGRYIDRLERRDGTWKIALRRCTVEWTLQGDGSALKSGNFTGFIKGSWDTNDVSYARPLTQDDTNIERW

SEQ ID NO: 2580 - protein, 256 aa, Mycobacterium paratuberculosis
MSDRFALTDRVAVITGAGTGIGRASALVLAEHGADIVLAGRRPDPLQATAKEVEALGRRALIVPTDVTETHQCQDLVDATLADFGRLDILVNNAGGGETKGITRWTEEEWHDVVDLNLGSVWFLSRCAVKPMMTQGSGAIVNISSGASLIAMPQAAIYAAAKAGVNNLTGSMAAAWGRKGIRVNCIACGAIRTDGLLADAAKGGFDVDQLGAMNAMGRIAEPDEIGYGVLFFASDASSYCSGQTLYIHGGPGPAGI

SEQ ID NO: 2581 - protein, 203 aa, Mycobacterium paratuberculosis
MSRVTPLRFRDWPPEMRDAMAALMPPNPRHPAPVTKDRPKAGNALGTLAHHPSLARAFCTLQGHLLMGTTLSMRHREMLILRTAAVRGSAYEWTHHNFIAPDGGISTEDVARIAFGPTAPYWSDFDAALLRSVDELIHDGQMSDATWATLSSEFGTQQLLDTMFTVTSYDALMRMLKTCQVRLEDDVRELRAQAGLSVDGDGA

SEQ ID NO: 2582 - protein, 282 aa, Mycobacterium paratuberculosis
MDVPMAGKVEGKVAFITGAARGQGRSHAITLAREGADIIAIDVCKQLDGVKLPMSTPDDLAETVRQVEALGRRIIASQVDVRDFDAMQAAVDDGVTQLGRLDIVLANAALASEGTRLNRMGPKTWRDMIDVNLNGAWITARVAIPHIMAGKRGGSIVFTSSIGGLRGAENIGNYIASKHGLHGLMRTMALELGPRNIRVNIVCPSSVATPMLLNEPTYRMFRPDLENPTVEDFKVASRQMHVLPIPYVEPADISNAILFLVSDDARYITGVALPVDGGALLK

SEQ ID NO: 2583 - protein, 213 aa, Mycobacterium paratuberculosis
VDMAASPRRVGAETSQTRDALLEAVAQMMLEEGYASVTYRALAAKAGVTPSLVQYYFPSLDDIFVAAIRRYSERNLQWLTEELQRRADDPLHALWESGWHESTSALMTEFMALGNHRKSIRSEIAAVTDSMRRVQVEALVAKFGNDARLLADLSFDAVVLLINGVPKLLGLEESVGVDTAHAELIAACERFLDAVEPRAKPRRRSKKAPTRRR

SEQ ID NO: 2584 - protein, 247 aa, Mycobacterium paratuberculosis
VSRVAVVTGGGSGIGRAIVERLAHDRHRVAVLDVNEEAAEKVAARVAADGAHAIAVPTDVAESASVAAAFESVRRALGPVQVLVTSAAITGFKPFGEITIEDWNRHLAVNLTGTFLCLQAALPDMVEAGWGRVVTISSTAAQTGSPRQGHYSASKGGVIALTRTIALEYAVHGITANTVPPFSVDTPMLRAAQEAGNLPPVKYLAKASPVGRLGTGEDIAAACAFLCSDEAGYITGQIIGVNGGAVI

SEQ ID NO: 2585 - protein, 58 aa, Mycobacterium paratuberculosis
LLGARARCFEQLRFVLCGYLTHDGGGVAIDIVEFEDFRCDHRAQGVPLASGSVNACLH

SEQ ID NO: 2586 - protein, 454 aa, Mycobacterium paratuberculosis
MSVEVAGSGSRKAPQFHFDRHTPEYRERFLDVTQEMHQRCPIAWTDTYGGHWVAAGAGAVFELARCPHVSNDHDVNNERRGYRGVTIPLTTESDQIRGGMLEMDDPEHRIYRSLLNPYLSPAAVSRWQPFIDDVVRACLDERIESGRIDFVDDLANVVPAVLTLAMLGVPLRKWTMYNEPVHAMVYTPPGSPEAAKVHDMWVSVVVDLFANLTEIREHPRPGIINALAQLRIDGEPAPDMEIIGMLTLLIGGGFDTTTALTAHALKWLSEHPDQRARLHGELDVLLNPATEEFLRYFTPAPGDARTISADMELDGIRFAEGERVWLSWAMANRDPSLFDNPNELMLARKANRHFSFGIGVHRCIGSNVARTVFKSMLTAVLERMPDYRCDRVNTVHYDTIGIIQGMRNLPADFTPGKRLGPGLDETLDRLQSVCDSQGLARPITEYKEQARLPG

SEQ ID NO: 2587 - protein, 309 aa, Mycobacterium paratuberculosis
MRIGLTGGASSTDKIVEQAQAAEAEGFTSLWYASTVAGDPLVAMALAGRATTSIELGTAVLQTYPCHPLLQANRVAATANAMGRPGFTLGLGPSHEPLVSGVLGLSYDHPGRNTEEYLRIISALLRGEEVDYSGQDWTTRSPAGVVRLDYEVPLLLSALSPRMLRIAGRFADGVVLWMASASVIESRIAPALRHATTEWGRPPPRIVAGLPVAVHDDPVEARAATAAMSTMYAGMTNYQRVIEAGGGATPADVAIIGNEESVRKQLQDLLDAGATDIWAQPIGVGDERAQRTASAQRTRELLSELARLG

SEQ ID NO: 2588 - protein, 347 aa, Mycobacterium paratuberculosis
VTKKLRVIQWTTGKVGKLSLRGVLDDPRLELVGVYAFSEEKAGSDAGALCGRPDTGVLATTDIDALLALKADTVIYTPFMADIDDVVRLLESGLDVISTNLFLNVGGIQGETKQRLAAACQRGGSSLYITGVNPGWINTMVTAMTAVCRDVEMVSVSESADVSVYESPETWQSQGFSLSEAPPAVIETAKMWLSTFRDSVQRMAVALGFELDDMEFFIEHATASERVDLGWWVIEKDTIAAMRAGWNGKVNGKTVVQSNVAWYMTKLLNEGWQFDDDHYHVVIKGEPGVDTRIRFLPPDSWGNHEWDTMTAMPAVSAAVDVAAAPAGILTLKDVGLPCAPAGLWLEG

SEQ ID NO: 2589 - protein, 202 aa, Mycobacterium paratuberculosis
MTVRCVDVWSPPCRTEPLTGSAAVALIAVTLTGCGSGDSTVAKTPQARTTSETPSITAPATPSAAAAQPGVGQPADPCAVNLAAPTIAKVVSELPRDPRSQQPWNPEPLAGNYNQCAQLSAVIVKANTNAISPSTRAVLFHLGQFIPQGVPDTYGFNGIDPAQTTGDTVALTYPGGLSGLSTDVKFHWNGNAVELIGNTPAH

SEQ ID NO: 2590 - protein, 566 aa, Mycobacterium paratuberculosis
MTLPDSSTEAASPTFADLQIHPSVLRAIADVGYETPTGIQAATIPALMAGSDVVGLAQTGTGKTAAFAIPILSKIDAASTATQALVLAPTRELALQVAEAFSRYGAHLPKINVLPIYGGSSYAVQLAGLKRGAHVVVGTPGRVIDHLERGTLDLSHVDYLVLDEADEMLTMGFAEEVDRILSETPEYKQVALFSATMPPAIRKLTAKYLHDPLEVSTKAKTTTAENISQRYIQVAGPRKMDALTRVLEVEPFEAMIVFVRTKQATEEVAERLRARGFSAAAINGDIPQGQRERTVAALKDGGIDILVATDVAARGLDVERISHVLNYDIPHDTESYVHRIGRTGRAGRSGTALLFVSPRERHLLKAIEKATRQPLTEAELPTVEDVNAQRVAKFADSITAALGAPGIDLFRKLVQDYEREHDVPMADIAAALAVQSRDGEEFLMAPEPPRERRERHTERRERTEKPRSTRPLATYRIAVGKRHKIGPGAIVGAIANEGGLHRSDFGHIAIGPGFSLVELPAKLPKSTLKRLEQTRISGVLINLQPDRAAAKARGRDGGKPRRKYGG

SEQ ID NO: 2591 - protein, 379 aa, Mycobacterium paratuberculosis
MTLSEEQDAQGGLEQTSRVDRVASLTGVRAVAALLVVGTHAAYTTGKYTHGYWGLVGSRMEIGVPIFFVLSGYLLFRPWVKSAATGGPPQSLSRYAWHRVRRIMPPYVITVLFAYVLYHFREAGPNPGHSWLGLARNLTLTQIYCNGYLGKYLHQGLTQMWSLAVEASFYVILPLLAYLLLVLICRRQWQPKLVLGPLAGLALISPAWLVLVHTDHWFPDGARLWLPTYLAWFLAGMMLKVLQEMGARAYGFVAIPLAVVSYFIVSTPIAGAPTTSPATLSEALFKTCFYAVIAALAVAPLALGDHGWYSRLLASRPMVWLGEISYEIFLIHLITMEFAMDYIVGARVYTGSMLNLFVATLVLTIPLAWLLHRFTRVRD

SEQ ID NO: 2592 - protein, 197 aa, Mycobacterium paratuberculosis
MPGARRSTDWLSGHRNEAAVDRILDAAQELYTQRDSESIGMNEIARAAGCSRATLYRYFENREALRTAYVHREANRLGRAIMEQIDGIDEPRQRLTASITTTLRMVRGNPALASWFAVTRPPIAGELAEHSEVITALAAAFVGSLGPEEPAVVERRARWVVRVITSLLLFPGHDEADERAMIEEFVVPIVTPVSARG

SEQ ID NO: 2593 - protein, 409 aa, Mycobacterium paratuberculosis
VSHNVPVAFELPNADTWADPWPMYRALRDHDPVHHVVPPKRPEHDYYVLSRHADVWAAARDHETFSSAKGLTVNYDDLELIGLQDNPPFVMQDPPVHTEFRKLVSRSFTPRQVEAVEPKVRDFVVERIERLRAAGGGDIVAELFKPLPSMVVAHYLGVPEEDRAQFDGWTEAIVAANTADGGVAGALGSAGDAVTSMMAYFTGLIERRRTDPEDDTISHLVSAGVGADGDIAGTLSVLAFTFTMVTGGNDTTTGMLGGSMPLLHQRPDQRQRLVDEPELIPDAVEELLRLTSPVQGLARTTTRDVTIGRTTIPAGRRVLLLYGSANRDERQYGPDAGELDVARCPRNILTFSHGAHHCLGAAAARMQSRVALTELLARCPDFEVDESGIVWAGGNYVRRPLSVPIRVKS

SEQ ID NO: 2594 - protein, 455 aa, Mycobacterium paratuberculosis
VSSEALASLIADLPDGTVVTDPTVTEGYRQDRAFDPSAGKPLAVVRPRRTEEVQTVLRWASAHGVPVVTRGAGSGLSGGATALDNGIVLSTEKMRDITVDPVTRTAVCQPGLFNAEVKKAAAEHGLWYPPDPSSFEICSIGGNIATNAGGLCCVKYGVTTDYVLGMQVVLADGTAVRLGGPRLKDVAGLSLTKLFVGSEGTLGVITEVTLRLVPKQNTSSVVVASFATVEDAVGAVLGVTGRLRPSMLEFMDSVAINAVEDTLRMDLDRGAAAMLVAGSDERGRAGSEDAEIMAKVFAENAATEVFSTDDPDEGEAFVVARRFCIPAVEAKGSLLLEDVGVPLPALGRLVTGIAAIAAERDLMISVIAHAGDGNTHPLIVYDPADADMTERAHLAFGEIMDLAVGLGGTITGEHGVGRLKRPWLAGYLGPEVMDLNRRIKQALDPQGILNPGSGI

SEQ ID NO: 2595 - protein, 415 aa, Mycobacterium paratuberculosis
MPDTSRGPALLILFATLLATAGTGISIVAFPWLALQHRHSATDASIVAAAMTLPLVLATLIAGTAVDSFGRRRVSLVCDWLSGAAVTAVPLTAWIFGAAAIDVAELAVLAFCAAAFDPAGMTARQSMLPEAAARAGWSLDRTNSSYEAMLNLAFIVGPGLGGLLIATLGGINTMWVTAGCFALSFLAIGALRLDGAGKPPRATRPVGLVTGIAEGVRFVWNLRVLRTLGLIDLAVTALYLPMESVLFPKYFADQHQPAELGWALMALALGGVAGALGYAVLSARLRRRTAVLTATLTFGATTAGIAVLPPLPVILGLCAVTGVVYGPIQPIYNFVMQTRAPHHLRGRVVGVMAGLTYAAGPLGLLVAGPLADAAGLKATFLTLAVPILAIGVVACGLPSLRELDRAPQFADDPGP

SEQ ID NO: 2596 - protein, 314 aa, Mycobacterium paratuberculosis
LRTRSKGPGRGSCQAWGSRGECNRIPWAAATEFRGGRPRMQDVGVLEHPRTGQAFDSPVPAGSGWPGDPATPQTPVAADADQVIALARHAGAIPELDALVSVCRACPRLVEWREEVAVVKRRAFADQPYWGRPVPSWGSARPRLLIVGLAPAAHGANRTGRMFTGDRSGDQLYAALYRAGLVNQPTSVDAADGLRTKHIRIVAPVHCAPPANVPTPVERDTCWPWLQAEWRLISEHVRVVVALGGFGWQIALRLPGVPAARKPRFGHGVVAELAPGVRLLGCYHPSQQNMFTGRLTPAMLDDVFRDAKGLAGIK

SEQ ID NO: 2597 - protein, 375 aa, Mycobacterium paratuberculosis
MSDVLVSGASVAGTAAAFWLGRHGHSVTVVERHRGPRPGGQAIDVRGPALGVLERMGLLAAAAKRRTQIRGSSVVDRDGNELSRDTEAAISGPTGGPIEGPDIELLRDDLVELLYGASQWTAEYLFDDTITALDDRGAAVRVTFERAAPRDFDLVIGADGLHSNVRRLVFGPEDEFIERLGTHAAIFTVPNFLGLDYWQMWHYGDSTMAGVYSARDNAEARAMLGFMDAELRLDYRDTEAQFAELERRMAGEGWVRPQLLEYMRTAPDFYFDEMSQIKMDRWSRGRVALVGDAGYCCSPLSGQGTSVALLGAYILAGELKAAGEDHEAGFANYHREFADYVQRNQWLVVDNIPGGAPIPQEVFERIVASIALKDY

SEQ ID NO: 2598 - protein, 343 aa, Mycobacterium paratuberculosis
VRLSVLDLVPVRTDQTTGDALAATVALAQAADRLGFTRYWVAEHHNMPSVGATSPPVLLAYLAPQTTRLRLGSGGVMLPNHAPLAVAEQFALLEAAAPGRIDLGIGRAPGSDPVTSYALRGGRGDEDIQRFPDYLDDVAALMSARGVVVPLRSGDYRLRATPAAAGEPRLWLLGSSMYSAHLAAAKGLPYVFAHHFSGKGTEEALEVYRSRFRPSALTPEPLTFLTVNAVVAETRDEATALMLPNLQMMAKLRTGQPLGPVPLVEEAEHAELTAEQRRIVDSGLRRAVLGGPAEAAEQVRALAERFGVDEVMVNPVASARRGTDPATAPARVATLELLAKELF

SEQ ID NO: 2599 - protein, 516 aa, Mycobacterium paratuberculosis
MASWAPPPATATQARRRFSPYVTPVASTIVALGVIVLAHHSRSAATLAALSLVVGAGRFSLTFRDVSLLHSHDRHAMTDELTALPNRRQLVTALQGLPASASPGAGSMPSRANPRRALLLLSLSDFHEITESIGRQFGDELLCHIANRLAGSVRRDDLLARVGDDQFAVLLADGANLTAASAQAGRLLEALSEPIALDPITIQVDGRIAIALCPDHCDHPRELLSRAETALAHAKSARSKIAVYDSAFEAHRDNDTNLIEELRTALFDTDELKLHYQPKIDGRDGSIHSVEAVLRWQHPTRGTLLPEEFLPVAERAGLMRKISNRTLSMALQQVRSWREEGLRLTVAVNLSTTNLLDIELVGTVERLLANYDLPADALILEITESALVDSVRSRNTVTALQRLGIRISIDDYGTGWSSLARLQEVSVDELKLDRIFVARLAHDARSVAIVRSTVALADNLGADLVAEGVENEDTLDALRRYGCNITQGFVHTPPLPPDELRAWIASHAPDPSQSRG

SEQ ID NO: 2600 - protein, 650 aa, Mycobacterium paratuberculosis
VAALPAADPGRRGGVGARGGQSHPRTHAGRVGILVAAVLARQFVVLVDNQNLLSEVAREAFRDNLTGLANRALFVHRLEQAVARRHPDGTPIAVLCLDLDNFKAVNDALGHPAGDELLVRVAERLTAALGDSGTIARLGGDEFAAVIEASVDESQAAAHRILEAFTGAILIDGIPITVRPSIGFTVCTGASTCTVDQLLRHADLAMYAAKREGGQCIRSFMPDLPLPYAFPPPPGSAAPTAVAAVAAGGNGAAPAAPPEVATAATSSPSPHDAARRPPPGYSGRPRDAGHRGGRLQRVQRRASGRRARNLLGDGAVFGAERRRRRADRAARLPDSGRPVGVGADRRRHGVLGGGRRRVRGVGARRALTVGGRPGVSGLLPVRLRRIAAADAGPAQAAADRGPARLGGVRVDVDRGGRGADRGPAAPGGGARTEDGVGGAGLPVVRSDAAGPGRRHAADLGLAQRDSLGAAGGGAGFVRGRRRGLPVPDGGRIVSGRFPAGRVLARVVGAHRDGELGAAARHGDAGPTPLQPLCHSGGVHHCGAGSDCAGPSFAFGRHPGGVEPGGRSRAVFADLPRREPAAQPRPARHDRRADRAAQPAPAGDGPAGFARLGIARRRFDAEPGKPPSRAVVVEPERLSRDHRIDRPAIRR

SEQ ID NO: 2601 - protein, 346 aa, Mycobacterium paratuberculosis
MAGAAMKRWAVNPWRRSGVPARVGWLLAGGYGTAALLVLLSSVRGWRGPYGTRPVDDLVMFVCLAVAAICAARAARAASGRRRYGWLALTTALLGWAVGEIIWAVYDVRPEFEHAAHPAAAELVLLLFPVGAMTSLVLLSQLSRHSPRRLLLDGLIVATSLFVISWVFVVEAQLREHTGTQVATLAEVFNDIVLMTTAILMLSRARPGDRPSRSLLACGIATISVTDIAMVFYTGIGSYHTDDIGDLARVAGVGTLALAGLASVYEQPAPGSPDEIEFRTRLWLPYLPLILAAAVGWGHAAGKAIHEPMLAALGSWWPPCWRGSSWSWSTTRICCRRSRGRPSATT

SEQ ID NO: 2602 - protein, 144 aa, Mycobacterium paratuberculosis
MSCVFCAIVAGEAPAIRIYEDDDYLAILDIRPFTRGHTLVLPKRHSVDLTDTPPETLAGMVTLGQRIARAARSTELADATNIAINDGSAAFQTVFHIHLHVLPRRNGDKLSVAKGMLLRRDPDRDATGQILRLALARIDANQPD

SEQ ID NO: 2603 - protein, 461 aa, Mycobacterium paratuberculosis
VNDLAFAGAAAQARMLANGDLSAPELLEVYLERIARLDSQLRCYRVVLADRARREAAAAQSRLDAGERLPLLGVPVAIKDDVDVAGEVTTFGSGGHGPAVSSDAEVVRRLRAAGAVIIGKTNVPELMMMPYTESLTFGATRNPWDPRRTPGGSSGGSAAAVAAGLAPLALGSDGGGSIRIPSTWCGLFGLKPQRDRVSLEPHDDAWYGLSVNGPIARTVIDAAVFLDATSTVPGPEGEFVAAATREPGRLRIALSTKVPTPLPVRVGKPELAAVQQAGALLRDLGHDVVTADPEYPAAAILGNYLPRYLRGICDDADSLAHPERLETRTRNMARMGSFFSDRRMAAIRAGEGPLIARIQAIFDDVDVVVTPGTAAGPSRVGAYQRRGAVSTLLRVGQCVPYQQIWNLTGQPAAVVPWDFDADGLPMSVQLVGRPYDEATLLSLSAQIEAARPWALRRPPVC

SEQ ID NO: 2604 - protein, 165 aa, Mycobacterium paratuberculosis
MSTPLLRGFPPVVDERARTLILGSFPSAQSLLTGQYYANPRNAFWSITGELFGFDAAAPYPRRLAQLRRHRIALWDVLHACRRAGSADSAIEPNSLVVNGFGEFFAEHPGITRVYFNGAKAAELYRRLAMAPDHVCFQRLPSTSPAHVMAPGAKLAAWAVLRNSA

SEQ ID NO: 2605 - protein, 385 aa, Mycobacterium paratuberculosis
MTSHDGLPALYVDDVHDGDDRDIEDLLDGLQGTARTERAELVRWLLAQGITAEEIRTTNPPLLLATRHLIGDDGTYVSTREISETYGIDMALLQRVQRAIGLVRVDDPDAAVHMRADGEAAAFTQRFVDVGLDPDQVVLVAQVLAEGLSRAAEVMRYSALSAIMRPGATELEIAKASKALVTQIAPLLGPMIQQMLFMQLRHMMETEAVNAAERAAGKPLPGARQITVAFADLVGFTRIGEAVSPEELGQLANRLAILARDVTVPPVRFVKTIGDAVMFVCPEPRPLLDVVLKLVEAVDTDNEFPRLRAGVASGTAVSRAGDWFGSPVNVASRVTAVARPGTVLVADSVWDVIGDNGEFSGSFAGARRLKGIKNEVKLFRVRRGG

SEQ ID NO: 2606 - protein, 197 aa, Mycobacterium paratuberculosis
RCDHVIMKAHHAHRRYGRPGGWQQAQQPDASDAAEWFAGRLPEQWFDGDPTVIVDREEITVIGKLPEPADAEKEASEARAAGRASRFREETRSERMRIADEAQDRYGRKVSWGVEVGSKTGTERILFTHIAVPVMTRLKQPERQVLDTLVDAGVARSRADALAWSVKLVGEHAEEWLAQLRDAMSAVDDLRAQGPDL

SEQ ID NO: 2607 - protein, 437 aa, Mycobacterium paratuberculosis
KAHPARHGGRDVEIHGARTVFGRRGHLSGRHLRAGMRAVRVPDRVRAVSGRQRRGAGLGARDGPHSRAECATARGAQGLRRGDRPRHGQKARGSLRQRGRSGAGRQGGAVHPRPGPRRHHPAAQSRGRPAAAGQRDAGASTVLAPPPAVNTRQPGSAASQAGRGWTPESGPIPAAGQPGPPYYQGGNANWAAAPAQFAGPPPWGRPPPKRRVWPIVAAVVAVLVVIAGGVGVWLVIRPKPEPPQAAPLTSDRLGALLLSASEVNAVMGSSTMEPGKPITATDSSSVTVSVPDCQGALYTTQDPVYAGSGYSAVNGLVSSEPGDNYDHWVNQAVVLFPSADKAKSFLQTSLQKWKGCAGQTVTVTNKSKTYRWTFAQVQGAPPKITLMHTQEGADGWECQRALSVANNVIVDINACGYRITDQGDQIADKIVAKIDNE

SEQ ID NO: 2608 - protein, 401 aa, Mycobacterium paratuberculosis
MSDERSSKVGSMFGPYHLKRLLGRGGMGEVYEAEHTVKEWTVAVKLLNESFSSDPVFRERMKREARTAGRLQEPHVVPVHDYGEIDGQMFLEMRLVEGTDLDSVLKRFGPLPPPRAVAIITQIASALDAAHAAGVMHRDVKPQNILVTRDDFAYLVDFGIASATTDEKLTQLGTAVGTWKYMAPERFSDAEVTYRADIYALACVLFECLTGSAPYRADSAGVLVSAHVMDPIPAPSARRPGVPKAFDAVIARGMAKKPEDRYASAGDLALAAKEALSTPDQDRAATILRRSQEAALPPRGSATPGPARCWRHRLPSTPGSPVPLRHKLAGAGRRRAARSQPPGSPGRRTTRAATPIGPLRQHNSPGRRRGAGRRPNGGCGRSSPRSSPCSSSSRAGWASGW

SEQ ID NO: 2609 - protein, 380 aa, Mycobacterium paratuberculosis
MAKRLEFGLLGPLEMTVDGDLVPLGTPKQRAVLAMLLMNRNNPVGIDRLITGLWDESPPSGARASLHSYVSNLRKLLSNAGVDPRTVLVAAPPGYRLNIPDDRCDLGRFITEKTAGVQAAASGRFEQAGAHLAAALAQWRGPVLEDLTEFRFVGTFATSLVEEKILTHIAQAEAEIACGRAFSVITELESLTREHPYREQLWAQLMTAYYLTDRQSDALAAYRRVQKSLADDLGIDPGQNLRMLNDRILRQEPLDAKKNAMTTAAVTVTVLEHYTLASGRNAGALLHDAAGRAFPLRGSTTIGRLDDNDIVLDSPKVSRHHAVIVDTGTSYIINDLRSSNGVHVQDQRIHSAAVLQDGDRIRICEHEFTFRLAEENQHAG

SEQ ID NO: 2610 - protein, 557 aa, Mycobacterium paratuberculosis
LSWGFGDDCWVQGRSDDQRELLDAESVAGHLLKADSMFAFLAAHRSQLFPEEMFADLFPSQRGRPSVPAEVMASVITLQALHGFSDNETVDAVTFDLRWKAACGLPITAGAFHSTTLTYWRRRLAASDRPNRIFEAVKTVVAETGVLAGKTRRALDSTVLDDAVATQDTVTQLIAAIRRVRREVPGAAAVIEAHCSAHDYDDPGKPAIAWEDKAARDRLVDGLVGDAHRVLGYLPDQELAPRAAEAVALLALIAGQDVEPVEGSDGTDGHWRIAQQVSGDRVISTVDADTRHAHKTVHRRQDGFKAHLAVEPDTGIITDCALTKASGADNHEAVVGLSLLEGEHTPGAGPGRFGVWHRGRPGGTGRRRPCRGDQTATATPAGSGWLHQRRFPHRFRRPHRDLPGWTRNADPSQWRSHLRKILSLMPVGVPVHDRHARTQTHPSYPRAIIARCSRRGPRPRLASRIPPTPAHGGTLNGLAHSRQPQGPLPRNRQKQPLAAPPRRSTEPTSAAHHGPDPHRHHLGHRLTRPHTKALPQPPTAATLNNGGAISFLSTHRV

SEQ ID NO: 2611 - protein, 114 aa, Mycobacterium paratuberculosis
VATMFSRRIITVLTTAAAIGLAAVGLAGPAAARTVQTGDEMFLAQMRSLGVSFPSPQEAVREGHQVCAELSAGKTPTAVTVAVFRQTNLTPPQAAGLVTAATQAYCPQFSGQPG

SEQ ID NO: 2612 - protein, 634 aa, Mycobacterium paratuberculosis
MTTTTRPAPPAPAGRSRDFWGPAARLVKQLAPQRRTAIAVITLGIAGTVIGVIVPRILGHATDLLFNGVVGRQLPAGISKAQAVAAARSRGQNTFADLLSGMNVVPGRGVDFGAVARTLALALLLYLVSALFIWMQARLLNRTVQRTMVALRSAVEDKLHRLPLAYFDGRQRGELLSRVTNDIDNIQSSLSMTISQLLTSVLTVLTVLAMMLSISPLLAGITLLTVPLSLLATRVIVRRSQRLFVAQWTSVGRLNAHIEETYSGFTVVQTFGHRAAARDRFRALNDEVYRASFGAQFFSGLVAPATAVIGNLGYVAVAVLGGLQVATGQITLGNIQAFIQYVRQFNSPLSQLAGMYNTLQSGVASAERVFALLDEPEEPPEEKPAAPGPAGRDAGGSGRVEFAHVSFAYRPGIRVIDDLSLVAEPGSTVAIVGPTGAGKTTLVNLLMRFYDVDAGRISIDGVDIATMDRRALRSRIGMVLQDTWLFDGTIAENIGYGRPGAGDDEIVAAARAAYVDRFVQTLPDGYHTRVSGDGGNLSAGERQLITIARAFLARPQLLILDEATSSVDTRTEALIAHATRELRRDRTSFIIAHRLSTIRDADRIAVIEAGRIVEQGTHAELLARHSVYYAMTQA

SEQ ID NO: 2613 - protein, 585 aa, Mycobacterium paratuberculosis
MLLALLRQYIQPYRRLVAVLMALQVISNLASLYLPTVNAAIIDEGVAKGDTSTIVRLGVVMLGVTAVQALCAVGAVYFGSRTGMGFGRDLRAAMFEHVITFSERETARFGAPTLLTRSTNDVRQIQYLVQITATVLVTAPIMCLGGIVMAIHQEAALTWLLLISVPVMAVTNYWVMSHMLPLFRRMQALIDGVNRVMRDQLSGVRVVRAFAREDFERDRFGRANAALSNTALAAGNWQALMLPVTTLTINVSSVALIWFGGLRIDHGQMQVGSLTAFLAYFTQILMAVLMATMTLVVLPRASVCAERITEVLSTGAAVADPASPKSPPGAITGIVRLDRATFTYPGADRPVLQDISLTARPGTTTAIVGSTGSGKSTLISLICRLYDVTGGAVQIDGIDVRDYRTERLWSAIGLVPQRGYLFSGTIADNLRYGRADATEQQMWEALRVAAADDFVGAHPDGLHMRVAQGGINFSGGQRQRLAIARAVIRRPAIYLFDDSFAALDARTDSRVRAALREITCDATVIVVTQRVSIAATADQVVVIDDGKVAGAGTHDALLTDCAVYAEFADSQSVGAVPSGHTGGTP

SEQ ID NO: 2614 - protein, 185 aa, Mycobacterium paratuberculosis
VRRNTRALALVASALTILIPATAACSDSGGSKPGATTSSAPQNGQGNHGPMFPQCGGISDQTVAELTKVSGLINTARNSVGCQWLAGGGILGPHFSFSWYRGSPIGRERKTEELSRASVDDININGHSGFIAVGNEPNLGDSLCEVGIQFSDDFIEWSISFSQKPFPPPCDIAKELARQSIANSK

SEQ ID NO: 2615 - protein, 189 aa, Mycobacterium paratuberculosis
MMAMMRPGPRRSTARAAATVLFLALLVLTGCSRSIAGNAVKAGGNVPRNNNSQQQYPNLLKECEVLTSDILAKTVGADPLDIQSTFVGAICRWQAANPAGLIDITRFWFEQGSLSNERKVAEFLKYKIETRNIAGIDSIVMRPDDPNGACGVASDAAGVVGWWVNPQAPGIDACGQAIKLMELTLATNS

SEQ ID NO: 2616 - protein, 158 aa, Mycobacterium paratuberculosis
MRHAKSDYPDGVADHDRPLAPRGIRQAGLAGDWLRAGAPAIDAVLCSTATRTRETLRNTRIEAPVRYSERLYASTPGIVIDEINTVGDDVSTLLVIGHEPTMSALALGLGGGSGANPAAAERISNKFPTSAIAVLAVPCRWTELELGAATLTDFVVAR

SEQ ID NO: 2617 - protein, 472 aa, Mycobacterium paratuberculosis
MSSGGIIDRDAISAAFDALDAALDGVAALGFDGLTPRECLALLGRCEKARRRLPVAEHQLINALARDATPAELGGRLSHAIAEATLISRAEAARRVHTAADLGPRVGLTGEPLPPLLAATAARQREGSLGLEQVAVIRKFCHQLPGWIDQATRERAEADLAREATRYRPEQLAALAGTLADCLNPDGLYRDEDRARRRSLTLGNQQADGMSELRGWLSPELRATLEAVLAKLAAPGMCNPLDESPCVEGTPSQHAIDGDARSAAQRNHDGLLAGLRALLASGNLGQHNGLPASIIVTTTLADLETAAGRRLTGGGTLLPMSDVIRLSRHAHHYLAIFDQGKALALYHTKRLASPAQRIVLYAKDRGCTAPGCTIPGYYSEVHHCTDYATCHTTDINDLTFACGPHHRLLQPGAWTTHKNAKGETEWIPPPHLDRNQPRTNTFHHPEKLLQGEDDDGEVDGEQEADQGDDHAA

SEQ ID NO: 2618 - protein, 383 aa, Mycobacterium paratuberculosis
MRFLHTADWQLGMTRHFLAGDAQPRYSAARRDAVAGLGALAAEVGAEFVVVSGDVFEHNQLPPKVVGQSLEAMRAIGIPVYLLPGNHDPLDASSVYTGALFTAERPHNVTVLDRAGVHQVRPGLQLVAAPWRSKVPTTDLVGEVLDGLPETDDTRILVGHGGVDVLDPDRDKPSLIRLAKLEDALTRGAVHYVALGDKHSLTQVGSSGRVWYSGSPEVTNFDDVEADSGHVLIVDIDETDPRRPVSVTARRVGCWRFVTLHRQVDSSRDIADLDMNLDLMTNKDRTVVRLALTGSLTVTDRAALDACLDRYARLFAHLRTWDSHTELAVIPADGEFSDLGIGGFAAAAVEELVATARQQDSDTAADAQGALALLLRLADRGAA

SEQ ID NO: 2619 - protein, 876 aa, Mycobacterium paratuberculosis
VKLHRLTLTNYRGIAHREIEFPDHGVVVVCGANEIGKSSMIEALDLLLEAKDRSTKKEVKQVKPTHSDVGSEVSAEISCGPYRFVYRKRFHKKCETELTVITPYREQLTGDEAHERVRAMLAETVDSDLWHAQRVLQAASTAAVDLSGCDALSRALDVAAGDSGGLCGTEPLLIERIDAEYGRYFTPTGRPTGEWAAAIARLADAEVAVAECAAAVAEVDERVSRHAALTEQVADLSQRRIAAGPRVTAARQAADRIAELTAQRREAQLVAEAAAATKAAAAQAHSGRLQLLADIDTRAAVVTQTHAQVQQAAADHAAAQADAQACDTALQHATEALAELERRVQEAQRTVERLAGREEADRLAARLDKIDAIQRDRERISAELSTIAVTEELLRRIEDAAAAVDRIGDQLASTSAAVEFTAVADIHLVIGDQQVSLPAGQSWSITAAGPTAVEVPGVLTARVIAGATTLDVQAKHAAAQQELAAALTAGAVADLAAARSADQRRRELQGTRDQLGATLAGLCGDEPLDELRSRLARLRAEHPEQPAEPTGGAADLAAARTELEALAQARACASAECDTRRQAATAAAARLAETATAATVLQNRLDTLRAELDAATGRLAAERASVGDEELAASADAALRAEQAAERRVAELADALAAASPDAVAAELADATQESESLRERYEEAAGALREVTIELSVFGSEGRQGKLDAAETEREHAASEHSQVGRRARAAQLLRSVMTRHRDTTRQRYVEPYRAELQRLGRPVFGPTFEVDIDSDLCIRSRTLNGITVPYESLSGGAKEQLGILARLAGAALVAKEDAVPVVVDDALGFTDPDRLAKMGQLFDSVGSHGQVIVLTCSPDRYDGVKGAHRIDLSA

SEQ ID NO: 2620 - protein, 326 aa, Mycobacterium paratuberculosis
MSRHDDAGADLPPEAMTVNQVVDDVAAVLDDARVDSAVVYGASYGTYIASGVGVRHPARVHGMVLDSPLLSRHDIVIVRRAIRRLLLRGDSPETASLAPKMRKLVDAGVMTATATQVVATIYGYGGARLLERQLDLLLDGRKLLWWTLSRFTTLGNLPFRYEEDLVSRIALRELDYAAEPDGLPLDPAVAEREVRTQTAAFEDEPYDLPAEMPNFDWPTAVVSGGRDLITPPAVAERVASLLPHAVLLSLPDMAHSALDFHEAVALASADAVLRGDLAGLAARACTLNALPPRPEVRLLWALIAAAAIIEGALPIPAPLRRRLSCG

SEQ ID NO: 2621 - protein, 564 aa, Mycobacterium paratuberculosis
VASGLGLGRCGFRPAALVAAIVLAVAGCSPAINLVPETGQNARIGTTSDINPRDPATLQDGGNLRLALTDFPPNFNILHIDGNSADVSAMMKATLPRAFVIGPDGSTTVDTDYFTSVELTGTAPQVVTYTINPKAVWSDGTPITWEDIASQIHALSGADKTFEIAGSSGAERVASVTRGVDDRQAVVTFAKPYAEWRGMFAGNGMLLPKSMTATPEAFNKGQLEGPGPSAGPFIVSSLDRTTQRIVLSRNPKWWGTRPRLDSITYLVLDDAARLPALQNNTIDATGVGTLDQLTIAEHTAGISIRRAPAPAWSHFTFNGAPGSILADRALRVAVSKGIDRQTIAKVVQYGLTSNPVALGNHIYVAGQQGYQDNSTTVPYDPAAAGRELDALGWKLHGRFREKDGRQLVIRDLFYDAQGSRQFAEIAQHSLAQIGVRLELVARAGSGFFTNYINVGAFDMAQFGWLGDAFPLSALTQIYKSDGESNFGNIGSPQIDAAIERTLQELDPDKARALANDLDKLIWAEGFSLPLTQSPGDVAVRSTLANFGAAGLGDLNYTAIGFTRS

SEQ ID NO: 2622 - protein, 611 aa, Mycobacterium paratuberculosis
VSPLLQVTDLAVTFPAGDAPVTAVRGVSYRIEPGEVVAMVGESGSGKSVSAMAVMGLLPEHARVRGSVRLHDTELLGLGDDAMSRLRGRAVGMVFQDPMSALTPVYTVGDQIAEAITIHQPRVGRKAARDRAVELLELVGIAQPQRRARAFPHELSGGERQRVVIAIAIANDPDLLICDEPTTALDVTVQAQILEVLKTARDITGAGVLIITHDLGVVAEFADRALVMYAGRVVESAAVASLYRDRRMPYTVGLLGSVPRLDAAQGTRLVPIPGAPPSLAGLDPGCPFAPRCPLAIDECRSQEPELLPVGPDHRAACIRTDQVDGRSAADIYGVRTQPHPGEPADSPVVVRVRELSKTYRLTKGVLRRSAGEVRAVDRISFQLRQGRTLGIVGESGSGKSTTLHEILELVAPQSGSIEVLGTDVAALSPAGRRSLRRDIQVVFQDPVASLDPRLPVFELLAEPLRANGFDKDRTNARVAELLETVGLPRADAARYPAEFSGGQKQRIGIARALALQPKILALDEPVSALDVSIQAGIINLLLDLQAQFQLSYLFVSHDLSVVKHLAHDVAVMYAGSIVEQGDSSQVFGNPQHEYTRRLLDAVPQPNPGSRG

SEQ ID NO: 2623 - protein, 291 aa, Mycobacterium paratuberculosis
VAGFASRRTLVLRRFGRNRLAVASLTLLVLLFVGCYTLPAVLPYSYQDLDFDALLQPPNARHWLGTNALGQDLLAQILRGMQKSMLIGVCVAVISTGIAATVGSIAGYFGGWRDRVLMWLVDLLLVVPSFILIAIVTPRTKNSANILMLVLLLAGFGWMVSSRMVRGMTMSLREREFIRAARYMGVSSRRIIVGHVVPNVASILIIDAALNVASAILAETGLSFLGFGVQPPDVSLGTLIANGTQSATTFPWVFLFPAGVLVLILVCANLTGDGLRDALDPGSGPARGGRR

SEQ ID NO: 2624 - protein, 324 aa, Mycobacterium paratuberculosis
MTRFLARRLLNYLVLLALASFLTFCLTSVAFKPLDSLLQRSPRPPQAVIDAKAHSLGLDEPIPIRYAHWASHAVRGDFGKTVTGQPVGASLGRRVGVTLRLLVIGSLIGTVAGIAAGAWGAIRQYRLSDRVVTMLALLVLSTPTFVIASLLILAALRVNWALGVQVFDYTGETSPGVTGGAAALVDRLRHLVLPSLTLALAAAAGYSRYQRNAMLDVLGQDFIRTARAKGLTRRRALVKHGLRTALIPLATLFAYGVAGLVTGAVFVEKIFGWHGMGEWLVQGVATQDTNIVAAITLFSGAVVLLAGLLSDVFYAALDPRVRVS

SEQ ID NO: 2625 - protein, 163 aa, Mycobacterium paratuberculosis
MAVTDDYLAHNAGYASSFEGPLPMPPSKHVAVVACMDARLDVYRILGLREGEAHVIRNAGGVITDDVVRSLAISQRLLGTREIILIHHTDCGMLTFTDDDFKRGIQEETGIKPPWAAEAFADLAEDVRQSLRRIEANPFVTKHVSARGFVFDVATGKLDEVKP

SEQ ID NO: 2626 - protein, 148 aa, Mycobacterium paratuberculosis
MTSSTSSASESAAAPSGRDVIAQFLPQSPFVVKLGIVAERLDEDEVRLRLPWDPSNVTIGDMVHGGAIATLADLTVMAAAWCGAQAPPQLRGVTVSMALDFMAPARASDVIGVGRVLRRGRSLVNCEAEIVDPQGTLVAKALATYKVG

SEQ ID NO: 2627 - protein, 314 aa, Mycobacterium paratuberculosis
LPKEAMTADLQTAPAAGQYELSHLRSLEAEAIHIIREVAAEFERPVLLFSGGKDSIVMLHLALRAFRPGRLPFPVMHVDTGHNFDEVIATRDELVKQHGLRLVVASVQDDIDAGRVVEPKQGRNPIQTVTLLRAIRENKFDAAFGGARRDEEKARAKERVFSFRDEFGQWDPKAQRPELWNLYNGRHHKGEHIRVFPLSNWTEFDIWSYIGAENIALPSIYYAHRRKVFRRDGMLLAVDRNMQPNPDEPVFEATVRFRTVGDVTCTGCVESQAATVDEVIAETAVSRLTERGATRADDRISEAGMEDRKRQGYF

SEQ ID NO: 2628 - protein, 616 aa, Mycobacterium paratuberculosis
MAAPTTLLRLATAGSVDDGKSTLIGRLLYDSKAVMEDQWAAVEQTSKDRGHDYTDLALVTDGLRAEREQGITIDVAYRYFATPKRKFIIADTPGHIQYTRNMVTGASTAQLVIVLVDARHGLLEQSRRHAFLASLLGIQHIVLAVNKMDLIGWDREKFESIRDEFHAFAARLDVHDVATIPISALHGDNVVTKSDQTPWYEGPALLSHLEEVYIAGDRNLVDVRFPVQYVIRPHTHEHQDHRSYAGTVASGVMRPGDEVVVLPVGKRTRITAIEGPNGPVQEAFPPMAVSLTLADEIDISRGDLIARTHNQPRIAQDFDATLCWMADNTTLEPGRDYVIKHTTRTTHARVTGLDYRLDVNTLHRDKTATALKLNELGRISLRTQVPLLLDEYTRNPSTGSFILIDPHTNGTVAAGMVLRDASAQAASPNTVRHKSSAIAAARPRGKTVWFTGLSGSGKSSVAMLVEQKLLEKGAQAYVLDGDNLRHGLNADLGFSMADRAENLRRLAHVAALLADCGNVVLVPAISPLAEQRELARKVHADAGFDFIEVFCDTPIEECEKRDPKGLYAKARAGEITQFTGIDSPYQPPANPDLRLIPDGTVEEQAQRVIDLLESRG

SEQ ID NO: 2629 - protein, 161 aa, Mycobacterium paratuberculosis
VRMSAKAEYAVRAMIQLATVPDGTLVKTDDLAQAQGIPPQFLVDILTNLRTDRLVRSHRGREGGYELARPGKDISIADVLRCIDGPLASVRDIGLGDLPYSGPTAALTDVWRALRASMRSVLEETTLADVATGSLPKHVAQLADDYRKQESQRHGTARTGD

SEQ ID NO: 2630 - protein, 131 aa, Mycobacterium paratuberculosis
MTISFNHTIVASRDKRESAEFLAELFDLPGPKPFGHFMVVELDHGASLDYADAPDGADIPRQHYAFLVSEQEFDTIYGKIRARGLEHWADPGARRPGEINHNDGGRGVYFLDPSGHAMEILTRPYGSGAAN

SEQ ID NO: 2631 - protein, 324 aa, Mycobacterium paratuberculosis
MRDGGVGQTHSPHGSTEGPNVKHARIPVVRVAMTMPVMEPDLDATVLETWARTIDEGPFSSLCWGERIAFDNPDSLTLLGALAAWTERVRLLTTLIVPQLHDPVLLAKGLATGDLLSGGRLSVGIGVGGRQEDYHAVGADPATQTMRGMAERVAVMKRVWAGEKLTESVLPVGPAPVQPGGPPLFVGSIGPKTIRSAAAWADGLAGTTLDLDVAKQRELFDVTRDAWARAGKPAPHLITSFWFAFGSPRTAREQIHRHLRRYMNWIPADYGDAMAPTTGWAGDEDELAEVLRKFAEIGADEVQLIPTSSDVGQLRRAADVAARL

SEQ ID NO: 2632 - protein, 206 aa, Mycobacterium paratuberculosis
VLGPDHLSTLTARHLLASRQQAALSSLAEWSQLFADEQRVWGADHENTLVAREKIAEKRWEIGDFVGAMAEGEQVLAARRRVLGADHTDTLGTQLMLSIWRGRAGDVPAAVAELEPLIGELREKLGDDHAHVLMARHMFTLWAPERAGVTDAVAAWEALVEEESRVLGDEHPVTLAARQELAGWCARRDGQAGGAGAQGSLDWSAS

SEQ ID NO: 2633 - protein, 581 aa, Mycobacterium paratuberculosis
MRDDSPRMSPRRHIIVSGDDVLATTIAEELNRAGATIVKLPSEELAGADLARASAIVCAGRDDAKNLEIALLARKTNPHVRVVARLGNDVLRGAVAADNGPGAILDVADLAAPSVVEACLSSSTHPVRAAGIDFLVSGAEAPRDATLREIYGDLAPVAVIHGNDGATPGEVVPCPGRDHRVRAGDWTAMIGSADELAARGIRTPRPPATRSRQTWLRRVLDAARAMRDDVNPMLFPAILLALTLLLVSTVIVHFSYTKPRLSWLDALYFTAETITTVGYGEFTFAHQSAWLRIFAVGLMFAGVTTTALLVAFLADLLLSRRFLQSAGLRRARHLRNHIIVVGLGSFGSRVVADLTAAGYDVAVIERDENNRFLSTAAELDVPVIFGDATLRQTLESARVDRARAVAVLTQDDMVNIEIGIVLREMLGPRVMPEVNRPDVPIVLRIYDRTLGDAVAKRFGFENVRSTVDLAAPWFIGAAMGLQVLGTFSVGQRSFMVGAMHVAAGSELDGLRMFEMSTQTRVIAITRRDTPVELHPRRDAWLRAGDTVYLVGPYRELLETLRKGQPPQQPTNEERPADKATT

SEQ ID NO: 2634 - protein, 123 aa, Mycobacterium paratuberculosis
MPSAEAITDTVNRYLALVATGTADDIVTLYAADATIEDPIGADIRRGHDAIRAFYAGFQDAKKDTELAELRVSGSEAAFLWYLTLDAGDTRTRISPISTMSFDEDAKITAMRAFWSPTDVQVL

SEQ ID NO: 2635 - protein, 208 aa, Mycobacterium paratuberculosis
IGTLLLAVSGVVFVAILGGVTFIERLASREIYRNPWMVLREDDIRRPDGSAGIYSVVDKPSYALVMPYDGRRFGLVEQFRYPIGERRWEFPQGTAPELADADPVELARRELREETGLRATTFEPLGRLDVAPGMSSQRGWVFLATGIVEGEADREHEEQDMRSAWFSRDDVEQMIRTGVIADAQSIAAYGLFLLRPESTGAPVTDQGQ

SEQ ID NO: 2636 - protein, 162 aa, Mycobacterium paratuberculosis
LNGRAVARQRDCHHRTLALLTAPLDGHECVCAVCAVPRATRRHSPHTEPVAPHRKKEPRIMSVCGLRMLCIPAVVAAALTVGSGIAVADDDGYLAQLKKIGVAWQPGGDTTLIQLGHAICSDRAAGKTPDELAADVHSGLNSSFNYADATAIVSAAESNYCP

SEQ ID NO: 2637 - protein, 233 aa, Mycobacterium paratuberculosis
VGVRVVTKGAGRWLAVAASLVISAAMIHAQGTKPRCCPAPPAAAPTPNATASSAAANPPPAGAPRTASPAEVESLTALAPPAPSAGQQFQLALPHSVGSEDRLQVKTIWAARAISVLFPQITTIYGYREDPLPWHPNGLAIDVMIPNYHTPEGIELGNQIAGYALANAKRWGINHVIWRQKIYPGVGGGNWMADLGSETADHYDHVHIATDGGGYPSGHETYYIASMTPTPPD

SEQ ID NO: 2638 - protein, 154 aa, Mycobacterium paratuberculosis
LMRRFASTTAGVALLRPTAHNLDRLVAKATGGRSSFAGLATGIPVIMLTTTGAKSGEPRTVPVYGIPHPEGLALIASNFGGAKHPAWYFNLKAHPEATVTVGRDSWPATARLATPDERDQIWAKGVELYPGWRKYEVRAGDRHIEAFILSRAPA

SEQ ID NO: 2639 - protein, 145 aa, Mycobacterium paratuberculosis
VINLKRAVLLLPVYIAAMIAVDVVFKSAHIAPSKPLPVWIVAGFIASAIVVVAVGIWYITQRRSSKVTRKREHAYIAIMAGVAVSGFVGDTVSGLAGLFMGGKSLWVMVPSYALAYVVLLWTIAFTAKALDGGAGNVNKRSGSAH

SEQ ID NO: 2640 - protein, 362 aa, Mycobacterium paratuberculosis
MPATLSQILAWSTEHLIEAAGYWTQTADRWEDGFLTMRNQAQSIAWRGAGGDALRERTQADLSVVSAKADLLRQAAGIARNGASDISAAQRRVLFGVEDAQNAGFTVGEDLSVTDTRSTSPAERPARQAEAEAFAADIRLRAEQLDGADTKVAAQLTAATAGLGGSGFAPASSPNSNHGAAAADRTTPGSNRNGVRLVDFKQDGGPQPQPQPQPGAPQPPQQPSFLDQYKQALTSPGQPAQPAATPMPAFGPRPDPGPQPAPGPMPTVPPQPSFGQCVGGQVKANVGKDMVKGGFETGIKGAIVGAAGGGIATPEFAGAGALPGAVLGFVGGFAKGVEEAPVKAALEGTAECADVPIPGWMK

SEQ ID NO: 2641 - protein, 97 aa, Mycobacterium paratuberculosis
MGQDSLQVVPAELVATAAQWQALSSQFIGAPPSPGPSFEATTAAVNALNAAIGATAASFVARTQETVGGVTTASGGYLSQEATSAAAMNDVTNVRVV

SEQ ID NO: 2642 - protein, 550 aa, Mycobacterium paratuberculosis
VTPADLAELLRNTAAAVLAERGLDAAALPATVVVERPRNPEHGDYASNLALQLGKKVGANPRELAGWLAAALAETDGIASAEVAGPGFINLRLEASAQAVVVTNVLDAGDRYGHSDAQSTHNINLEFVSANPTGPIHIGGTRWAAVGDALGRLLSTQGAGVVREYYFNDHGAQIDRFASSLIAAAKGEPTPEDGYAGSYINDIAAQVLRQAPDALSLPEPQLRETFRAIGVDLMFTHIKESLHEFGTDFDVYTHEDSMHTSGRVDQAIARLRETGNIYEKDGATWLRTSAFGDDKDRVVIKSDGKPAYIAGDIAYYLDKRQRGFDLCIYMLGADHHGYIARLKAVAAAFGDDPATVEVLIGQMVNLVRDGQPVRMSKRAGTVITLDDLVEAIGVDAARYSLIRSSVDTPIDIDLALWSSASNENPVYYVQYAHARLSALARNAAELGLIPDTAHLELLSHDKEGTLLRTLGEFPRVLKTAASLREPHRVCRYLEDLAGDYHRFYDSCRVLPQGDEQPTDLHTARLALCQATRQVIANGLAILGVTAPERM

SEQ ID NO: 2643 - protein, 472 aa, Mycobacterium paratuberculosis
VNVHPAGPRHAEETRHPESPPRPQSPEELLLLAPNVWPRNATRNEAGVATIAGVAVTELAREYGTPLFVVDEDDFRSRCREIASAFGGGNNVHYAAKAFLCSEVARWIDEEGLSLDVCTGGELAVALHADFPPERITFHGNNKSVAELTAAVKAGVGHVVLDSMTEIERLDAIAADAGIVQDVFVRLTVGVEAHTHEFISTAHEDQKFGLSVASGAALAAVGRVFDTEHLRLVGLHSHIGSQIFDVAGFELAARRVIGLLHDAVEQFGVEKTAQIATVDLGGGLGISYLAADDPPPMGELAGKLSAIVQHESAAVGLPTPRLVVEPGRAIAGPGTITLYEVGTVKDVDVSATAHRRYVSVDGGMSDNIRTALYDAQYDARLVSRVSDAPAELARVVGKHCESGDIVVRDTWVPGDLRPGDLIGVAATGAYCYSLSSRYNMVCRPAVVAVRDGRARLVLRRETVDDLLSLEVR

SEQ ID NO: 2644 - protein, 441 aa, Mycobacterium paratuberculosis
VPRDEKPVGVAVLGLGNVGSEVVRIIEDSAGDLAARIGAPLVLRGVGVRRVADDRGVPVELLTDDIEGLAARDDVDIVVELMGPVEPSRKAILCALEHGKSVVTANKALLSTSTGELAQAAESAHVDLHFEAAVAGAIPVIRPLTQSLAGDTVLRVAGIVNGTTNYILSAMDSTGADYDTALAEASDLGYAEADPTADVEGYDAAAKAAILASIAFHTRVTADDVYREGITKITPADFASARALGCTIKLLSICERITGDDGQERVSARVYPALVPLSHPLATVNGAFNAVVVEARASGRLMFYGQGAGGAPTASAVAGDLVMAARNRVLGSRGPRESKYAQLPVAPMGFISTRYYVSMNVADKPGVLSSVAAEFAKREVSIAEVRQEGVADEGGRRVGARIVVVTHTATDAALSETVHALADLDVVQSVTSVLRLEGTSL

SEQ ID NO: 2645 - protein, 360 aa, Mycobacterium paratuberculosis
MSAQRTAVHQPWPGLIEAYRDRLPVGDDWTPVTLLEGGTPLIPARRLSEKTGCTVHLKVEGLNPTGSFKDRGMTMAVTDALARGQQAVLCASTGNTSASAAAYAARAGITCAVLIPQGKIAMGKLAQAVMHGAKIIQIDGNFDDCLELARKMAADFPTISLVNSVNPVRIEGQKTAAFEIVDVLGAAPDVHALPVGNAGNITAYWKGYTEYHHEGLIEKLPRMLGTQAAGAAPLVHGEPVKNPETIATAIRIGAPASWTAAVDAQQQSHGRFLAATDDEILAAYHLVAESEGVFVEPASAASIAGLLKAVEDGWVARGSTVVCTVTGNGLKDPDTALRDMPAVTPLPVDPVLVVEKLGLA

SEQ ID NO: 2646 - protein, 315 aa, Mycobacterium paratuberculosis
LVTSMLPAGLVASAVVSASSANLGPGFDSIGLALSLIDEITVETTDSGLVVQVEGEGADQVPLGPEHLVVRAVECGLRAVGVRAAGLVVRCRNAIPHSRGLGSSAAAVVGGLAAANGLVAQANCQPLSDAALIQLSSEFEGHPDNAAAAVFGGAIVSWIDRGGQHPRYAAAPLRLHPDIHLYCAIPQERSLTAETRVLLPAQVSHEDARFNVSRAALLVVALTERPDLLMAATEDVLHQPQRAPAMPASAEYLRLLRRHNVAATLSGAGPSLIALTTASALPPEVMEYGAANGFTLAEMTAGEGVRWSPGVTVVG

SEQ ID NO: 2647 - protein, 101 aa, Mycobacterium paratuberculosis
LEPGSHRRRLIHSVAGGFACFRQGWGLSSEPSSNRSICICIHTALPLGQHQFFLWTRFAVYSADPGDHRCKVDDWAHSAIWLNATNPLYELISGGRKEIRD

SEQ ID NO: 2648 - protein, 620 aa, Mycobacterium paratuberculosis
VTDTDLFTAGENTDANQLSTAVTTDTPDAKTHAPVGALTTMVLPELRALANQVGVKGTSGMRKNELIAAIKEVRGQANGAAPAEQANGAEPAEDSGKPDAKDAKDDTTPDTKDANDHTGAQSAAEAPAPSEQNGATAEAPRRERRSASRDAGAAGRGSDDADRETDGREQSKQDSREQSKQDGGDQDQQSSGGQQGRGSNQQDDDGEGRQGRRGRRFRDRRRRGERSGEGGDAELREDDVVQPVAGILDVLDNYAFVRTSGYLAGPHDVYVSMNMVRKNGLRRGDAVTGAVRVPKDGEQPNQRQKFNPLVRLDSVNGGSVEDAKKRPEFGKLTPLYPNQRLRLETTPDRLTTRVIDLIMPIGKGQRALIVSPPKAGKTTILQDIANAITKNNPECHLMVVLVDERPEEVTDMQRSVKGEVIASTFDRPPSDHTSVAELAIERAKRLVEQGKDVVVLLDSITRLGRAYNNASPASGRILSGGVDSTALYPPKRFLGAARNIEEGGSLTIIATAMVETGSTGDTVIFEEFKGTGNAELKLDRKIAERRVFPAVDVNPSGTRKDELLLSPDEFGIVHKLRRVLSGLDSHQAIDLLMSQLRKTKNNYEFLVQVSKTTPGAMDND

SEQ ID NO: 2649 - protein, 80 aa, Mycobacterium paratuberculosis
MKADIHPTYAETTVLCGCGNTFQTRSTKDGGRIVVEVCSQCHPFYTGKQKILDSGGRVARFEKRYGKRKAGAEKAESADK

SEQ ID NO: 2650 - protein, 357 aa, Mycobacterium paratuberculosis
MTQPVQTIDVLLAEHADLERRLSDPDLHSNPDEARKAGRRFARLAPIVGTYRKLMAAREDLETARELAADDDSFTAEVADLESRVAQLDTQLTDMLAPRDPHDADDIVLEVKSGEGGEESALFAADLARMYIRYAERHGWTVTVLDEITSDLGGYKDATLSIRSKGDSADGVWSRMKFEGGVHRVQRVPVTESQGRVHTSAAGVLVYPEPEEVAEVQIDESDLRIDVFRSSGKGGQGVNTTDSAVRITHLPTGVVVTCQNERSQLQNKARALQVLAARLQAMAEEQASAEASADRASQIRTVDRSERIRTYNFPENRITDHRIGFKAHNLDQVLDGDLDALFDALAAADKQSRLQQA

SEQ ID NO: 2651 - protein, 300 aa, Mycobacterium paratuberculosis
MHTMSSETIRLSLRRAIDDATATLAEAGIASARWDAEQLAAHLAGVDRGRLGLLEPPGQEFFQRYRDAVSARARRVPLQHLLGTAAFGPVLLHVGPGVFVPRPETEALLEWATAQQLPPRPVIVDLCTGSGALAVALAHHCAGRGLPARIVGVDNSDAALEYARRNAAGTTVELVRADVIELARVPGSAPDLDGRVDLVVANPPYVPDGAVLEPEVAQHDPHHAVFGGPDGLAVIAPIVELAGRWLRPGGLIGIEHDDTTSHQTVELFDRTGLFDDVRARRDLTGRPRFVTARRRSGADV

SEQ ID NO: 2652 - protein, 219 aa, Mycobacterium paratuberculosis
MSDFFDCADPDQRSRGIAAAAAAVKGGRLVVMPTDTVYGIGADAFNSAAVSALLSAKGRGRDMPVGVLVGSWHTIEGLVYTMPDGARDLIRAFWPGALSLVVPQAPSLQWDLGDARGTVMLRMPLHPVAIELLREVGPMAVSSANISGHPAAVDADEARGQLGDLVDVYLAAGRAERGAASTIVDLTGATPRILRPGPVSAQRIAAVLGIDPESLAVPG

SEQ ID NO: 2653 - protein, 407 aa, Mycobacterium paratuberculosis
LSSTVSLVSSDVTDLAGGLLALSDRGAGVPLRELALVGLTAAIITYFATGPVRVLATRLGAVAYPRERDVHVTPTPRMGGLAMFLGVVCAVFLASQLPALTRGFVYSSGMPAVLVAGAVIMGIGLIDDRWGLDALTKFAGQITAASVLVTMGVAWSVLYIPIGGVGTIVLDQASSILLTLALTVSVVNAMNFVDGLDGLAAGLGLITALAICMFSVGLLRDHGGDVLFYPPAVISVVLAGACLGFLPHNFHRAKIFMGDSGSMLIGLMLAAASTTAAGPVSQNAYGARDVFALLSPFLLVAAVIFVPMLDLLLAIVRRTRAGRSAFSPDKMHLHHRLLQIGHSHRRVVLLIYLWVGIVAFGAASTIFFRPRDTAAVMLGAIVVAGIATAIPLLRRGDDYEDEEYDRQ

SEQ ID NO: 2654 - protein, 160 aa, Mycobacterium paratuberculosis
VTTPAQDAPLVFPSVAFRPVRLFAISVAITAVAVLAAGLSGHLMVGVFFGIGLLLGLLNAVLVRRSVDSITAKEHPLKRSMAVNSASRLAIITVVGLIIAYLFRPAGLGVLFGLALFQVLLVASTALPVWKKLRAGDWAPSADGAAAGSDGTEGRNSTDA

SEQ ID NO: 2655 - protein, 252 aa, Mycobacterium paratuberculosis
MPETTFLAESAIEVGEHNHATWLGMTVNTDTILSTGIAALIVLALAFFLRAKITSTGVPSGVQLFWEAITVQMRDQIESAVGMRIAPFVLPLAVTIFVFILISNWLSVLPLQYTDKSGHTTELLKSVAADINYVLALALFVFVCYHVAGIWRRGVVGHPLAVLKGHVAFLAPINVVEELAKPISLSLRLFGNIFAGGILVALIALFPPYIMWAPNAIWKAFDLFVGAIQAFIFSILTILYFSQAMEIEEHHD

SEQ ID NO: 2656 - protein, 84 aa, Mycobacterium paratuberculosis
MALDPQVAAAALIGGGLIMGGGAIGAGIGDGIAGNALVSGIARQPEAQGRLFTPFFITVGLVEAAYFINLAFMALFVFATPVGT

SEQ ID NO: 2657 - protein, 177 aa, Mycobacterium paratuberculosis
MGDASLSVLASSQVVAEGGNNFLVPNGTFFFVLAIFLIVLAVIGTFVVPPVMKVLRERDAMVAKTAADNRKAAEQFEAAQADYEEAMTEARVQASSLRDNARAEGRKVVEDARAKAEQEVLSTLQLAARQLKRERDAVELDLRANVASMSATLASRILGVDVAPAAATTSATKTSGR

SEQ ID NO: 2658 - protein, 446 aa, Mycobacterium paratuberculosis
MSTFIGQLVGFAAIVFLVVRYVVPPVRRLMAARQEAVRQQLQDAAAAADRLTESTTAHSKAVEAAKAESKRVVDEAQADAKRITEQLAAQAGLEAERIKSQGSRQVDLLRTQLTRQLRLELGHEAVRQAGELVRNYVADPAQQSATVDRFLDDLDAMAPAAADVQYPLMTKMRSSSRVALVNLTERFTTVAKDLDNKALSALSSELVSVAQMLDREIVVTRYLTVPAEDAGPRVRLIERLLSGKVGDVTLEVLRAAVSERWSANSDLIDALEHLSRQALLEVAERENKVDEVEEQLFRFSRILDVQPRLAILLGDYAVPVEGRVGLLRKVLDSASITVNPIVAALLTQTVELLRGRPAEEAVQFLAEVAVARRGEVVAQVSAAADLSDAQRSRLTEVLSRIYGHPVSVQLQIDTELLGGLLIAVADEVIDGTLASRLAAAEAQLPD

SEQ ID NO: 2659 - protein, 554 aa, Mycobacterium paratuberculosis
MAELTISADDIQSAIEEYVGSFTSDTSREEVGTVVDAGDGIAHVEGLPSVMTQELLEFPGGVLGVALNLDEHSVGAVILGDFEKIEEGQQVKRTGEVLSVPVGDAFLGRVVNPLGQPIDGQGDIETDIRRALEIQAPSVVQRQSVKEPLQTGIKAIDAMTPIGRGQRQLIIGDRKTGKTAVCVDTILNQRQNWESGDEKKQVRCVYVAIGQKGTTIASVRRALEEGGAMDYTTIVAAPASDSAGFKWLAPYTGSAIAQHWMYDGKHVLIVFDDLSKQAEAYRAISLLLRRPPGREAYPGDVFYLHSRLLERCAKLSDELGGGSMTGLPIIETKANDISAYIPTNVISITDGQCFLESDLFNQGVRPAINVGVSVSRVGGAAQIKAMKEVAGSLRLDLSQFRELEAFAAFASDLDATSKAQLDRGARLVELLKQPQYQPMPVEEQVVSIFLGTGGHLDSVPVEDVRRFETELLDHMRASEDKILAGIRDTQKLSDEAAEELEKVINNFKKGFAATGGASVVPDEHVEALDEEELEKESVKVKKPAPEKKAKKEQK

SEQ ID NO: 2660 - protein, 304 aa, Mycobacterium paratuberculosis
MAATLRELRGRIRSAGSIKKITKAQELIATSRIGRAQARLDSARPYAFQITAMLTTLAAEAALDHPLLVERPEPKRAGVLVVSSDRGLCGAYNASIFRRAEELFSLLREQGKTPVLYSVGRKALNYYTFRNWDISGSWTGFSEQPQYENAAEIAETLVESFMRGTGGEDEGESDAESVDELHIVYTEFKSMLSQSAVAHRIAPMVVEYVEEPPEVRTLYSFEPDATTLFESLLPRYLTTRVYAALLESAASELASRQRAMKSATDNADDLIKALTLMANRERQAQITQEISEIVGGANALADAR

SEQ ID NO: 2661 - protein, 402 aa, Mycobacterium paratuberculosis
VRGVEVIDTGRSISVPVGQEVKGHVFNALGHCLDKPGYGEDFEHWSIHRKPPPFEELEPRTEMLETGLKVVDLLTPYVRGGKIALFGGAGVGKTVLIQEMINRIARNFGGTSVFAGVGERTREGNDLWVELQEANVLKDTALVFGQMDEPPGTRMRVALSALTMAEWFRDEAGQDVLLFIDNIFRFTQAGSEVSTLLGRMPSAVGYQPTLADEMGELQERITSTRGRSITSMQAVYVPADDYTDPAPATTFAHLDATTELSRSVFSKGIFPAVDPLASSSTILDPGVVGEEHYRVAQEVIRILQRYKDLQDIIAILGIDELSEEDKQLVNRARRIERFLSQNMMAAEQFTGQPGSTVPLKETIEAFDRLTKGEFDHVPEQAFFLIGGLDDLAKKAESLGAKL

SEQ ID NO: 2662 - protein, 121 aa, Mycobacterium paratuberculosis
MAELNVEIVAVDRKIWSGEATFLFTRTTVGEIGILPRHIPLVAQLVDDAMVRVEREGEDDLRIAVDGGFLSVTEETVTILAESAEFSSEIDESAAREAAESDDPRVAARGRARLRAVGAID

SEQ ID NO: 2663 - protein, 147 aa, Mycobacterium paratuberculosis
MSAPMAGMVVLVVVLAAAVIALSYRLWKLRQGGTAGIMRDIPAVGGHGWRHGVIRYRGGEAAFYRLSSLRLWPDRRLSRRGVEIVSRRAPRGDEFDIMTDEIVVIELRDTTQDRRSGYEIAFDKGALTAFLSWLESRPSPRSRRRSL

SEQ ID NO: 2664 - protein, 199 aa, Mycobacterium paratuberculosis
LVMAVHLTRIYTRTGDDGTTGLSDFSRVSKNDPRLVAYADCDEANAAIGVAVAVGRPGPELAGVLRQIQNDLFDAGADLSTPVVEDPEYPPLRVTQPYIDRLEKWCDTYNESLPKLNSFVLPGGSPLSALLHVARTVVRRAERSAWAAVDAAPEGVSALPAKYLNRLSDLLFILSRVANPDGDVLWKPGGQQGGEPAPG

SEQ ID NO: 2665 - protein, 417 aa, Mycobacterium paratuberculosis
VAERFVVTGGNRLSGEVAVGGAKNSVLKLMAATLLAEGTSTITNCPDILDVPLMAEVLRGLGATVELDGDVARITSPDEPKYDADFAAVRQFRASVCVLGPLVGRCKRARVALPGGDAIGSRPLDMHQAGLRQLGATCNIEHGCVVAQADTLRGAEIQLEFPSVGATENILMAAVVAEGVTTIHNAAREPDVVDLCTMLNQMGAQVEGAGSPTMTITGVPRLYPTEHRVIGDRIVAATWGIAAAMTRGDISVTGVDPAHLQVVLHKLHDAGATVTQTDDSFRVTQYERPKAVNVATLPFPGFPTDLQPMAIALASIADGTSMITENVFEARFRFVEEMIRLGADARTDGHHAVVRGLPQLSSAPVWCSDIRAGAGLVLAGLVADGDTEVHDVFHIDRGYPLFVENLAILGAEIERVE

SEQ ID NO: 2666 - protein, 172 aa, Mycobacterium paratuberculosis
LTTTSEGPTQPRIATPPKGNGRSGFGWLVPLIHQGRPYTGTGISTRCPSTTPVGLALGPDSPWADWPGPGTLGLTAGKVLTCLIATHACILTPPPSTTDHPEASLNGGRSPTHIHRKDECAAASAVCLSPATLSAHNHLTSELLRTLSRVAASKPTSWLSLRLHILFHLAHA

SEQ ID NO: 2667 - protein, 122 aa, Mycobacterium paratuberculosis
MLSAVILSERGYPAVPLVGQLVYQRFVRPGPLVLGTGFLKFLTRAADRDRTVSRRSKPSSRAALMGEQPNPWDLLQPQDATSRHRGAKPSRRYGLLGKISLLSPGYLLSVERHPFHSGVPDH

SEQ ID NO: 2668 - protein, 165 aa, Mycobacterium paratuberculosis
MDRSEIAAELGAPGAQELLASTSAAHLAYTAKDGTPRVIPVGYFWTGAEFVIATAATSPKVAALSACADVALSIDGGDTPETARALSIRGRARVQIVDGVVPEYLAAARKSMDADAAARFEEQVRKTYDRQARIGITPTWVRFYDFGAGRLPRFLADLTEGNRGE

SEQ ID NO: 2669 - protein, 165 aa, Mycobacterium paratuberculosis
MIEYRTVDSPIGLLTLAGRDPVLTNLRMVDQTYEPSRTGWTENPRAFAGAVEQLGAYFAGELTEFDIELDLRGSEFQRRVWRALQTIPYGETRSYGEIAEQIGAPGAARAVGLANGHNPIAIVVPCHRVIGASGKLTGYGGGLDRKQTLLALERRHSPASLTLFD

SEQ ID NO: 2670 - protein, 480 aa, Mycobacterium paratuberculosis
MTLSSRRGSGCGVVDSVVAQHGPQDVEAAAGQGEDGLGVAFSFGAFSVVVGARGGVGADADQGRQVAGAQQAPVVASGAFEVSADAAGISWYRRQAGDAGEAVGGGECGHVPAGGGEELSAQDDAESGHAQDDFGVAVAAKSLLDHRVGVADFGVEGHHLLGQAGHHSGRQLLAGHDAVLGVSGLQRGGCDGIGVAGLAFTQERGYSSATGAAQRVGSLVASKQDQRGTALVVVEGAFQRRKVFQQLGAHSVDRPGPISHQIGTSAGQDAQLDCDVIAGAQRLQVVAHPGLIGDDRSVFGVGLAFAAVTTRGVMDRAPGNIKQPLPGSDEQGDQQRGAAGVEVDRPRDLASIGQRRHRRNQLQQRGLVVGHPLREQSLRVVVNNHAVMVGLTGVHARPDRLCHNHLRNRHCPDQPSRRPRRRVLTQRSNRISQLAVESSRDAGRPISFGHPTQQPHESHTRRPWAIRSLRPTAPNTLQER

SEQ ID NO: 2671 - protein, 507 aa, Mycobacterium paratuberculosis
VHDDFERCYRAVQSKDARFDGWFVTAVLTTGIYCRPSCPVRPPFARNVRFYPTAAAAQRAGFRACKRCRPDASPGSPEWNVRGDVVARTMRLIADGTVDRDGVGGLAARLGYTTRQLERLLQAEVGAGPLALARAQRAQTARVLIETTELPFGDVAFAAGFSSIRQFNDTVRAVFESPPSVLRRRASARCASAANSPGAVCLRLPVRTPFGFHGVFGHLAASVVPGCEEVRDGAYRRTLRLGFGTGIVTLTPAADHVRCELVLDDFRDLTAAIARCRRLLDLDADPEAVDEALAADPQLAPAVRKAPGQCIPRTVDEAELAVRAVLGQQVSIRAARTHAGRLVAAYGRAVHDPEGTLTHTFPSVQQLADVDPIHLAVPKARQRTLAALVAGLADRSIVLDTGCDWQSARTQLLALPGVGPWTAEVIAMRGLGDPDAFPAADLGLRVAAKRLGLPSGQRSLTAASARWRPWRSYATQYLWTTLEHPVNHWPPQQPSKGILNDVVKPPR

SEQ ID NO: 2672 - protein, 294 aa, Mycobacterium paratuberculosis
MAVGDYEWFITLAELQHVTAAAEQLHVAQPTLTRMLARLEQRLGVALFDRHGRRLSLNTYGRIFYEHARRAQLELDSARRAIADLADPAVGEIRLAYLSSFGSTVVPRLIARFKESSPRVTFTLEKGAAESIADRVRSGGVDIGVVSPRPVERTLAWRSLFRQRLGVAVPDGHRFARGAAVSMVDLADEPFVTMHPGFGMRRLLDELCAAAQFRPRVALQAPNLTTAASLVAAGLGISLVPIDGSSYPSGVSVKPLADADAYRDVGMIWDSGRPLPRSARDFIAAAAAVGRGGW

SEQ ID NO: 2673 - protein, 420 aa, Mycobacterium paratuberculosis
VPARSMVVMPHGPVAHQAGTRGYRRMTAALCGAGLASFAAMYCSQALLPALSAHYRIGPATAALTVSLTTGALALSIIPASVLSERYGRIRVMLISGVASSVIGLLLPFSPSLGVLLFGRAAQGVALAGIPAVAMALLAEEVDASSLGSAMGRYIAGTTIGGLAGRIVPSVVVQVGTWRVALLACSLITLAGTAVFAVLVPRSRFFTPKPASVRAALRNLAGHLRNPVLAKLFAVGFVLMGGFVTVYNYLGYRLAARPFGLAPSVVGLLFLLYLVGTGTSVVAGRLADRRGRPLVLGAALPIAVAGLLLTVPATLAAIVAGVGVFTGGFFAAHTVASGWVGAVAQRDRAEASALYLFSYYLGGSVAGAFGGVLYGVGGWSATVCFVVVLLMAGAALVALLVRDNGFRIGRRVVTSVASVK

SEQ ID NO: 2674 - protein, 544 aa, Mycobacterium paratuberculosis
MSATQSTAQRIGRVLEKITRQSGRLPETPAYGSLLLGRVTESQHRRRIRIQIIMTVMVLGANLIGIGAALILVIVAIPAPSVFNDAPAWITFGVGPAYVASALAVGTYWITRRTVLALRWAIEERKPTPTDERNTFLAPWRIALVDLVLWGAGTLLLTVLYGLVDTMFIPRFLFGVSFCGVLVATACYLLAEFALRPVAAQALEAGPPPRRLTAGIMGRTMTVWFLGSGVPVIGIALLALFEIWLRNLTETEFAVGVLIVSTAALIFGCLLMWILAWLTATPVRVVRAALKRVERGDLRGDLVVFDGTELGELQRGFNAMVDGLRERERVRDLFGRHVGREVALAAERERPKLGGEERHVAVVFIDIVGSTQLVTRRPPAEVVSVLNQFFGIVVEEVDRHCGLVNKFEGDATLAIFGAPNHLDCPEDAALTAARAIADRLANEMPQCRAGIGVAAGQVVAGNVGARERFEYTVIGEPVNEAARLCELAKSHSSRLLATGDAIEGASEKERARWSLGDTVTLRGHERPTRLASPAGAADRPAGTD

SEQ ID NO: 2675 - protein, 226 aa, Mycobacterium paratuberculosis
VSRVRLVIAQCTVDYVGRLTAHLPSARRLLLFKADGSVSVHADDRAYKPLNWMSPPCWLREEAGDAAPVWVVENKAGEQLRITVEDIEHDSSHDLGVDPGLVKDGVEAHLQALLAEHVQLLGEGYTLVRREYMTAIGPVDLLCRDERGGSVAVEIKRRGEIDGVEQLTRYLELLNRDSVLAPVRGVFAAQQIKPQARTLATDRGIRCVTLDYDKMRGMDSDEYRLF

SEQ ID NO: 2676 - protein, 98 aa, Mycobacterium paratuberculosis
MARRRTPPRRQRLLGPPPALRRVEVGPDGHDYEVRPIAAARAVKTYRCPGCDHEIRSGAAHLVVWPVEPTLGGAEDRRHWHTGCWAHRATRGPTRRWS

SEQ ID NO: 2677 - protein, 154 aa, Mycobacterium paratuberculosis
MTTDQVDARQVLATALVTAIDHVGIAVADLDAAIAWYHDHLGMILVHEEVNEEQGIREAMLAVRGAPAGTAQLQLMAPIDDSSTIAKFLDKRGPGIQQMAMRVSDLDTLIERLREQGVRLIYDAPRRGTANSRINFIHPKDAGGVLIELVEPAA

SEQ ID NO: 2678 - protein, 389 aa, Mycobacterium paratuberculosis
VIVAGARTPIGKLMGSLKDFSASDLGAIAIAGALEKADVPADLVEYVIMGQVLTAGAGQMPARQAAVAAGIGWDVPALSINKMCLSGIDAIALADQLIRAGEFDVVVAGGQESMTKAPHLLMDSRAGYKYGDVTVLDHMAYDGLHDVFTDQPMGALTEQRNDVDKFTREEQDQYAARSHQRAAAAWKDGVFTDEVVPVNIPQRKGDPLQFTEDEGIRANTTAESLAGLKPAFRKDGTITAGSASQISDGAAAVVVMSKAKAQQLGLSWLAEIGAHGVVAGPDSTLQSQPANAIKKALGREGISVDQLDVVEINEAFAAVALASTRELGVNPDIVNVNGGAIAVGHPIGMSGARITLHAALELSRRGSGYAVAALCGAGGQGDALILRAG

SEQ ID NO: 2679 - protein, 303 aa, Mycobacterium paratuberculosis
VTRPRPSIGPALAGAVDLSGLKQRAQAASGPAGGPAPADGGPGISAVTEANFEAEVLIRSEEVPVVVLLWSPRSDACVQLLDTLSGLAAQDNGKWSLATVNVDVAPRVAQIFGVDAVPTVVALAAGQPISSFQGMQPADQLRGWLDQILSATAGKLKGATGSAESEAVDPELAAARQQLEAGDFEAARTSYQAILDANPASTEAKGAIRQIDFLTRATAQRPDAVAVADAAPGDIDAAFAAADVQILNQDVGAAFDRLIALVRNTSGDDRARVRTRLVELFDLFDPADPEVVAGRRNLANALY

SEQ ID NO: 2680 - protein, 731 aa, Mycobacterium paratuberculosis
MSHADQLARTHLAPDPADLSRLVAGTHHDPHGILGAHEYGDHTVIRAFRPHATEVAALVGGDRFAMQHIESGLFAVALPFTNLIDYRLQITYPDSEPYVVADAYRFLPTLGEVDLHLFGEGRHERLWEVLGAHPRSFTTADGVVTGVSFAVWAPNAKGISLIGEFNGWTGTEAPMRVLGSSGVWELFWPDFPIGGLYKFKVHGADGVVTERADPMAFATEVPPHTASRVTLSSYTWGDADWMTQRAARNPVFEPMSTYEVHLGSWRPGLSYRQLARELTDYVVEHGFTHVELLPVAEHPFAGSWGYQVTSYYAPTSRFGTPDEFRALVDALHQAGIGVIVDWVPAHFPKDAWALGRFDGTPLYEHSDPKRGEQLDWGTYVFDFGRREVRNFLVANALYWLQEFHIDGLRVDAVASMLYLDYSRPEGGWTPNIYGGRENLEAVQFLQEMNATAHKSAPGIVTIAEESTSWPGVTRPTNLGGLGFSMKWNMGWMHDTLDYISRDPIYRSYHHHEMTFSMLYAFSENYVLPLSHDEVVHGKGTLWGRMPGNNHVKAAGLRSLLAYQWAHPGKQLLFMGQEFGQRAEWSEERGLDWWQLDEQGFSNGILRLVRDINDIYRSHPALWSQDTVPDGYSWIDANDSANNVLSFLRYGKDGSVMACVFNFAGAEHSGYRLGLPSAGRWREVLNTDATVYNGSGIGNMGGVDATEDPWHGRPASAVLVLPPTSALWLEPK

SEQ ID NO: 2681 - protein, 712 aa, Mycobacterium paratuberculosis
LRTARRARRTRADRNGVLVPGRVEIDNVQPVVSCGTYPAKAVVGEVVPVSASVWREGHEAVAATLVVRYLGPAYPPVTETRRVKAVQAPVADREGRVDQQRIKPLSLPMTMGPEPYVFHGQFTPDQVGLWTFRVDGWGDPIHSWRHGLVAKLDAGQGETELSNDLLVGAELFERAATGVPRARREPLLAAAAALRTAGDPVTRTALALAPEIEEILAEYPLRDLLTRGEQYGVWVDRPLARFGSWYEMFPRSTGGWDDDGNPVHGTFATAAAALPRIAAMGFDVVYLPPIHPIGKVHRKGRNNSPTAGPTDVGSPWAIGSDEGGHDAVHPDLGTIEDFDAFVARARELGMEVALDLALQCAPDHPWAREHRNWFTELPDGTIAYAENPPKKYQDIYPLNFDNDPAGLYDEVLRVVRHWIDHGVKFFRVDNPHTKPPDFWAWLIAAVKGIDPDVLFLSEAFTPPVRQNGLTKLGFTQSYTYFTWRTAKWELTEFGNDIAALADFRRPNLFVNTPDILHAILQHNGPGMFAIRAVLAATMGPAWGVYSGYELFEHRAVREGSEEYLNSEKYELRPRDFAGALAEGRSLEPFITQLNTIRRLHPALQQLRTIHFHGVDNDALLAYSKFDPATGDCVLVVVTLNAFGPEEATLFLDMAALGMEPYERFWVRDEITGQEFQWGQANYVRIDPAQAVAHVINMPLIPDEARMTLLRRR

SEQ ID NO: 2682 - protein, 871 aa, Mycobacterium paratuberculosis
VKALRRFTVRAHLPERLAALDQLSTNLRWSWDKPTQDLFASIDPELWQRCGSDPVALLGAVKPARLDELAVDETFLGRLDELTADLNDYLSRPLWYQQQQDQGAQMPAAIAYFSMEFGVAEVLPNYSGGLGILAGDHLKSASDLGVPLVAVGLYYRSGYFRQSLTADGWQHENYPALDPQGLPLRLLSDATGDPALVELTLPDSAQLHARIWVAQVGRVPLLLLDSDVPENEHDLRGVTDRLYGGDQEHRMRQEILAGIGGVRAIRAYTAIHGLPEPEVFHMNEGHAGFLGAERIRELMTGSGLDFDTALAVVRSSTVFTTHTPVPAGIDRFPIDMVRLYFDDHADDAAGAPVLLPGVPTARILALGAEDDPTKFNMAHMGLRLAQRANGVSSLHGRVSRAMFNELWPGFDSNEVPIGSITNGVHARTWAAPQWLQLGYELAGSDSFSDPGVWLRVQQVDAGHLWGIRCQLRSLLVEDVRQRLRRSWLERGATDAELGWIETAFDPDVLTIGFARRVPTYKRLTLMLRDPDRLQQLLLDEQRPIQLIVAGKSHPADDGGKALIQQVVRFADRPEVRHRIAFLPDYDMSMARLLYWGCDVWLNNPLRPLEACGTSGMKSALNGGLNLSIRDGWWDEWYDGENGWEIPSADGVADEQRRDDLESGALYRLLEEAVAPKFYERDERGVPPRWIEMVRHTLQTLGPKVLASRMVRDYVEQYYTPAAQSWRRTIGPAEGATGGAEFGAARELAAYRRRAEEAWPNIVITDVDSTGLPDSPVLGSKLTLTATVALGGLAPDEVTVEAVVGRVDGSDALLEPVTVEMSYAGTAEGGNQVFSTTTPLPLAGSVGYTVRVLPRHPMLAAGNELGLVTLAR

SEQ ID NO: 2683 - protein, 663 aa, Mycobacterium paratuberculosis
VPELLATAVAALGGSEREGQQQMAAAVAQAFDTGRHLVVQAGTGTGKSLAYLVPAIVHALRDDSPVVVSTATIALQRQLVDRDLPRLIDSLAAALPRRPQFALLKGRRNYLCLNKIHNGGPADGEEAADRPQEELFNPMAVSALGRDVQRLTEWASSTDSGDRDDLKPSVPDRSWSQVSVSARECLGVARCPFGAECFSERARSRAGQADVVVTNHALLAIDAVSDSAILPEHALLVIDEAHELVDRVTAVATAELTSAALGVAARRIGRLVSPELVQRLEATTATFAAAIHDGTPGRIDRLDDELATYLAALRDAASAARSAIDTTSDPKAASARAEAVAALSEISDTASRVLASFGPAIPDRTDVVWLDHEDNRGAMRPVLRVAPLSVADLLRDRVFSRSTVVLTSATLTIGGSFDAMAAAWGLKGPDGDDPPWRGLDVGSPFQHAKAGILYVAAHLPPPGRDGVGSAEQLTEIAELITAADGRTLGLFSSMRAARAAAEAMRDRLSTPVLCQGDDSTSALVEQFSAEPQTSLFGTLSLWQGVDVPGPSLSLVLIDRIPFPRPDDPLLGARQRAVAARGGNGFMAVAASHAALLLAQGSGRLLRRVSDRGVVAVLDSRMATAGYGGYLRASLPPFWQTTNGAQVRAALQRLRTAATASGPG

SEQ ID NO: 2684 - protein, 508 aa, Mycobacterium paratuberculosis
LTGSSQTIVTHGLAVTSSGADSRCPVVPGLDFGSVGADITTMAPTIPRDGRRYRAPIRSRYRYGMNDPVVTGLLTDKYELTMLAAALRDGSAGRRTTFELFARRLPEGRRYGVVGGTGRLLEALPQFTFGDEACQSLRQFLDPDTLRYLRDFRFGGDIDGYAEGELYFPGSPVLSVTGTFAECVVLETLALSIFNHDTAIASAAARMVSAARGRPLIEMGSRRTHEQAAVAAARAAYIAGFAASSNLEAQRCYGIPAEGTSAHAFTMLHARTDAAAESTELAAFRAQVQALGVDTTLLVDTYDVTTGVANAVTAAGAGLGAVRIDSGELGVLARQVREQLDRLGASRTRIVVSGDLDEFSIAALAAEPVDSYGVGTSVVTGSGAPTANMVYKLVEVDGLPVQKRSSHKESRGGRKEALRLSRDTGIITEELVYPAGHRPDVAEPARAVTVPLVRGGELVSKPNLAAARELVASGLRSLPWEGLNLSHGEPAIPTTQIPADRRRPPGID

SEQ ID NO: 2685 - protein, 108 aa, Mycobacterium paratuberculosis
VGAMVVMSAPTEPKSRPGTTGQRESAPEDVTASPWVTIVWDDPVNLMTYVTYVFQKLFGYSEPHATKLMLQVHNEGKAVVSAGSREAMEVDVSKLHAAGLWATMQQDR

SEQ ID NO: 2686 - protein, 195 aa, Mycobacterium paratuberculosis
VRKWKRVETAEGPRFRSALASHEAALLKNLATAMIGLLDERESSSPADELEEITGIKTGNAQPPKDPTLRRLLPDFYRPDDNGDESPDAAESLNAALRSLHEPGIVNAKRVAAQRLLGTVPDDGGRFELTEDDANAWIAAVNDIRLTLGVMLEIGPDGPERLPADHPLAVHFDVYQWLTVLQEYLVLVLMGPRSS

SEQ ID NO: 2687 - protein, 347 aa, Mycobacterium paratuberculosis
MNAITDVGGIRVGHHQRLDPDASLGAGWACGVTVVLTAPGTVGAVDCRGGAPGTRETDLLDPANTVRFVDAVLLAGGSAYGLAAADGVMRWLEEHDRGVAMDGGVVPIVPGAVIFDLPVGGWQCRPTAEFGYLACAAAARDDDAPAVGTVGAGVGARAGALKGGVGTASRTLPSGVTVGALAVVNSAGEVVDRATGLPWMTDLVEQFGLRPPPAEQIEAFAALPSPSNPLDNPLNTVIAVVATDAALSAAACRRVAVAAHDGLARSIRPAHTPVDGDTVFVLATGAVEVPPEADTPAAFSPETRLATEVGVAAADCLAHAVLGGVLAADSVAGIPSYRDVLPGALGR

SEQ ID NO: 2688 - protein, 72 aa, Mycobacterium paratuberculosis
MGKTTGRAPAAQTKKRSTAAAGATTIVTFVALLYLVELIDQLTRHALDVHGIRPQRVDGLWGIVFAPVLHES

SEQ ID NO: 2689 - protein, 147 aa, Mycobacterium paratuberculosis
MANTVPLLVLGFLMTLAGLARFVWATVIIWIVGGFGTWLIGNVGSSCGPTDHIGASGLIFGWLAFLLVFGIFVRRVRDIIIGLAVMFAYGGVLLGAMPVLGLCGGVSWQGHLCGAIAGVLAAYLLSEPERKGRSGRKTGAGAPRPKT

SEQ ID NO: 2690 - protein, 275 aa, Mycobacterium paratuberculosis
MSSALAPVGIFDSGVGGLTVARAIIDQLPDEHIIYVGDTGHGPYGPLSIPEVRAHALAIGDDLVGRGVKALVIACNTASAACLRDARERYEVPVVEVILPAVRRAVATTRNGRIGVIGTQATINSHAYQDAFAAARDTEITAVACPRFVDFVERGVTSGRQVLGLAEGYLEPLQRAQVDTLVLGCTHYPLLSGLIQLAMGDNVTLVSSAEETAKEVLRVLAERDLLHPHPDDPRAAGPSRVFEATGDPEAFTRLAARFLGPAVSGVRPVHHVRID

SEQ ID NO: 2691 - protein, 275 aa, Mycobacterium paratuberculosis
MRQCFRHGPIGHGTVVSVRITVLGCSGSVVGPDSPASGYLLRAPDTPPLVIDFGGGVLGALQRYADPSSVHVLLSHLHADHCLDLPGLFVWRRYHPTRPLGKAMLYGPGDTWSRLGAASSPYGGEIDDCSDIFDVRHWVDGEPVTIGGLTVTPRVVAHPTESYGLRVTDHTGASFVYSGDTGACDQLVELARGADVFLCEASWTHSPDRPPALHLSGTEAGRAAAQAGVHELLLTHIPPWTSREDVISEAKAEFDGPVHAVVCGETFDVRRSERV

SEQ ID NO: 2692 - protein, 259 aa, Mycobacterium paratuberculosis
VTRREDGRLDDELRPLVITRGFTEHPAGSVLIEFGHTKVMCTASVTEGVPRWRKGSGLGWLTAEYAMLPSATHTRSDRESVKGRLSGRTQEISRLIGRSLRACIDLAALGENTIAVDCDVLQADGGTRTAAITGAFVALADAVTYLSAAGKLSDPRPLSCAIAAVSVGVVDGRIRVDLPYEEDARAEVDMNVVATDTGTLVEVQGTGEGATFPRSTLDKLLDAALAACDKLFAAQREALKLPYPGVLPEGPPPPKAFGS

SEQ ID NO: 2693 - protein, 101 aa, Mycobacterium paratuberculosis
MRVALWAWRCRMSDDAERRSRVSGAARRSADEAAERVAAARERLHAARLSAGDAHERAAQLHDRAAGGGASVTSKPTTGLPSGIERHGMRTTWLLSRISKA

SEQ ID NO: 2694 - protein, 204 aa, Mycobacterium paratuberculosis
LSPLLVASRNRKKLAELRRVLDAAGVTGLTLVSLDDVAPFEEAPETGAVFEENALAKARDAFAATGLASVADDSGLEVAALNGMPGVLSARWSGRHGDDAANTALLLAQLRDVPDERRAASFVSACALVSASGEVVVRGEWPGRIAREPRGDGGFGYDPVFVPDDAAGRTAAQLSPAEKDAVSHRGRALRLLVPALETLARARG

SEQ ID NO: 2695 - protein, 116 aa, Mycobacterium paratuberculosis
MTTPETPGAPVPAVPVDKIRTALLGYRIMAWTTGLWLIALCYEIVSHLVMHHEIRWIEVVHGWVYFVYVLTAFNLAVKVRWPIGKTIGVLLSGTIPLLGIIVEHFQTRDVKARFGV

SEQ ID NO: 2696 - protein, 126 aa, Mycobacterium paratuberculosis
VPRKRRRRPALIALVIIAACGCLALGWWQWTRFQSVSGSFQNLGYALQWPLFAWFCVYAYRKFVRYEEEPPRPRDTAAVTEIPAGLLPERPRPTPQPPDDPALREYNRYLAELAAQDAAQQNRTTT

SEQ ID NO: 2697 - protein, 174 aa, Mycobacterium paratuberculosis
VWTLGARIAVPASAVSLLLSGCSEVRNPIAPPQARAQVIAAARDIVQALHPEVTEANFSYESCNDQGEAPFRGVVNLSFWMPGVPHNQAVDPQAVIKGLVADRWSTDSDFVSHGATLKKNGVNVILTIAPQAGPSTVYHRHVGADINGECRDTTDHRTDGSTSPVDVSKEIQPQ

SEQ ID NO: 2698 - protein, 526 aa, Mycobacterium paratuberculosis
LSWGFGDDCWVQGRSDDQRELLDAESVAGHLLKADSMFAFLAAHRSQLFPEEMFADLFPSQRGRPSVPAEVMASVITLQALHGFSDNETVDAVTFDLRWKAACGLPITAGAFHSTTLTYWRRRLAASDRPNRIFEAVKTVVAETGVLAGKTRRALDSTVLDDAVATQDTVTQLIAAIRRVRREVPGAAAVIEAHCSAHDYDDPGKPAIAWEDKAARDRLVDGLVGDAHRVLGYLPDQELAPRAAEAVALLALIAGQDVEPVEGSDGTDGHWRIAQQVSGDRVISTVDADTRHAHKTVHRRQDGFKAHLAVEPDTGIITDCALTKASGADNHEAVVGLSLLEGEHTPRCGSWGDSAYGTGAARAALADAGHVAVIKPLPLRSPVPGGFTSDDFLIDFDARIVTCPAGHGMPIRPSGGVTFERYCRSCPLASRCTTATRGRKLTLHIHEQLLRAARVAARDPDWQAEYRQHRPMVERSMAWLTRGNRKVRYRGTAKNNHWLHHRAAALNLRRLLTMGLTRTDTTWAIA

SEQ ID NO: 2699 - protein, 120 aa, Mycobacterium paratuberculosis
MDLTGYEGDAMPTGYESTPHGEKAVSAEDVELAELRAAKARERAARAGLSAARSFEESAVQHERVAKTQDWTVQQGVPEVDMHRASAIKHRQAAAEDRKLAERKRRESAADLASPASASD

SEQ ID NO: 2700 - protein, 869 aa, Mycobacterium paratuberculosis
MARGLQGVMLRSFGARDHTATVVETVRIAPHFVRVRMTSPTLFEDVDAEPAAWLRFWFPDPDGSKTEFQRAYTISEADPAAGRFAVDVVLHDPAGPASRWARTVQPGTTIAVMALMGSSRFDVPDEQPAGYLLIGDPASIPGMNGIIGVVPDDVPIEMYLEQHHDDDTLIPIAVHPRLRVHWVARRDEKSLAAALESRDWSNWYAWATPEATTLKHVRARLRDEFGFPKSEVHAQAYWSAGRAMGTRRGDEAATTDDGTETPEAIAAQADSTQRQPEAAPVPAARGNWRTQAAGRLLAPLRWALIPSGVLQAVITLIQLAPFVLLVELARRLVAGAPAARLWDVGIAAVSLLGLGALLGAALTLWLHVVDARFARDLRSALLRKLSRLPLGWFTARGSGSIKQLLQDDTLSLHYLVTHAIPDAVAAVVAPVAVLVYLFAVDWRVALVLFVPVLVYLVLTASLTIQSGPRIPQSQRWAETMSDEAGAYLEGQPVIRVFGGAAASSFRRRLDEYVGFLVAWQRPLAGKKTFMDLVTRPSTFLWLIAAVGTLLVVAGRMDPVNLLPFLLLGTTFGARLLGIAYGLGGIRAGMLAARRLQNTLDEHELEVREPGEPTGESAQAVVFDNVGFGYRPDVPVIHDVSLTLRPGTLTALVGPSGSGKSTLAALLARFHDVDRGSITVGGRDIRSMTADELYARIGFVLQETQLVHGTVAQNIALAVPDATAAQIEQAAREAQIHDRIMRLPHGYDTVLGAGVGLSGGERQRLTIARAILADTEILILDEATAFADPESEYLVQQALNRLTRNRTVLVIAHRLHTITRADQIVVLDHGRVVERGRHEELLAADGRYRRLWEGGRRDAVTVGTAGEVAR

SEQ ID NO: 2701 - protein, 578 aa, Mycobacterium paratuberculosis
MIRTWLSLVPADRRNKVVAYTVLALLSVAVRAVATVLLVPLVGALFSGTPHRALVWLGWLTAATAIGWAIDTATARIGFNLGFAVLDHSQHDVADRLPGVRLDWFTAEHTATARQAIAATGPELVGLVVNLLTPLISAVLLPAAIAVALVPVSWQLGLAALGGLPLMLGALWASARLARRADSTAAEANSALTERIIEFARTQQALRAARRVEPARSLVGDALAAQHGATMRLLAMQVPGQLLFSLASQLALILLAGAATALTVNGTLTVAEAIALIVVIVRYLEPFTTISELAPALESTRATLDNIRAVLTAPQMNAGSASLPGTAAPRIEFDEVVFRYDGASAPVLDGVSFSLEPGSTTAIVGPSGSGKSTILALIAGLHEPTRGRVRIDGVDAATLDAESRRAASSVVFQHPYLFHGSIRDNVLAGDPGAGDDAYARAVALARVDELVARLPDGADSVVGEAGSALSGGERQRVSIARALLKPAPILLVDEATSALDTENEAAVVDALTADPRSRTQVIVAHRLASIGHADRVLFLDDGRVVEDGTVDELRAAGGRFAEFWRQQHEAAEWRIPAG

SEQ ID NO: 2702 - protein, 374 aa, Mycobacterium paratuberculosis
MPYSLSVGSASRRRAAMSAVLSIPRYPGDVTPQWLSAALSGRGAPVEVAEVDVAAIGTGQTGATYRVTARYATDPGDLPQTFVIKLPAQDDTVRDRVVIGYRSECAFYSSVADRVQVPTPRCFYSEITEDAMDFALLLADQAPAVQGDQLLGCGETEARLAVTALAGLHAPSWCDPVWLDFPGIAFGRPDEAGAGGMGEVAKMSADITLERLGDRMSAEDRETFAAAMGVIAPWLLSEYDRFALLHGNYRLDNLLFDPDRTRVSVVDWQTLGVGLPARDLAYFTATSLDSPLRAAIEEELVADYHRALVAGGVSGYNLETCWRDYRLGVLQAPLISALGFAFAAATERGDDMVLTMLGRGCRAIRELGTLELIG

SEQ ID NO: 2703 - protein, 142 aa, Mycobacterium paratuberculosis
MKPFSESERQEFLAGTHVAVLSVEATDGRPPAAVPIWYDYTPGGDIRIMTGASSRKARLIERAGKVTVVVQREEPPYQYVVVEGTVVDATKPAPSDVQLAVAIRYLGEDGGRAFVQSLEGVEEVLFTIRPDRWLSADFTGDL

SEQ ID NO: 2704 - protein, 272 aa, Mycobacterium paratuberculosis
MAGKLEGRVAFITGAARGQGRAHAVRMAAEGADIIAVDIAGKLPSCVPYDPASPDDLSETVRLVEAANRRIVAAVVDTRDFDRLRKVVDDGVAALGRLDIIVANAGVAAPQAWDDITPEDFRDVMDINVTGTWNTVMAGAPRIIEGGRGGSIILISSAAGMKMQPFMIHYTASKHAVTGLARAFAAELGKHSIRVNSVHPGPVNTPMGSGDMVTAVGQAMETNPQLSHVLTPFLPDWAEPEDIADTVCWLASDESRKVTAAQIPVDQGSTQY

SEQ ID NO: 2705 - protein, 397 aa, Mycobacterium paratuberculosis
MTSAEVAEVSEQDFGEILAQTRQFVRTAVVPREQEILDGDRVPDDLRDQARKMGLFGYAIPQQWGGLGLNLMQDVELAMELGYTSLALRSMFGTNNGIAGQVLVGFGTEAQKARWLEPMAAGDVVASFALTEPGAGSNPAGLRTKAVADGDNWVISGQKRFITNAPVADLFVVFARTRPADDQGPGIAVFLVPADAAGVQVGAKDAKMGQEGAWTADVSFDDVRVGGDALIGGSENIGYRAAMTSLARGRVHIAALAVGAAQRALDESVSYAATATQGGTPIGNFQLVQAMLADQQTEVLAGRALVREAARLWVTGEDRRVAPSAAKLYCTEMAGRVADLAVQVHGGSGYMRGVPVERIYRDVRLLRLYEGTSEIQRLIIGSNLVKAAQRATTTKER

SEQ ID NO: 2706 - protein, 248 aa, Mycobacterium paratuberculosis
VVQVSLLSGQTAVITGGAQGLGFAIAERFVAEGARVVLGDVNLEATQTAAKQLGGDQVALAVRCDVTKSSEVETLIQTAVERFGGLDIMVNNAGITRDATMRKMTEEQFDQVIAVHLKGTWNGTRLAAAIMRENKRGAIINMSSVSGKVGMVGQTNYSAAKAGIVGMTKAAAKELAYLGVRVNAIAPGLIRSAMTEAMPQRIWDSKVAEVSMGRAGEPSEVASVALFLASDMSSYMTTVMEITGGRHL

SEQ ID NO: 2707 - protein, 405 aa, Mycobacterium paratuberculosis
VSAVREAVICEPVRTPIGRYGGMFKALTAVDLGVAALGGLLQRTGLPPEAVQDVILGHCYPSSEAPAIGRVVALDSGLPVTVPGMQVDRRCGSGLQAVIQACLQVRNGDHDLVIAGGCESMSNVAFYSTDMRWGGARSGVRVHDGLARGRTTAGGRRYPVPGGMLETAENLRRQYGISRQEQDELAVRSHQRAVAAQKDGILAQEIIAVAVPTRHGDELIDTDEHPRADTSVESLSKLKPVLLDQDPEATVTAGNASGQNDVASMCVVTTPEKADEHGLRPLVRLVSWAVAGVAPHIMGIGPVPATEVALAKAGLSLSDIDLIELNEAFAAQALAVMREWKFGAADHDRTNVHGSGISLGHPVGATGGRMLATLARELTRRQARYGLETMCIGGGGLAAAFERVA

SEQ ID NO: 2708 - protein, 399 aa, Mycobacterium paratuberculosis
MTDPRLPLHGLSVVEVSSFVAAPLCGMTLSQLGAEVIRVDPIGGASDVQRWPLAADGTSIYWTGLNKGKRSATIDLRSAEGQRLVQRLIVEGDGVVVTNAAGLSWLSHDALAALRADVIHVQLLGRGDGSTGVDYTVNAGIGYPLVTGPAEHAGPINHVLPAWDVCCGLYAALSVVTAVHRREQSGAGARISLALEDVALATAANLGLLTEPQVVGTQRERLGNAIYGQYGQDFTSRDGARFMVVTLTGRHFRDLLDVTGTGAAVSALADALGVDFGSEGERYRYRDVLSGLFATWFGDHTADEITAALSHTTVLFERYRTFAEVAAGPKVTANPLFSRLHQPGLGDYFAPGLPAAFDGTHPAGAPAPALGQDTAEVLARLGLTAADIERLADAKTIAC

SEQ ID NO: 2709 - protein, 397 aa, Mycobacterium paratuberculosis
MTRLAQTLGLTEFQTEIIATVRQFVDKEVIPHAAELERADTYPQDIVDQMRDMGLFGLMIPQEYGGLGESLLTYALCVEELARGWMSVSGVLNTHFIVAYMLRQHGTDEQKQRFLPRMAVGETRGAFSMSEPELGSDVAAIRTRARRDPDGGYTIDGQKMWLTNGATSTLIAVLVRTDEGSDKPHRNLTAFLVEKPVGFGEVVAGLRIPGKIDKLGYKGIETTELIFDGYRAAADDILGGTPGQGFFQMMDGIEVGRVNVSARACGVAIRAFELAVRYAQQRETFGKPIAEHQAIAFQLAEMATKVEAAHLMMVNAARLKDSGERNDVAAGMAKYLASEYCAEVTQQSFRIHGGYGYSKEYEIERLMRDAPFLLIGEGTSEIQKNIISKRLLAEYRV

SEQ ID NO: 2710 - protein, 230 aa, Mycobacterium paratuberculosis
MSVPDFAARPQLSDDVAHLIRGRIFDGSYAAGSYVRLDQLAAELGISVTPVREALFALRAEGLISQQPRRGFVVLPVTRRDVTDVANVQAHVGGELAARAAVNITDDQLRELKQIQAQLEDAYAGDEHERTVRLNHEFHRAINIAADSPKLAQLMSQITRYAPESVFPAIEGWPEQSMKDHRRILSALKKRDDKLARAAMSEHLAAGAVPLIDHLVARGVVVDAGGPDPG

SEQ ID NO: 2711 - protein, 120 aa, Mycobacterium paratuberculosis
MFPTLRASAVLVVCVAAIATAAPAFPDPMDPIPGNGVFVVGPDIAPGLYHTGGSGSAFGVWINNVPTQDSMCSWFTYSTADANKEHVLQTNTSIGPMYANINSAVKAFESQNCQPWTRVS

SEQ ID NO: 2712 - protein, 518 aa, Mycobacterium paratuberculosis
MPEASAPTIDHLVRSRAAEFGGKPMVIDPGSRISYDQLDTATRELAAVFVQAGVGKGTRVGLIMPNNTRWVLIAIALTRIGAVLVPLSTLLRAGELVAQLRVAAVQFLVSVDEFRGHRYLDDVAAARSELPALQQVWPNEQLDAAAAGARAGQIVDAMTQTVTPADPLVIMFTSGSSGTPKGVWHSHGSALGAVQSGLAARCIDADSRLYLPMPFFWVGGFGSGILSALLAGATLVTEEIPRPETTLRLLESERVTLFRGWPDQAETLARHAGTVGADLSALRPGSLQALLPPEQRARPGARATLFGMTEAFGPYCGYPADTDMPVSAWGSCGKPFDGMEVRIVDPDTGAPVGAGTAGIIQIRGPHTLRGMCGRSREELFTVDGFYPTGDLGHLDDAGFLFYHGRADDMFKVSGATVYPSEVERALRTIDGVDSAVVTNVPGATGDRVGAAVVCRELTAAQLRAAARNLLSSFKIPTVWLVLRSDDDLPRGGTGKVDVRRLRELLADADRRQETRVQG

SEQ ID NO: 2713 - protein, 524 aa, Mycobacterium paratuberculosis
MPGDFATVGATLRHQARRRGDHPLLICDAERISYAEADVRSAELARGLIALGAGKGTHVGLLHPNGARFVVAMLAAARIGAVVVPFSTFVTARELREQLLDSDVEILLSARSFRSHDYARRLSEAVSETDFDPGRRLFCTAAPQLRRVLFAPQTVGAPGGGIDPALLAAMEDDVQACDPLAIVYTSGSTSTPKGVVHTHGALLEHQRNLNGIRGLTADDRLFCNSPFFWIGGFAFGLLATLVAGSTLICSNATDAGATLDLLEAEKPTMTNGFSAGIAHLAEHPSFADRDLSSMRRGNLYPIMAVEARPADPELRHNMLGMTEAGGVVLIGDDEADQPEHRRGSFGKPAPGFEARILDPDTGAAVAVGKVGELCIRGPYLMQRYHKRSREECFDPDGWFHTGDLVRADADGYFYFAGRLGAMIKTAGANVSAVEVEKAIAAVTGGATAYVVAIPDARRGQLVAAAVVWPDDRAALDPDALRERLKSELSAYKIPRRFASLRRADVPLLSSGKVDLRQLRKLFDA

SEQ ID NO: 2714 - protein, 485 aa, Mycobacterium paratuberculosis
MPRHPLVQRIADVLDLDPHGRAIEYGGQWFSWAQLGATARQVAARTTGTEVGMLLRNRPWQVAAFLGVLLGGGTVVVVNPSRGDERTRADLARLRLPLIIGEPDDLAALVTDDTPTMPISRLADPPGPAAPPAAAPRSVAVRMLTSGTTGPPKRIDLGYDMLARSVLGVEPGTAPAPTEPRRDVAIVNSPLVHIGGVFRVLQCVAEARPFVLLERFELNAWTAAVRRHRPRAVSLVPAALRTVLHSDLPRADLESIQVVTCGTAPLSADDADAFTEKYGIPVLTSYAATEFGGGVAGWTLADHRRYWRVKRGSVGRANPGAALRVVAEDGTPLGPDEIGLLEVKPGQLGPDAGWLRTTDMARIDADGFVWIVGRADQAIIRGGFKVMPDDVRAALESHPAVAGAAVVARPDPRLGETPVAMVELRAPSTTDALVQHLRERLARYEIPTEIAIVDALPRTPSGKADLAAVRGYFAERPTVLRNHAR

SEQ ID NO: 2715 - protein, 270 aa, Mycobacterium paratuberculosis
LAMPMSAQFDTILLEVDATDHVATITLNRPEQLNAFNRAMCAEMAQAWRLVKLDDAVHAVVLRAAGDRAFSAGLDIKTPYGQPENIWNHEDPGEALSPKWQKMWKPVVCAVQGMCTAGAFYFVNESDVVICSQDATFFDSHVSAGLVCALEPVGLMRRIGLGETLRIALMGNDERVGADTALRIGLVTEVVPAERLWDRAHEIAATIAAKPPTATAGTVKAIWESLDKPYRAAMEQGLIYTRLGNPLGTAELAAGRDAGARGAARTPKIR

SEQ ID NO: 2716 - protein, 270 aa, Mycobacterium paratuberculosis
MPVDSFDTIKYEVDGHTATITLNRPDALNALSPHMITELRAAYHEAENDDRVWLLVVTGTGRAFCSGADVKEIPEDGKVIYERPYLSTYDQWEAPQEGTPPFRTMAKPVLTAVNGICCGAGMDWVTTTDIVIASEQATFFDPHVSIGLVAGRELVRVSRVLPRSIALRMALMGKHERMSAQRAYELGLISEIVEHDRLLERAHEIADIVNSNAPLAVRGTRLAILKGLNVPLHEAEILAETFRERVLRTEDAAEGPRAFVEKRQPNWQCR

SEQ ID NO: 2717 - protein, 286 aa, Mycobacterium paratuberculosis
MGNRIGEERPDSTVSQGADAAAAEGSVAVHRQGAVLRLTLDRPSRRNALTQLMIATLVDALTAAASDDSLRAVHIVGAGDDFCAGADWVAVNDPGGPRPRAGDLVRRIPHAAHRVIELVAGIQLPVVCSVRGWAVGFGCNLALAADFTVAAADAVFWEPFVERGFSPDSGSTWLLARLVGLARARRMLLLGEKVGGRDAADWGLIHRAVGGAELDDAAEELVGRLAAGPTAALGLAKQALSFGQHATLSQSLTQELFNLELSCRTSDFKEGLEAFRQRRDPDFRGR

SEQ ID NO: 2718 - protein, 231 aa, Mycobacterium paratuberculosis
MTIEEGQAAPASAPGGDARFGEAPLAQTVAAAAAIRRLSSLLVSLEHPHPAVDAMLAKFTEWESELSAAAPADNAPRIGEMPDDPRRVYLNHATDIGAYNPCFPEYRFTGLDAEKATGRVDFPLVYEGPPGLVHGGFLAVFFDCVIQHHNCVTGRSGKTRSLAVTFRRPTPVLTELAFDITRSQGERGITSTARLLLGDDVLCTGEVNTLASRPDQLAGSRFGRRRKESDT

SEQ ID NO: 2719 - protein, 296 aa, Mycobacterium paratuberculosis
MTASSTSDDRVLFDVDAEHRIATITLNNPKQRNSYDAAMREAIARCLDRVAEDDDLTVVLLRGAEGVFSTGADMNNAYGWYGTSRNADESTRRRPSQRRRLTVDRKSFGFYHNFMGFPKVTVGEIAGYALGGGFEMALMTDISVIARDTKIGMPATRFLGPALGSLHMFFHRLGPVLARRLLLTGDIIDAGQVEHLGIFTDTCDPAAVTARARYWAEKAAKMPADGVVIAKEAFRLVEQSQAYQGEEVASYLFHAFGTNLQFAPGEFNFVKSRAEHGAKEAFRLRDEHFHVPEPEA

SEQ ID NO: 2720 - protein, 268 aa, Mycobacterium paratuberculosis
LMEVPVVAKQATADKRQRRERGSINPDDIITGAFELAEQVSIDNLSMPLLGKHLGVGVTSIYWYFRKKDDLLNAMTDRALSKYVFATPYVEASDWRETLRNHARLMRKTFMGNPILCDLILIRAALSPKAARLGAQEMEKAVANLVQAGLSPEDAFDTYSAISVHVRGSVVLQRLYEKNQSSDVGPRAIEDAVAIDPEKTPLLAQVTRIGHRIGAPDETNFEYGLTCILDHASRLIEEGKGAKAGPSRQRKPAKSSAARGRTKAPANR

SEQ ID NO: 2721 - protein, 265 aa, Mycobacterium paratuberculosis
MDLGLANAAAVVVGGSRGMGLATARCLADEGARVAVIGRSRDALDSAVTDLTRRGSPDALGLVADIGDDAAVGQAFGELARRWDGELNALVITVGPGAAGTFEDLTDEQWRQAVEDGVLGMVRCVRAALPLLRKAQWARIVTFSAHSTQRQSVLLPAYTAAKSMLTSVSKNLSLLLAKDEILVNVISPGSIASESLVGWANSVGVDGRDPYALMEAIGKHFGHPAHMPRAGLPEEIGPVAAFLASRRNSYMTGANINVDGGSDFT

SEQ ID NO: 2722 - protein, 338 aa, Mycobacterium paratuberculosis
VATAADARAWARGALRGIGDSLYTPFCGPDGDDIDWDAYRELVRYCVGDLGHPMLWCTSGIAEFWALTLDERKRLLEVAIEEGRAANPDVVIQACTAAMSAKDCVELTLHAQQVGADIAYIQTPMMEAHGGEGVLRFFEYVAARTDIALGMFNSPSSGYVLTPAESARIYHEVPAVCATKEGAFRPGASRLLHELAPGLVLWECDKTVYRAGWLRDGIVCPAQLGTAGYLFETPQRRLFSEYWDLVQSGKLIEAMDYGRESGLDQFDLDVGSWWTCHPGRADYFTHWGGAFKYAASLLGLPIGAYPHSRPPQAELPAEAKAQIENAYQRLGLLATALR

SEQ ID NO: 2723 - protein, 111 aa, Mycobacterium paratuberculosis
VARATPAPCLPPAGRRERPWKEPTIMGEGDAMVDVKSGPVELVQGIVDDVLGRAKQVIGIIIGHNGLIEQGKAQQDKADAQRSAGKKEAAAEKARGKAKAYEQRERAEQQQ

SEQ ID NO: 2724 - protein, 275 aa, Mycobacterium paratuberculosis
LMSAADHVVTDEAVLYQTTETGVAVVTFNRPGRLNAWGPDISSGFYACIDRAEADPAVRVIVLTGAGRGFCAGANLGGAGSIDAKLGDGDTDVTALVGDRHPHFLTALRKPIIAAINGACVGIGLTHALMCDVRFAAAGAKFATAFTRRGLVAEYGITWILPRLAGWGAAMDLLLSGRTFFAEEAAKLGLVNEIVAPDELMTRALTYADDIARNCSPASLAVIKRQAYDDALRDIVDVSARAETLMHESLQRPDVIEGITSFLEKRPPRFPPLAT

SEQ ID NO: 2725 - protein, 400 aa, Mycobacterium paratuberculosis
MTALNYRVIDVDNHYYEPLDSFTRHLDKKFKRRGVQMLSDGKRTWAVIGDRVNHFIPNPTFDPIIVPGCLDLLFRGEIPDGVDPASLMKVERLADHPEYQNRDARIAVMDEQDIETAFMLPTFGCGVEEALKHDIEATMASVHAFNLWLDEDWGFDRPDHRIIAAPIVSLADPTRAVEEVDFVLARGAKLVLVRPAPVPGLVKPRSLGDRSHDPVWARLAEAGVPVGFHLSDSGYLHIAAAWGGKSTFEGFGAKDPLDQVLLDDRAIHDTMASMIVHGVFTRHPKLKAVSIENGSYFVHRLIKRLKKAANTQPQYFPEDPVEQLRNNVWIAPYYEDDLPELARVIGVDKILFGSDWPHGEGLASPVSFTAELKGFSESDIRKIMRDNALDLLGVQVGSAA

SEQ ID NO: 2726 - protein, 545 aa, Mycobacterium paratuberculosis
VSEWTIGAVLDEIADVIPDRTMTVCGDRRSTFAESADRTRRLANFLSGNGLGVHRERAVLQNWECGQDRVALVMHNDLYPDMVVGCLKARTVPVNVNYHYTPREVGELFDYLRPRAVIYHRGLGPKFADVLGRGDVDLLIAVDDGSEAAQLPGAVSLDDALAQGDTGHPAPGSPDDLLMICTGGTTGRPKGVLWRQSDIYVSSMVGADHACAQEIRDKVSGAAGAPWFAVSPLMHAAGMWTAFAAIMAGTTVVLYDTGKKLDPRSVWETAQRERVGMMTMVGDAYAAPLVAELQRGSYDLSSLYAIGTGGAATNPKYQQALLELLPHITLINGYGSSETGNMGFGHSRTGTRTDTFTLREGGLVLAEDYSRFLSPGEPQLGWVAREGRIPLGYFDDPDATRKTFPVIDGKQVVISGDRAALEPDGTLRLFGRDSLVVNTGGEKVFVEEVEEVLRAHPAVADALVVGRPSGRWGEEIVALVELRAGTGAAADELHAHCTSRLARFKAPKEFLFVAAVQRLGNGKADYRWAKRHAVTEASEKAPMST

SEQ ID NO: 2727 - protein, 276 aa, Mycobacterium paratuberculosis
MRAIDCLVNVHFGETEKQPTWMLKVRDDYFKGPASMFAPVELSELIDEMDAQGVRKAILMDNLAKPSVTARKFVEDKPERFALAMGGVKLLRPIPSLRELGAVVADLPVAYAAVGPSFWGDGQYPPSDAVYYPLYTKCAELELPLCVNTGIPGPPIPGEVQNPIHLDRVCVRFPELKLCMIHGADPWWDVAIRLLLKYANLRLMTSAWSPKRLPESLLHYMRTRGQDKVIFASDWPVLKMHRVVPEAAELDLPADVLENYLYNNAHEFFFGGHKEG

SEQ ID NO: 2728 - protein, 348 aa, Mycobacterium paratuberculosis
MDRYELRRLDYSLTDDHQALQAAYRDFFTTHCPIETVRAAEETGFDKNLWERLCAMGATSMAVPESAGGDGATLVDLTLVAEEIGRSLAPVPWIDQVCTARLLARLGAVEPDVVHGKRLAGFDPQHDSLSGPRLIPTGSIADAIIVRDGDDVVALSFGTRPAKVDNIGRLPMAWVDPAAADTRTVLAGGSDALAEYQRALDEWRVLTAAALVGLVEETMTIAAEFAKTRYTLGVPISTLQGISHPLANIAITVQGGRNLARRAAWFLDNEPDERPELAPSAFVFMAEEAAKAATMAVHVQGGLGVSAEAAATAYLVRARGWALAGGDPGASAKYIGELVAARESGKGA

SEQ ID NO: 2729 - protein, 397 aa, Mycobacterium paratuberculosis
VDFSRVTLSDEDQRFLDEAREFLRTHVTDEVRRRDRETGDNFDEGVHLALGAAGYLEREWKPEAEGGFSRVQRRIWELEKRRAHVPWVTWGTTAMVARSVTKFGSEELQREVLPGVFSGHVRLCLGYTEPEGGSDVATCKTRAVRDGNGWIINGSKMFTTGAHNCQYVFLITNTDPDAPKHKSLTMFLVPLDSPGIDIQGIRTVDGDRTNIVYYSDVRVDDKYRLGDVNAGWTVLREPLNVEHGAVAAAPDGLQDVSIMMHQAGFMADALDKVAAKVMQPDPHGRRLIDDSAIAYRLGRNAARMEAALSAPSIYGRVALAQTMRDISPDLMDILGTASALPVGTDGAADDGASEYVFRFAPLVGIYGGTLEVFRNMIAQYMLGLGKPAYAPVAQRAS

SEQ ID NO: 2730 - protein, 381 aa, Mycobacterium paratuberculosis
MSDVAIIGVGLHPFGRFEGKTAMEMAVDAIQLAVADAGVEWKDIQAATGGSWTVANPDAIVGMVGLSGIPFTNVFNACATAASAAKACADGIRLGDYDIGIAIGLDKHPRGAFTEDPALVGMPRWYAENGQYLTTQFFGMKANRYLHQHGISQRTLAKVAAKNFRNGARNPNAFRRKPIPEDEILNSPMLNYPLTQYMFCAPDEGAAAVVMCRADIAHRYSAKPVYLRAVEVRTRRYGAYEVNTTFAPVDEDVAPTVYAARAAFEKAGVAPQDVDVIQLQDTDAGAEIIHMAECGFCADGEQEKLLADGVTEITGAMPINTDGGLIANGEPIGASGLRQIHELVRQLRGEAGDRQVAGEPRVGFAQLYGAPGTAAATILTT

SEQ ID NO: 2731 - protein, 408 aa, Mycobacterium paratuberculosis
MVKVMQGFRVLEVAQFTFVPAAGAILADWGADVIKVEHPVRGDTQRGFVNMGGIQVVPERHPLMEHPNRGKRSVGVDVSTPGGQEVIYELAKTSDVFLTNYMPAQRRKHKFDVEHIRAVNPNIVYARGSAYGDKGAERDVGGYDGTAFWTCSGIGYALTPEELGGALGQGIPAFGDSIGGMFIAGGISAALLHRERTGEAVELDVSLLSTAWWAAGASVTQGMETGEVMRTPMPGAGTPSVNPFMGNYETSDGGTINLCIISPTGLIRDTFEHLGIPEAADDPRFCDVLPLIQNADAAAELIAKAFAAKPFDYWRQHLKTMKGQWAPFQSLLDLIDDEQAIANDMIAEVELAGGGKPFRVVRGPVQFNHEPLATTRAPQASEHTELVLMELGMDWDRIEELKNAGAIA

SEQ ID NO: 2732 - protein, 400 aa, Mycobacterium paratuberculosis
VMTNVPTAAGDETVSLRDPYPFFARKRREAGVFAGTVMDYSKTPESLMPKQEYSAVSFDAVNTVFRDGRVFSSKPYDKTIGLFMGPTILAMEGKKHRDHRNLVSAAFKSKALARWEPTIVRPICNALIDDFIDAGTADLVRQFTFEFPTRVIARLLGLPDEDLPMFHTRAVQLISYHVDYERAFEASAALKDYFLEQIEQRKSKPTEDIIGDLVTAEIDGEKLSDEAIYSFLRLLLPAGLETTYRSSGNLLYLLLTHPDQFAALQADRELLAPAIEEGLRFETPLTTVQRFTTEDTELQGVRIPARSVIGVCIGSANRDERRWERSEEFDIFRKHVPHISFAAGEHTCLGLHLARLETRVAMECLLNRLTNVTLLSDGDPHIHGQPFRSPTALPVTFDAK

SEQ ID NO: 2733 - protein, 280 aa, Mycobacterium paratuberculosis
MKYQGRVVVVTGAGSGIGRALTQALTAGGAHVAASDIYDNGLAETQASCGPGQVTPYRIDVADRDAVLGFADEVRRKHGPASMVFNNAGVDLFASVADMSWEDFDWLMGINVGGVVNGTKAFLPQLIEAGSDRRPSRLVNLSSAFGLIAVPYQGAYSTSKFAVRGFTEALRQEMIIERHPVTVHCVHPGVVRTNFGANMRTSDTEDPDLAAQLFDRAALTTPARAARLILRGAEKNRARILIGADGRAMAALPRLLGVAYAGLLARAARLTDSRAAHSGR

SEQ ID NO: 2734 - protein, 550 aa, Mycobacterium paratuberculosis
MSDTTTAFTVPAVAKAVAAAIPDRELIIQGDRRYTYRQVIERSNRLAAYLHSRGLGCHTEREALAGHEVGQDLLGLYAYNGSEFVEALLGAFAARVAPFNVNFRYVKSELHYLLADSEATALIYHAAFAPRVAEILPELPRLRVLIQIADESGNELLDGAVDYEDALASVSAEPPPVRHCPDDLYVLYTGGTTGMPKGVLWRQHDIFMTSFGGRNLMTGEPSSSIDEIVQRAASGPGTKLMILPPLIHGAAQWSVMTAITTGQTVVFPTVVDHLDAEDVVRTIEREKVMVVTVVGDAMARPLVAAIEKGIADVSSLAVVANGGALLTPFVKQRLIEVLPNAVVVDGVGSSETGAQMHHMSTPGAVATGTFNAGPDTFVAAEDLSAILPPGHEGMGWLAQRGYVPLGYKGDAAKTAKTFPVIDGVRYAVPGDRARHHADGHIELLGRDSVCINSGGEKIFVEEVETAIASHPAVADVVVAGRPSERWGQEVVAVVALSDGAAVDAGELIAHASNSLARYKLPKAIVFRPVIERSPSGKADYRWAREQAVNG

SEQ ID NO: 2735 - protein, 210 aa, Mycobacterium paratuberculosis
MTDTAPGTLDGSAGGFPEIKPAESAPPGLGRLIAALRRLQDLTVATNPADPLWTVAAQHVEDACAVLDGHQVPEGVSPAGRVIELPGLGHPLLPPWTVADSGAHGVTMQGHFTRSHVGGNNAVHGGMIPLYYDWLFGMVVSGANCPPTRTAFLHVDYRNVTPIDAPLTAHGRITDVDGRKIFISASMTAADGTLLSEATGLMVRLLPHQP

SEQ ID NO: 2736 - protein, 209 aa, Mycobacterium paratuberculosis
MTDLAELVAPAHTAVITQEVQGAVVGPDAGLGALAAEARRVALPNIVRLLPPARAAGVRIVHCLVQRRPDGLGSNHNAKIFALGRRSGQGRVDISPGTPGATLLPELGPEPSDLVLSRWHGVGPMGGTDLDAVLRNLGVSTLVVVGVSLNIAIPNVVMDAVNAAYRVVVPRDAVAGVPAEYGEAVIANTLSLLATITTTDELLRAWSRP

SEQ ID NO: 2737 - protein, 337 aa, Mycobacterium paratuberculosis
VKVPFTWKVTGWFMVGWSPEFPIGEVRPLHYFGEDLVAYRDESGELHILEAHCKHLGAHLGHGGTVVGDCVQCPFHGWRWGPDGTNRYIPYQPDRPNRGLRLKVYPVREQYDCVFVWHQPHGKEPQWEMPDIFGKFPQFETDPAAYYRAYPEFSRRAEREPVHPQIVAENAPDSAHFEYVHHATVTPRVLDWKIVEQEWQFVAGWPDANSDDPAALALRFHSHLFGLGGAISVFEGAQNHRLIFTCTPVDDECSDLFYSIWWPRVPGDTADVPEGKLREVIEKQFLSTVFDDLQIWRYQKYVEHPPLSKVDAKGYMALRKWATQFYELPPAGTSSPA

SEQ ID NO: 2738 - protein, 542 aa, Mycobacterium paratuberculosis
VRMTEADTPFDVLVIGAGFSGLYMLHRLRQLGIPARVLEMAENVRGTWLFNRYPGARCDIESIEYSYSFSEEIQQEWVWTESMPAQPEILAYLNYVADRLDLRRDIQFGAEVVAMTFDEDAAMWSVRTRSGDTFRVPFVVAASGILSVPLQPDIPGMNTFAGTSLFTSRWPAAGVDLTGKRVGVIGTGSTGVQLIPVVAREALHLSVFQRSPAYTLPWRVHRFQPGELDEMKARYGEIRAAQRAHPIGAARLSAFSVLLEMLGRPPLKSATPEERLRAIEEHGVLGALNWGDVFFDIEANRMAAELYGEAVARIVKDPETAASLVPVHPFACKRPIIDQGYYETFNRDNVTLVDLRKSPIREVTPAGIRTEDRLHELDVIVYATGFDAMTGALSRIDIRGRGGIGLAEFWATQGPLSYLGLAVAGFPNLFTVQGPGSPSAATNFVAALEQHVEWIGDCIGYLRANHIRTIEALSTAQQEWIEHTTALVAPTVLVHPSCNSWYNGGNVPGKKRMYMGYTGGIPEYRRRCDEIAAGGYTGFKLA

SEQ ID NO: 2739 - protein, 373 aa, Mycobacterium paratuberculosis
MAKALSGLSLARDAARELAMLVPRTVAGLQESTGWAPLSPRGARQFGEVMLDELVLSAFSLLGGSPAALRPVDACAAAAEELAALGIDGAHAAPNPLRPTSIRRRSIAGLDYERMAFEHDPALPTTLVADGLGGPARAVVHLRRHRDGPRPWLVWVHGAGQGGTEDLLLSGIDRIHHKLGFNIAMPVQPGHGCRRRQWPVYPDMDPLGNVAGMMRAVSEVRAVVRWARSQASTLVVAGISMGSPVAALVSHLERRVDAVALYTPILGLNAMIARHLQRWGPARDGFRELLESPVVTQLTSVIDPLAVTPAPPPERRLIVGAWHDRMAMREPANALQDRWAGQLYWYDGSHVGHIFSRRVQRITDRFLRDAVLA

SEQ ID NO: 2740 - protein, 117 aa, Mycobacterium paratuberculosis
VVELYNLVVWNERNIELARELLGDTVIRHEVGAAHTLTHAEAVQRVVDMWEMADSLHFDLNVVVEGDDGEHVAIVYDSTIRTKDGAETNIAGIEVFRVVDGKITEVWNCGYQQGVWN

SEQ ID NO: 2741 - protein, 346 aa, Mycobacterium paratuberculosis
LSDRVLDELGFYLLAGAGGEGPATLMDEARRGEELGFGTAFISERWNVKEASSLVGAACAVTHRMQIATAATNHNTRHPLITGSWATTMHRLSGGRFTLGVGRGIAAIYGAFGIPAVTTAQMEDWAGVMRRLWHGELIFNHDGPMGKYPILLLDPDFNEDIRLALVAFGPNTLALGGRVFDDVILHTYFTPETLQRSVKTVKSAAEKAGRDPDSVRVWSCFATVGDHLPEQLRLKKTVARLATYLQGYGDLLVRTNDWDPAVLQRFRDDPVVTSIAGGIDHKATPEQIEHIATLIPDEWLEPSATGSAQQCVARIRKEFDYGADAVILHGATPDELEPIVAAYRAG

SEQ ID NO: 2742 - protein, 498 aa, Mycobacterium paratuberculosis
MPKAQDWEETLADLQRRRQHAFDMGGPERLDKHRNKGKLDARARIEYLLDPGTFRELGTLVGGEIAADGLVVGSGEINGTPVMLGAEDFTTLAGSIGPGGNSKRYRIAELALRDKIPLVMLLEGAGFRPTGGHYGRTPTDLLAQAQCSGRVPTVAAVLGPSAGHGALVAPVCDFRIMSRQGAIFTAGPPVVKESTGEDISKEDLGGPDVALPSGVIHNVAENDEAALDDVRRYLSYFPPSAWSYPPSLPPGDAAMPRPTPELLDIVSRDNRRVYDMRAVLDVVFDSPDWFEVQPQFGKAIICALAHLGGHPVAVVANQPQVLAGSIDADAADKAAHFIMVADSFHLPIVFLADNPGMLPGSRSERSGVLRAGARMFAAQTAATTLKLHVTLRKAYGFGSMVMSLLGFDHQVATFAYPGATMGAMSAAALSRASHAGEDLSTKLRNAELQASYRSAEHMGFDELIDPRETRDALLASLRRGLSSRQAAAEPVSRTVIMP

SEQ ID NO: 2743 - protein, 411 aa, Mycobacterium paratuberculosis
VSTTTMDEAAKLLADPMAYTDEQRLHAALTHLRANAPVSWVEVPNYKPFWAITKHADVMDIERENMLFTNWPRPVLTTAEGDEMQAAAGVRTLIHMDDPQHRVVRAIGSDWFRPKAMRALKVRVDELAKIYVDKMLAAGPECDFVQEVAVNYPLYVIMSLLGLPEADFPRMLKLTQELFGSDDSEFKRGSSNEDQLPALLDMFGYFNGVTAARREHPTEDLASAIANARVDGEPLSDIDTVSYYLIVATAGHDTTSATISGGLQALIENPDQLQRLRDNLDLMPLATEEMIRWVTPVKEFMRTAAKDTVVRGVPIAAGESVLLSYVSANRDEDVFDEPFRFDVGRDPNKHLAFGYGVHFCMGAALARMEVNSFFTELLPRLKSIELTGDPELVATTFVGGLKHLPVRYSLA

SEQ ID NO: 2744 - protein, 274 aa, Mycobacterium paratuberculosis
MTRRTIVITGASDGIGAAAARRLSRAGDRIVVVGRSQTKTAAVAAELGADHFVVDYADLSQVRALADKMRAQYPRIDVLLNNAGGVASRIELTADGYERTYQVNYLAPFLLTTQLLDVLLESRATVVNTTSSSHKLILRATVDDLENTANRRPAVAYAYSKLAIVLFTKELHRRYHARGLSVAAVHPGNVNSNIGIASGSRFLVFMQRYTPAALFISSPDQGADPLVRLASSPPDSEWTSGAYYAKRKIGKTTRLADDPRLAAELWERTAARLG

SEQ ID NO: 2745 - protein, 201 aa, Mycobacterium paratuberculosis
MSPVKPLRSRPTRGEVRDRILDAAAKVFAAEGFAGATIDAIGQAAGFTKGAVYSNFESKDELFLALLDREFELRGQQIAIALDRSAGDTTAAAREVSRSVLDSVRDHSDYYVLLVEYWLRAQRDPQLRECLIERRRAAADQALHIVESTDTVPGDRRLTDIAQLVVTLNLGVAMEEVLRPGTINPDLLAQLITALLESIPV

SEQ ID NO: 2746 - protein, 225 aa, Mycobacterium paratuberculosis
MDANNEPDDVAPVITAAGLGVDGEHGPLFSGVDLALTPGFHAIQMPGGPGQTTLLLTLAGRFKPSHGTLTVLGATTPRAIRRHCSIAAFEGIDDLEDSVTVGTVLAEQRRWLAPWYSSVPLQSGPAELTEVFGDTAPPSDNTYVVELSDLELFLLRITLALLSNRPILVVGDLEQVRDNSRRAIAAERLGAIARRRTVVVGVTNPLGADAPDHELHDHRIPTGED

SEQ ID NO: 2747 - protein, 634 aa, Mycobacterium paratuberculosis
MLAGLAFGSEIKRFRRSRLTRAAIVVLMLLPLVYGALYLWAFWDPFGHTNKMPVALVNSDRGAVVSGQQFNAGAEIAKSLTADGSLDWHVVDLPEARNGVDHGKYYFMVELPPDFSAAIASPVTGQPKKANLIAVYNDANNYISTSIGRTAIEQVLNAVSSRISGQAVNQMLSVVVSSGSGIKQAADGAARLDDGAGQLAAGLDSARTGSATLAAGATQLSDGINQATDPLLAVTKAVSQIGGSTEQLQQGATALAQANDQLGAIAAAQDAAASSLTSVIDQLSARADPLANNLRGIQDQLRGHQFTPQIRQQLTDAQNAAIAMTSGLRTPGSPLASALDQLGGKGQELTNKLTQLRDGAQQVATGNAELAGGIAKLDDGAGQLKAGSAELATKLAEGARQVPNWTTQQKEAVADTIGGPVQLEASHENAAPNFGTGMAPFFLTLALFFGALVLWMVLRPLQYRAIAAEVIAIRVVLASYLPAAAIALFQAVVLYCVVRFALGMHAVHPVAMLGFMVLISGAFVAATQAINALVGPAVGRVLIMALLMLQLVSAGGMYPVETTSRPFQVLHRFDPMTYGVNGLRQLILGGIDARLWQAIIVLAAITAVALAISCLSARRDRLWNLSRLFPAIKM

SEQ ID NO: 2748 - protein, 529 aa, Mycobacterium paratuberculosis
MKSRAAILHDVGGPWSVEEFELDPPRAGEVLVQMAAAGLCHSDDHILKGDMSAPNEVMRSLGLPTMFPTIGGHEGSGIVREVGEGVTDFAPGDHVVMSFVAVCGQCRWCASGMEYLCDVGIGTMIPGMPTDGTFRHHTAGGGNLGHIAKIGAFAEHTVVSTNSLVKIEQQLPLAPSALLSCAIPTGYGSAANRAGVRGGDAVVVIGAGGIGTGAIQGARISGAAQIVAVDPVEFKQKSALRFGATHSVATIAEALDLVRDLTYGVMADAVVVSPSLITADDVRDALKLTRKGGTCVLTGMTSQLTRSVNIELQDFILMNKTLAGTIFGSCNPRADISRLARLYQSGQLQLDEMITKRYRLDESTTPTTTCSTAKSCGASSISGSPERAAYILIAGNSLLRFHSRSLRADRHEIASATAVIAASTMIACHSRASMPPRMSCRSPLTPYVIGSKRCRTWNGRDVVSTGYIPPALTSCSMSRAMISTRPTAGPTRALMACVAATNAPEISTMNPSIATGWTACMPRANRTTQ

SEQ ID NO: 2749 - protein, 410 aa, Mycobacterium paratuberculosis
MPLSTGPTGQPVVPTLDFTGETSPYPFFEHMRRTDPVWHGSLADASQLPEELRPEDEWVLFDYESVSQAFRDDRIFSSHKYDETIGLVMGHTILAMGGREHHDHRNLVAKAFRATALERWEPSVIGPVCEQLVDEIKNDGHADLVKAVTFEFPTRIISTLLGLPAEDLDLFRRLSLDLISIPTDIEAGLNAATELYDYFLKQVEQRRRKPTDDIIGDLVAAEIDGEKLTDEAIIAFLRLLLPGGLETTYRSSGNLLYLLLTHPEQLAMVYRDRSLIPMAIEEGLRFETPLTMVTRTTTEEVEIGGKTIPANAQIDMCMGSANRDETRWTDPNAFDIRRPRQAHIAFAGGIHMCLGMHLARLETRVMLNSLFDRVRDLAFVPDDGTGEESKIVGLTFRSPNKLPVTFAPAA

SEQ ID NO: 2750 - protein, 314 aa, Mycobacterium paratuberculosis
LARPQGLTRIDPALRDTAAQLGVVEFRAETLAAEREHANRLAAQRAASADTRGVAIDSVSIAGPDGQPLELRLYRGHTESAAPLLVYAHGGAFVTGNLATDHAHCVELARDGGCLVVSVDYRLAPENPCPAALDDVEAAFRYVVDNSAALNADANRIAVMGRDAGAALVAGLTQRMFDQEGPTILMQILHQPMLDSDATPSRREFQRTPGLNGPAVSRAWNHYLGHASASGQHVPAHRANLEGLPPTFISCSEIDPCRDEAIDYANRLLHAYVHTELHVIAATFNGFDSMVPDWIVAQENRALHAQALRRVFAM

SEQ ID NO: 2751 - protein, 382 aa, Mycobacterium paratuberculosis
MSTVDSPEKILFTSTTQAFLEKEAPLRRVRELHAAGTAFDPGWWRRAAELGWTGLLVPEELGGGSVSESGLADLATVAEQLGKTVAPGPLYPVSIVLSALAECSGAETHGDVIEALISGETVASWAVYEPGQGWAPLNPSVTATETDSGYRIDGVKDRVEAGAQSALLLVVARCGADGQIRQFLVPTDTPGVRIEPQQSVDLVKQYARVHFDGVVVPRSAAVGTAAETATLIERQSQLGQVLQCAEVVGVVQTVFDFTTQWALDRHTFGRPLASYQALKHKFADMKLWLEACRATTWAAVAEVAARSPQAGLSASIAKSYVGEMAGQIVQACVQMHGGIGVTWEHDLHLYLRRVTLYRGMFGTPEEHNLRVYQFEKAGRAAK

SEQ ID NO: 2752 - protein, 413 aa, Mycobacterium paratuberculosis
MTTESVAQFAARARAWLADNMPAIDRESPPPAPRDDERAWRRARELQKRLYDGGFAGICFPREYGGLGLDYEYQKAFDAESLDYEMPLILNTPTFTICCATLLDTASEQQKEQHIAAALRGEEILVQLLSEPSGRSDLAGVLTRAERRGDRWIINGAKTWSTSAFAADYGLCLARTNWDVPKHEGLTMFLVPINHPGITLRRITMLSGSTEFCEEFLDGVDVGDDAVVGEVNGGWAVASRQLYHERRAVGQGSEFASGGGSEGGHTIPVDYVSLAEKTGQADDPRVQEMAGRVLVHRAVAEQLIGHVYRSVRDGALPPAAGTLIRLFHSETVTTDVDTALAIAGSAGVVGEPGAGLETGLRYLSRQTVAIGGGTTEMARNVIGERVLGFPREYAADRGVPFNQVRHGQRSDRS

SEQ ID NO: 2753 - protein, 655 aa, Mycobacterium paratuberculosis
MVAEKDWDRIVGAADDVRRVFDNVPALLVGLEGPDHRFVAVNAAYRALSPPVDPIGLLAREVYPELESQQIFQMFDRVYQTGEPQSGTEWRVQADFEGVGKAQEHFFDFIVTPRRGDDGSIEGVQLAFVDVTDRVRNRMAAEARLEELSERYRNVRDSATVMQQALLAPSVPVTPGADVTAEYLVAAQDTAAGGDWFDAIPLGDRLVLIVGDVVGHGVEAAAVMSQLRTALRMQILAGYPIAEALEAVDRFHKHVPGSSSATMCVGSLDFGSGEFSYCTAGHPPPLLVTADATARYVEPSGAGPLGSGTGFPVRTEFLDVGDSILLYTDGLIERPGRPLGASTAEFADLAANIVSGQGGFVIESSVRTADRLCAETLELLLRSTGYSDDVTLLAAQRRTPPPPLNLTLDATIHAARTVRTRLRQWLSDVGADADDISDIVHAISEFVENAVEHGYATEVPDGVVVEAMLAGDGNLHASVIDRGRWKDHREGETGRGRGLAMAEALVSEAHVSHGPEGTTARVTHRLSRPANFVADSLVSRAGDHGVRSAEFVSTVTEPGRIVVSGDVDSNTASTLDRQIAVESRSGVAPLTVDLSAVTHLGSAGVSALAAARERALRQGSDYVLVAPPGSPAHHVLSLVQIPVVSGLAENVVAEG

SEQ ID NO: 2754 - protein, 177 aa, Mycobacterium paratuberculosis
VTVGYVAGVADPLAQSTKGAKGLRRRLLSSRVLTLNGWVAFNLPRTVTALGGALLTGLVLVHIYVLTTEPGLPRYFAAYVLGLSAACALAAGAMVFALKPIVPQAGWYFGSLVCSAFLCAYLVTRWIQLPGLIAVTARWDFAPGTLGIAFAGAFLAVHTTVLSGINVAYPQRQQWYD

SEQ ID NO: 2755 - protein, 496 aa, Mycobacterium paratuberculosis
MTVLDYPVWLRVDHWLNVLFVTLIIRSGIEILSTHPKLYWHDDSKPGTEWARFTRKVMPRDRIYDTLDEEEDYHLLISLPGHAQLGMGRHWHFFAVIGWVLVGLSYYVLLFATGQWHRYWPYSWSIFPEAFNDIVTYLTFNLPPVLPGEPLDAMQKLTYAGVVFVLAPFQILTGAAQSPAIEARFPWYVRMWGGRQWARSLHFLGLVAFVVFIVIHLSMIFFWGWGRLTAAMIFGSVRNTYWATAISLLIIAAIVGIHVAATLWSLRHPRSVQRVLGRVVTAARLMLLRPLNSRQNYPASKITPRHRINGKPPTSTEYKVMAVHNFVDWRLRVGGLVENPVVLDLAALRSLAEPETQRVMHNCVQGWTSIGEWTGVQLRQLVDLVRPLPQARYICFLTMQDNSTDEPASHGGGQFYEVLDLEFADKPQTLLAYEMNGAPLPIQHGAPLRLRVETQVGFKMAKWINQIEFVDDFAGIGMGTGGWREDRVYYDKDVEI

SEQ ID NO: 2756 - protein, 100 aa, Mycobacterium paratuberculosis
MSDAAANGIGVRPELISLDAAAVHRVREQVAAKGGHCEACGATDFVVGDVLYLGFLFLNEEADAYLVALTCANPQCPASRTAIRLSENEFLTSGRGAAGR

SEQ ID NO: 2757 - protein, 123 aa, Mycobacterium paratuberculosis
VASPGRERIDIDDDLAFVGEQIEALERLGGREDVDDERVYDLSIRWGAALAGRLPRMAHYSALGQLVEQDERRFQALCDRLRELSPLIDRFGLAQPRLPGAADASANGRRRRGRWSKTRSRTA

SEQ ID NO: 2758 - protein, 402 aa, Mycobacterium paratuberculosis
MPSRELPFPVFDADNHMYEPQEALTKFLPDHRKHVIDYVQIRGRTKIVVRGHISEYIPNPTFEVVARPGAQEEYFRNGSGGKSYREILGEPMKAIPAFREPGARLEVMDELGIDYALMFPTLASLVEERMKDDPEMTHDVIHALNQWMYEQWSFNYKDRIFATPVITLPIVDRALEELEWCLERGARTVLVRPAPVPGYRGSRSFGFEEFDPFWQACVRAEIPVSMHASDSGYSELLNIWEPGDEFLPFKPTAFRSLAMGHRPVEDAFGALICHGALSRNPDLRILSIENGADWVPHLFKGLKGVYKKMPQAFAEDPIETFKRCVYVSPFWEDRFAEIVNMVGTDRVVFGSDWPHPEGLKDPISFVDELADFSDEDKAKIMGGNLMKLMKVSAPAAKKPVSA

SEQ ID NO: 2759 - protein, 343 aa, Mycobacterium paratuberculosis
MAEPNEDVEITRGDRFIKTAVAILGETGRTDFTVQEVVARSKTSLRAFYQHFSSKDELLLGLFDRTIAQSAQTWRAETAGLDSTAALKLVIDRVSQQPESSTQDSLNRALTLYNQHLAETRPREYARVLSPLHRLIRDIVGQGITEGVFNAGLDVGAAAAIVMQTMMGAQRLHWLGAELNGTPVDAGQLYDFCSRALGIRDTDDDSSAPSLAELFGQIGMRPGTRNGQFAMTMPVSPAVVNTSGALQGGLIATLVDVAGGQFGLDYLRPGTTMTTADLFVRYLRPVRQGSAFAVPRMLRSGRRAMVMQVDIFGDGDDELLATATVNFAIINGDTPSSGLPPAE

SEQ ID NO: 2760 - protein, 222 aa, Mycobacterium paratuberculosis
VMPPSLLHTWFELLSPEQIVMAYGMTENLGLTALRGDEWLEHPGSVGRGFRDTEIRILDSQQRPLGPGEDGDVYLRAPMSAGYRYLGGAPPLPSTEDGFRSAGDIGHLDEDGYLYIVDRRVDMIISGGANVFPAEVESALAGHPAIADVVVIGLADPQWGRRVHAVVQRADGASLTEQQVIDYAKGRLAPYKAPKTVEFVDAIPRTAATKVNRSAMIAARGG

SEQ ID NO: 2761 - protein, 276 aa, Mycobacterium paratuberculosis
MTESAPAELAANPLADGIPFGAKLQQLAGQRGDDTAVTVVALDGTATSLTFAELDARANQWGRALAATGAQTGSLVALAIPNSQHLVLATLGCWKIGAVPVPMHWDLPEWERDRVREVIDPAVVVDETSRWGLEARAAGESEAALPVAVSPTANGICSSGSTGVPKVILNLAPSLWIPQHGEPFLSNWTPVAQPQTIMVPAPMYHTNGFAPLLMLLGGDHLVILEKFDAALVLDVIERFRITNFTATPTMLARIAARPDVRQRDLSSIVFILQGPR

SEQ ID NO: 2762 - protein, 311 aa, Mycobacterium paratuberculosis
VKTDLPQDISDFATVAAKRFTRLGGPPAALRAETDDTVREAARTALAEVGAFDLDVRTAPDDLLAAAVLCQAAGAAALPYPLVEELLAIDGARLTLVNPAAPRIDHGDLAGDWIAADIDGNRYRPRPGSRTGAKLGPFLVPATLSAPEGTVPGADVNLHLVLGAWRILGAVQQSLRIVTDHVQARIQFGKPLADFQAVRFAVADAAVMVRGLHELAKYTICRPKMLPAQVYSADALVLRLKAADTARQVMRTSHQLLGALGFCDESDVSVLDRHTQPLIRLPLSTEELALRLIPSVADGAFETLFSEPVSA

SEQ ID NO: 2763 - protein, 382 aa, Mycobacterium paratuberculosis
MDYDLGDDAAQLRSHLRELVANHIPADFLGACTENPQDLATTETFCKLLAAEGLLALAWPKEHGGGGGSVWQQTVLREEMWAQHEPRGPQYMGINWVGPALMRYGTEEQKAKHLAAIAAGDVIWCQGFSEPEAGTDLVSLRTRAVADGDGWRITGQKVWTSYALMASWCVLAACTDPDAPKHKRLTLFLIPMDRPGFTVRPIPSMLGPHHLNEMFLDDVPAYPGDVLGEVGDGWRVMREALAYERVGIARYARCESLLERMRGRLGDEWEQLPESIRARWVRALVDLRVARLLAYRAVSLQDDPAAGAAASAARIATTTCDQQVAELLFDVLGPTALDAGSGAPLHGAIEDHWRYAQAATVASGTIEVQKMLVARDVLGGHR

SEQ ID NO: 2764 - protein, 375 aa, Mycobacterium paratuberculosis
VTSGVSTRSEVVAEFAAWLAAFLPNDYYENYRRYRWDLTLRRDYQRAAFEAGWIQPTWPREHGGRSLGLRDAMEVRLEAALRSAPKLPNIAGPNVAAPGIRQFGTPAQIERLLMPLLRGDEWWALGMSEPEAGSDFAGLRTRAVRDGDVFRVNGHKIWTTQAHESRWCTLYARTDPEAPKHRGISCLILDLHSPGVRIEPIRMASISDETFCEVFLDDVEVPAENLLGPLHGGWDVALSSLHHERQMIWIMNWVEINRGLDAVRTANGAGPGHDIHTELGSLLADAEALRATGYRALANELAGRPSPEADTMKLLGSLTLQRVWELAAAAAGPDSATDPDLLFERQDALAATIYGGTSEVQRNIIAERLLGLPKG

SEQ ID NO: 2765 - protein, 400 aa, Mycobacterium paratuberculosis
MSAADNRTWGRNRYHSTIRVTSSVRFGAIAPARLVYYFYYVRGLMDVGLNSEQLSLRDAVRDILRTECPPDAARQAITDPERWRALWKTVVDLGWTELAAANTGDYGPMELVVVLEECGAAIAPIPLLCSVGLAAGLLRGSGLDLVLADIAGGAVATVAVHAEKSRLPGVPMTLRQGRLRGRAVAVPNLARAELLVTLARTDDGGTVAAVARCGDGVTALPAAECTDPAQPLAGVQIDAEPVAVAPVDLESALPAPWVACAADLVGVAGAALRRSVEHAKTRRQFGKPIGAFQGVKHALADNYVSVERARSLTYAAAARLADPGTAPGDAWTAAALAKAAAGEAATGCARTAVQVHGALGQTWEHDAHLYVRHAWQTAALLGDSRALYHEVGRRFCGGAA

SEQ ID NO: 2766 - protein, 283 aa, Mycobacterium paratuberculosis
MVEWYLFLPQVRLSAADIAERARRAEASGFDGIAFIDHLEAPGLRDESIWEAMGIATWVAAKTERLRIGHLVLCDAFRHPAVLAKQAVTLSEASEGRFELGLGAGSWPAEFARFDVGQQDPKARVAQLARHLELIKRYWGDDGRGEAQAPRRSHPIPLVLGGSGPRMMELVRTHADWWNLPANKLDKLPALAPAAGSARLSIQQMVGFVGAGQDPEKVREVSTRRFGNLGSGLVCGDADELIGHFSGLAAQRVERFYVWFADFAAPDSLREFGESVITAFPAR

SEQ ID NO: 2767 - protein, 238 aa, Mycobacterium paratuberculosis
MRTALVTGGSGGIGKGCARKLVERGYDVLLCARREAPLRAAAEEIGARHVVADASDPIGFPSALSTLETVDLVVHAAGALGGTYARKQTFEQWRAIISANLDSCFVVTSAVLPKMTAGSRLVFISSSAAHEPMPARTAYSASKAGMNAFARALALEVDRDGISVHLVTPGPVATEMLQDVPFEMYAIAVSDVAEAVVFLDTVDPSVDLPEIRLSAVQRGPFARPPVVPTEARRRAQRG

SEQ ID NO: 2768 - protein, 273 aa, Mycobacterium paratuberculosis
MTALGIGPDARRRLSAPRIAEIVADELRRQIISGELADGDLLPRQEVLVEQFNVSLVSLREALRILETEGLVSVRRGNRGGAVVHAPAKTSAAYMLGLLLQSESVAVADLGMALQELEPACAALAARRPDRADTLVPELTKINESMATHLDDGRLFTEIGRQFHDLVVRGCGNHTIIAVVGSLETLWTSHERQWADESSSRGTYPSLAQRRAVLNTHVKLTETIAEGNVDRARRIAGRHLADTQTYVLSGQPDQRIHAFSPQALARPRDLRRS

SEQ ID NO: 2769 - protein, 816 aa, Mycobacterium paratuberculosis
LIARRSEGRVHLSERSDSRPTPLRDLRVVEISDRIAGSYCGKLLLDAGAQVRKIEPPQGDWLRRYSASGSPVAPGADAPFFSYLNAGKRSVTFGSGGDDNAARFRAELAGADVIVVTAGPSRAAALGIDPSRLLRQSPRAIVVTISDFGWTGPFAQRAATEFTLQAWAGSPGFRGDPAGPPIAIGGDLGEYMGGVFAAFGVLALRRRVERGGPGEHLDLSMLEALTAMQSSEWLHSQLLRVPPIRRTTEVPSIEPAKDGYVGITMVTGQQWLDFAAMVECPQLEEIEQLRFQIGRWQYRDLIRELIHPWLAERTVAEIVELGQLFRLPIAALGNGSTIRDLEYVRERHVFVENPAGFHQPRPPWLMSACAPAPVGDTPAVGEADRESPWRRDDSGSAPDPTLPPLPLAGVRIVDLTAFWAGPSATHLLAAFGADVVKIESIQRPDGIRYSGGMRTDVDDWWEYGWVFHAMNTNKRSVTLDLGSEQGRGLFTRLVADADVVIENFSPRVMDQFGLTADVLLDINPRLVFARMPAFGVEGTWRDRVGFAPTMEQIAGLAWITGLPEGPPVTPRGACDPLAGVHAAFAVLAALNFAERTGTGQLVELAMLETVLNATAIQAIEAEVFGVTLSRRGNRGHGAAIQNIYRCAGAERGKDDWIAVSVGDDAQWRALVDVMDRPAWCADPDLATVDGRRQRADDIDARLAQWFGRQDLDSTVELLAGAGIPAAPVVSPSLVTDNPQLLARGFFEALHHPSTGVGLYPCPPFALLTGQDKWLLRPPPKLGEHNEEILRDRCGLTDEELTHLAAGGVIGTRPKGL

SEQ ID NO: 2770 - protein, 63 aa, Mycobacterium paratuberculosis
MRVTVDENLCEANGFCESLAPDVFELGDADVVQIADGPVPPRLEIDVRAAVDQCPKAALRLID

SEQ ID NO: 2771 - protein, 431 aa, Mycobacterium paratuberculosis
LNVNAATAACGDDPAERGSAMTTAAVDLSDFSLWCNGFPDELFAELRRTRPLFHHDLTPGVAATVHRDFWVATKHRHAVRLHRDTESFTAADGPLIQPVAMFSSSPTIITMDPPELNKRRKLISNAFNPRAIAKLEDGIRARAARMIDSLLAHGGGDWIEDVADALPMTVIGDILGIPERDRPRIFDLFDRILKALAPEAHPRGGVELELFASVFDYAMQLTADKRRNPTGDIWSTLATAVITGEDGEEFRLPANELEFFFFVLAFAGSDTTKNALAIGLQAFLANPEQVERYCADEALRPTAVEEVLRWASPVAYWTRTAKVDVEMDGQRIAKGERVVSMLRSANRDEEVFDAPFTFDIGRQPNPHVAFGGGGPHHCLGAMLARAELRAVFDELLLRCDDIEIGPAKAAYPNLITNMSIYDEMPISLRRR

SEQ ID NO: 2772 - protein, 384 aa, Mycobacterium paratuberculosis
LVRTGYGVQVARTVSDSAPDSAEDPSEREFGQAGIALSTYRFPTGWFIVAFGSDLAPGQVKRAHYFGEELVLFRTASGRVHVMDAYCQHLGANLGVGGTVEGENIVCPWHGWQWRGDGSNALIPYSKIGCKNNVRIRTYPSMEWYGFVLAWHERHGRAPYWQPPVLPELETGEYYPLHPHTQMVNRVKVHPQMIIENAADPYHVQYVHKAANPATTASFEVAGYHLHATVNAHFGGGRAQTWLTPNGPVDAKIIYDNYSLGLGVVRFPSELVATVQVTGQTPVDEDYTDYFYTQASVREPGDTGDVPTGRAARFLALQKEVIKQDFFTWENMKYLEKPNLAPEEAHDYAALRRWAHRFYPGPQPAPTDFGYTADGEPDPAAAKA

SEQ ID NO: 2773 - protein, 521 aa, Mycobacterium paratuberculosis
MRAPADFGVDRFTVPAVLDRRAAQHPDRVMMSIAGVDVTFAQMRQRSCAAANMLSDLGVGRGDRVALFSGTCPEWVYFWLGAARIGAVSAAINAAHKGDFLLHALRLCRPAVIFTDPEHRSRAERAAAALEGPPRIVVQGDSLTATLSRAADRAPAEDRPDAGELGCLFYTSGTTGPSKAVATTWHYLFSVAATVAAAWEFRQGEVLWTAMPLFHLSAAPSVLAPMLVGATTVLAAAFHPAEVWDDIRAHGAIGFAGAGAMVSMLQNLPADPGDARLPLRFISAAPIAARSYRDIEKRYGCRIVTMYGLTEAFPIAVKALADAGIPGTSGRPNPDFEVRILDAHGNSLPPDTVGEIACRPRHPHVMSEGYIGDDLAVRPHPEWFRTGDLGRLDRDQNLTYVDRIKDALRRRGENISSVEVETVVMGHPAVAEAAAVGVPGELGEDDVLVVVTLRPGATLDCAELLDFCADRMPYFCVPRYVETVPELPKNAIGRIRKDLLRARGLTTNVWDREKHGYVVRR

SEQ ID NO: 2774 - protein, 141 aa, Mycobacterium paratuberculosis
MSLTYQQEQFLQAATSRAAILNLNARHNRAYSDGDRDGWIATFRHSGASYTRDGEAFTDLRAAFDGGDDQRLVTVDHEIHVDGVTATQQCVAVLFAAMFGDAALRATGVFRDELIYERGGWYFTSRALQWDSVPSRHPLVM

SEQ ID NO: 2775 - protein, 176 aa, Mycobacterium paratuberculosis
VDQDFSRRLAFGTYEDALRMVGAKGEPRTAGTAVSAARIQLFAAMVRDGNRSYWDSAFAQHHWGGLLAPPALLMGWLIAPPWQPDGRPSASLIALRVPLPGTTFINAANEVEFPHPIVEGDVLTVVDELVSVSPEKRTRLGVGHFVETLETYRRQDGTVVATSRNTLFRFTPGPSS

SEQ ID NO: 2776 - protein, 145 aa, Mycobacterium paratuberculosis
VTGAGVDWSRLSVPAELPEVVDHISYQRVVENAGATWDYFPGHFDPDYARAQGNPTIYVNTMHLAGFADRVATEWAGPRSRVVRRAMRLAGPIYAGDTMIGRGRAVAKRRDTSVDPPRCLVDIEIEVTNQHGALCCPVELTVQLP

SEQ ID NO: 2777 - protein, 525 aa, Mycobacterium paratuberculosis
MIHPRLPDLSFFRYVSVNSKLRCGSGPAPIAASRRRPMTKNSDHRCYDELFIGGQWRKPANPQQLDVISPHSEQPIGHAQAAGPEDVDAAVAAARRAFDHGPWPRMSHAERMAKIEQLATIYAAHMDEMADLITDEMGSPRSFSRMGQGAAAATLIHLTLAAARDFPWTERRQGVLGEVHLHRAPVGVVGAIVPWNVPQFLIMPKLIPALIAGCTVIVKPAPETPLDALWLAEMIEQLELPQGVVSVLPGGTDVGEALVRHPGVDKIAFTGSSAVGRRIAALCGERLKRVSLELGGKSAAIILDDADIDKTVAGLKSAGLMNNGQACVAQTRILVSDRKHDEVVDALAAMMAELNVGDPADESTDIGPLVAQRQQRRVQEYIKSGRSEGARMVLGGEDSPAGRGWYVRPTLFADATNDMRIAREEIFGPVLTVLRYRDEDDAIRIANETDYGLAGSVWTADVAHGLEVAAAVRTGTYGINMYTLDIGAPFGGFKQSGIGREFGPEGLHEYVELQTLVCKGQLPPL

SEQ ID NO: 2778 - protein, 352 aa, Mycobacterium paratuberculosis
VSRREMNSDWRSYPFQLVPGDGQLEFPAAEGEHRDQESDTWFLAGQLEAAGADRSFAFLTIFNKNRPGGTVVADFYTMALFDLDTGDYGTYTDYDMPPANLEPGAPRKMGLAAGYLDISYASGAGTASWTSCRNGDGGLLPYTYRVSLVGEDHCGRRMRLDLAVTPTRAPTPVGASAYNGKIVCFGQRDTYSYFQTGMAMTGTLRWGEQVHQVSGSSGHVDRQWFPKYAGGGGSGGDPRARSHEWRTINFDNGVDLSIWRQFDRTNNNVLQPFTGITVSYPDSAMAPECAEDVEVTVSSYVRWPESMRPLVRPLAPARYLPDRHRIACPTLGLDITGEPVVAAPAHGLPIEY

SEQ ID NO: 2779 - protein, 103 aa, Mycobacterium paratuberculosis
MEGPYRYRGTLQGQPVTAFAFNERSLALYRDWELVEVLATTVTHTEPSDPDLRATVDRLAPLVAAGRRREAVELLAAVRPAQTGALATLLDDLVTVLSTESAG

SEQ ID NO: 2780 - protein, 381 aa, Mycobacterium paratuberculosis
MQHDQLIDLTRRALKLARDRTTDLAPTAHVVDARDYTCVQRHQQDRAMLLASPQLVGYVSELPAPGTYCTKTVMGRSVLLTRTSDGSVKAFNNVCLHRQSQVATGCGTASRFSCPYHAWTYDNTGRLVGLPGREGFPDVALRSAGLTELPATEFAGFLWVSLDPGATLDVATHLGPLADELDSWGIGRWSPLGEKVLDCAINWKLAIDTFAENYHFATVHRQTFATIARSNCTVFDSYGPHHRLIFPLNTILELDDIPEDQWNPFHNMVVIYALFPNIVLSVTIANGELFRVYPGDRPGRSITVHQNATPQDLSDESVAAGVQAVFDYAHATVRDEDYRLVESLQANLESGARDHLVFGRNEPGLQHRHITWAKALAASTG

SEQ ID NO: 2781 - protein, 302 aa, Mycobacterium paratuberculosis
VAEQLLIGDVTALTGIASGRIRHYEKIGLLHADHLSNGYRVFDVEQVLDLLRIDLMRSLGVGINDIQRLLHGGHSTLADLLDEHRALLIQQRDRLDQLIRALDESCAQSRAAADGTDVSEHLLRQLATTHRDSIGVIGRLSAPLPAPVAAMYADLFDEWDLPVPALFGQMRLPSAASTLLARLAETPGRQVLFDRLRRLAADVIALGESVSAATELAHNWIEQQLADPLPDDVVTVLRGVQPLLGQDPVIVQGFRAWAGSISPAAARFIEEIARQTARRGLAAVSVIVLPAADRAQTVDATP

SEQ ID NO: 2782 - protein, 240 aa, Mycobacterium paratuberculosis
VSSVSRRDLLKFAAAAPALLGLGVAGSTVHAAPASASLGTLLDYAAGVIPGSQLRAAGALGAIRYVSDRRPGGNWMLGKPIQVAEARDLNANGLKIVSCYQYGKGNTADWLGGASAGLQHAQRGMQLHAAAGGPATAPIYASIDDDPSYEQYKSQIAPYLRSWESVIGHQRTGVYANSKTIDWALHDGLGSYFWQHNWGSPKGFTHPAAHLHQVEIDKRSVGGVGVDINEILKPQFGQWV

SEQ ID NO: 2783 - protein, 101 aa, Mycobacterium paratuberculosis
VLWVTPGFAGRSDAANKPAACRWLRSSSYNCADQSSFVIESLCKNFAPRGAVEPASAAPCGDRRRPRAEKMSERVFAGISKSRPSGRPGGRGDGSRGPGGG

SEQ ID NO: 2784 - protein, 3092 aa, Mycobacterium paratuberculosis
VTIHEHDRVSADRDGQGPHGVKHPPAGDTHALVDRLAAGEPYAVAFGGQGSAWLETLEELVSSAGIEPELATLVGEVDLLLEPVAKELVVVRPIGFEPLSWVRALAAEDPVPSNKHLTSAAVSIPGVLLTQIAAVRALARQGMDLTATPPVAVAGHSQGVLAVEALKGAGARDVELLALAQLIGAAGTLVARRRGISVLGDRPPMVSVTNADPERISRLLDEFAQDVRTVLPPVLSIRNGRRSVVITGTPEQLSRFELYCRQISEKEEAERKNKLRGGDVFAPVFDPVQVEVGFHTPRLADGIDIVGGWAEKVGLDVALARELTEAILVRRVDWVQEITRVHESGARWILDLGPGDILTRLTAPVIRGLGVGIVPAATRGGQRNLFTVGAVPEVARAWSSYAPTLVRLPDGRVKLSTKFTRLTGRSPILLAGMTPTTVDAKIVAAAANAGHWAELAGGGQVTEEIFAARIEELSGLLEEGRTYQFNALFLDPYLWKLQVGGKRLVQKARQSGAAIDGLVISAGIPELEEAVELIEELGDVGISNVVFKPGTVEQIRSVIRIATEVSTKPVIVHIEGGRAGGHHSWEDLDDLLLATYSELRSRPNITVCVGGGIGTPERAAEYLSGRWAEKYGFPLMPIDGILVGTAAMATLESTTSPSVKRMLVETQGTEHWIGAGKAVGGMASSRSQLGADIHEIDNSASRCGRLLDEVAGDAEAVAERRDEIIAAMAKTAKPYFGDVGEMTYLQWLQRYVELAIGDGDSTADTASPGSPWLADTWRDRFEQMLQRAEARLHAKDFGPIETLFDGSTEDGARLLENPAEAIATLLAHYPDAESVQLHPADVPFFVTLCKTPGKPVNFVPVIDKDVRRWWRSDSLWQAHDARYDADQVCIIPGTAAVAGITRMDEPVGELLDRFEQAAIDQALAAGVQPAAVTSRRTGRADVTGPLAVVLDAPDVQWAGRTAINPVHRIAEPGDWLVHDGPDSRRATHSSTGARLQVEGDRVVLSVPVSGTWVEIPFTLPPNTIDGGTPVVSTDDAATAMRAVLAIAAGVDGPEFLPKVVDGAATVTVDWDPERVADHTGVTATFGEPLAPSLTTVPDALVGLCWPAVFAAIGAAATDTGVPVVEGLLSLVHLDHAAHMVGKLPTTLAQLTVTATASAAADTDMGRVVPVSVTIADAGGQVIATLDERFAILGRTGPAELTDPARAGGAVSENATDTPRRRRRDVTITAPVDMRPFAVVSGDHNPIHTDRAAALLAGLETPIVHGMWLSAAAQHAVTATDGQARPPARLIGWTARFLGMVRPGDEVAFRVDRVGIDQGAEVLEVAARVGSDLVMSATARLAAPRTVYAFPGQGIQHKGMGMDVRARSKAARKVWDKADKFTRDTLGFSVLRVVRDNPTSIIASGVHYNHPEGVLYLTQFTQVAMATVAAAQVAEMREQGAFVEDAIACGHSVGEYTALACVTGIYELEALLETVFHRGSKMHDIVPRDELGRSNYRLAAIRPSQIDLPDDEVPAFVAGIAERTGEFLEIVNFNLRGSQYAIAGTVRGLEALEEEVERRREITGGKRSFILVPGIDVPFHSRVLRVGVAEFRRSLDRVMPRDKDPDIIIGRYIPNLVPRPFTLDRDFIQEIRDLVPAEPLDPILADYDTWLAERRIEMARTVLIELLAWQFASPVRWIETQDLLFTEEAAGGLGVERFVEIGVKSAPTVAGLATNTLKLPEYAHSTVEVLNAERDAAVLFATDTDPEPEPEADEASDSAVPASSDGAPMSDVAPAPAAAPSGAPRPEDIPFDAADATLALIALSAKMRIDQIEELDSIESITDGASSRRNQLLVDLGSELNLGAIDGAAEADLAGLRAQVTKLARTYKPYGPVLSDAINDQLRTVLGPSGKRPGAIAERVKKTWDLGEGWAKHVTVEVALGTREGTSVRGGALGHLHEGALADAAAVDKAIDAAVAAVAARRGITVALPSAGGGGAGATIDAAALGEFTEQITGRDGVLASAARLVLNQLGLDEPAGAAAASAATDAELIDLVTAELGADWPRLVAPVFDPKKAVLFDDRWASAREDLVKLWLADEGDIDSQWLHLSERFEGAGHVVATQATWWQGKALSAGRAVHASLYGRIAAGAENPDPGRYSHEVAVVTGASKGSIAASVVARLLDGGATVIATTSKLDDERLAFYRGLYRDHARYGAALWVVAANMASYSDIDALVEWIGTEQTESLGPQSIHIKDAQTPTLLFPFAAPRVAGDLSEAGSRSEMEMKVLLWAVQRLIGGLSKIGAERDIASRLHVVLPGSPNRGMFGGDGAYGEAKSALDALVSRWHAESSWAARVSLAHALIGWTRGTGLMGHNDAIVDAVEQAGVTTYSTDEMAAMLLDLCDVESKVAAASAPIKADLTGGLGEVDLDMAELAAKAREQATGAEPAADDGPTAGTIAALPSPPRGFTPAPPPEWADLDVDPADLVVIVGGAELGPYGSSRTRFEMEVDNELSAAGVLELAWTTGLIRWEDDPQPGWYDTESGELVDESELVERYHDTVVARCGIREFVDDGAIDPDHASPLLVSVFLDKDFTFVVSSEADARAFVEFDPEHTIIRPVPDSSDWQVTRKAGTEIRVPRKTKLSRVVGGQLPTGFDPTVWGISPDMASSIDRVAVWNIVATVDAFLSAGFSPAEVMRYVHPSLVANTMGTGMGGGTSMQTLYHGNLLGRNKPNDIFQEILPNIVAAHVVQSYIGSYGAMIHPVAACATAAVSVEEGVDKIRLGKAEMVVAGGIDDLTLEGIIGFGDMAATADTGMMRGRGISDAKFSRPNDRRRLGFVEAQGGGTILLARGDLALKMGLPVLAVVAYAQSFADGVHTSIPAPGLGALGAGRGGKDSPLARALAKLGVGADDVAVISKHDTSTLANDPNETELHERLADSLGRSEGAPLFVVSQKSLTGHAKGGAAVFQMMGLCQMLRDGVIPPNRSLDCVDDELAGSAHFVWVRETLRLGDKFPLKAGMVTSLGFGHVSGLVALVHPQAFLAALDPEQRADYQQRANARLLAGQRRLVSAIAGGAPMYQRPPDRRFDHDVPEKRQEAAMLLDPASRLGDGDAYQVSAG

SEQ ID NO: 2785 - protein, 130 aa, Mycobacterium paratuberculosis
MGIVGVGIDLVSIPEFAEQVDQPGTVFSETFTPGERRDASDKSSSAARHLAARWAAKEAVIKAWSGSRFAQRPVLREDIHRDIEVVTDMWGRPRVRLSGDIAKHLADVTIHVSLTHEKDTAAAVAILETP

SEQ ID NO: 2786 - protein, 473 aa, Mycobacterium paratuberculosis
LSASRHNSAATRREEGAFASAREITERVREVLPSVRLDLEELVRIESVWADPGRRPEVQRSARAVADLLAQAGFGDVRIVSEGGAPAVIARHPAPPGAPTVLLYAHHDVQPEGDRGQWVSPPFEPTERDGRLYGRGSADDKAGIATHLAAFRAHGGRPPVGVTVFVEGEEESGSPSLGRLLAAHRDTLAADVIVIADSDNWSVDTPALTVSLRGLVDCVVEVATLDHGLHSGLWGGVVPDALSVLVRLLASLHDDDGNVAVAGLHETDIATLNYPDYPPERVRADSGLLPGVSEIGSGSVPQRLWAKPAITVIGIDATPIERASNTLIPRARAKISMRVAPGGDAAAHLDALTAHLQQHAPWGAQVSVTRGDIGEPYAIDASGSVYDAARAAFRQAWGAEPIDMGMGGSIPFIAEFAAAFPEAKILVTGVEDPATQAHSINESLHLGVLERAAISEALLLTNLANLADLLNPG

SEQ ID NO: 2787 - protein, 164 aa, Mycobacterium paratuberculosis
VNRKGLTLTETTRLAPGDKAPAFSLPDADGKTVKLSDFKGRKVIVYFYPAASTPGCTKQACDFRDSLAELNGAGLDVVGISPDKPEKLAKFRDAEKLTFPLLSDPDRTVLTAYGAYGEKQMYGKTVTGVIRSTFVVDEKGRIAVAQYNVKATGHVAKLRRDLSV

SEQ ID NO: 2788 - protein, 86 aa, Mycobacterium paratuberculosis
MSQTAGDLEDTVADRDPEAIKREIDVARDQLATTVDSLAERANPRRLADDLKARVIGFVQKPVVLASLAGVGALVVVVAVRRVRNR

SEQ ID NO: 2789 - protein, 579 aa, Mycobacterium paratuberculosis
MGFIRPNLPVVDVAEWSARPRAERLVPMARHIAENGFGTPLVMHVMYGAKIALYVLGGWLFAWSTRGIGGFTEVGAWWSEPIVFQKAVLYTMLFEVVGLGCCFGPLAGRYFPPMGSILYWLRPGTIRLPPWPNRIPLTRGSTRTPLDAALYGALLVLLVGALVSDGSGPIPALETAIGVLPRWQTAAILGVLAAIALRDKVIFLAARGEVYAPLALVFLFGGADVVVGAKVAFMVIWLGAATSKLNRHFPFVISTMLANNPFIPSGPLKRSMFRRYPDDLRPSALAGFIAHFSTAVEGLVPLVLFCSTGGWPTALAAFVMIVFHLNILLAFPMGVPLEWNVFMIFGVLWLFLAHAPVGLSSVADPWPIALLFVVMAGTVVVGNLYPRKVSFLPGMRYYAGNWDTTLWCVRPSADEKIRVGARALGPMQHLQLERLYGSKEETLIPLHLALAFRGMNTHGRALLTLAHRAMADYDEDDYNLCEGEVLCAMVLGWNFGDGHLHNECLIEALQQRCGFEPGEVRVVILDAQPIHRQTQEYRLVDAATGEFERGYCTVDDMATAQPWADDIPVYVQTGRVSDS

SEQ ID NO: 2790 - protein, 88 aa, Mycobacterium paratuberculosis
VKTELKWIEPYPGHFHANIDDRSEYRVHAVSTGGFRAERVDDGFVHHDLGRAASAAEAQGICQDLHTRTLRRAAWEAYMAEHDPPGWE

SEQ ID NO: 2791 - protein, 412 aa, Mycobacterium paratuberculosis
MNTQDDGIAIRHPTEDDWQAVFENQARTFGDPVGPQDLEAWKRRVRLDDILIAEDVSDPKNPFLVGTSIIYPAQLTVPGGTNLRAAWLTMIAVASTHQGKGLWAQLSAKGLGILLDRGYPIVCGVPTQTAMYDGFGAGVSSYSHTYAIDRRFAKLRDTPGDDRAREVNAATARRHLPGLYERWCAVTPGAVTRDKAWWADHLEDRTTQRGNGSALHYTIHPDGFLTYRVVGSRQHAFRPPLGTVVVEDFCPITDEAHTELLQTLLVLEMFYRVEIDVPPDDPLPLKLVDQRAAETKGISDFLWVRINDVPEVLGARGYAADTDIVLDVTDPLGLAGGRFQLQTRDGAGKCTPHDGPADLEIGLADLATVYMGAHRGAQLARAKRITELRQGALGRLDAAFGAERAPFCGTVL

SEQ ID NO: 2792 - protein, 784 aa, Mycobacterium paratuberculosis
VMAMLRVITRLAIAAPRRIIGIAVLVMVGAAIFGLPVVNSLSGGGFQDPTSESARATEILRDRFNQTDQQMLIVVSAPDGARSPQAHRVGTDIVDKLKNSPWMMSVSSAWTSPSAAAAQLISKDNKSGMIVAGLKGGENDAQKYASTLTRELVHDRDGVTVRAGGMAVAYAQINAQNQRDLLLMESIAIPLSFAVLVWVLGGVVAATLPVVLGALAIVGTMSVLRLISFATDVSTYALDLSIAMGLALAIDYNLLIITRYREELARTEDRDRALYRTMATAGRTVLFSATTVGLSMAVMAVFPMYFLKSSAYTIVATAIIVAIAAVVITPAAIVLLGPRLDTMDARRVMHRILHGQRSFRDPAHKPLVEQFWYRSTKYVLRRALPVGLSVVALLLLLGVPFLGVKWGFPDERVLPRSASARQVADMLDNDFPGLGTELSVVVPDARGVTPTELRKYAAELSRVPDVSAVSAPTGTFSAGHRVGPPAAATGLANGSAFFTVSSTAPLYSPASNAQLDRLHQVAGPGGRAVLMTGLAQINRDSVDAITKRLPTVFGLIAVVTFMLLFLLTGSAVLPVQALVCNVLSLTAAFGAMVWIFQDGHLGALGTTPNGTLNANIPVLLFCIAFGLAMDYEVFLVSRIHEYWLASQSIRETPPTAREARAETDESTALGIAGIGRVVTTAAVVMSISFAALIPAHVSFMRMLGLGLTLGVLVDATLVRMVLVPAFIHLLGRWTWWAPRPMVWLRERSATGEAGEVRVGRRRWARDAPRPAIRRWPSRATSGRG

SEQ ID NO: 2793 - protein, 297 aa, Mycobacterium paratuberculosis
VPRTEIIAALLALSSALCVATGDVLQQRAAHCITDRELGPVELFAGLLRSQRWWWGAVLLLASIGLQAAALGGGSVLLVQALLMFSVLFALPINARLSHRAVTAGEWVWAALLTAAVTVVVVVGNPQTGHAGAPLRTWAVVALVLGPLLAGCVVAGRARGGAVAAVLFAFVSGSLWGVFAVLAKEVMARLGQGVGVVTRTPELYACILVALGGVVWSQAAFRAGPLTASMPTLQVSQPVVASVLGVVVLGETLDTGRAGTVALLVAVVVMTAAIIKLARVEAVATRDRAEAQLHQPA

SEQ ID NO: 2794 - protein, 407 aa, Mycobacterium paratuberculosis
VRREMEGHWMTPLRGRRSWLAAAMALVAVGAVACGGGHTAAPPKVIFDKGTPFADLLVPKLTASVSDGAVGVTVDAPVTVSVADGVLASVTMVNENGRSISGQLSPDGLRWSTTEQLGYNRRYTLTAKATGLGGAASKQMTFETSSPAHLTMPYVSPADGEVVGVGEPVAIRFDENIANRAAAQKAITITTNPPVEGAFYWLNNREVRWRPEHFWKSGTVIDVAVNTYGVDLGDGMFGEDNVKTHFTIGDEVISTADDTTKTVTVRVNGEVVKTMPTSMGKDSTPTANGIYIVGARFKHIIMDSSTYGVPVNSPNGYRTEVDWATQMSYSGVFVHSAPWSVGAQGHTNTSHGCLNVSPSNAEWFYDHSKSGDIVEVVHTVGPTLPGTEGLGDWNIPWSQWKAGNANT

SEQ ID NO: 2795 - protein, 112 aa, Mycobacterium paratuberculosis
LAGCGGSTPTATTVISTPPAQTKTVTVTVTPPPPPGPKTSIETNGTFIVNKEIAAGTYRTDGKSGCYWARLRSFDTNDIIDNNVGDGAQVVRILPTDVAFMTRSCGIWRKID

SEQ ID NO: 2796 - protein, 215 aa, Mycobacterium paratuberculosis
VRDELVWIDCEMTGLDLGSDKLIEIAALVTDAELNVLGDGVDVVIHADDAALAAMGEVVTEMHSRSGLIDEVKASTVDLATAEEMVLDYIRTHVKAPKTAPLAGNSIATDRAFIVRDMPALDAYLHYRMIDVSSIKELCRRWYPRIYFGQPVKGLTHRALADIHESIRELQFYRRTAFVAPPGPSTSEIEAVAAALDEGKDAPGPSDSASAPPTG

SEQ ID NO: 2797 - protein, 521 aa, Mycobacterium paratuberculosis
MSTDSAATPATRIADGYAVAGQALELGTVVIDGAADPSAQIRIPLATVNRHGLVAGATGTGKTKTLQLIAEQLSAAGVPVLMADVKGDLSGLSKEGERSDRTDARAKDTGDDWQPSGFPVEFLSLGANGIGVPIRATVDSFGPVLLSKVLGLNATQESTLGLIFHWAKERNWPLVTTDNLRGAISHLTSDEGKEDLKSLGGVSATTAGVILRALVNLDAEGGDTFFGEPKLDPNDLLRTNDQGQGVISLLEFTGQSVRPVIFSTFLMWLLADLYTQLPEVGDIDKPKLVFFFDEAHLLFADASKAFLEQVEQTVKLIRSKGVGVFFCTQLPTDIPNDVLSQLGARIQHALRAFTPDDQKALSKTVRTYPKTDVYDLESALTSLGIGEAVVTVLSEKGAPTPVAWTRMRVPRSLMASIGTEEITKAAKRSELQAKYGQTVQQPAQPPPGPQAPTGSRSPQAQSDYPPVPPNGPVPPMPEPAEPKGPGLLERLWHDRDVQSAVNTGIREIIRLKFGGGGRRRK

SEQ ID NO: 2798 - protein, 268 aa, Mycobacterium paratuberculosis
MPIPAPSPEARAVVTGASQNIGEALATELAARGHHLIVTARREDLLKDLAARLTEKYRVTVEVRPADLADAGERATLCDELAARTISVLCANAGTATFGPVATLDPAGEKAQVQLNVLGVHDLTLAVLPGMVERRAGGILISGSAAGNSPIPYNATYAATKAFVNTFSESLRGELRGSGVHVTLLAPGPVRTDLPDDAEASIVERLVPDFLWISTEHTARVSLDALGRNKMRVVPGLTSKAMSVASGYAPRAIVAPIVGSFYKKLGGG

SEQ ID NO: 2799 - protein, 449 aa, Mycobacterium paratuberculosis
LPGMSQPESRAAAPVRSRVVAWALWDCGSTGLNAIVATFVFAVYLTSSVGVGIGGSTTPASWLGRAAAIAGLTVALLAPAVGVWVESPHRRRVALSVLTALAVTLTGSMFFIRDRPGYLWAGLVLLGATAACGDLASVPYNAMLRQLSTPRTAGRISGFGWAAGYVGSVLLLLVIYTGFIAGSGSGPDATRGLLRVPLRDGLYVREAMLVAAAWLALFALPLLFVAHRLTESAEGYRPTSMLGGYRKLWTEVREEWRRDRNLVYFLFASALFRDGLAAIFAFGAVLGVNVYGISQADVLVFGVAASVVAAVGAVLGGFVDHRVGSKPVIVASLLAIVVLGLTLMALSGPVAFWACGLLLCMFIGPSQSSSRALLLQMAKHGREGVAFGLYTMTGRAVSFVAPWLFSVFVDAFGAVRAGLGGISLVLTAGLLAMLAVRVPRRAPVAVEAA

SEQ ID NO: 2800 - protein, 253 aa, Mycobacterium paratuberculosis
VDMNDSRPTERFSPPQPRYSPSVDPAYADQTPYAPTYGPTMSPWAPAANETNPTKQLPAYWQQELPPGGDPHAPGMAPPPGEPKSPRWLWIAAGAAVLLVVALVIALVLANDAIKTQTAVPPLPAMPEPSPETPTTSTHRSPSLIPAPIPPTSEPEPPTATTGPAAMQDVVYTVSGEGRAISIMYIDTGDLIQTEFNVALPWSKQVSLSKSAVHPANVTIVNIGHSVTCTVTVNGVQVSRRVGGGLTICDARG

SEQ ID NO: 2801 - protein, 218 aa, Mycobacterium paratuberculosis
MTTSASESRAGGAQPPNRRSQLKSDRRLQLLSAAERLFAERGFLAVRLEDIGASAGVSGPAIYRHFPNKESLLVELLVGISTRLLAGARQVRARSADAAAALDGLIDFHLDFALNEPDLIRIQDRDLAYLPKPAERQVRKAQRQYVEVWVGVLRELNPELAEADARLTAHAVFGLLNSTPHSMKSQGSGRGKPARAARSRAIMRAMTVAALAAGNQCP

SEQ ID NO: 2802 - protein, 559 aa, Mycobacterium paratuberculosis
MVFSTTELIRINSKLRPPDGKEAAAAMDKVMAAPAKADPVSFADEHRRLVGELNAKLAAAALGGNERARERHVSRGKLLPRERVDRLLDPGSPFLELSPLAADGMYDDESPGAGIITGIGRVSERECVIVANDATVKGGTYYPMTVKKHLRAQEVALQNRLPCIYLVDSGGAFLPRQDEVFPDREHFGRIFYNQATMSAKGIPQVAAVLGSCTAGGAYVPAMSDEAVIVREQGTIFLGGPPLVKAATGEVVSAEELGGGDLHSRISGVTDHLADDDEHALRIVRSIAATFGPREPSPWQVRTPVPPKAAQNELYDVVPPDPRVPYDVHEVIVRLVDGGEFSEFKANYGKTLVTGFAHIHGHPVGIVANNGVLFSESALKGAHFIELCDKRKVPLLFLQNIAGFMVGRDYEAGGIAKHGAKMVTAVACARVPKLTVVIGGSYGAGNYSMCGRAYSPRFLWLWPNARISVMGGEQAASVLATVRGEQLTAAGKPWSAEEEEAFKAPIRAQYEDQGNPYYSTARLWDDGIIDPADTRTFVGLALSVCAQAPLEPVGYGVFRM

SEQ ID NO: 2803 - protein, 671 aa, Mycobacterium paratuberculosis
VFETVLVANRGEIAVRVIRTLHRLGIRSVAVYSDPDATARHVLEADEAVRLGPAAARDSYLNIDKVVEAATRTGAQAIHPGYGFLSENADFAAACERAGVVFLGPPARAIQVMGDKITAKNAVAEFDVPVVPGVAKLGLGDDELVAAADEIGYPVLIKPSAGGGGKGMRLVEEPGRLREALVGARREAASSFGDDTLFLERFMLRPRHIEVQILADAHGNVVHLGERECSLQRRHQKVIEEAPSPLLDPETRARIGAAACNTARSVDYVGAGTVEFIVSADRPDEFFFMEMNTRLQVEHPVTEAVTGLDLVEWQLRVAAGEKLVFAQDDIELRGHAIEARVYAEDPARGFLPTGGRVLGVFEPSGDGVRVDSSLLPGTVVGSDYDPMLSKVIAHGADRDEALARLDRALSHTAILGVQTNVEFLRFLLADERVRAGDLDTALLDARLADFAPLPAPDDVLAAAGLYRQSALAARARRFAGNPWAAPTGWRAGGSPAPVRTDMRTALRTETVSVWGPPEAAEVQVGAGERLSASAHLGPDRISVTLDGRRRDYRWAEADRHLWIADERGTWHLREAEQTTIHRAAGPQRAEILSPMPGSVIAVQTPSGSDVSEGDVVVVVEAMKMEHSLAAPVSGRVEVLVCVGDQVSVDQVLARVVPEESDPPADSSKDET

SEQ ID NO: 2804 - protein, 388 aa, Mycobacterium paratuberculosis
MTTSLTAGTLPKEYQDLRDTVAEFARTVVAPVSAKHDEEHSFPYEVVAKMGEMGLFGLPFPEEYGGMGGDYFALSLALEELGKVDQSVAITLEAGVSLGAMPIYRFGNEEQKRKWLPDLTAGRALAGFGLTEPGAGSDAGATRTTARLEDGEWVINGSKQFITNSGTDITSLVTVTAVTGTVGADKKEISTIIVPSGTPGFTVEPVYSKVGWNASDTHPLSFSDARVPEENLLGARGTGYANFLSILDEGRIAIAALATGAAQGCVDESVKYAKERQSFGQPIGSYQAISFKIARMEARAHVARTAYYDAAAKMLAGKPFKKEAAIAKMIASEAAMDNARDATQIHGGYGFMNEYPVARHYRDSKILEIGEGTTEVQLMLIARSLGLS

SEQ ID NO: 2805 - protein, 166 aa, Mycobacterium paratuberculosis
MSEPVKSVVQRGLWFEEFEIGTTYLHRPGRTITEADNVLFTTLTMNTQSLHLDAAWAAQQPGFRGERLVNSMFTLSTLVGLSVSQLTLGTIVANLGFSEVSFPKPVFHGDTLYAETVCTGKRESKSRPGEGIVTLEHTGRNQHGDVVARAVRTTLVQKRPSDQEAP

SEQ ID NO: 2806 - protein, 273 aa, Mycobacterium paratuberculosis
VNPHAAGPAWLFCPADRPERFAKAAAAADVVILDLEDGVAEADKPAARKALLETPLDPERTVVRVNAADTDEYARDLEALAGTAYTTVMLSKTESAAQVQTLAPREVIALLETPRGAVFATEIAAAQNTVALMWGAEDLVATLGGSSSRRADGSYRDVAHHVRSTALLTASAFGRAALDAVHLDIRDLDGLRAEAEDAVALGFAGTVCIHPSQVPVVRQAYRPPEEKLDWARRVLAAARSERGVFAFEGQMVDSPVLKHAQMMLRRAGETAAG

SEQ ID NO: 2807 - protein, 363 aa, Mycobacterium paratuberculosis
MAQTSQPPMTVDLQPVQLVAADGTPTPEHRYSRELPAETLSWLYEMMVLTRELDGEFVNLKRQGQLALFASCRGQEAAQVGATACLRKTDWLFPQYRELGAFLVRGIPPGNVGAVWRGTWHGGLGFTDKCCAPLSIPIGTQSLHAVGAAMAAQRLGEDSVTIAFLGDGATSVGDVHEALNFAAVFRTPCVFFVQNNQWAISLPVAKQTAAPSLAHKAIGYGMPGIRVDGNDVLACYAVTAEAAARARAGRGPTLIEAITYRLGPHTTSDDPTRYRTQDEVDHWAALDPIPRYRSYLQGQGLWSERLEERVIGRATRMRAELRDAVFDAPDLDVDEVFTAVYAEITPELQAQRRALRTELEKSD

SEQ ID NO: 2808 - protein, 351 aa, Mycobacterium paratuberculosis
MTQLADRPTGHGETLTAAVQDVALHAQALTMVQALNRALHDAMAADERVLVFGEDVAVQGGVFRVTEGLAEAFGESRCFDTPLAESAIIGIAVGLALRGFVPVPEIQFDGFSYPAFDQVVSHLAKYRTRTRGAIDMPVTVRVPSFGGIGAAEHHSESTESYWAHTAGLKVVVPSNPADAYWLLRHAIACPDPVMYLEPKRRYQGRGLVDAGRPEPPIGRAMVRRAGTDVTVVTYGSLVGTAVGAAEEAQRQRGWSLEVIDLRSLVPLDFDTIATSIHRTGRCVVMHEGPRTLGYGAELAARIQEELFYELEAPVLRACGFDTPYPPARLEKWWLPGPDRLLDCVERTLELP

SEQ ID NO: 2809 - protein, 388 aa, Mycobacterium paratuberculosis
VSDERVKPFLVPDLGEGLEEVTVTHWNVAVGDDVELNQVLCTVETAKAEVELPSPYAGRIVEMNGAEGDVLKVGAVLVRLDTAPESGEPPAAETAPTLVGYGADAGIDTSRRTGRPLAAPPVRKLAKELMVDLGSLRPRSGAVITREDVLSAAHGTGNGAEVRPVQGVQARMADKMTLSHKEIPAATVSVQVDCTALVRLSERLGPAEQRITPFVLTLRLLVIALRRNEIMNSTWVDTPQGPQVRIEHRVHLGVAVATERGLLVPVIADAHTKTTRELASRAAELISGARAGSLTPGELRGSTFTVSNFGALGVDDGVPVINHPEAAILGMGAIKPRPVAIGTEVVVRPTMSLSAVFDHRIADGAQAARFVCELRDLIESPETALLDL

SEQ ID NO: 2810 - protein, 249 aa, Mycobacterium paratuberculosis
MAQSNLVLLDIENHVALITVNDPDRRNAVTAEMSGRLREAVERVEADSDVHAVVITGAGKAFCAGADLSALGAAGGGSAETGFMAIGSCRLPTIAAVNGAAVGAGLNLALAADVRIAGPAALFDPRFQQLGLHPGGGATWMLQRAVGPQVARAALLFGMRFDAEAAVRHGLALSVADDPVAAALELAAGPAAAPREVVLATKATMRATISLGSLDNEQHQHAMRTELGPQAHSIQSPEFAQRLAAAQRK

SEQ ID NO: 2811 - protein, 136 aa, Mycobacterium paratuberculosis
MASSDWQPVVRVGKPRFIAGVGNRIKVEVKTRGWLSRDWRCYFGSQVSQQQLDARYTSYPCWDEIQRIEGSCAEHDAERYIEMIDAAIHYANTRLRNDALPPTMTYGSRSDSRACAVRERQAELDELAKKLAKPEA

SEQ ID NO: 2812 - protein, 213 aa, Mycobacterium paratuberculosis
MTAGATLLGAPLPASAAPCPDIEVTFARGTAEPPGVGGVGQAFVEALRSQAGARSLGVYPVNYPADDDFAASASAGAGDASAHVQSMVADCPNTKLVLGGYSQGAMVIDLITIAQAPVAGLIPQTLNADQAEHVSALALFGNPSDRYLGAPVSVVSPWYGAKSIDLCAPGDPVCTPGGPLALPSHDEMVSPAHLSYRQSGMPAQAATFVAAHL

SEQ ID NO: 2813 - protein, 102 aa, Mycobacterium paratuberculosis
MTILATTLVHPNPGVAWDDIQKQLKRASGLARKHGAENVTVLVNMVGGQGTNSIGFLTTAKDWATYGQIQQSLSSDPDYQGLLVDSAQIATWENYVSQTIEV

SEQ ID NO: 2814 - protein, 395 aa, Mycobacterium paratuberculosis; identical to SEQ ID NO: 2035

SEQ ID NO: 2815 - protein, 423 aa, Mycobacterium paratuberculosis
MTSRGDVAMSVAGDLTSRCSWAGAQAARLAAEARDVYQLGNLVLRGGPFALGCFAGWLFTEFPPHVLTGHALSRVSHPSIGRVGKTLATQRADHTLTAALQESLGPDFRDQVCHPTSVASVCARRGGLLGRPGPHRRYAAQTSDISYGPGGRDNLLDIWRRDDLAPGCRAPVLIQVPGGAWALNGRRPQAYTLMSRMVLLGWICVSIDYSKSPRSTFPAHLIDVKRAIAWVRENIADYGGDPDFIAITGGSAGGHLASLAALTPNDPAFQPGFENADTAVQAVAPYYGVYDFTDFENMHPLMVPFLEQFVLKARYADDPQRFAAASPISYVHADAPPFFVLHGQKDELVPSGQARAFCAALRAAGARTVGHAELSNAHHAFDITPTVRSRLAADAVADFLGVVYGRRVSSLVDSLPLSATSAS

SEQ ID NO: 2816 - protein, 489 aa, Mycobacterium paratuberculosis
MTESVETIKLSDELGPVDYLMHRGEANPRTRSGIMALELLDTTPDWQQFRARFENASRRVLRLRQKVVVPTLPTAAPRWVIDPDFNLDFHVRRVRVAEPGTLREVFDLAELILQSPMDISRPLWTATLVDGLADGKAATLLHVSHAVTDGVGGVQMFAEIYDLERNPPPKPPPPLPVPQDLSPNDLMRQGINHLPFAVVGGVVSALSGAVSVAGRAVLEPASTVSGIVGYAMSGMRVLNRAAEPSPLLRRRSLATRSEAIDIPLADLHKAAKAGGGSINDAYLAGLCGALRRYHEVFGVPISTLPMAVPVNLRAEADTVGGNRFTGVNLAAPIGTVDPVSRMKKIRAQMTQRRDEPAMNIIGSLAPVLSVLPTAVLEGITGSVIGSDVQASNVPVFPGDTYIAGAKVLRQYGIGPLPGVAMMVVLISRGGWCTITVRYDRASVRDEALFAQCLLEGFDEILALAGDGAPRAVPASFTESAVSARSASGS

SEQ ID NO: 2817 - protein, 357 aa, Mycobacterium paratuberculosis
LRFSSRGPVGLRRQLRTLAGFGSMFPVAAGAVGVGVLTRNRRRGVNFFTSTFSQLSLAIAGVHLNVIGKENLTAQRPAVFIFNHRNQVDPVIAGALVRDNWVAVGKKELEKDPVMGTLGKLLDGVFIDRDDPAAAVETLHTVEDRARNGLSILIAPEGTRVDTTEVGPFKKGPFRIAMAAGIPIVPIVIRNAELVAARNSTVINPGTVDVAVFPPISVQDWTLDTLPERIAEVRQLYLDTLANWPVGELPEVDLYAEKKAAQKARGRAAKSPATSPAKPPAKSPAKRPAKKSAAKKTAATSAAKTRAKKTVVEPKSRTTPAAPNPEVAASHNGEVSPSRAADPIGAEPPEAPPRGRP

SEQ ID NO: 2818 - protein, 785 aa, Mycobacterium paratuberculosis
VTEPAADASALLTEQDSLVLASMASAVEVDLVTVWLEQQRAGHPGAQFELVKLPALDAPPAEMTALAERLEAGDDRSVVPVRVFWLPPPDRGRIAKLAGLVPGRDPYHPNQRLQAQILRRAPQRARVVAGEAATVSELRRQWRDTTVGDDQRDFAQFVIRRAILAMERVEYRILGPQYKSPRLVKPEILASNRFRAGLAKIPGATVEEAGKMLDELATGWSRASVDLVSVLGRLISRGFDREIDYDEYQVAAMRTALEAHPAVLLFSHRSYIDGAVVPVAMQENRLPPVHVFAGINLSFGAMGPLLRRSGVIFIRRNIGNDQLYKYVLREYVGYIVEKRFNLSWSIEGTRSRTGKMLPPKLGLLSYVADAYLDGRSEDILLQPVSISFDQLHETAEYAAYARGGEKTPEGVGWLYNFIRAQGERNYGKIYVRFPEAVSMRQYLGAPHGPLAQDPDAKRLALQKMSFEVAWRILQATPVTATGLVCALLLTTRGAALTLRQLHHTLQDSLDYLERKQNPMSTSALRLRSPDGVRAAVDALSNGHPVTRIDGGREPVWQITPEHQHAAAFYRNSVIHAFLETSIVELALAHAKHVDGDRMQAFWDQAMRLRDLLKFDFYFADSATFRDNIAEEMAWHDNWEDHVAAGGDEIDALLFAKRPLMAEAMLRVFFEAYEIVADVLRDAPADIGNKELTRLALGVGRQYVAQTRIRSSESVSTLLFATARQVVEDQDLIAAAPDLAERRDAFLRELRAILRDFDYVGRVAREQFVAREAKARRESLDSRPGP

SEQ ID NO: 2819 - protein, 689 aa, Mycobacterium paratuberculosis
MTVAPPAGTASTEAVPQHRTLVWPVLAGVAVLAGCTAAGIGTLSLASALTATGLPDPGPVTTVGLPFLRAAGEIAAVLAVGSFLFAAFLVPPQPSGVLDADGYRALRLGTVASGVWAVCAALLVPLTLSDVSGHPVADLRPAQMWSLAGLITTASAWRWTAILAAAITLASLPVLRWSWAPVLLAASLTTLIPLGLTGHSSAGGSHDLATNGLLIHLVAAALWAGGLLALLAYALRGGQGGDHLGLATRRFSAIALWCWVAMALSGLVNAAVRVQPSDLLATGYGRLVLAKAAALCLLGGVGWRQRRVNVAALQAVSTLARARRALLRLTLIEAALFGLTFGIAVGLGRTAPPSPPARLPSIAEAEIGYDFDGPPTLTRILFDWRFDLIFGTAAIVLAGLYVAGVVRLRRRGDRWPPGRTSSWLLGCLVLLFVTSSGVGRYMPAMFSMHMVVHMCLSMLVPILLALGAPVTLALRALPAAGRGDPPGPREWLLAALHSRFSRLLTNPVVATVLFVAGFYGLYLSNLFDTTASSHAGHLLMNLHFLLSGYLFYWVVIGVDPTPRPIPPLAKLAVVFASLPLHAFFGVVLMGTRKVLGADYYRSLGFSWHTDLLGDQRLGGGIAWSAGEFPLVIVMLALLVQWARSDRRTAKRLDRAADRDDDAELAAYNAMLAQLAGRDKPGEGSATGQA

SEQ ID NO: 2820 - protein, 160 aa, Mycobacterium paratuberculosis
MFETPLTVVGHIVNNPERRQVGAQEVIKFRVASNSRRRTADGGWEPGNSLFINVNCWGRLVTGVGAALGKGAPVIVVGHVYTSEYEDRDGNRRSSLEMRATSVGPDVSRAIVRIEKPGYTGPSTDEATPAAAEAADAAGEDADRGDTVEPVDTGPVPLSA

SEQ ID NO: 2821 - protein, 558 aa, Mycobacterium paratuberculosis
MAEFIYTMKKVRKAHGDKVILDDVTLSFYPGAKIGVVGPNGAGKSSVLRIMAGLDKPNNGEAFLATDATVGILQQEPPLNEEKTVRGNVEEGLGEIKVKLDRFNEVAELMATDYSDELMEEMGRLQEELDHADAWDLDSQLEQAMDALRCPPPDDPVTNLSGGERRRVALCKLLLSKPDLLLLDEPTNHLDAESVQWLEQHLAAYAGAVLAVTHDRYFLDNVAQWILELDRGRAYPYEGNYSTYLEKKADRLAVQGRKDAKLQKRLSEELAWVRSGAKARQAKSKARLQRYEEMAAEAEKTRKLDFEEIQIPVGPRLGNVVVEVEHLDKGYDGRTLIKDLSFTLPRNGIVGVIGPNGVGKTTLFKTIVGLEQPDSGTVKVGETVKLSYVDQARAGIDPKKTVWEVVSDGLDYIEVGQNEVPSRAYVSAFGFKGPDQQKPAGVLSGGERNRLNLALTLKQGGNLILLDEPTNDLDVETLGSLENALVNFPGCAVVISHDRWFLDRTCTHILAWEGDDDNEAKWFWFEGNFGAYEENKIERLGAEAARPHRVTHRKLTRD

SEQ ID NO: 2822 - protein, 1973 aa, Mycobacterium paratuberculosis
MTIDPRAQQDLKPWTTFTRQQDIPEWISKAYVESYRGPHSDESGGAEAGPIDLTVPTALVTPAMLSAHYRLGLHRPDGESRVAVYPADDPAGFGPALQVVTDHGGMLMDSVTVLLHRLGVPYTAIMTPVFDVHRSPDGDLLSLEPKPQGAPQYAGEAWIHVQLLPSVDSKGLTEAERLLPKVLADVQQVASDASALIAVLDELAAAVEANRDNHFSAPDRDDVAALLRWLGNGNFLLLGYQRCRVHDGLVSGDGSPGLGVLRTRTGSRPRLTDDDRLLVLAQSVVGSYLRYGAYPYAIAVREYVDAAVIEHRFVGLFTVAAMNADVLEIPTISRRVREALAMADSDPIHPGQLLLDVIQTVPRSELFTLSSERLLAMAKAVVDLGPQRNALLFLRADSLQYFVSCLVYLPRDRYTTAVRLQIEDILVREFGGTRLEFTARVSESPWALMHFMVRLPTDDPAAKPVDVSEDNRVRIQGLLSEAARTWTDRLVAAAAEGAVGHADAEYYADAFPEVYKQAISPADAIGHIAIIKELQDNSVKLVFTEGEDGSAQLTWFLGGRTASLSQLLPMLQSMGVVVLEERPFTVTRSDGLPVWIYQFRISPHPTIELASTPDERDAMAERFADAVTAIWQGRLEVDRFNELVMRAGLRWQQVVLLRAYAKYLRQANFPYSQSYIEAVLNEHPSTARSLVALFEALFDPHPDSSAGRDAQAAAAAVAADIDALVSLDTDRILRAFASLVQATLRTNYFVTREGSARARNVLAIKLDAQLIDELPLPRPKYEIFVYSPRVEGVHLRFGPVARGGLRWSDRRDDFRTEILGLVKAQAVKNAVIVPVGAKGGFVVKRPPLPSGDGAADRDATRAEGVACYQLFISGLLDVTDNVDHATGKVSPPPEVVRRDGDDAYLVVAADKGTATFSDIANDVAKSYGFWLGDAFASGGSVGYDHKAMGITARGAWEAVKRHFREMGVDTQTEDFTVVGIGDMSGDVFGNGMLLSKHIRLLAAFDHRHIFLDPNPDAAASWEERRRMFELPRSSWDDYDKSLISEGGGVYSREHKSIPVSPQVRDALGLDGSGGDVTEMTPPNLIKAILQAPVDLLFNGGIGTYIKAESESDADVGDRANDPVRVNGSSVRAKVIGEGGNLGVTALGRVEFDLSGGRINTDAMDNSAGVDCSDHEVNIKILIDSLVTAGKVKPQERKPLLESMTDEVAALVLTDNEDQNDLIGTSRANAPSLLPVHARQIQYLVDERGLNRELEALPSEKEIQRRAEAGIGLTSPELCTLMAHVKLDLKEQMLQTELTEQDVFASRLPLYFPTPLRHRFTPEIRAHQLRREIVATMLINELVDAAGISYAFRIVEDVGVSAVDAVRTYVATDAIFGVGEIWRRIRAANLPVALSDRLTLDTRRLIDRAGRWLLNYRPQPLAVGAEINRFAAKVKALTPRMSEWLRGDDKAIVEKEAAEFESQGAPRDLAYLVAAGLYRFSLLDIIDIGDINDIDAAEVADTYFALMDRLGTDGLLTAVSELPRNDRWHSLARLAIRDDIYASLRSLCFDVLAVGEPDESGEEKIAEWEHLSASRGRAGPPHTDRDPGKRGQGSRDAVRRRATNPSHDPHQRKRFIELSVGFVAAVPVRWSDIDMYQHVNHATMVTILEEARGSVPAGGVRGRHPDHRAAHRRGQGDLQRPTAACGFAAAGDHVDQAAAGGRLHAGLRGALGQRRPRVPAGRHRRIATGRRAHRRGAAGAAHTATSRVSAAVDSVAERGLWLDAQSRAAHRADLAAFVDRALRLDDAAIIRLRTRSPGLLTAWVATGFDVLASRVVAGEVRPADLSVGADALARGLAAMDDSGYVDPGFAMDSAWRGALPPESGFTHLEDIPARVMLDLAQQGARLAKQHSSSHGPPVSLLDQEVIQVSSGDVEVGLPMRCVFALTAMGFLPQSPDAVDAGELIRVRILPTWLRLDARFGSVYRRRGDPGLLLG

SEQ ID NO: 2823 - protein, 343 aa, Mycobacterium paratuberculosis
MACYEWTVIGAGPAGIAAVGRLLDHGADSIAWIDPAFAAGDIGQKWRSVSSNTHAGLFLEYFNGCKSFRFSEAPPMPLREIDAGETCALALVAEPLLWVTGQLRERVDTVTTTATALYLSDRRWRIETEQREIFSRNVILAVGAVPKKLCHPGLEEIPVEVALDPEKLARQSLSGATVGVFGSSHSSMIVLPNLLRQPVEKVINFYRSPLKYAVYFDDWILFDDTGLKGQAAVWARENIDGVLPERLHRCLVSSPEFAENLARCDRVVYTVGFERRTLPETPQWGRLDYNPTTGILAPGLFGVGIAFPQYAEDPYGYGQFRVGLKKFMDYLDAVLPLWLRYGP

SEQ ID NO: 2824 - protein, 557 aa, Mycobacterium paratuberculosis
VMSAHEVMSAHETERGAMQSKPWWSSAVFYQVYPRSFADSDGDGVGDIDGVTAHLDHLEQLGVDAIWLNPVTVSPMADHGYDVADPRDIDPLFGGMAAIERLIAAAHRRGIKITMDVVPNHTSSAHPWFQAALAAGPGSDARQRYFFRDGRGADGELPPNNWTSVFGGSAWTRVLEPDGNPGQWYLHLFDTEQPDLNWEHPDVFDDFEKTLRFWLERGVDGFRIDVAHGMAKPAGLPDSPDLESKVLHHSDDDPRFNHPSVHDIHRDIRKVVNDYPGAVTVGEVWVTDNARWAEYLRPDELHLGFNFRLTKIDFDAVQIHDAIQNSLAATALQEATPTWTLSNHDVGREVTRYGGGEVGLRRARAMAMVMLALPGAVFIYNGEELGLPDVELPDEVLQDPTWERSGHTERGRDKCRVPMPWSGQAPPFGFSSRTDTWLPMPKEWAALTVQKQRDDPDSTLSFFRRALELRRRRVEFDGDGVELAGGDRRCGDVPASRRAGVRPQQRRAARAAAAGRTGAGERAAAGREAAPGRGGLAGLAARPGRAFRRPLLYMLTH

SEQ ID NO: 2825 - protein, 129 aa, Mycobacterium paratuberculosis
MDQVSFYDAVGGAETFQAIVSRFYAQVPEDEILRELYPLDDLEGAEERLRMFLEQYWGGPRTYSDRRGHPRLRMRHVPFRITPLARDAWLRCMHTAVASIDSKTLDDEHRRELLDYLEMAAHSLVNSPL

SEQ ID NO: 2826 - protein, 215 aa, Mycobacterium paratuberculosis
MAQGKKRRRHRSQVAAAGLTGPPTASSLHSVETHPPTRPDSTSIWSRRRVLLLNSTYEPLTALPMRRAIVMVICGKADVVHHDPAGPVIHSATSSIVMPSVIQLRSYVRVPYRARVPMTRAALMHRDRFCCAYCGAKADTVDHVVPRSRGGDHSWENCVACCSTCNHRKGDKLLNELGWTLRRPPLPPTGQHWRLLSTVKELDPAWARYLGEGAA

SEQ ID NO: 2827 - protein, 79 aa, Mycobacterium paratuberculosis
VSPMQMHLFIVGIPLLLVIVLSVLIWSHKGPHPATYKLGEKWTHPPILWAAVDEDVGHAGHGGHGTSEFTVGGGASGTW

SEQ ID NO: 2828 - protein, 169 aa, Mycobacterium paratuberculosis
VDTARRNSQSEVAPVARGEVATREPAELPNGWVITTSGRISGVTEPGELSVHYPFPIKDLVAIDDALKFGSRASKTRFAIYLGDLGTDTAARAREILADVPTPDNAVLLAVSPDQKVIEVVYGSAVRGRGAESAAPLGVAAASSAFQRGDLVDGLVSAIRVLSAGISPA

SEQ ID NO: 2829 - protein, 863 aa, Mycobacterium paratuberculosis
VVLPNLTREQAVERAALVTVAGYRIDLDLTDGKGGPGDRTFRSITTVVFDALAGADTVIDIAADTVRSATLNGRDIDVSGYDESTGISLQGLADRNVVVVDADCRYSNTGEGLHRFVDPVDDEVYLYSQFETADAKRMFACFDQPDLKATFDVRVTAPRHWKVISNSAAVSVNDAAQHRVHTFATTPRMSTYLVALIAGPYAEWKDSYVDEHGEIPLGIYCRASLARYMDAERLFTQTKQGFGFYHKNFGMPYAFGKYDQLFVPEFNAGAMENAGAVTFLEDYVFRSKVTRASYERRAETVLHEMAHMWFGDLVTMAWWDDLWLNESFATFASVLCQSEATEFTEAWTTFATVEKSWAYRQDQLPSTHPIAADIPDLAAVEVNFDGITYAKGASVLKQLVAYVGLEHFLAGLRDYFRTHAFGNATFDDLVAALEKASGRDLSDWGRQWLKTTGLNTLRPDFDVDDRGRFTRFAVTQSGAAPGAGETRVHRLAIGIYDDDGSGKLVRVHREELDVEGPVTEVPALVGVSRGKLVLVNDDDLTYCSVRLDAESLGTALDRIADIAEPLPRSLVWSAAWEMTREAELRARDFVALVAGGVQGETEVGVAQRLLLQAQTALGSYAEPGWARDHGWPQFADRLLELARAAEPGSDHQLAFVNALCSSLLSTRHVVTLADLLDHDPAELGLAGLEIDTDLRWRIVTALAAAGEIDADGPATPFIDAEVQRDPTAAGKRHAAQAAAARPQLPVKEQAWTTVVEDDTLANITARSMIAGIAQPGQHELLKPFTPRYFEAIPGVWARRSSEVAQTVVVGLYPAWDISDEGIAAADRFLSDPQVPAALRRLVLEGQAGVKRALRARRFDATAD

SEQ ID NO: 2830 - protein, 207 aa, Mycobacterium paratuberculosis
MAQQAPAKNKADFWFDPLCPWAWITSRWILEVEKVRDIEVNFHVMSLAVLNENREGLPDEYRERLAKAFGPVRVAIAAEQAHGAKVLAPLYTAMGTRIHNEGNKDLTDVIKQSLAEVGLPAELAEAADTDAYDDALRKSHHAGMDPVGDDVGTPTIHVNDVAFFGPVLSRIPRGEEAGKLWDASVTFASYPHFFELKRTRDEKPEFD

SEQ ID NO: 2831 - protein, 159 aa, Mycobacterium paratuberculosis
MRVYLGSDHAGFELKQQIIAHLEQSGHQPIDCGAFSYDADDDYPAFCIAAATRTVADPDSLGIVLGGSGNGEQIAANKVPGARCALAWSVETAQLAREHNNAQLIGIGGRMHTVAEALAIVDAFVTTPWSKAPRHQRRIDILAEYERTHQAPPVPGAVG

SEQ ID NO: 2832 - protein, 268 aa, Mycobacterium paratuberculosis
VPEGHTLHRLARLHQRRYAGAPVAVSSPQGRFAEAAAVVDGRVLRRTSAWGKHLFHHYAGGPIVHVHLGLYGSFSEWERPGDGPLPDPVGQVRMRMVGAGHGTDLRGPTVCEVIDEGQVSDVLARLGPDPLRDDADPSWAWQRIAKSRRPIGALLMDQTVMAGVGNVYRSELLFRHGIDPYRAGRDVGEAEFDAAWTDLVALMKVGLRRGKIIVVRPEHDRGAPSYRPDRPRTYVYRRAGEACRVCGEPVRTAVLEGRNVFWCPTCQK

SEQ ID NO: 2833 - protein, 396 aa, Mycobacterium paratuberculosis
MSDLKTDAPIHGSCAPDFVGVRDAFERNFTHGGEVGAAVAVWVDGSLVVNLWGGWADAARTRPWQQNTLTTVLSGTKGLSATCVHQLADRGQLDLQAPVARYWPEFAQAGKQDITLAMVMSHRSGVIGPRTRMRWEQVADWDYVCEQLAAAEPWWEPGTAQGYHMTTFGFIMGEVFRRVTGRTIGHYLRTEIAGPFGADVHIGLPLAEQHRCAERVNKPHARDLLADANAPTDPRSLAEHPKAGLSISMGFAPDDELGSHDLNLWRELEFPGTNGQVSALGLATFYNALAQEKLLSREHMDRVRVCQGGLDTDLVLGPRVADHGWGLGYMLNQRCVNGPNPRIFGHGGLGGSFGFVDLEHRIGYAYVMNRFDATKANADPRSLALSNEVYSVLGVR

SEQ ID NO: 2834 - protein, 464 aa, Mycobacterium paratuberculosis
VKSTVEQLSPTRVRINVEVPFAELEPDFQRAYKELAKQVRLPGFRPGKAPAKLLEARFGREAMLDQVVTEALPARYGQAVAESEVHPLGQPEIEVTKKEYGQELAFTAEVDVRPELNLPDPGALKISVDPIEVTDEDVDAELQSLRARFGTLTGVERPVAEGDFVSIDLSATIDGQEVPGATAQGLSHEVGSGRLIEGLDEALIGMSVDESREFTTKLVSGEHAGQDAQVTVTVKSVKERELPEPDDEFAQLASEFDTIDELRANLREQVGRVKRAQQAERIRDAAIDTLLEQVDIPLPEAIVKAQVDSALHGALHSLNHDESKLEEVLAQQGKSREEFENETRTAAETDVKKQLLLDALADKLQVQVGQEDLTERLVATSRQYGIEPQQLLAYLQENNQLPAMFADVRRALAIAEVIRAATVTDTAGNTIDTSEFFGKRPSGDGAADEDADQADESTTADAGE

SEQ ID NO: 2835 - protein, 199 aa, Mycobacterium paratuberculosis
VSDMRSPSQGLNLTDSVYERLLSERIIFLGSEVNDDVANRLCAQILLLAAEDPTKDISLYINSPGGSISAGMAIYDTMVLAPCDIATYAMGMAASMGEFLLAAGTKGKRYALPHARILMHQPLGGVTGSAADIAIQAEQFHVIKKEMFRLNAEFTGQSIERIEADSDRDRWFTAQEALEYGFVDHIITRAATITNGEAQ

SEQ ID NO: 2836 - protein, 211 aa, Mycobacterium paratuberculosis
VNPQIQPQARYILPSFIEHSSFGIKESNPYNKLFEERIIFLGVQVDDASANDIMAQLLVLESLDPDRDITMYINSPGGGFTSLMAIYDTMQYVRADIQTVCLGQAASAAAVLLAAGTPGKRMALPNARVLIHQPSLQGVIQGQFSDLEIQAAEIERMRTLMETTLARHTGKDAATIRKDTDRDKILTAEEAKDYGIIDTVLEYRKLSAQTA

SEQ ID NO: 2837 - protein, 306 aa, Mycobacterium paratuberculosis
VGSARGFTWPSDPVLLDGGLATELEARGHDLSDPLWSARLLADAPQEIVAVHAAYFRAGAMIATTASYQASFEGFAARGISRSDTAGLLRRSVELAKAARDEAGVAGHVAASVGPYGAALADGSEYRGRYGISVRQLEDWHRPRLEVLAGADADVLAVETIPDVDEAEALVNLVRSLGVPAWLSYTIDGAHTRAGQPLADAFAVAAGVPEIVAVGVNCCAPDDVLPTIEIAAAIGKPVIVYPNSGEHWNALRHNWTGPSRFSAPLAARWISAGARIVGGCCQVRPTDIAAVRRACSDGENSAKKSP

SEQ ID NO: 2838 - protein, 426 aa, Mycobacterium paratuberculosis
MARIGDGGDLLKCSFCGKSQKQVKKLIAGPGVYICDECIDLCNEIIEEELADADDVKLDELPKPIEIREFLEGYVIGQDTAKRTLAVAVYNHYKRIQAGEKGRDSRHEPVELTKSNILMLGPTGCGKTYLAQTLAKMLNVPFAIADATALTEAGYVGEDVENILLKLIQAADYDVKRAETGIIYIDEVDKIARKSENPSITRDVSGEGVQQALLKILEGTQASVPPQGGRKHPHQEFIQIDTTNVLFIVAGAFAGLEKIIYERVGKRGLGFGAEVRSKAEIDTTDHFAEVMPEDLIKFGLIPEFIGRLPVVASVTNLDRESLVKILSEPKNALVKQYTRLFEMDGVELEFTDDALEAIADQAIHRGTGARGLRAIMEEVLLPVMYDIPSRDDVAKVVVTKETVQDNVLPTIVPRKPSRTERRDKSA

SEQ ID NO: 2839 - protein, 656 aa, Mycobacterium paratuberculosis
MEGNDVDPNGSGAGSDSQNGASPNGSSRQRLEQVVIRFAGDSGDGMQLTGDRFTSEAALFGNDLATQPNYPAEIRAPAGTLPGVSSFQIQIADYDILTAGDRPDVLVAMNPAALKANIGDLPRGGMVIANSDEFTKRNLTKVGYVTNPLETDELSDYVVHSVAMTTLTLGAVESIGASKKDGQRAKNMFALGLLSWMYGRPIETSEKFIREKFARKPEVAETNVLALKAGWNYGETTEAFGTTYEVSRATLPAGEYRQISGNTALAYGIVAAGQLADIPVVLGSYPITPASDILHELSKHKNFNVITFQAEDEIGGICAAIGASYGGALGVTTTSGPGISLKSEALGLAVMTELPLLVVDVQRGGPSTGLPTKTEQADLLQALFGRNGESPVAVLAPRSPSDCFETALEAARIAVSYHTPVIVLSDGAIANGSEPWRIPDVSTLPRITHAFAKPDEPFQPYARDPETLARQFAVPGTPGLEHRIGGLEAANGSGNISYEPVNHDLMVRLRQAKIDGISVPDLEVDDPTGDAELLLIGWGSSYGPIGEACRRARRKGIKVAHAHLRYLNPFPANLGEVLRRYPQVVCPEMNLGQLALLLRGKYLVDVQSVSKVQGVAFLADEIGRVIRAALGGTLAEVENDKTMVARMAAATVGASA

SEQ ID NO: 2840 - protein, 363 aa, Mycobacterium paratuberculosis
VTDVVGNLAGKDLGLTAKLTKNDGVPTTDQPQKAKDFTSDQEVRWCPGCGDYVILNTIRNFLPDLGLRRENIVFISGIGCSSRFPYYLETYGFHSIHGRAPAIATGLALAREDLSVWVVTGDGDALSIGGNHLIHALRRNVNITILLFNNRIYGLTKGQYSPTSEVGKITKSTPMGSLDHPFNPVSLALGAEATFVGRALDSDRAGLTEVLQAAAGHRGAAVVEILQDCPIFNDGSFDVLRKEGAEERVISVRHGEPIVFGANGEYCVVKSGFGLEVAKTADVSVDETVVHDAHTDNSAYAFALSRLSDQNLEHTVLGIFRDISRPTYDDAARAQVQAAQSAKAFDSAALQSLLRGRDTWTVD

SEQ ID NO: 2841 - protein, 197 aa, Mycobacterium paratuberculosis
VADSMQLAGIVLAGGESRRMGRDKATLPGPRGAATLLEYVVGVLIQRCDPIFVMAAPGQPLPEVTARIIRDEIRGQGPLPATGRGLRAAAEAGARYAFVCAVDMPLLSPELIDDLVHLATETNAEVVLPWDGRSHYLASLYRTDLAERIDRLVAGGARSMRALIDASDAQQIVLPESRFLANVNTEADLRALAQARA

SEQ ID NO: 2842 - protein, 411 aa, Mycobacterium paratuberculosis; identical to SEQ ID NO: 1383

SEQ ID NO: 2843 - protein, 216 aa, Mycobacterium paratuberculosis
LARRCRARPRRHVPKQAFNQQPQPTFVGLLWRARTAKGRILRNVRKTLILAAVTGTLVTIPSATAHADAEQVGFDPNVPAAGPAPDAPPPPAPDAPPAPAPDAPPAPDAPPPPAPDAPPPAPDAPPAPGPDVPPPPAPKAYSVNWDAIAQCESGGNWGINTGNGYAGGLQFTSSTWHANGGSGSPAGASREEQIRVAENVLHSQGIGAWPVCGRRG

SEQ ID NO: 2844 - protein, 419 aa, Mycobacterium paratuberculosis
VTATPREFDIVLYGATGFVGKLTAEYLAGAAPDKRVALAGRSTEKLRAVRDSLGDAAQSWPVLQADASSPATLNEMAARTQVVITTVGPYTRYGLPLVAACAAAGTDYADLTGEAMFVRDSIDSYHKQAADTGARIVHACGFDSVPSDLSVYALYRAARDDGAGELVDTDLVVRSFSGGVSGGTVASMLEVLDTASRDPEARRQLADPYTLSSDRGAEPDVGPQPDLPWRRGRQIAPELAGVWTAGFVMAPYNTRIVRRSNALLDWAYGRSLRYSESMSLGSSPLAPVASAVVGGTAAATFGLGSRYFRFLPRRLVERIVPKPGTGPSPAARERGYYRIETYTTTTSGARYVARMEQRGDPGYKATSVLLGESGLALAFDRDKLPQLYGVLTPAAAMGDALLDRFPGAGVFLQVDRLAG

SEQ ID NO: 2845 - protein, 882 aa, Mycobacterium paratuberculosis
VTASRSPATDLPKSWDPPAAEYAIYRQWVDAGYFTANPASDKPGYSIVLPPPNVTGSLHMGHALEHTMMDALTRRKRMQGYEVLWQPGMDHAGIATQSVVEKQLAVDGKTKEDFGRELFIEKVWDWKRESGGAIGGQMRRLGDGVDWSRDRFTMDEGLSRAVRTIFKRLYDAGLIYRAERLVNWSPVLQTALSDIEVNYEEVEGELVSFRYGSLDDSGPHIVVATTRVETMLGDTAIAVHPDDERYRHLVGSSLPHPFVDRQLLIVADEHVDPEFGTGAVKVTPAHDPNDFEIGLRHQLPMISIMDTRGRIADTGTQFDGMDRFAARVAVREALAAQGRIVEEKRPYLHSVGHSERSGEPIEPRLSLQWWVRVESLAKAAGDAVRNGDTVIHPTSMEPRWFAWVDDMHDWCVSRQLWWGHRIPIWYGPNGEQRCVGPDETPPEGWEQDPDVLDTWFSSALWPFSTLGWPEKTPELEKFYPTSVLVTGYDILFFWVARMMMFGTFVGDDDAITLDGRRGPQVPFTDVFLHGLIRDESGRKMSKSKGNVIDPLDWVDMFGADALRFTLARGASPGGDLAIGEDHVRASRNFCTKLFNATRYALLNGAQLAELPPLDELTDADRWILGRLEEVRAEVDSAFDNYEFSRACESLYHFAWDEFCDWYVELAKTQLAEGITHTTAVLATTLDTLLRLLHPVIPFITEALWQALTGNESLVIADWPRSSGIDLDQVATQRITDMQKLVTEVRRFRSDQGLADRQKVPARLAGVTESDLDTQVSAVTSLAWLTDAGPDFRPSASVEVRLRGGTVVVELDTSGSIDVAAERRRLEKDLAAAHKELASTTAKLANEDFLAKAPPHVVDKIRDRQRLAQEESERINARLAVLQ

SEQ ID NO: 2846 - protein, 485 aa, Mycobacterium paratuberculosis
MSEPPDWAPEHDVPDPVPTPDEIAALLQVEHLLDQRWPETKIEPSLTRISALLDLLGSPQRAYPSIHVAGTNGKTSVARMIDALVTALHRRTGRTTSPHLQSAVERISIDAKPISPARYVDTYREIEPFVQMVDQQSQAAGGPAMSKFEVLTAMAFAAFADAPVDVAVVEVGMGGRWDATNVVNAPVAVITPISIDHVDYLGHDLAGIAGEKAGIITRAPAGAPDTVAVIAQQPPEVMEVLLAQCVQADAAVARAGSEFAVLGRQVAIGGQLLQLQGLGGVYSDVYLPLHGEHQAHNAALALAAVEAFFGAGAQRQLDVDAVRAGFAAVTSPGRLERMRSAPTVFIDAAHNPAGAAALARTLADEFDFRFLVGVLSVLADKDVDGILAALQPVFHSVVVTHNGSPRALDVESLALAAREQFGPDRVSTAENLSDAIDVATALVDDAVRDGLVDGQAEDFAGTGIVITGSVVTAGAARTLFGRDPQ

SEQ ID NO: 2847 - protein, 125 aa, Mycobacterium paratuberculosis
MTRPDPPEGPQQRGAADPWRSFGAVMAATLILEAIVVLLAIPVVGAVGGGLTRVSLGYLIGLAVLLVLLAGVQRRPWAIWVNLGAQAILLAGFAVYPGVGFIGVLFTGLWALIAYFRAEVRRRQG

SEQ ID NO: 2848 - protein, 136 aa, Mycobacterium paratuberculosis
VTERTLVLIKPDGVQRQLVGEIIGRIERKGLTLVALELRHVSQDLAAQHYAEHEGKPFFASLLEFITSGPVVAAIVEGPRAIAAFRQLAGGTDPVEKAIPGTIRGDFGLETQFNLVHGSDSVESAKREIGLWFPDA

SEQ ID NO: 2849 - protein, 946 aa, Mycobacterium paratuberculosis
VVDGAPTADPSEESTRSGDLPDRLRVHSLARTLGTTSKRVLDALSELDGRVRSAHSTVDREDAVRVRDLLAAQPSAEPEPAAEDAASGGPDAGIAGEPESRLLLETPDATERPHYMPLFVAPQPLESSDDDGDADETADSDDSDGDDDEQADRPSSRRRRRGRRGRGRGRGEQGGSDGPGDGDDDEPQNRGKKGGQSDGDDDSDGQDAEDADDSDTGDDGSADGGNRRRRRRRRRKSGSGDDNEDGPSPDDPPNTVVHERPPRNGKNGGDDGNGSSSSEIKGIDGSTRLEAKRQRRRDGRDAGRRRPPVLTEAEFLARREAVERVMVVRDRIRTEPPHQGSRYTQIAVLEDGIVVEHFVTSAASASLVGNIYLGIVQNVLPSMEAAFVDIGRGRNGVLYAGEVNWEAAGLGGSDRKIEQALKPGDYVVVQVSKDPVGHKGARLTTQVSLAGRYLVYVPGASSTGISRKLPDTERQRLKEILREVVPSDAGVIIRTASEGVKEDDIRGDVTRLQERWKQIEAKAIEIKEKAAGAAVALYEEPDVLVKVIRDLFNEDFAGLIVSGDDAWNTINEYVNSVAPDLVSKVTKYEPATGPDGTPGPDVFAVHRIDEQLAKAMDRKVWLPSGGTLVIDRTEAMTVIDVNTGKFTGSGGNLEQTVTKNNLEAAEEIVRQLRLRDIGGIVVIDFIDMVLESNRDLVLRRLTEALARDRTRHQVSEVTSLGLVQLTRKRLGTGLVEAFSTSCPNCGGRGILLHADPVDSAPSNGRKSESGGRRGRRKKSKAEEPVVAKVPVHSPGEHPMFKAMAAGSSTQAASDEDESAAEEAGDELERKKAARAEELEAAEDTEDLEDTEDDDEDSDDSDDEDLDDEDIDDEEDLGDDDEDLELDDDDLDTEDSDDSDDSDDSEDSDDSEDQRDPAAERPGVSALGRPRRRRAAGRPAGPPIHAD

SEQ ID NO: 2850 - protein, 103 aa, Mycobacterium paratuberculosis
MATYAIVKTGGKQYKVAVGDVVKVEKLDSEPGSNVSLPVALVVDGAKVTSDAAALAKVAVTGEVLEHTKGPKIRIHKFRNKTGYHKRQGHRQQLTVLKVTGIK

SEQ ID NO: 2851 - protein, 88 aa, Mycobacterium paratuberculosis
MAHKKGASSSRNGRDSAAQRLGVKRFGGQIVKAGEIIVRQRGTKFHPGTGVGRGGDDTLFAKQAGAVEFGIKRGRKTVNIVAAGQAAD

SEQ ID NO: 2852 - protein, 492 aa, Mycobacterium paratuberculosis
MPRFVDRVVIHARAGSGGNGCASVHREKFKPLGGPDGGNGGRGGSIVFVVDPQVHTLLDFHFHPHISAPSGKQGMGNNRDGAAGADLEVKVPDGTVVLDENGRLLADLVGAGTRFEAAAGGRGGLGNAALASRARKAPGFALLGEPGETRELTLELKTVADVGLIGFPSAGKSSLVSAISAAKPKIADYPFTTLVPNLGVVSAGEHTFTVADVPGLIPGASAGRGLGLDFLRHIERCAVLVHVIDCATADPGRDPISDIDALEAELAAYTPTLQGDVTLGDLTERPRAVVLNKIDVPEARELAEFVRDEIAERGWPVFLVSTVAREGLQPLIFGLWQMISEYQSAQPEIVPRRPVIRPVPVDDSGFRVEPDPRQPGAFVVSGARPERWVRQTNFDNDEAVGYLADRLARLGVEEELLRLGARPGCAVTIGDMTFDWEPQTPAGQQVVLSGRGTDARLERTERVGAAERKAARRQRRTGDDAERGTTERGENT

SEQ ID NO: 2853 - protein, 347 aa, Mycobacterium paratuberculosis
VTAHRDAIRTARSMVVKVGTNALTTPAGVFDAGRLAGLADAIEARMKAGTDVVIVSSGAIAAGIEPLGLSRRPRDLATKQAAASVGQVALVNSWSAAFARYGRTVGQVLLSAHDISMRAQHTNAQRTLDRLRALHAVAIVNENDTVATNEIRFGDNDRLSALVAHLVGAEALVLLSDIDGLYDSDPRKTKGAKFIPEVTGAEDLAGVVAGPGSDLGTGGMTSKMSSALLAADAGVPVLLAAAADAASALTDASVGTVFAARPVRMSARRFWVRYAAEAAGALTLDEGAVRAVVHQRRSLLPAGITAVSGRFYAGDVVELRGPDAVPVARGVVAYDTTELATMMGRST

SEQ ID NO: 2854 - protein, 216 aa, Mycobacterium paratuberculosis
MPSVTRTPPGRRSPGREQRREQLERRLLDATERLMRDGASFTELSVDRLAGAAGISRASFYIYFEDKGHLLRRLASRVFGELTDGARRWWSVAGRHDPDDVRAAMTRIIATYRRHQAVLVALNEMSGYDPLTAQTYREILTGISGQLTRVIEDGQADGSIRPRLAAATTASALTWMVERACQQNLPAQLPAYDAELADTLAEIVWGALYLKPASGI

SEQ ID NO: 2855 - protein, 436 aa, Mycobacterium paratuberculosis
VTGVIAERIGIMAVLTGESGTDRSGRPYDEIDLSSRAFWSGTAAERERSFAVLRAERPVSWHPPVEDSLLPDPTDPGFWAVTRRADIVTVSRNNDVFLSGHGVMFESIPAELLEASQSFLAMDPPRHTKLRKLAHAALSPRQVRRIEDSIKANAKAIVEELRSAGSGCDFVDHCAKELPIRTLSDMMGIPESERERMAHATDALVSWADPEFLNGRPALEVLLENQMYLHQVVGDLATQRRERPGDDLISSLVTAEVDGDRLEDAEVAAFFVLLSVAGNDTTRQTISHTLRALTVFPDEKFWLLEDFGHRIGTAVEEFIRWASPVMTFRRTAAADVELGGQTILAGEKVVMFYPSGNWDTEAFDHPERLNLGRDPNPHVGFGGGGLHFCLGAHVARAQLRAIFSELFRQLPGIQAGEPTYLAGNFVHAIRAMPCTF

SEQ ID NO: 2856 - protein, 282 aa, Mycobacterium paratuberculosis
VTVGRAESPELVAVLAGRRIAVLTGAGISTDSGIPDYRGPESPPSNPMTIRQFTGDPAFRQRYWARNHVGWRHMDDTLPNAGHRALATLEDAAVVTGVITQNVDLLHTKAGSRNVIDLHGSYARVICLGCGDTTSRAALAERLEALNPGFIERTEAIGGLAVAPDADAVVADTASFRYLDCARCAGMLKPDIVYFGESVPKDVVAAAYRLIDESDALLVAGSSLTVFSGYRFVRHAAARGIPIAIVNRGDTRGDHLATVKIDGGCSELLTLLADELSPLPTH

SEQ ID NO: 2857 - protein, 180 aa, Mycobacterium paratuberculosis
MSDTAVLVVDMMNSYQHPDAENLIPNVEKIIEPLTGLVRRARESAGVDLVYVNDNYGDFTAQFSDLVRSALDGARPDLVKPIAPVSGEAASLTKVRHSAFYSTALAYLLSRLGTKRLIITGQVTEQCILYTALDAYVRHFPVVIPTDAVAHIDPELGAAACKMMEQNMSAELTTAAGCLG

SEQ ID NO: 2858 - protein, 680 aa, Mycobacterium paratuberculosis
MDFYNAYSQGFARVAACTHRTVIGDPAANAESVLRLARACHDDSAALAVFPELTLSGYSIEDIVLQDLLLDDVEQAIAAIVAASADLLPVLVVGAPVRHRHRIYNAALVIHRGALLGVVPKSYLPTYREFYERRQIAPGDDERGTVRVAGLEAPFGPDLLFAASDLPGFVLHVEISEDMFVPIPPSAQAALAGATVLANLSGSPITIGRAEDRCLLARSASSRCLAAYVYSAAGEGESTTDLAWDGQTMVWENGVLLAMSERFPKGERRSIADIDTELLRSERLRMGTFDDNRRHHRIASESFRRIEFRLDPPAGDIGLRREIERFPFVPADRERLQQDCFEAYNIQVAGLEQRLRALDYPKLVIGISGGLDSTHALIVAARAMDREQRPRSDILAFTLPGFATGDRTKRNAIELCRALGVTFSEIDIRETAQLMLKEMDHPFARGEKVYDVTFENVQAGLRTDYLFRLANQRGGIVLGTGDLSELGLGWSTYGVGDQMSHYNVNAGVPKTLIQHLIRWVISSEEFAPEVGAVLQSVLDTEITPELVPSGEEEELQSSEAKVGPFALQDFSLFHVLRYGFRPSKIAFLAWHAWSDPEQGNWPPGFPEDKRPSYSLKEIRHWLQVFVQRFYSFSQFKRSALPNGPKVSHGGALSPRGDWRAPSDMSARIWLDEIEREIPED

SEQ ID NO: 2859 - protein, 165 aa, Mycobacterium paratuberculosis
LAVFGSVARRSGSGGRAASVVTCQPSERKIMSATTIDRTTGRDGLLRLAMRADAAISGLVGLAGIPLVGWLAEVSGTTTAFEYGMSAFLIGYGVLVFGLAALPSVRRAGMAVIIGNLLYTAAAVVLVLADVFPLTSTGVVLNLAAGVYTLVFAELQYFGWRRARA

SEQ ID NO: 2860 - protein, 183 aa, Mycobacterium paratuberculosis
MFRGKVWVFGDNLNTDAMYPAFAMKMQPAEAAKHVFYQVRPGWTDEVSPGDIVLAGKNFGLGSSRPVAALFVELGVAGLVAEEFNSLFFRNAVNSGLPAITVPDATAVFRDGDTGTFDLAEGSWRNDTTGASGTVPKLPDLILDIIDSGGVLPRLARQGYLPGELADLLRSPTVAMRGAGSGA

SEQ ID NO: 2861 - protein, 415 aa, Mycobacterium paratuberculosis
MGMTVIEKILARKAGLDSVSSGDTVVVDVDMTVLIDLQFATMWISPTRIHDPDRLAVIMDHAVPAPTIKDADGGRQARRFVADFGIERFYDVGRHGICHQVIAENGLARPGEVLACTDSHTCAAGAYNNAARGLGPAEIYSIMCTGTTWFQVAPTIRYEFHGAKPEVVSGKDIFLHIADEYGDAPNRNLEFGGPGLASIPMHDRRTIATQGAEVSADFSTFEPDDVLTSFLAERGVVEYEAVTPDSDAAYHDVRRVDLATLEPYVARPGTVSRNGSPVSRLGRQKIDQAFIGSCANGQLEDLRIAAEVLRGKTVAPGVRLLITPASQAVYREALRRGYLQDLADAGAVVTNSTCGACFGYHMGLLGAGEVCITASTRNFTGRMGSTEAEIFMASPATVAASAVAGYITDPRSVTA

SEQ ID NO: 2862 - protein, 295 aa, Mycobacterium paratuberculosis
MATTPARRRLRQLLDNGELIVAPGVFDGLSAHLARRTGHVAAYLTGAGVAASGFGLPDIGLVTATEMADRAAMIAAALGDVPLIADADTGYGGPMNVVRTVRAYDAAGVAAIQLEDQVFPKRCGHLPDKQVVDAAVFEQTLAAALDVRSDDDLLVVARTDARGPLGLDAAIERANRYARAGADIVFVEAPHDAGEIERIATEVDAPLLINLVLGGLTPLQSAARLHELGYAIAIHPGDLLMHTTFAMLHSLCGLNGTDPAAHLPASPGDFFDLVGMAHWRALDEKYAHTGGRTWA

SEQ ID NO: 2863 - protein, 476 aa, Mycobacterium paratuberculosis
MTALQQETVTDPVGPTGLLATWVAELTLDDVPAPVVDRAKHLLLDGIGCALVGAQLPWSRIATDAVLALEGSGDSIVIGTGRRTSAPAAAVLNGTFIQGFELDDFHPLAPLHSCSLLIPALLSTAATRSATTTGRELLLAAIAGFEVGPRVGHALHGTQMLDRGWHSGPVFGTHAAAMASGKLRGLPPAQLEDALGLAGTQSAGLMAAQYEAMSKRMHHGLAARNGFYAAGLAAAGYTGIKRVFEREYGGFLSVFGEGHDPDAAALTADLGQRWETSLIMVKSYAAMGGLHGAIDAARRLRNSVAPQNISSVDITVGETVYKHGWWLPERPLTPIGAQMNIGYATVAALLDGNVLPEQFTAARLDADDIWALISATRVHLDESLADADITEKFRTDLAVTTREGTVHRARVTLPHGAPNDPVTNDEVVAKFHALADRVTSRGRAAAIERAVIRLDDLTDVENLMDLLADPVAGALD

SEQ ID NO: 2864 - protein, 257 aa, Mycobacterium paratuberculosis
VTAAAGVPLHRQLFLVLHDEIDRGVIAPGEALPTEQTLCDQFGVSRITVRRALADLAAQGYIERRQGVGSFVRQHDPADVPTGRSYLQGLRQTQFETEAEVVELGVRSAPRAVAEALGRSGELLHIVRVRRQRRTREPLMVTNAWLPPELAPVLTERALRRAPLYELLSANGVAVDRVRHEITAEIAGPRNAQLLDVPIGAALLRVNRLVYVGDRPHHHVSALLSPSRSRVLLSQSADDMETGDGLRIAHDVGGPRG

SEQ ID NO: 2865 - protein, 299 aa, Mycobacterium paratuberculosis
LTVCRDADPRQKARAPGLVWPPGRRLTSAPMTDVCVVGSVNLDLSLAVDALPRPGETVLASSLRQAPGGKGGNQAVAAARAGARVQFVGAVGDDAAAGQLRAHLQANGVGLDGAVEIPGPSGTAIVVVDANAENTIVVAPGANGRFTLNDERARAVLAGCDVMLTQLEIPVATAVAAARHARSGGAVVVVNASPAGRDPDSLSELAAAADVVITNEEEASEWPWRPRHLVVTLGSHGARYVGADGEYSVPSPDVDAVDTTGAGDVFAGVLAANWPLEPGSPDQRRLALRRACAAGALAT

SEQ ID NO: 2866 - protein, 731 aa, Mycobacterium paratuberculosis
LTTSELTDAESDIAPAPAPQPAKRTRRTPLRSRFRFGIQSKILITMLLSSILGVAVIGLIGAVSGRNALRQVESERLIELREGQKRAVQALFREVTNSLIVWSGGFTINEATAALTAGFARLANATITPAQQQQLVNYYDNQMLKPIKHATGDSIDINAVLPNSNAQKYVQAYYTAAPRPTPDSLPVQDAGDGSAWSAANVRFDFYVRDIATRFDYRDALLLDTQGNVVYSVMKGPDLGTNILTGPYRESKLREAYQKALASNDVDFVWITDFQPYQPQLDAPTAWVVSPVGMNGRIEGVMALPVPAAKINKIMTAGGHWEAAGMGPATETYLAGPDDLMRSDSRVFVEDPQQYRRDAIDAGTPPDVVDRAIHLGGTTLVQPVATAGLRAAQRGETGVVTATDYMGNRELEAYAPLNIPNSDLHWSILATRDNSDAFARLGRFSKNLVIAVTAMIFVICVASMFVAQAAVRPVRRLEEGTRKISSGDYDINIPVRARDEIGDLTAAFNEMSRNLAIKEELLNEQRRENDRLLLALMPESVLQRYREGEETIAQKHQDVAIIYADIVGLDELFTEMPEAQLVGTVDELFRQFDSAAETLGVERIRTFHNGYLASCGVVTPRLDSIHRAVDFALEIGRIIDRFNSQTGHQLGLRVGVNTGNVVSGLVGRSGLVYDMWGGAVSLAYQMHSGSPQPGNYVSSQVYEAMRDVRQFAPAGTISVGGTDQAIYRLLER

SEQ ID NO: 2867 - protein, 154 aa, Mycobacterium paratuberculosis
MNAFGSSWFYWAIGIAIGLPIGMIALTEIHDALLRRQSPLARQVGLLRNYLLPLGALLLFLVQASGIPAGHIPVRILTTAFGLLVLVLLLSGLNATVFERAPEKSWRKRLPTIFIDVARLALICVGLAVMSSYIWECGSAGCSPRWASPRSSSA

SEQ ID NO: 2868 - protein, 331 aa, Mycobacterium paratuberculosis
VRIGGLFTALGITSVVIGLMLQNSVGQIVSGLFMLFEQPFRIDDWLDTGTTSGRVVEVNWRSVHIDTGAGIRIMPNSMLATTSFINLSRPPGPHKVAIDTTFSTADAPDRVCATLSRVARALPQVKPGTVARTVPVGAAGYRTVIWLDSPADAGAAKATFLRWAWYAARREELHLDGADDDFSTVQRVEHALDTVVAAALRLSAEEQRSLRSAARIVRYGADEIVEDAGQVPSAMTFLVSGRVQLTATAEDGTVVPVSTLAEGEFLGLTALTRQPNLASAYALEEVTALEIDREHIEHLGTRAPALLQNFGRILEERRSKVRGARRGERVG

SEQ ID NO: 2869 - protein, 435 aa, Mycobacterium paratuberculosis
MGLQAPFRSGGGTSRPQGRAAPRAVDLRREVHDAARRARVASRVLALLPAVAKDQALRSAADAIAGHAELILSANAEDLETARAAGTPSAMLDRLALDTKRVEGIAAGLRQVAGLPDPVGEVLRGYTLPNGLQLRQQRVPLGVVGMIYEGRPNVTVDAFGLALKSGNAVLLRGSSSATRSNQALVQVLRASLVSEDLPADAVQLLSADDRATVTHLIQARGLVDVVIPRGGANLINAVVRDAQVPTIETGVGNCHVYVHEGADLEVAERVLLNSKTRRPSVCNAAETLLVDAAIAEEALPRLVTALQDAGVTVHGGFARDATEDDLRREYLSMDIAVAVVDGVDAAIAHINEYGTGHTEAIVTTNMAAAQRFTDGVDAAAVMVNASTAFTDGEQFGFGAEIGISTQKLHARGPMGLPELTSTKWIAWGDGQTRPA

SEQ ID NO: 2870 - protein, 291 aa, Mycobacterium paratuberculosis
VSVPARPRPLFADIDDVSRRLAETGYLPDTATATAVFLADRLGKPLLVEGPAGVGKTELARAVAQATGSGLVRLQCYEGVDEARALYEWNHAKQILRIQAGSGDWDQTKTDVFSEEFLLQRPLLTAIRRTEPTVLLIDETDKADIEIEGLLLEVLSDFAVTVPELGTLTAERPPFVVLTSNATRELSEALKRRCLFLHIDFPSPDLERRILLSRVPELPAHLADELVRIIGVLRGMQLKKVPSIAETIDWGRTLLALGLDTIDDAVVAATLGVVLKHQSDQQRATGELRLN

SEQ ID NO: 2871 - protein, 482 aa, Mycobacterium paratuberculosis
MATRRIRPSRPLAPHGLPGHLVGFVEALRGAGISVGPSETVDAGRVMATLGLGNREVLREGLACAVLRRPDHRETYDAMFDLWFPAALGARAVVTDEDAGPGSGEDALPPDDVEAMRQMLLDLLTENPDLADMDERLVAMIARIVEAYGKYSSSRGPSFSSYQALKAMALDELEGKLLAGLLAPYGDEPTPTQEEIAKALAAQRITQLRKLVDAETKRRTAEQLGRDHVQMYGIPQLSENVEFLRASGEQLRQMQRVVAPLARTLATRLAARRRRSRAGTIDLRKTLRKSMSTGGVPIDVVLAKPRPARPELVVLCDVSGSVAGFSHFTLLLVHALRQQFSRVRVFAFIDTTDEVTHMFGPQADLAVAIQRITREAGVYSRDGHSDYGNAFASFEQKFPNVLSPRTSLLVLGDGRTNYRNPEVELLSHMVTASRHAHWLNPEPKHLWGSGDSAVPRYQEVIPMHECRSAKQLAAVIDQLLPV

SEQ ID NO: 2872 - protein, 222 aa, Mycobacterium paratuberculosis
VQKQLRRLGVMGGTFDPIHYGHLVAASEVADLFGLDQVVFVPSGQPWQKDRHVSAAEDRYLMTVIATASNPRFSVSRVDIDRAGPTYTRDTLRDLHALNPDSELFFITGADALASILSWQGWETLFELAHFVGVSRPGYELCREHITGVLGELPDDALTLVEIPALAISSTDCRQRAAQRRPLWYLMPDGVVQYVSKRRLYRAEPGPAVAVTETRLSTGDHP

SEQ ID NO: 2873 - protein, 131 aa, Mycobacterium paratuberculosis
MSATQEAIDMATVAAGAAAAKLADDVVVIDVSAQLAITDCFVIASASNERQVNAIVDEVEEKMRKAGYKPARREGAREGRWTLLDYRDIVVHIQHRDDRDFYALDRLWSDCPVVPVNLDEDRQNPGDAGTP

SEQ ID NO: 2874 - protein, 224 aa, Mycobacterium paratuberculosis
MKIRRLIMLRHGQTEFNAGSRMQGQLDSELSELGRAQAVAAAEVLGKAQPLLIVSSDLHRAYDTAVRLGERTGLPIRVDRRLRETHLGDWQGLTHTQVDTQAPGARLAWREDATWAPHGGESRVDVAARSVPVVAELVAGEPEWGDPDGPDRPVVLVAHGGLIAALSAALLKLPVPNWPMLGGMGNASWVQLSGHSDDAADEFDDIRWRLDVWNASAQVANDVL

SEQ ID NO: 2875 - protein, 249 aa, Mycobacterium paratuberculosis
MSSEQRPRPTLLIFADSLAYYGPTGGLPADDPRIWPNIVAAQLDWDVELIGRIGWTCRDVWWAATQDPRAWAALPRAGAVIFATGGMDSLPSVLPTALRELIRYVRPPRLRRWVRDGYGWLQPRLSPVARSALPPHLSVDYLEQTRGAIDFNRPGIPIVASLPSVHIADTYGRAHHGRAATAAAITEWAQSHDIPLVDLKAAVAEHIMSGRGNPDGIHWNFEAHQAVAELMLKALAEALPKTVPPTEKR

SEQ ID NO: 2876 - protein, 277 aa, Mycobacterium paratuberculosis
VAVVVVTDSSARLPADLLGQWGIRVVPLHILLDGTDLRDGVDEVPADIHQRAATTAAATPAELADAYQQALADSGGDGVVAVHISSALSGTCRAAERTAADLDPNLRVVDSKSAAMGTGFVALAAARAAAAGAQLDAVADAARAAVSRGHGFIVVHRLDNLRRSGRIGGPAAWLGTALALKPLLRIDDGKLVLAQRVRTAGHATEAMIDRVCQVIGDGAAALAVHHVDNPGGAAEVAAALGERLPACDPAIITELGPVLALHVGAGAVAVVVQQPGS

SEQ ID NO: 2877 - protein, 943 aa, Mycobacterium paratuberculosis
MSDASNKTQPDLSAADTGPINVKGLSKAERGHRPYLPHAIRIFAVPIILGWLFVTVLVNVIVPTLEKVGEAHSAPMTPLDAPSMKAMMRLGHNFHEFDSNSTVMIVLEGQQPLGPDAHKYYDNLIRQLRQDPKHIQHIQDFWGDRLTAAGAQSADAKGAYVQVNLAGNQGTTLANESVDAVRKVIDENKAPPGVKAYVTGPAALSDDMHIIGNASLAKITLFTLGAIAIMLLLVYRSIVTTLVQLFMTFVALACSRGVVAVLAYHNAFGLTTFAANILTMLAIAAGTDYGIFLIGRYQEALAAGEDRESAYYTTFKGVAPVVLGSGLTIAGATYCLSFSRLPWFNTMGAPVAIGMLVVVLADVTLGPAVVFVGSRFHFFERQAKRGRLWRRVGTAVVRWPAPVLAVSAAVVLVGMIALPSFHTSYNDRHYLPLSAPSNQGQEAANRHFSEARMNPDLLMIESDHDMRNPADMLVLDRVAKNEMRTLGIAMVQDITRPLGIPIQHSSIPFQNSVQSQTTMQNMGFLKERMNDILKMADDLQTQIDTTQRQYEVSMDLANAADDSAKTTAVTSQITDSLRDHIADFDDTFRPIRTYFYWEKHCYDIPVCIGLRSLFDTFDGFDQLAEQFHYLTTDIAHTAKASRDLTALFPTLITTLKTTRGITLTLYQTFKAMIDQMEAMSNTAVVMGQSFDASKNDDFFYLPPEAFDNPDFQTGLRMFLSPDGKSARFFITHQGDPMSPEGIKRVDAERTAAQEGLKQSSLSDARVYLGGTAATFKDMADGEKYDLMIAVVSALTLIFMIMLLLTRSVVAALVIVGTAASSIAASFGLSVLIWQDLFGIRIHWIVAALSVIILLAVGSDYNLLLVSRFREEIHGGLKTGIIRSMAGTGGVVTAAGLVFAFTMAAMLGSELRVLGQFGSTVCIGLLLDTLIVRTLLMPSIATLL

SEQ ID NO: 2878 - protein, 164 aa, Mycobacterium paratuberculosis
LVSFAEGGQVVAGPNSESRPGVLSRARKQAWIPLVLVVVLAVSALIVSRLHKIFGSEDLNANAGKGIEIVQFNPKVVVYEISGAPGSTANINYWDENANTHQVNNAPLPWSTTISTTLPSVSANIMAQSDGSTISCKITVDGVVRDNQNSDGHNAQTFCLVKSA

SEQ ID NO: 2879 - protein, 364 aa, Mycobacterium paratuberculosis
MNIMRQSHGKGAPMSKPSTTRPLRVIQWTTGNIGRRSLHAIIGRPDMELVGVYAHGAEKVGVDAAELAGWPEPTGVAATNDIDALLSLGADACCYNPLWPNVDELVRLLESGVNVCTSAAWITGGKQTPEDRRRIEEACRKGNSTIFGSGAHPGMTNMVGMVLSASCERVDEIRITESVDCSTYESAETQTAMGFSQDPDTPGLAESVRRESEVFAESAAMMADAIGAKLDKMTFDVTFTAATGDSDLGFMKIPAGTVGSVYGYHRGWVGERNVVSVGFNWTMGDHVVPPKPLEHGHVIQVFGLPNMRTVLHCLPPKDWTEPGFMGLGMIYTAMPVTNAVPAVVAARPGIVTLADLPPVTGRLG

SEQ ID NO: 2880 - protein, 216 aa, Mycobacterium paratuberculosis
MLITVLVMAAAVSVEPFRIGMAVLMMTRPRPVLQLLAFLAGGFAMGMTVGLVVLFLLRRVLLGSSYFTVPKVQLLIGVLALLVAAALAVDVPRRLGSRPAAMARPAQRLLNGDSLSVAGLAGLGIALPSVDYLAALAVIVASGAAAATQVGALLLFNVVAFALVEIPLLAYLVAPARTAASMTALHNWIRSRRRPQVAVLLAAAGCVFLTVGVTGL

SEQ ID NO: 2881 - protein, 578 aa, Mycobacterium paratuberculosis
MSQSSILSMLHARASLRPADIAFTFTDYERDWAGVRESLTWSQLSRRTINVARELHLHGSVGDRAVILAPQSLDYIAAFLGSMQAGLVAVPLPLPHRGSSHERVSAVLADTSPSVVLTTSAVAEDITEYVDKACLDAVPKIVEIDSLNLDVDGGPHVRAADLPSVAYLQYSSGSTRQPTGVMISHRNLKVNFEQLMRGFFADAHVKAPSDLTIVSWLPFYHDMGLVLGVCAPVLGGYRGELSSPLSFLERPARWVQALASSPHAWSAAPNFAFDLAARKTTDGDLAGLDLGGVLGIISGAERVEPATLQRFVDRFAHFNFRDEMVRPSYGLAEATVFAAAGTWNESSGAVRFDTDELSAGRARRCAAGSGTALVKYQVPQSPTLRIVDGDTQRECPPGVVGEIWVHGENVADGYWRKLPHEQSCFGATLRDPSPGTPGGPWLKTGDQGFLFDGALFIVGRIKDLLIINGRNHYPEDIEATVHEITRGRVAAISVPANGTEKLVTIIEFKERSDSADTSHRIASVKSDVTAAISNAHGLNVDDVVLVSPGSIPTTTSGKIRRAGCIEQYRQRQFTRLDS

SEQ ID NO: 2882 - protein, 376 aa, Mycobacterium paratuberculosis
MKQLLAGVTALLSVSTAGYFGIGTAAADGGPIGGPPTPGAPGDQTAYALGGAHVLGIPYDQYIRMEGADWFPGQQRQIVRYPAGQVQGHVLERLFPGIGKLDESFPGLGMNGPSVGESVAEGIDNLDAAIRTTGRPGTAIGLSEGAFVVDGEQARLANDPTAPPPNTLNFATFGDPIGRHAFGQSFLTAMFGVGSVVPALDYTMPPPYESQYDTNRFVAAYDSIADFPDRPDNMFALANTLMGLATGHTAVAFTNPSMVPPQNIRTTINSRGAKDTTIMIPEKHLPLVMPLRYIGIDENTLNKLDAILTPRVNAGYSRNDDPATAPVQVDPVHGFDPAEVTAPANQATFGGGADPLSQIMAGAMSVLSHGAGEADH

SEQ ID NO: 2883 - protein, 169 aa, Mycobacterium paratuberculosis
VVLLTLMALLRAIVAPLYLVATVVISYLSAVGVGVLVFQFLLGQQLHWSVPPLAFVVLVAVGADYNMLLVSRMRDESPHSMRYGIIRTLSSTGGVITAAGLIFAASMSGLLFSSIGTVVQGGVVIGVGILLDTFLVRTVTVPAIAALAGRANWWPSRMAVRRNPVSEQP

SEQ ID NO: 2884 - protein, 822 aa, Mycobacterium paratuberculosis
VIGFWAALAVALPLAFPSLAEMAQKHPLAILPGNAPSNVAARQMTEAFHESSSDDLLLVALTDEKGLGPADEAVYRRLVDALRRDTRDVVMVQDFISAPPLRSAVTSKDRKAWVLPVGVAGELGTPQSYAAFNRIAGIVKQTLEKHENGPAATSLTVSLTGPAATVADLTVAGERDRLPIELAIAVLVLVVLLVVYRSAVTMLLPLVTILLSLVIAQAAVAGYSQLTGSGVSNQSIVFLSAIMAGAGTDYAVFLISRYHDYLRRGDDFDQAVRKALISIGKVITASASTVGITFLLIGFARMGVFKTVGISSAIGIGVAFLAAVTLLPAIMVLAGPRGWIRPRRELTTGLWRRSGIRIVRRPRTHLVASVLVLIILASCAGLVRYNYDDRKALRPSAPSSVGYAALERHFPVNQSIPEYILIRSPHDLRTPQALADLEQLADRVSQLPNVSVVSGITRPTGNVPEQFRATYQAGAIGSMLAGGSTMINDQTDDLNRLARGAGTLADNLGDVRGQVNQLAASVRELENAFSSTKNQYSGDALVNQVDIAARLVDHVNSLSNAMGWNFTAAKNMFAWIGPVLAALQGNPVCDADSSCSATRATFEQLVGPRGQADLDAIDDLSHQLQAYPDKRALKASTDRLRNAFAKLNDVLRAMGMDRPGGLQSNLTTLQNGADQFAGGSRQVADAVAQLVDKVKQLGAGLSESAAFLLSLKHDAAHPAMAGFNIPAQLLRLPQFQEAAKVFISPDGHSVRYLVQSKLSPFSTQAMDQVDAITATARGAQPNTALADAEVSMAGYTVGLKDTRDYYQHDIKFIIAVTCWWCS

SEQ ID NO: 2885 - protein, 544 aa, Mycobacterium paratuberculosis
LHQYRRVIARVSSSVRAGLCPARGRIRPANTAVPVGCCTHIRASRRRPLPPGLCWCRQRGRTAAVRTEENRLRIGKITIGSLGDWTPTPGPVTSWHPTAAAAEKVRQAPASPVPVSYMQGQHLRNYHERTAAGLDFSRQIIATCDVPGRCDISAMNYAVNAYLRRHDTFRSWFHHSGDGEFVRHTVSNPADIEFAPIHHGEMTAEEIRAHVVAIPNPLEWGCFTFGVVQNEEYFTFFAAMDHVHGDATLIGTTMLEANGMYAAASAGGEPLELPDAGSFDDFCAREREYTSALTVDSPEVRAWIDFAENNNGSFPEFPLPLGNPSEATASAMVSELVMDAEQTERFESACTAVGVRFIGGLFACIALVEHELTGALTYYGLTPRDTRRTTDNFMTQGWFTGLVPITVPIAAASFADAAWTAQTSFDSGQQLAKVPYYRVLELAPWLKWPQPNFPVSNFFHAGAAPLNAVLAAADLGYANNIGIYSDGRYSYQLTIYVFRYGDGTAMAMMYPDNPVAHKSVARYTETMRSVCGRVADTGHWGRVA

SEQ ID NO: 2886 - protein, 3679 aa, Mycobacterium paratuberculosis
MSTVEGLRDPASSFAIVGYAARFPDAADADEFWRVLAEGRDAVSEVPKDRWDADEFFDPDPDAPGKVVTRRAGFVDDVTGFDAPFFGMSAREARLLDPQHRLLLETAWRAVEHCGTAPTDLANTNTGVFIGISTHDYLGMASDELTYDQIEAYTAIGTSSAAAAGRISYRLGLQGPAVAVDTACSSSLVAIHQACQALRLGECDLALAGGANVLLTPATMITFSQAHMLAPDGRCKTFDAAADGYVRGEGCGVLVVKRLEDAIRDGDRIRAVIRGSAINQDGASGGLTVPNGVAQQRVIAEALQRAGIAPGDVDYLEAHGTGTSLGDPIEVQAAGAVLGAGREASRPLLIGSVKTNIGHLEAAAGIAGVIKVILALEHGMLPQHLHFRDPSPHIPWDRLAVQVVKEATAWQRNGRPRVAGVSSFGFAGTNAHVILEEAPDGTGRAAVPPAAVRPPGQRRFHVLPLSARTPAALVQIAGEYRDWLSAHPDTALADLCLTAGAGRAHFEHRAALVVDSTGSAGELLAALADDRPAPGLLRGVCEDAPKTAWLFTGQGSQYAGMARELFDTEPVFAETLTRCATVLADVLEKPLLDVIFDTDDPASEETLRQTSYAQPALFAVEMGLARLWQSWGFEPDVVLGHSVGQYSAACVAGVLRLEDGARLIAERGRLFGSLPAGGRMVAAFAAAARVESLTDEFPSLSVAAYNGANTVLSGPGQELEQAVARLTAEKVRCDWLDTSHAFHSALRDPILDEFESYANQFDFGPPQRILICNRTGSALGRSVKLDGAYWRRHARQPVEFAKSVRTLADLGCKVLLEIGPQPVLTAAALRAWPDPATAPRAIASLRRNTADHRQITEALAEAYIVGHLPDFGAAVGPARKLDLPTYPFQHRQYWFSEQRVPPGSQQTSTQTTAVRLLEDGRIAELAELLDGASVDQHTLDVLTKLAAQHNQQRKSRSIAEDRYEIRWEKSTVPGPEAEATWLVVGDDDDAVAPLVDALTARGHQHRILVLPASDADEERVEIVLRAAAAEEAPLRIALVAALDSGTAPSMRSLLRMQHRVLAGTRRLFRAAAAAELRQPIWLVTRGAQRVTDADTVFPDQSCLWGFGRAASLEYPQLWGGLADLAQGSAEEWSRLVRVASAPRDPAVGEDQIALRGSDIYVPRLTRRSGQPAAAALTLRADATYLVTGGLGSIGLEIAGHLAAQGARHLVLTGRRAPGEAAQRRIDALSQQHGCEVRVIAADVADAHHVARLLGAVRAELPPVAGIVHAAGEIGTTPLSDLEDAEIDRVFAGKVWGAWHLSEAAADLRLDFFVSTSSIASVWGGLGQTAYGAANAFLDGLAWRLREQGVNGISVNFGPWAAGMADENARARLAQRGIKTLSPADALAGLADVMATAAAQGVVARIDWTRFLPLYQQAGQRSLLAELAREVPDFAPAPTPSGKTGLVERLAGAPVQQRRKLMTEFLRNAVAEVTRVDAAEIREDAGFFDLGMDSLMAIELRRHIEQGVGKQIPATLAMDYPRLSDVAEYLLGDVLDLRGQPDAKPAPPAGTPAPAGRTDEPIAIVSMACRFPGAADPEAFWELLSGGVDAIREVPEDRFDIDEFYDPDPETPGKMYSRFGGYLDQIDEFEPEFFGISPREAVWIDPQQRLALETVWEGLERAGYSPAALRGSRSGIFVGVGANEYSHLLSAESVDKIEPHFITGNALNAISGRVAFALGLEGPAVAVDTACSSSLVAVHQACQALHSGDCDLALAGGVNVLLSPVSNIAASRARMLSPVGRCKTFDATADGYVRSEGCGILVLKRMSDAVRDGDRVCAVIPASAVNQDGASSGLTVPNGGAQQRLIATALSRAGLSGDDVDYLEAHGTGTALGDPIEVQAAGAVYGATRDTDRPLLIGSVKTNIGHLEAASGVAGLIKVVLSLQHEMLPQSLHFETPSPHIPWDSLPLRVVDKAVPWQTNGRPRRAGVSSFGFTGTNAHVLIEEAPQPVTTQHATPAAESDARPVDVLPLSARSPEALLALAQRYGEWLHAHPDADIGDLCFTVGAGRAHFEHRAALVVDSVRSAREALADLADNRTRPGVARGECTDPPTTAWLFTGQGSQYPGMARELFDAEPVFAETVTRCADAVDGLLPRPLTEVIFATDKDTGGEAGKTLRNTAFAQPALFAVEMGLARLWQSWGVEPDVVLGHSVGQYAAACVAGVFSLEDGARLMAERGRLFGGLPDGGRMVAVFADAQYVEELANDCPRVSVAAYNGPNTVLSGPGADLEQIVARGASDGIRCSWLETSHAFHSELLDPVLDEFESYAAHLDFAVPTLPLVCNRTGTVLTTETPLDARYWRRHSRQPVQFAESVRTVAALGCTVLMEIGPQPVLTGAAVQVWPEHLAAPRAIVSLRKGVGDRRQIAEGLAAAYVSGHRPEFAALHRRPRRKLELPTYPFQRRRFWPKASGIAGIDGQGAAASGLLGSAKELASGDCVYTSRLSVKSQPWLADHVIYGTVVVPGATYAAMALAAVGPPARVQNVYFYEPIILPDKASREVQLSLHPLQEGGWSFRVDSRPYGVPDAEWSLNADGTVVAGIEDEPAADPADHIDAVIERLDRSRPQLLFDSFAESELEWGTTWSTSLKSLWMGDGEAVGDVTVGDELAEHLGTEPMHPVLLDLCTGVVFPAFPALLAAEQGFNDLLLPLRYGQVSLREKMPRRFYCRGKWRPSALDSETQVFDIDFIDRDGRHLGGIREFTVKRAPREALLRGLGGDATRLLYTLGWHEVPPQPSNDGGANPSGTWLIAGFDELAAQLPGCIPFDRNTDPESFGQLLARAEDRGGPVTGIVWRATQSGGQESSAESVARLETEIAGLLTAVHALQNADGSAVKLPGGLWIVTERGVATESGEPVDPVQAALWGLGRTIVNEEPALRCRLVDSDGSEQAVRSLAGLLGAPLDEPELAVRQGKLLASRLLPWARSGHLAVPRGTDYVLAPTERGAIDNLRLIEQEAPPPAEGCVQVRVEAGGLNFREVLNVLGLYPGDPGPLGGDFAGTVTQLGSGVTGLEVGTRVYGFMQGAFASRFNVPVQLLAPIPDGVSAVDAATIPAAALTARLAFDWAQLKPGDRVLIHAASGGVGLAAIQLAQRHGATVFATASTYKRATLRKLGVEYVYDSRSTDFADQILADTDGAGVDVVLNSLTNEGFIEATVRATAQHGRFVEIAKRDIWTREQMAAARPDIAYEIVALDWACVEQPEHIHALLTEVSDGLASGEWRPLPAEIYPLAEAKTAFRRMQQARHIGKIVLQMPKPLQPRGDRSYLITGGLGAIGLHLAAYLAQLGAGEIVLTSRRAPDAAARRAIDDITERYRCRVHTFAADVGDAAQVEQLLARIRAELPPLAGVAHLAGVLDDALLSQQSPERFRVALAPKAFGASYLDHATRTDDLDFFIVSSSVSSLLGSPGQANYSTANAWLDGLVAARQARGLPATGVNLGPWAQGGMASSEAARANIGAQGLIPLEPTAALAALAEVVANGTGQATVIKANWQRAAKLLGDARPPILDLVLPSAVGEASGDSELLKQLQEIPVAQRAAFITEFLQREVQGFLRLAQPPAATSRFLDLGTDSLMAVELRNRLHSQFGGAFTINATAVFDYPTIGGLAEYLAGQLPDAEPEPGAAVAANPNPGSETGTGEAEPEREAAPEPS

SEQ ID NO: 2887 - protein, 140 aa, Mycobacterium paratuberculosis
MAALSAEVVEFLSAGTRTGMLGYVAADGRPLVAPIWFVVDDGELAFNTGRGTAKARAIARDSRVVICVDDPHPPYSFVQVQGVAAVSEDPAEVLDIATRTGARYMGADRADEFGRRNAVPGELVVRIRPTKVNSAFDVAD

SEQ ID NO: 2888 - protein, 368 aa, Mycobacterium paratuberculosis
MDFQLSDEQALLRDTTRDLLSRSYDPESRNKVIGSELGWSREVWSQLADTGILGLGFDPDESGQIEIMVVLTEIGRRLAPEPVLHAALGPGALIAELGSAAQKELLDEVAAGQRLLAFAHLEPGQRKPTAEVGTKAARQGDSWTLSGQKNPVLAGDCADTLVVSAALPDGGTGLFLVDAGAVTRHPYRTFDGQRGAQIDLDATPAEPLGEATDASGGIEAAIIRIQSALCSEALGAMEESLRLTTDYLKTRKQFGVTLNKFQALTQRAADMYVSLELARSMSLYAAMSIADGNIDPVIASRAKLQIGRSGRHIAQESIQMHGGIGVTAEYPISHYAARLTAIEHTLGTSGEHLHNLIDHLGDYDLVRL

SEQ ID NO: 2889 - protein, 386 aa, Mycobacterium paratuberculosis
MQLALTPEEAAFRDELRTIYTTKIPEELRERVRRGSAEVNRDDIVTSHKILHEHGLAVPNWPVEWGGKDWTPTQHQIWADEMQLACVPEPLNFNTKMVGPVIAEFGSEEVKQRFLPPTASLDIWWCQGFSEPDAGSDLASLRTTAVRDGDHYIVNGQKTWTTLGQYADWIFCLVRTDPQAPKRQAGISFLLFDMKSPGITLRPIKTIDGGHEINEVFFEDVRVPADQLVGEENQGWTYAKFLLGNERTGIAGVGRTKVRLAEVKKHAAATGVLDDPLFAARLAEAENELLALELTQSRVTTDSANGQPNPASSVLKLRGSQLQQVATELLVEVAGPDALPAKADDIASPSWAQSSAPHYLNYRKTSIYGGSSEVQRNIIASTILGL

SEQ ID NO: 2890 - protein, 286 aa, Mycobacterium paratuberculosis
MQTELPAERPQRRLRAEPDADAAVQPEEPGPIAGEDSPDDDQNSLLPRWLPGAPEHRGWVARIRADPGRAGAIGLAIVAALAVLVTVFTLIRDRPAPVMSAKLPPVEKVSTASPRSSASPSGGPDRPVVVSVVGLVHTPGLVTLAPGARIADAVQAAGGAVNGADTAGLNMARPLDDGEQIVVGLAPVPGQPPVLGSSVAAGSTPAPKPPPGPGAAKAKPKTGDAVDLNTATVQELDALPGVGPVTAAAIVAWRQTNGRFTSVDQLADVEGIGPARLEKLRALVRV

SEQ ID NO: 2891 - protein, 513 aa, Mycobacterium paratuberculosis
VTAGGIWWPIGRELAWCCVGLLAIAGALRWRAARRPRHPRLSSVSAGLAAIGVVGAGFGFAVALRADAVDHHPIAADFGASAPVTVTPSESPVSLGSGNQGRLMFRATLQQLRSDQMSGRVVVFARGPDFGGLMVGQPVRFTARIGRPTRRDLTVAVLTASGRPTLGSASAVQRAAHEVRRRFAAAVRDTLPADQAALLPALVLGDTSAVPTPTGRDFRAAGMTHLMAVSGANVTIVCAAVLFSARLIGPRAAVLLAALALVAFVVVVQPTASVLRAAVMGAIALAGMLTSRRRQAIPALAATVLVLLAVAPQLSVDVGFALSVLATAALVVLAPAWSRRLADRGWPKPLADAVAVAWAAQLVTAPLVAAISGRFSVVAAAANLLVAAVIAPITVLGTAAAALCPIWPAGARLLIRFTGPELWWVGGVAHRAAGVPGATVPVPDGTAGTLIVGGVTLLAVVAWRWWRGGGAGSAPRPPRRCWSAWPGCCPGWRSTRRAPIPARGRRSVVTPSW

SEQ ID NO: 2892 - protein, 325 aa, Mycobacterium paratuberculosis
VSEVSPLHLVLGDEELLVERAVAEVLAEARKRAGASGDADVPINRMRAGDVSTYELAELLSPSLFADERIVVLEAAGEAGKDAAAVILSAAAEMPAGVVLVVVHSGGGRAKALATELQSLGAVVHPCARITKLSERIDFVRKEFRRLRVKADEETVTAMLDAVGSDLRELASACSQLVADTGGAVDAAAVRRYHSGKAEVKGFDIADKAVAGDIEGAAEALRWAMMRGEPLVVLADALAEAIHTIGRVGPLSGDPYRLAAQLGMPPWRVQKAQKQARYWSRDSVATAMKVVATLNANVKGAVADADYALESAVRRVAELAGGRNR

SEQ ID NO: 2893 - protein, 86 aa, Mycobacterium paratuberculosis
VANIKSQQKRNKTNERARLRNKSVKSSLRTAVRAFREAAHAGDKEKAAELLVSTNRKLDKAASKGVIHKNQAANKKSALAQALNKL

SEQ ID NO: 2894 - protein, 558 aa, Mycobacterium paratuberculosis
VSLSNQLEDTGRGFRAARSERIFGGYNVASDAYDMAFDEMFDAAGAVRGPYKGIYAELAPSDASELKARAEALSRAFLDQGITFSLSGQERPFPLDLVPRVISAAEWARLERGITQRVKALEMYLDDIYGDQEILNDGVIPRRLVTSCEHFHRQAVGIVPPNGVRIHVAGIDLIRDEEGNFRVLEDNLRSPSGVSYVMENRRTMARVFPNLFATHRVRAVDDYAAHLLRALRNSAATNEADPTVVVLTPGVYNSAYFEHSLLARQMGVELVEGRDLFCRDNQVYMRTTEGERQVDVIYRRIDDAFLDPLQFRADSVLGVAGLVNAARAGNVVISSAIGNGVGDDKLVYTYVPTMIEYYLGEKPLLANVETLRCWLDDEREEVLDRIDELVLKPVEGSGGYGIVFGPEASDKELAAVAKKIRDDPRSWIAQPMMELSTVPTQVGSSLAPRYVDLRPFAVNDGEDVWVLPGGLTRVALVEGSRVVNSSQGGGSKDTWVLASRASSGDHELGAAEVVRSLPTAMPDPLVDDAPRSMAQQPQPTGPPQREQLEQQQQQRAGR

SEQ ID NO: 2895 - protein, 325 aa, Mycobacterium paratuberculosis
MLARNAEALYWIGRYVERADDTARILDVALHQLLEDSSVDPDQASRVLLRVVGIDPPDHDLDVWSLTDLVAYSTGAQGGCSIVDAVTAARENAKSAREVTSSEIWECLNTTYHALPERERAAKRLGPHDFLSFIERRAAMFAGLADSTLSRDDGYRFMVLGRAIERVDMTVRLLLSRVGDSASSPAWVTLLRSAGAHDTYLRTYRGVLDAGRVVEFMLLDRLFPRSVFYSLRLAEHNLDELMHNRQSRVGATAEAQRLLGQARSELEFVQPGVLLESLESRLAGLQRTCRDVSDALALQYFHVTPWVAWSDASQRARLVSRKGDG

SEQ ID NO: 2896 - protein, 510 aa, Mycobacterium paratuberculosis
MWRLRVVHTTGYAYQSPVTASYNEARLTPRSNNRQNVILNRVETIPATRSYRYIDYWGTAVTAFDLHAPHTDLTVMSSSVVETERAERPATELGWGDLHSEAVIDRFDELLRPTGHVPASKRVASVAKKIAKSHDPAEAVVAVGDWVRGELEYLPGTTSVHSSGLDALKEGRGVCQDFVHLSLMLLRSMGIPSHYVSGYLHPKRDAVVGDTVDGRSHAWIEAWTGAWWSYDPTNDAEITEQYVGVGAGRDYADVSPLKGIYSGEGATDLDVIVEVTRSPDQRRSRRRSGETHGRHRAPRLRVAAAVAALRRPAGRRARRRGRDGRRHAAAVRPGGRGGGLCSRPAGCRAGDRRRDVRVVGPAGALRGDGRRPVAPPRGRPDDRRDHAHRRNPGGRIARPGRIARLDAVPAGGHRGHGGGGGAVPAGVSHRRAGAHRGAGRVGRRDGGARPDPGGAAPARRAGRSGHGRTRRVGDRGADLARAGRDLAGRAGGGAGLAGGRGNCFAGQGLW

SEQ ID NO: 2897 - protein, 280 aa, Mycobacterium paratuberculosis
MIEVTLLGTGSPIPDPNRAGPSTLVRAGGQVFLVDCGRGVLQRAAAGGVGAAGLSALLLTHLHSDHVGDLGDVLITRWISTFTPDPVPLPIIGPPGTAELVAATLNALRHDIGYRIAHHADLNAPPAVDVREHTDGPVWDRDGVSIRVAPTDHRPVAPTIGFRVEYQGASVVLAGDTVPCAGLDELAAGAGALVHTVIRKDIVATIPQQRLQDICDYHSSVEEAAATAARAGVGTLVMTHYVPALVAGQEEQWRALAAREFAGRVELGDDLHRVQVDAPS

SEQ ID NO: 2898 - protein, 142 aa, Mycobacterium paratuberculosis
MRIADVLRNKGAAVVTINPDATVRELIAGLTEQNIGAMVVVGAEGVLGIVSERDVVRQLHVHGASVLSRPVSKIMTTTLATCTKTDTVDEISVLMTRNRVRHVPVLDGKKLIGIVSIGDVVKTRMEELEAEQQQLQSYITQG

SEQ ID NO: 2899 - protein, 204 aa, Mycobacterium paratuberculosis
MLRIWRPAGSRSGRAFQRFAENLVFDRAPRLVRHVQNSQTVLRELQQAVKITANVIAAAAPPPPDTAVLGRPVTRSSLPTAQRARKLVYAPKLDGRADPGEIVWTWVVYEDDPSRGKDRPVLVVGRDRSTLLGLMVSSQERHAADPEWVGIGSGSWDYEGRPSWVRLDRVLVVPEEGIRREGAILDREVFDVVAARLRAQYAWS

SEQ ID NO: 2900 - protein, 660 aa, Mycobacterium paratuberculosis
LRLPAGRHIRSIDAPIVPQSGRADTLDTLANRRLAGPDQEIPISSFADKTFTAPAQIRNFCIIAHIDHGKSTLADRMLQLTGVVDERSMRAQYLDRMDIERERGITIKAQNVRLPWQVSGGEDAGKEFVLHLIDTPGHVDFTYEVSRALEACEGAVLLVDAAQGIEAQTLANLYLALDRDLTIIPVLNKIDLPAADPDRYAGELAHIIGCEPDDVLWVSGKTGEGVARLLDEVVRQVPPPQGQADAPLRAMIFDSVYDIYRGVVTYVRVVDGKITPRERIAMMSTGATHELLEVGIVSPEPKASDGLGVGEVGYLITGVKDVRQSKVGDTVTSARHGAQEALTGYREPKPMVYSGLYPVDGSDYPDLRDALDRLRLNDAALTYEPETSVALGCGFRCGFLGLLHMEITRERLEREFDLDLISTSPNVVYRVIKEDGTEIVVTNPSDWPEGKVRTVYEPVVKTTIIAPSEFIGTIMELCQSRRGELGGMDYLSPERVELRYTMPLGEIIFDFFDSLKSRTRGYASLDYEEAGEQEAQLVKVDILLQGEAVDAFSAIVHKDAAFAYGNKMTTKLKELIPRQQFEVPVQAAIGSKIIARENIRAIRKDVLSKCYGGDITRKRKLLEKQKEGKKRMKTIGRVDVPQEAFVAALSADAAGDKSKK

SEQ ID NO: 2901 - protein, 252 aa, Mycobacterium paratuberculosis
MRIFTAATLLTAVAALAAGCGGVVSGTAKPAPNLKPRPLSGATVQQVLLDGPTLSRMLNQPFVARDPAQVGGPEKLYRGRRSASQSGCLGVTAMLQKSVYPAADVRDVAAESWWNNGEPAQVITVMEGVVTLPSAAQAQALFAQFSRQWQQCNGMTTSEQSGPISTTNVISDVRATDTTVAATKTATAVLPNMPALRPTPQGRALGVRSNCLVEVEVVFFGGRRSSDPGSADLNTSALDIAHAMMDRVSALG

SEQ ID NO: 2902 - protein, 652 aa, Mycobacterium paratuberculosis
MESSIDLRTPGPLAPNAALRNPFPPIADYAFLSDWETTCLISPAGSVEWMCVPRPDSPSVFGAILDRSAGHFRLGPYGVSVPSARRYLPGSLIMETTWQTHTGWLIVRDALVMGPWHDLERRSRTHRRTPMDWDAEHILLRTVRCVSGTVELMMSCEPAFDYHRVGATWEYSANAYGEAIARATKQPDAHPTLRLTTNLRIGLEGREARARTRMKEGDDVFVALSWTKHPPPQTYQEAADKMWQTTECWRQWINIGNFPDHPWRAYLQRSALTLKGLTYSPTGALLAASTTSLPETPQGERNWDYRYAWVRDSTFALWGLYTLGLDREADDFFAFIADVSGANNNERHPLQVMYGVGGERSLVEEELHHLSGYDHARPVRIGNGAYDQVQHDIWGSILDSFYLHAKSREQVPETLWPVLKKQVEEAIKHWREPDRGIWEVRGEPQHFTSSKVMCWVALDRGAKLAERQGEKSYAQQWRNIAEEIKADILAHGVDSRGVFTQRYGSDALDASLLLVVLTRFLPPDDPRVRNTVLAIADELTQEGLVLRYRVEETDDGLSGEEGTFTICSFWLVSALVEIGEVRRAKRLCERLLSYASPLHLYAEEIEPRTGRQLGNFPQAFTHLALINAVVHVIRAEEEADGSGMFQPANAPM

SEQ ID NO: 2903 - protein, 67 aa, Mycobacterium paratuberculosis
VSSVNAFLNWWDGNELWLSGLAFVLQAMVVMPIVLAVAYVTAALLDGLLGKGIALMRRARQAGGTSG

SEQ ID NO: 2904 - protein, 343 aa, Mycobacterium paratuberculosis
MDIRTAARWRPVLALVLTAGVVAGCHGGASDAVGGTGPADARTSITLVAYSVPEPGWSKIIPAFNASDEGKGIQVVTSYGASGDQSRGVVDGKPADVVNFSVEPDIARLVKAGKVAKDWNTDATKGIPFGSVVTLVVRKGNPKHIKDWDDLLRPGVEVITPSPLSSGSAKWNLLAPYAVKSEGGAHGDAGVDFIRKLVTEHVKLRPGSGREATDVFVQGSGDVLISYENEAIATERAGKPVEHLNLAQTFKIDNPVAVVNTSPHLQAAVAFKNFQYTAAAQKVWAQAGFRPVDPAVAADFRDQYPVPAKLWTIADLGGWSAADPQLFDKNTGSITKIYTQATG

SEQ ID NO: 2905 - protein, 290 aa, Mycobacterium paratuberculosis
MTAITPDPLAIRPELGGDPGHQPVPGRGRGTTALRVGVATVWLSVIVLLPLAAIAWQSAGGGWHVFWLAVTSNAALESFRVTLTISAGVTVLNLVFGLVIAWVLVRDEFPGKRLVDAIIDLPFALPTIVASLVMLALYGNNSPVGLHLQHTAAGVAVALAFVTLPFVVRAVQPVLLELDRETEEAAASLGASGPKIFTSVVLPALLPALLSGAGLAFSRAIGEFGSVVLIGGAVPGKTEVSSQWIRTLIENDDRTGAAAISIVLLAISFVVLLILRVVGGRAAKREELAA

SEQ ID NO: 2906 - protein, 272 aa, Mycobacterium paratuberculosis
MTSSPGVRYGLRFVALAYIFVLLVIPVSLILWRTFRPGFGQFYAWVSTPAAISALNLTLLVVAIVVPLNVFFGIPTALVLARNRFRGKGVLQAIIDLPFAVSPVIVGVALIVLWGSAGALGFVEKDLGFKIIFGLPGIVLASIFVTLPFVVREVEPVLHELGTDQEEAAATLGSGWWQTFWRITLPSIRWGLTYGIVLTIARTLGEYGAVLMVSSNLPGKSQTLTLLVSDRYNRGAEYGAYALSTLLMGVAVLVLVFQVVLDARRGRAAGQA

SEQ ID NO: 2907 - protein, 362 aa, Mycobacterium paratuberculosis
VIDAGTDRGDIAITVRDAYKRYGDFVALDHVDFVVPTGSLTALLGPSGSGKSTLLRTIAGLDQPDTGTVTIYGRDVTRVPPQRRGIGFVFQHYAAFKHLTVRDNVAYGLKVRKRPKAEIKAKVDNLLEVVGLSGFQGRYPNQLAGGQRQRMALARALAVDPQVLLLDEPFGALDAKVREDLRAWLRRLHDEVHVTTVLVTHDQAEALDVADRIAVLNQGRIEQIGSPTEVYDAPTNAFVMSFLGAVSTLNGTLVRPHDIRVGRTPEMAVAAEDGTAESTGVARAIVDRVVKLGFEVRVELTSAATGGPFTAQITRGDAEALALREGDTVYVRATRVPPITAGATTVPALSRDGADEATLTSA

SEQ ID NO: 2908 - protein, 247 aa, Mycobacterium paratuberculosis
MTERTTKLPEAELRELAARGAAELEGASASDVLRWTDETFGGVNGPRGWATCNYVVASSMQEAVLIDLAAKVRPGVPVVFLDTGYHFAETIGTRDAIESVYDIRVLNVTPEHSVAEQDKLLGKDLFARDPGECCRLRKVAPLGKTLRGYSAWVTGLRRSEAATRANAPVIGFDEGFKLVKVNPMATWTDEDVQNYIDEHNVLVNPLIYEGYSSIGCAPCTAKPLAGADPRSGRWQGLAKTECGLHAS

SEQ ID NO: 2909 - protein, 555 aa, Mycobacterium paratuberculosis
MTTARPAKARNEGQWALGNREPLNPNEEMKQAGAPLAVRERIETIYAKNGFDSIDKSDLRGRFRWWGLYTQREQGYDGSWTGDENIEKLEARYFMMRVRCDGGAISAAALRTLGQISVDFARDTADITDRENIQYHWIEVENVPEIWRRLDAVGLRTTEACGDCPRVILGSPLAGESLEEVIDPSWAIAEIARRYIGQPDFADLPRKYKTAISGLQDVAHEVNDVAFIGVNHPEHGPGLDLWVGGGLSTNPMLAQRVGAWVPLHEVPEVWAAVTSVFRDYGYRRLRSKARLKFLVKDWGIEKFREVLETEYLKRPLIDGPAPEPVAHPIDHVGVQRLKNGLNAVGVAPIAGRVSGTILLAVADLAQQAGCDRIRFTPYQKLVLLDIPDDKLDEVVAGLEALGLQSQPSHWRRNLMACSGIEFCKLSFAETRVRAQGLVPELERRLADVNRQLDVPITINLNGCPNSCARIQVADIGLKGQMVDDGEGGSVEGFQVHLGGSLGQDSGFGRKLRQHKVTSDELGDYIERVARNFVKYRGEGERFAQWAMRADEDDLR

SEQ ID NO: 2910 - protein, 390 aa, Mycobacterium paratuberculosis
MAIREQTVELPDVRVVDGHPFGLYVHVPFCVTRCGYCDFNTYTPAELGGVNPDAWLGALRTELELAAARLRPPPVNTVFVGGGTPSLLGGARLALLLDMVREHFALAPDAEITTEANPESTWPEFFDAIGAAGYTRVSLGMQSVAPRVLGVLDRIHTPNRSADAAREALAAGFEHVSLDLIYGTPGESDEDLLWSLDTAIESGVDHVSAYALVVEEGTALARRVRRGELAAPDDDVLAHRYELVDARLSQAGLSWYEVSNWSRPGGQCRHNLGYWDGGQWWGAGPGAHGYVGTTRWWNVKHPNAYAERLNAAALPVAGFEQLGSEALHTEDVLLKIRLRQGFPVDLLNSAERERAQGVVADGLLVRDGDRLVLTPRGRLLADGVVRTLLG

SEQ ID NO: 2911 - protein, 413 aa, Mycobacterium paratuberculosis
MLQEFWHNFTHNLFKPLLLFFYFGFLIPILKVRFEFPYVIYQGLTMYLLLAIGWHGGEELAQVSASSVGAIVGFMVLGFVLNCAIGGLAYLGLSRLKSLRKVDRATIAGYYGSDSAGTFATCVAVLAAVNIAFNAYMPVMLAVMEIPGCLVALYFVARLRHRGMDSAGYMPDEAGYTPPVRVGVGPGTAARPPHGQSLQTQEEAAIEQELELSLEKLEHPEWQTDPSPLRGKGTRAPIFSRELFQEVFLNPGLVLLMGGIIIGLVSGLQGQKVVADDDKFFVIAFQGVLCLFLLEMGMTASRKLKDLRSAGWGFIVFGLVAPNVFATLGIFVACSYASLTHTDFKTGTYVLFAVLCGAASYIAVPAVQRLAIPEASPTLPLAASLGLTFSYNVTVGIPLYIEIARLVERWYGV

SEQ ID NO: 2912 - protein, 450 aa, Mycobacterium paratuberculosis
VTEVSVETTSAGSESPSIPLPVHIDPADLAAELAVVLSERAGEEYLLYERGGEWVLATGVRAMIELDSDELRVIRDGVTQRQHWSGRPGPVLGEAIDRLLLETDQLFGWIAFEFGVYRYGLQQRLAPGTALARVFWPNGRIVVTREAIQLFGTSTGRRDDVLGVLGDGVPGLRDASAVDVVTDPSNYRDRVASAVAEIAAGRYHKVILSRCLQVPFAVDFPSTYRLARRHNTPVRSFLLRLGGIRAVGYSPELVAAVRHDGVVVTEPLAGTRAFGRGALHDRQARDDLESNSKEIVEHAISVRSSLQEMAEIAEPGTAVVTDFMTVRERGSVQHLGSTVSGRLGTSNDRMDALEALFPAVTASGIPKAGGVEAILRLDEGPRGLYSGAVVMVSADGALDAALTLRAAYEHDGKTWLRAGAGIIEESTPEREFEETCEKLSTLAPYLIARQ

SEQ ID NO: 2913 - protein, 227 aa, Mycobacterium paratuberculosis
MDNREGSVPKDLTNLQLLHELEPVVEGLLNRHLAKFKEWNPHDYVPWSDGKNFHTRGGQDWEPGQTRLPDVAQVAIVQNLLTEDNLPSYHREIAMNFGMDGPWGQWVNRWTAEEARHSTALRDYLVVTRSVDPVELELLRLEQMTRGFSPGQNQQGDMFAESLFDSVMYVLTFLEGCSGPSALGFELPRDVGYGFHVVAVLDGRRRLAARRPATTRPLIERCDWIAV

SEQ ID NO: 2914 - protein, 406 aa, Mycobacterium paratuberculosis; identical to SEQ ID NO: 1515

SEQ ID NO: 2915 - protein, 182 aa, Mycobacterium paratuberculosis
LTTSLRISFQELATRVSHRNTGKVCNDAIAEQLMARVSHDENLHMIFYRDVSAAGLDIAPNQAMKSVHRILRNFKMPGFTVPEFRRKAVIIAVGGVYDPRIHLDEVVMPVLKKWRIFEREDFTGEAARMRDDLGLLVKELQDASEKFEESKQRYLEREARRTEKITASKVLQTKGTLTLSRH

SEQ ID NO: 2916 - protein, 308 aa, Mycobacterium paratuberculosis
MATERATYRSSRPEPGTIASVLHNVRRAPKRVRRQSREYRQLIEGAVSQLFDAAVRHPHGDPNSGEYRIDDLARLAGTTTRNICVYRDRGLLPPPLRVGRIALFNDTHLTRLRLITSMLDRGYTIAHVREMLSAWEQGKNLGDVLGLETAIVGTWTTEKPETMSLAEAQRLVGDPRAFERLVALQVIRVDGSRATLTRPKLIEAFNEIRGYGVEFDKLIDLHEQIVPEIDKISDMLVRAGAEHVLDRIKPGEPLPADAEIAELITMLVRFRTQAVATVTATLASSIEANIESLVSRILADYLESSSSA

SEQ ID NO: 2917 - protein, 527 aa, Mycobacterium paratuberculosis
VAFRPVSAAAASAGAILGGRTHPRAGGVSMARDHAHAALIIGAGFTGLGAAIRLAEAGVDDIVILERADRVGGTWRDTTYPGASCDVPSLLYSYSFVKNPTWSRTYSPAPEIYRHLEDMADRFDIRRRIRFGHEVSGLAFDEDAGVWTATTKNRKKFRARTVVLASGPLSDVSFPDIRGLDSYRGHKIHSARWDHDYDFAGKRVAVIGTGASAIQIIPELVKQAGFVKVFQRTPCWVLPRLDVATPPAVQALFAKVPAAQELARQALYWGHEASATALVWDTPLTSLVARLGKAHLRAQVKDPWLRRQLTPDFRPGCKRMLVSSDYYPALQRDNCKLIDWPIATLSPAGIRTSDGIEHHLDCIVFATGYDVHLTGPPFPVTGLGGRSLAAEWAGGAQAYKSINVHGYPNLFVMTGPNSGPGHNSLLVYIEGQLDYAVRGITTILNDDLRYLDVREEVQRRHNEAIQRRLTKTTWMSGCRSWYLTKDGFNGSMYPGFATQYLRQMSDFRYQDYQAVARRARTPAASSA

SEQ ID NO: 2918 - protein, 306 aa, Mycobacterium paratuberculosis
VAIDMEAMLAKIKDRQWALADIDWTAPGADMISDEQRPQLKAFMADLCWIENIGARGFAALAKKAPTPTIAEIYRYFHAEEQRHANAELALMKRWGMLTDGEIPEPNVNIRLAIDWLDRWADDMPLSLLGTVIPMLEVALDGALLKFLLDEVHDPICHQVFEKINNDESRHLVVDFEVLDMIGHAKVRRLLIDFVGHHATPGLIIGAITGAPLINRIRNEITAMGMEPERLYRAVKRFKELGDRGERTTRVPTYRFLRRYAGVVTNPRHPYHLLANSMVWLSDRYPRLLLPRVPSWVEELTHEPAA

SEQ ID NO: 2919 - protein, 282 aa, Mycobacterium paratuberculosis
MLDRLLHRSKTSRGALAVVTGAGSGIGAAFALELGKRGGTVVCSDIDQAAAQRTADAITQHGAKALATRCDVSQFGDVQALAEQSQSCFGAPPTLVINNAGVGAGGAAIGDAPLDDWQWTLGINLWGPIHGCHVFTPILRDAAPSAAPRGIINVASAAAFGAAPGMAAYNVSKAGVLSLSETLAAELSGTPVRVTVLCPTFVKTNILESGRISEESGELAAKLMRWTGFSADKVARICLDAHDRGDLYCMPQLDAQIGWHIKRLAPQAYTRAAGLVSRINLP

SEQ ID NO: 2920 - protein, 334 aa, Mycobacterium paratuberculosis
MTGGVPARGSLRSRGAAAVSTYTLRPITSVIPPERAWGLWLSRQIVARIMGTFGPSLSGTRVQSVDTRLPDGRRVKGEWVFGPRTPTSEHSRPSSIAEAIYYIHGSGYAVCSPKTHRRLTSWLSSLTGLPVFCVDYRLAPRHRFPTAADDVRAGWDWLINTCGVLPEQMVIAGDSAGGHLSVDLLLQPGVEHPAAMVLFSPLYDLTFELAKARERIRPDPTTRAANAIRLVGLYHSGVDLTHERLTLDVARGPALPPTLIQAGGAEMLQADAHQLAADIRTAGGRCELQIWPHQVHVFQALPRMTPEAAKAMAYVARFITHALQDARALTQEMH

SEQ ID NO: 2921 - protein, 159 aa, Mycobacterium paratuberculosis
VWLIADSLNADIDEVTASVEAVPAEADHQIFDHLLKAGTTAGQRWNWSGGRDGEVLVEIETLWTVGGEYPKHWPQPQHGWTLTIEGDPSMRAHFFALASFTRAASMAEHVRSASVATAMQVLNAVPAVCAAPAGFATAADLPIIRSHTGFGNRSGWPSE

SEQ ID NO: 2922 - protein, 273 aa, Mycobacterium paratuberculosis
MSDRRPLNVIAWGIGTVGAEMLTTIIDHRDDLRIVGARVYSDSKAGQDVGILAGRAPIGVAATTDVNAVLELEADCVLYTPRSQSIDDVCSLLSSGKNVATTAFQFHPARINTADRARVLNACRTGGTTVHGGGLNPGNLSSALPLALSGMSPTIDKITLQERADWSAYESTSITFDNMAFRATRRRHQPAHQPVPGIQQRHLHRTSVVDRRLTQRGYRRGHRIGRGRSRRSRPSDLRPPAQGGNHCGTTLELVRRTRRRGARRNRDAMDGGR

SEQ ID NO: 2923 - protein, 448 aa, Mycobacterium paratuberculosis
MGLLGCRRIWHGPTRRLVLRRRWRSRSSGSVKHPCGPGRRRPGVADSEFVVASPAGDTVDQIDTVPIDSGASVPPSGNPVSLIAAACCEHRTNVDPEVQTQVAIEEWMGASPNYTRRLRHALGVTGDTVEDIFKVLQFDVGAPPQFLDFRYSLIDPNHGEFRNDYCGALIDVEPMGDVWVRAMCHTIQDFTFDATAIATNPKARFRPIHRPPRKPADRTPHCHWSVTIEDSREDLPIPAEAVEVSRCELTALQFDPIDLSDDGLGDYTGPLFSDIRFDQWSRSALVRLAEEVAIQHHLLALAFERSVRRHGGEAKALGLLRRQFTGTAYVGSARIKAASGLASAQMTLLRSSICIPPCARSPTPEHPWSASGQERATRCGCASQATPPPSATAVGWRRCRRTMSVPSRSWPPVSIRTGRICTRPTRPATWSSTSGGRTPKRSAGRKSK

SEQ ID NO: 2924 - protein, 526 aa, Mycobacterium paratuberculosis
MLTRFVRIQLTIFALASVVAMAFMFFQYMQVPTLLGIGKLTVTLELPDTGGLYRFSNVTYRGVQIGKVTAVAPTATGAKATLQLDTSPKIPADVHAAVRSMSAVGEQYVDLVPRSESGPYLCDGSVITARDTSIPRPVGPMLDRLSALVKSIPKDKLGQLLNESFSAFNGAGYDLEWLLDSSGKLSRDASGVVDHTRALVDDGAPFLDAQAQTADKTRRWAHNLAGFTDQMVTDDAQFRKLLHTGPGFEQEVSRLLDQLKPTLPVFLANLSTIGQIGVTYHPALEQLLVLLPPSVAAYGSYGVTNNPTGLAVGRFTLTIADPPACTVGFLPPSQWRSPADTSEADTPDNLYCKLPQDSPISVRGARTYPCMGKPGKRAPTVEICNSDKPYVPLAERQHALGPYPLDPNLLSQGLPPDDRAGIEDRTFGPVEGTPLPPGAAPAGTPPGPPAPGSLNQPPTAPDVAAAPAAPSAFDSNSSGVSPSVAVLHYDPRTGRYVAPNGQLYRQSDLVRANAPKTWQGMLLSSD

SEQ ID NO: 2925 - protein, 378 aa, Mycobacterium paratuberculosis
VRLRRWWLFLSGRELVAPARCCRSRATRQHLSHRDRQYRHPGIEFAGDDGRRHRGQRRQDAGQARSRRRRGLGETRCGGARKRGGRRRTDQPAGFDARGAQSPAGPTAAGTAAARGHHPAGQGIVGRLQGVLGQIGDIVHNFSAALSGHETDVRQLLTRLDEFVGVLDQQRDRIIASIDSLNRLAGTFASQREVITQALRKIPPALDVLIRERPRITAALDKLRVFSNTATQLVNETQADLVKNLQNLEPTIQALADVGPDLSTVLGYVPTFPFTQNFIDRAVRGDYFNVFAVIDMTIPRLKRTLLAGTRWGDPDAPLVPAPGDPWFSNYTYDPLGFGVTNPPLAPPPSPGAPASAPPVMAPDMSVIAPVDQPSRGGG

SEQ ID NO: 2926 - protein, 444 aa, Mycobacterium paratuberculosis
MTVRRRLLVTALLVGLLVGASGFLVRQTFFRPLTITAYFPSATGIYAGDEIRVSGVKVGTVASVQPQPSRARLILHVDRHVSIPADAKAIIVAQNLVSARYVQLTPAYHRGGGPKMLDGAVIDTDRTAIPVEWDQVTEQLTRLATDLGPASDVSSTSVSRFITTAANALDGNGEKLRQTLGQLSGISRILANGSGNIVDIIKNLQKFVTTLRDSNQQIVQFQNRLTTLSSVLDDSRSDLDAALSNLSVAVGEVQRFVAGTRDKTAEQIQRLTTVTQVLVDHRMDVENILHAAPTAFSNGYNIYNPNTPGAMGSFIINNLSNPVHFFCDAIGAVANVTAAETGKLCAEYAGPGLRTANLNYLPIPTNIILQQIATPGKIIYAEPRLAPGAEGPSPTPPDVPPAVSAYTGINGDSTPHSVQDLLLPDDRQPAPGDQPPPPGPGTPP

SEQ ID NO: 2927 - protein, 359 aa, Mycobacterium paratuberculosis
VRGALMLKYRGANLIRPGFIGTVLILLVVAVGLAPDRLVTWATTIRYEALFSEAGGLLPGNKVLVSGVNVGTVSRVSLDDDGNALVDFGVNGKVRLGSLSTAHIRTGSLLGARVLTLESAGAGLLRPSEVIPLSRTSSPYSLTEAVSDMTTNLSTTSTDTLNQSLDALSATIDQIAPQLGPTFDGVTRLSRAINSRGESLDALLKSATDVTGILSEHSQGVNSLILDGNVLLETLVRRRDAISELLANVSAVSKQLTGLVADNESKLGPTLDRLNSVAAMLEKNRDNLSKALPGLKKFEITSGESVSNGFYYNAFVPNLAIPELIQPFFDYYFGFRRNDPNMPRALFPWPHNGIPGGSR

SEQ ID NO: 2928 - protein, 341 aa, Mycobacterium paratuberculosis
MTGTGRIMVKFGVFAAVMLMLTTSLFFIFGQFRNGPTHSYSAVFIDASQLKTGDSVRVAGIRVGTVNGIALQPDNKVVVDFDADDDVALTTGTRAAVRYLNLVGDRYLELIIGPGSMRVLPEGSQISIDHTMPSLDLDLLLGGLKPVIQGLNPQDVNALAGALLQVFQGQGQTLQSLLAKTSSFSNDVAGKNKAIETLIDNLNTVVRTLSDQGSQFSGAIERLQRLVTDLAHDRDPIGDAIQALATGTASVTDLLSAARPPLSGTVDQLNRLAPLLEHGKGRLDDALQRAPNNFRKLARTGAYGSFVNYYICGLTFRVTDLQGRTAVYPWLKQTEGRCAEP

SEQ ID NO: 2929 - protein, 384 aa, Mycobacterium paratuberculosis
LATVIAAAAVLALALTQFRGGFTQTVPVTVVAGRAGLMMNPGAKVKLHGAPVGSVASIQDRADGQADIHLALDPSRLQLIPANVLVNIVATTAFGAKFIQLIPPESPSPQRLRAGQVLDAGRVTVEINSVFQQLTSVLAKIDPAKLNETLGAMATALNGRGARLGQMFSDLNNFLGKIEPSLPNLSHDIEATAEVSSAYADAAPDLITVADRTTRISQTLVDEQQNLDALLISSIGLADLGNDVLGTNREKLAEVTHLLAPTTDLTNEYHQALTCSLKGMFPLALQPPTPVPGLEVLGGITLGSERYRFPKNLPKVAARGGPQCDHELPLAYNTFPPFDVADIGANPWQYGQQGILLNSDGLKQFLYGPLDGPPRNTAQIGQPG

SEQ ID NO: 2930 - protein, 514 aa, Mycobacterium paratuberculosis
VTGIRVVAPELARRYEEQGWWTPDTLGDLLARGLKDNQHNTFRVHSAVRPFAGTFGDVELLARRLAAGLRARGVGPGDVVAFQLPNWVEAAVTFWASALLSAVVVPIVHFYGPKELRYILSSVRPRVFITAEGFGRMTYVPEVCAGVPTVALVGESFDALLEDEPMDATVATDPANPAVIAFTSGTTSDPKGVIHSHQTLGFETRQLLANYPQGLGRQLTALPVGHFIGMLGAFLMLVLDGAPIDLTDVWDPDKAIDLMDADGVALGGGPPYFVTSLLDHPRFTPDHLRYIKHIGLGGSTVPAAVTRRLADLGIVVTRSYGSSEHPSITGSQHTAPEAKRLFTDGKARAGVEVRLADDGEILSRGPDLFVGYTDPVLTARAFDEDGWYHTGDIGVMDDDGYLTITDRKSDIIIRGGENISALEVEEVLLAMPAVAEAVVVSAPDARLGEHAAAVLRLKPGYGMPTMAEVREHFERAGVAKQKWPEELHEVADFPRTASGKVQKYVVRQSIREKA

SEQ ID NO: 2931 - protein, 360 aa, Mycobacterium paratuberculosis
LRVELLVKIEYGSTVTWYLGVVVTIVAEQRTYVAGRWVTGDEVVSVENPADESHVADITVTPLPEVQRAIAEARRSFDDGVWADMPPVERAQILHAFIDHIESERATLVPTLVAEAGQSARFAEMTQLGAGAAIARQTIDLYLSMSHEEASPVPVDDLVRGRVALSVRRHEPVGVVTAITPYNAALIMGFQKLIPALMAGNSVILRPSPLTPISSLIFGAAADAAGLPPGVLSVVVESGIAGAELLTSDPSVDMVSFTGSTLAGRKILAQAAPTVKRVSLELGGKSAQIYLPDAVHRAVGGAFVAVASTAGQACVAATRLLVPQDKKAEVLDAVSAMYQQIKVGPPSDETAMMGPVISAA

SEQ ID NO: 2932 - protein, 142 aa, Mycobacterium paratuberculosis
VKLAEEHGGKVFCGGGRPAGLDRGYYFEPTVLDLPSNANPAAQEEIFGPIIGVLGYRDIDDAVAIANDSIYGLSGQVYGTDAAAALQVARRLRTGAVNVNTTVFSAYAPSGGYKQSGLGRERGPDGIREFQEVKHMSIGELK

SEQ ID NO: 2933 - protein, 409 aa, Mycobacterium paratuberculosis
MSSETNGDKTYNLDWLISVDDHILEPPNLWVDRVAAKDRDRAPHMEKNDQGVDNWVYDGKRYPNSGLSAVVGKSKEEFSPEPLSYSEMRPGCYDAKARVEDMDRSGVLASLCFPTITRFCGQLFMEASDREFGFECLQHYNDWLVEEWCGAAPGRYIPLMLIPMWDPKLAAKEMERMAAKGVTSFAFSENPEPLGLPTIHDPAGYWEPVMAAANELEMVASMHVGSSSTLPKICSDAPFMANLTWGASRTSGTMLSWLFSGMFQRYPKLKIALSEGEVGWMPYFLERAEQVLDKQRYWVMRGAKFDTHAGAGQAIDLDTLDIRETFRNHIYGCIIEDRHAVKSLDEIGEDNIMCETDYPHSDSTWPDCIGVARNTMKDLPENVQYKLLRGNAEKLYRFTPAEPPVLASA

SEQ ID NO: 2934 - protein, 261 aa, Mycobacterium paratuberculosis
MPGVLAGKSAIVTGAGSGVGRVSALRFAEEGARVVAADIDLDHAKETVCQIESAGGTAIAIGTDVSDEQQVQAMIAAAVDQYGRLDILFNNVGIPTPRLGMIFEDHTLEDFNRLVAVNLGGVFLGCKYAVLRFKEQGAGGVILNTASVAGLVGWGGSVYGATKGGVIQLTRAVAIEAAPFGIRVNAICPAAMPLTGFMAAGGLEVDAEQQAAIAESVGGQHPLGRAITAEDCAEAALYLVSDAARNVTGVALPVDGGFVAK

SEQ ID NO: 2935 - protein, 416 aa, Mycobacterium paratuberculosis
MTAPALDRDRLRELFDLRSSYNAWAGGAYEDDPYPVWHRLREKGPVLPGVLHELTGSTDTMFFHGLPYPDCPHFTVFDYDSCMIAYRNPEVFASSPEPVDLEHGPLGLTNSMLSMNGEQHKRYRALVQPSFLPANGKWWIDNWISETVDLLIDGLVHEGRAELNVDFCAAIPVLTITGSFGVPVEQALDIREALARDPQKVVDLLKPVIAARPEEPRDDLISVLVQAELTDEDGAKDRLTDREIDSFVLLLLGAGSGTTWKQMGTTLTTLLQRPELLEAVRADRSLLRPAIEEAIRWMPTDPMFSRWVMADTELAGVSIPAGSVVHLALGAANRDPARWDRPDEYDITRKFKPSLGFGQGSHICLGMHVARAEMTIAISALLDRLPNLRLDPDAEPPRFVGMYERGATAIPVVFDV

SEQ ID NO: 2936 - protein, 144 aa, Mycobacterium paratuberculosis
MSEPGYTPPDLMLVGDDHVRAYRETGGETGYLWNGVPILLLTVTGRRTGRALTSALIFGRDGDDYLVVASMGGAPRHPSWYLNLQANPAAGIQVQADELAVVARTASAAEKPRFWKIMTDVWPNYDVYQSRTDRDIPVVVLTPA

SEQ ID NO: 2937 - protein, 228 aa, Mycobacterium paratuberculosis
MTTASISSVSRAEERAAERSAAVQRSRERIANQVRLMLDAALRLIREKGDSFTTQELVKEAGVALQTFYRYFATKDELLLAVIADAMTDACARWRDAARDLPDPVARLRFYVTAVIEVLDNEQGDGGTAKFVVSTHWRLHRVFPDELAEAEKPFVDLLLGEINAGIEAGLLAPADPKWAAWFIAELVRSVYHYYAYAPREVDVKEQLWQFCLTALGGTARKSRGSRSK

SEQ ID NO: 2938 - protein, 141 aa, Mycobacterium paratuberculosis
MPHAKPDELPSGGGGRWPAAGDNFRSVQWGDMEVGYTTTGPLDCTQLYQFGGLPGGVCPCPHYGYIFEGSIRATYPNTDWPDETATAGEVYFFPAGHILIYRERTKALELNPAFALQQCMDAMQRAGQKAERAQRERELQA

SEQ ID NO: 2939 - protein, 153 aa, Mycobacterium paratuberculosis
MGSARRLARKTSTLAGALAFAAAACPPIAQAAMPFGNYDLHVEGRYDFHTWLWAITACPGGGCVHVNAIARPVAKAFPYVGDARSVDGQYVLTVDVPDGLRCDDIYYGPTVPTHDVYTWDPTTLAGSLQSSFDAGCHGAPAGSYTYPFTLSRL

SEQ ID NO: 2940 - protein, 400 aa, Mycobacterium paratuberculosis
MSPNTTPPAGVLDGFVPFPAERAAAYRAAGLWTGRALDTILTDAARRWPDRTAVLDASGGTGFSYAGLDEQANRAAAGLADAGIAPGDRVLLQLPNGCQFAVALFALLRAGAIPVMCLPGHRAAELGHFAALSQATALLIADTAAGFDYRTMAAGLIEEHEALAHVIVDGDPGPFLSWAQLCERAPAGRPATPVDPGSPALLLVSGGTTGTPKLIPRTHNDYVFNATASAELCGLTRDDVYLAVLSAGHNFPLACPGLLGAMTVGATTVFGTDPSPEAAFATIARHGVTVTALVPALAKLWAQACEWEDNPPKSLRLLQVGGAKLEADDARVIRSALRVRPAKTASSSATQAAQLMRRAETPEPQGTSRNSVTAMPQAFQNRAGMSATFPHLLSKKASCK

SEQ ID NO: 2941 - protein, 1165 aa, Mycobacterium paratuberculosis
VVHAPARSEDIREEVAELLGVDVDAVQPGSNLIGQGLDSIRIMTLAGRWRRRGIAVDFATLAETPTIEAWAQLVTAGRQDTDSAAPPADSSGDPSGETEPFALAPMQHAMWVGRQDNQQLGGVAGHLYVEFDAGLLDSGRLRAAATALARRHPMLRVRFLPDGTQCITPAVECGDFPVHVEDLRELGTDEVERRLTALREAKSHQQLDGAVFELTVTLLPGGRSRLHVDLDMQAADAMSYRTLMADLAALYRGCDLPELSYTYRQYRHAVEAQDAQPQPRRDADRDWWARRLPELPDPPALPITAGRGANRSTRRWHWLDPQTRDALFARAQARGITPAMALAAGFANTLARWSSNSRFLLNVPLFGRQPLHPDVDALVGDFTSSLLLDVDLVGAHTAAARAQVVQDAMRTAAAHSAYSGLSVLRDLSRHRGTQVLAPVVFTSALGLGELFSPEVTGQFGTPAWIISQGPQVLLDAQVTEFDGGVLVNWDVREGFFPPGVIDAMFAYHIDELLRLASADDAWDAPGPAALPEAQRAVREAINGRTAPPSGEALHDRFFRQAERQPDAPAVFAGSGDLSYAQLRDQALAVAAALRAAGAGAGDTVAVVGPKSAEQIPAVLGILSVGAAYLPIGADQPRDRAERILQSGRVRLALVCGGRQLSLPVPGLVLADVLGGAPADAEIACARVDPGELAYVLFTSGSTGEPKGVEVTHDAAMNTVEFIGRHFEIGPADRCLALSTLEGDISVMDVFVTLRTGGAIVVVDEAQRRDPDAWARLIDTHRVTVLHFMPGWLEMLVEVGRGRLSSVRVVPTGGDWVRPEVVRRLRAEAPGLRFAGLGGATETPVHNTIFEVTEPIPADWTALPFGVPLPNNVCRVVGDTGGDCPEWVPGELWVSGRGIARGYRGRPDLTAQRFVEHDGRTSYRTGDLVRYRPDGTLEFVGRADHRVKISGYRVELGEIESALRRVPGVRTAVAALIAGAGESDVLAAQVGTDDPALTGEQVRQYLADLVPAHMIPRHVAVVERIGFTAAGKLDRRAVARELHSVVGQSHSPGHRAASTPLEGALALILGDLLGRDDVGVDDDFFALGGDSVLATQAVARIRAWLDAPDVMVADMFANRTVSALAAVLRAAEDDPDRLDHVAELYLEVIGMDAESVLTATRQTTKS

SEQ ID NO: 2942 - protein, 254 aa, Mycobacterium paratuberculosis
MTLNNIATMPSAFPSWIKLAPGRGGPASGTGATIVFPHAGAAAASYRVLAAALAAGADTYVVQYPQRAERLGDPAHESVHDLAAGLFRAAPWPGVAPLTLFGYSMGGVVAFEFARVAEANGTPVRKLWVSAGPPPCVVGDMPELPTTHDGLLADIADLGGTDPELLADEEFSELLTTAVRADYQAFNGYDPSPDVRIGADIHVLGGHHDHRIATGVLRQWERHTAGSFAMSLYDGGHFYLYDHVETVAAQVNAG

SEQ ID NO: 2943 - protein, 442 aa, Mycobacterium paratuberculosis
VTPMSENGFDAAGIDPVVIVGMGVEAPGGIETAEDYWELLAHGREALGPFPTDRGWAVSELLAGSRRSGFKQIHDRGGFLSGAATFDPEFFGVSPREAVVMDPQQRVALRVAWRALENSGINPDDLAGEDVGCYVGASATGYGPEMARFSEHSGHLLAGTALSVISGRIAYTLGLTGPALTVDSSCASALVAFHVAVRALQNGDCDLALAGGVNVLGSPGFFVEFSKQHALSDDGHCRPYSAQASGTVWAEGAAMFVLQRKSVALRAGRRVVAEVRATAINQDGRSAGLSAPSGDAQVRLFRRALGESGVKPAEVGMIEGHGTGTRLGDRTELRSLAQTYGDTEPGAGALLGSVKSNLGHSLAAAGALGLAKVLVSAEHGAVPPTLHATEASGEIDWEHQGLRLAQTLTPWPAIDGQRTAAASAFGIAGTNAHLIVSMPEVA

SEQ ID NO: 2944 - protein, 1013 aa, Mycobacterium paratuberculosis
MMPTHGLPDGRIPVLLSSHDPELIRRDAAAILEYLDRIGESTEATGAVAATLLRLRRVRRHRALLRAADRAELAAGLGAIARGEEHALITRSARTTPPRIAFVFPGQGNQWQAMGADAYRLLPAYREAADRCAQAFVSAGFPSPLPYLVSPDEQSWTRPEIQGAQFTHAVALAEAWRCFGVLPEITIGHSLGEVAAAYVAEAISLPDAVALVVARATVVDRLTGRYAMAVLGTGAADAESLLATTPGWVEVSAVNGPASTVVAGDHDAVAAAVRLARQREIFAHQLFVDYPGHTSALRPLRAALAELTPQSAFRDSPIRFIGSTRGAEVAATTDYASYWYENLCSTVRFDLAVQCARSCGADAFVELSAHPSLLYPLSGIIDDESAVIVGSGHRDRPITESLSASMAAVATADPGYRWSETVPTPNQPALHGFPNAPMRATHLWAAPDRVTEAAPRPRLTVAVEDWRHTTSPTTPTAADLGFAGAHPLTRRLADAAAAQGGCRVVAPGEAEILAIVAPELDQLDAVAAVEQIGAREDAGLPDYRGLIGPRCRAVWLLTVRAEHVDGDDDQACVAQAALAAMHRSIGFEFPDQAFGHLDLPHRDVDAATAHAIIEVLLAEPAEVALRGEQSPRRHVRTFRAHNESADRPLDDAALEHVVITGGSGAIGLHYARYCLQRGTRNLTLLSRNGIEAAVLRELTGSHDARVSAPRCDITDRAAVTQAAARYAGSGATLLIHTAGIAQARSRTDLTGADVAAVCAAKVRGLALMADVWPLRPDCRILACSSVFGVWGGYHHAAYAASNRMLDVLATQLRARGLDCTAIRWGLWQDAGVVAGSEIARTERSGLVAMDPRRALQASLHRYESDPLIFDADFERLQVFFESQGMPMPFSDTPTRDDEAAAAPAGKPLAELVRAELAATLHLGDSVSIDPSASLIDLGVDSLLALDLRKRLRRTVGNSVPVARMLGGITVAELVDALRADATGGPVVPPTVQRTGAVSGAHPSTLAMLERLDS

SEQ ID NO: 2945 - protein, 1729 aa, Mycobacterium paratuberculosis
STGTARHDEPRMSVGQHRMWFVQSVDPDSALLNICVSYRLTGGVDTGRLHRAVDAVAARHPVLHTTYDTTDEGDPRPVLRADLRPEWAEHDLSGLTEQARRLRLDVLAQRDFRRPFDLSKDSPLRVTAARLADEELMLLITAHHIAWDDGSWAPFFADLTRAYAAPGDFDTTPVVPDLSADPTAIRREDLDYWRPLMADLPEPLELPGPNGSVVPSTWRAQRAFAELPAEIVDRAAALARETGATPYMVLMAAFAALVHRYTGSTDFLVAAPVLNRGAATENVIGYYGNTVVIRLRPQSHQSFRELLAQTRDGAVGAFAHSRADLDWLVRESNPDRRHGADRMTRVSFGQREPDGASFCPPGVRCERGDLRGHFNQLPLSLMIELNRTPDGSGGGLVEAEYLVEVLDQQLVEQMLRHYRTLLDSLLSDPDATLSACALMSDADAEWLRAVSTGEQFITPAATLSELVSHRAARTPDAVAVVYEGHTYTYRDIEEESNRVAHWLIERGVGTEDRVAVLLDKSPELVITALGVLKAGGVYLPVDPTYPQDRLNFILGDADAKLVLREPVTDLADYPATAPTELLRPLTPQNTAYLIYTSGSTGLPKGVPVPHAPIAEYFVWFGDEYRIDETDRLLQVASPSFDVSIGEIFGTLIMGARLVIPRPDGLRDIGYLTELLAREGITSMHFVPSLLGLFLSLPGVSQWRTLRRVPIGGEALPGEIADKFHATFDASLYNFYGPTETVVNCTSYPVEGAQGTRVVPIGRPKINTRVYLLDNALQPVPPGVIGEIYIAGTHVAHGYHRRPQLTAERFVADPFSRGGRMYRSGDLARRNANGDIEFVGRADEQVKIRGFRIELGEIAAAISVDPSVGQAVVLAMDLPQLGKSLVGYVTPAQGAGTETVDVERIRARVAAALPDYMTPAAYVVLDEIPITAHQKIDRAALPQPQIGAGTEYRDPATPTEHRIAQLFSGLLGHERVGVDDSFFDLGGHSLVATKLVTAIRAECGVEIGIRDVFELATVGLLAERVDQLSSGELTGTRPKLIATAHDEPLPLSASQLRSWFAYRMDGPSPVNNIPFAARLTGPWDIDALIAAVGDVVARHEILRTRYVELDGVPYQVVGPPGVEIPVRREDGPDDPWLQQQLDAERRHCFELDGELPIRVAVLRVANAAEHVLSLVVHHIASDHWSAGVLFADVMTAYRARRGGEAPSWAPLRVQYADYAAWQRTFLGDAGGQESAVAGAQREYWTRQLAGLPEDTGLRPDFPRQPVPSGDGESVDFHIDAATRVKLAEVCRELGITEFMLLQTAVAVVLHKAGGGVDIPLGTPVAGRTEAELDQLIGFFVNILVLRNDLDGNPTLRELLKRARETALAAYAHQDLPFDRVVDSVSPVRSLSRNPLFQVVVHVRDHLSATRVIETAPVGGDGQDTVCTSLDPVFDMAHADLSVNFFGTDGASDIGYNCHLIFRTDLYRRTTIERLAGWLVRAVTAFADDLDQTLRDVALIDAGEQQRILRQWSRGAQPPRDRPRTIPELLQPTRSLGADRIAVRCGAEHIDYPALHRRSDNLAALLVDRGVGPGTLVGLSTRRGIELVVALVAIMKAGAGYFPVDPGYPSARKQFMLDDVRPPVVVATVEAVDTMPALPGVELLSLDDPQVRALVDRDRPTPMIRCIWCSPRAPPASRKVLWERIARWRPGWIGSCGTTRRAPTTFDWRRPPSPSWKAAWRCWPGWRRARR

SEQ ID NO: 2946 - protein, 487 aa, Mycobacterium paratuberculosis
MYLVFTSGSTGKPKGAVGTHRSMAARLDWQLRHYPPRTDDVRLAQASITFLEGGMEMLAGLAAGATMILADDAEHRDPEALGELMHRHSVAQVTAVPSLVSALLDSRPDAVRSLSRLVCGGEPVSTSLLQRLVSVCDEADGGGPELLNNIGSTETSGAVSRGPLSPPNPLVGKPVPGAQAYLLDDGLRPVPVGVVGELYYAGDQLARGYWKRPGLTAARFVANPFGAEPGSRLYRSGDLARWTEDGQLEFVGRSDHQVQVRGFRVELAEVEAALAGADGVAAAAARTWEVHGGTSLAGYVVPQRPIADEAEKAAFAAQVRAEIAATLPGYMMPSSLTVLDALPKTESGKLNRPGLPRPVVSTGGRTEPTRTDTERALANVFAELLSTPEVGRFDDFFALGGDSILSVQLASRARAAGLPVSPRMIFENPTVQQLAAALDALGDNDSDGRLDDQPADARFEPMSTSGLSASDLAAVTQLWSSSREGTA

SEQ ID NO: 2947 - protein, 1412 aa, Mycobacterium paratuberculosis
MTAAETDVAPDIEDVMALSPLQEGLYSLTTLAEFADGQPADDPYVIGMAADITGTLDVALLRDCAEKMLVRHPNLRASFFSRGVPRPVQIVPSRVELPWRSVTASPAEVPTLETAERRRPFDLERGPAIRFLLIELPDAHWRLVLTAHHIVIDGWSLPVFVNELMTLYRAGGDPSALPAAPRPYRDYIGWLAGRDLQASQRVWREHLAGLPGPTLLAASLGSVEATEGQRTALPRTTELRMPAEATARLAAETRSRGITVNTLMQMAWALVLSRLTDTRDVVFGVTVSGRPPELTGVETMVGLFINTVPMRVRLDPAATVGEQCRAVQRDAALLREHSYLGHAQLRALGGIGEMFDTLLVYENFPMDGLTAGGELSAGGATFRPSALQTLSHFPIAVAAHMEGGELVVLIEVVDGALGVIPADAVGRRLLTTAERLLRHWERPLRAVSVLFDDEAAPLRAAGPIAPPSPKCLPARFADVVAQTPDAPAVSWAQGSLTYRDLDEATNRLAAQLVALGVEPETPVAIKLFRGPRYVVAMLAVLKAGGMCVPMEPGMPAPRVNSILRQSGASIVLDEERIDELLEAARSRHGGFEPPDIPPAQAAYVVFTSGTTGEPKGVIGTHGAVGAYADDHLDRVLRPAAAALGRPLRIAHAWSFAFDAAWQPLVALLDGHGVHVVDEATQTDAEALVALIAEHGVDMIDTTPSMFAQLQAFGLLSEAPLTVLALGGEALGSAAWARIRNACNTTTMSAYNCYGPTETTVEAVVAAIAEHAEPSIGRPTRHTRGYVLDSELRPVPCGATGELYLGGAQLARGYLGRAGETASRFVADPFAASERMYRTGDLVRRLPDGSLQYVGRADAQVKIRGHRVEPGEIAAALESHPAVRHAGVLVRHRDGAPRLTGYVATHQAAADTPSPAELRGMLSARLPRYMVPQRIIMVDEIPLTPNGKLDETALAAVDNAEAVDGAAPPQTGTESALAELIAELLGQPRVDVTADFLALGLDSIMALSVVQAARARGIALRARLVLDCTSIRELAEAIDAESTPAAGEVDDGTGPMPLLPNGRWLYEHGQPRRLAQTEAIRVPQTLRRDQLETALAGIVGGHEVLRSRVDRATMTLVPGPAPDIGRELEEVAVVGDLRAAVADHAARAIDRLDPERGVLLRAVWLRPAGGDGVLLLTAHVIALDPASWRVVLGELGAALTAAATGHSPAAVREHTSYRRWAHALTARAPAGHRGVLGVRIGRRRPRSRRPARRPGPRPRPRPARPQRRHRRRPHPPAPGIGPAAAHAAGGRHRGHRDALAPATRTVHAAATAGPRNTRPRRQFGGRPGYTHHRHRRHGGPAQLHLPDPGRRGGPATGGRQAGRDPRRRTRLRAAALPARRHRRTARRPPVAATAAELPGRRPHRRRHRADARA

SEQ ID NO: 2948 - protein, 248 aa, Mycobacterium paratuberculosis
VGFWASELDGDDPDLGARRVDPARARARDLLVRNVATDADLTRRLLESGLPLPTLLVAATAATVTRWRRQRGQSTPPPLLALETHGRADSLVDGPGTHTIDTGDTVGLLSSIYPIRVDAADPRRVADKLAAIPGDGLDYGLLRYLRDDTAERLAGLPSPQLLLNYLGAAHTDGGTGLTLERELLAGLSPIPEPDLAVRHELTIAAMVLTYGGQRVLAAQWRTLPDILTDTDITALQELWVDSLREMVT

SEQ ID NO: 2949 - protein, 428 aa, Mycobacterium paratuberculosis
MSTLAILGAGAKAVAVAAKASVLRDMGVEVPDVVAVERIGVAANWQASGGWTDGAHRLGTSPEKDVGFPYRSALVPRRNAELDERMTRYSWQSYLIATASFAEWIDRGRPAPTHRRWSQYLSWVADHVGMTVVHGEVEQLAVTGDRWALHTHETTVHADALMITGPGQAEKSLLPGNPRMLSIAQFWDRAANHDRISAERVAVIGGGETAAAMLNELFRHRVSSITVISPQATLFTRGEGYFENSLFSDPTNWPALTLAERRDALARTDRGVFSSSVQEALLADDRIHHLRGRVTHAVGVQGQIRLTLSTNRGSENLETVHGFDLVIDGSGADSLWFAPLFSQEALDLLELGLGGPLSSERLQEAIGYDLAVTDVTPKLFLPNLSGLTQGPGFPNLSCLGLLSDRVLGSTLGPTNYPARRRHDERQPL

SEQ ID NO: 2950 - protein, 71 aa, Mycobacterium paratuberculosis
MSANPFDDDTATFVVLVNDEDQHSLWPTFAETPPGWRVVFGAAGRADCLQYVEQNWSDIRPKSLIEALAGE

SEQ ID NO: 2951 - protein, 178 aa, Mycobacterium paratuberculosis
VKTVKSIATGVAALTAIGGPAAGVASMAAPTGLHEVQLAAFEAPLPQDPPPPPPPPPGAPGQLPTADQLANLCNQVTDPGVNYREKANLVENGVSQNEGMVADHDLRKAYRNGNFPEQFNVTNIAPAGPNMAQADVGITGPKFAGPVNKHLVFVNQGGNWVLQHDAAIALIQAATAMN

SEQ ID NO: 2952 - protein, 172 aa, Mycobacterium paratuberculosis
MNTVKTIATGVAALAIVGGAAAGLAAAAAPSAPGTVRLAAVGAPLPQDPPPAQPVAGANVPTPDQLTGLLNSLADPSVPFANKSNLVQGGISGVEAHVADKKLQKAAKNGDLPLSFDVTNIQPTASGAATADVSVSGPKLTSPVTQNVTFVNQGGWVLSRASAMELLQAAGQ

SEQ ID NO: 2953 - protein, 305 aa, Mycobacterium paratuberculosis
VCAARHPAAMTSPDAADLTARFEAARPQLGALSYRMLGSIDDAQDAVQEAWLRLDRSGGADIANLDAWLTTVVARICLNMLRDRRTRDGAEPAAHLPDPIVEPAGEFDPEHRAMLADAVGMALFVVLDTLPPAERLAFVLHDVFAVPFAQIAAIVDGTPESARKLASRARRRIERADPVPDGDLAAQREVVDAFFAAGRSGDFDRLVSVLHPDVVLRGDFGPATATVRVQGAAAVAKLARSYAGPEREAWAATVNGAAGAVIFVAGRAASVMGFVVRGGRIRAIDVLADPDRIAKLELGALRADH

SEQ ID NO: 2954 - protein, 198 aa, Mycobacterium paratuberculosis
MSRLPGVSDRDAGLGARIAFFFTRRKLAQMTGLETAGMLEPLRMYAHIPRLLNAYGRLEQAESRLDILSPRHRALAELKAATTVRCEYCIDLGSQIARRWGITDEELLAMADYRDAACFSDVDKLILEYATAISRTPVEVSDELFDALRAHFDTAQLVGLTHVITLGNLRARFNIALGIGSSGFSGNRVCALPDTPRP

SEQ ID NO: 2955 - protein, 104 aa, Mycobacterium paratuberculosis
MIFKGVRDGKPYPEHNLSYRDWSQIPPQQIRLDELVTTTTVLALDRLLSEDSTFYGDLFPHAVRWKGITYLEDGLHRAVRAALRNRTVLHARVYDMDLPLGPSG

SEQ ID NO: 2956 - protein, 343 aa, Mycobacterium paratuberculosis
VGSADERRFEVLRAIVADFVATKEPIGSKTLVERHNLGVSSATVRNDMAVLEAEGYITQPHTSSGRVPTEKGYREFVDRLDDVKPLSAAERRAIQNFLESGVDLDDVLRRAVRLLAQLTRQVAIVQYPTLSSSTVRHLEVIALTPARLLMVVITDSGRVDQRIVELGDVIDDHELSRLREMLGQALVGKKLSAASVAVADLAEQLRSPDGLGDAVGRSATVLLESLVEHSEERLLMGGTANLTRNAADFGGSLRSILEALEEQVVVLRLLAAQQEAGKVTVRIGHETAAEQMVGTSMVTTAYGTSDTVYGGMGVLGPTRMDYPGTIASVAAVAMYIGEVLGAR

SEQ ID NO: 2957 - protein, 381 aa, Mycobacterium paratuberculosis
VARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKGRRGRDVPEVRSTHAGGGLFSRLRETFTGR

SEQ ID NO: 2958 - protein, 253 aa, Mycobacterium paratuberculosis
MVATLFYTDELPDAGSLAVLGGDEGFHAATVRRIRPGERLVLGDRAGGLARCEVEHAGRDGLRARVLERWTVAPPNPPVTVVQALPKSERSELAVELATEAGADGFLAWQAARCVANWHGPRVDKGLRRWRAVAKAAARQSRRPHIPTVDGVLSTASLTSRIRDEVAAGAVVLALHESATDRLTDVPVAQAKSLFLVIGPEGGIADDELAALRQAGALSVRLGPQVLRTSTAAAVALGALGVLTPRWDDAASP

SEQ ID NO: 2959 - protein, 352 aa, Mycobacterium paratuberculosis
VTPRDTSAADAAGALQADAQVRISIDVPPDIVMGLLGSADENLRALERSVIADLHVRGNAITISGESADVARAERVISELVAIVANGQVLTPEVVRHSVAMLAGTDNESPAEVLTLDILSRRGKTIRPKTLNQKRYVDAIDANTIVFGVGPAGTGKTYLAMAKAVNALQTKQVSRIILTRPAVEAGERLGFLPGTLSEKIDPYLRPLYDALYDMMDPEVIPKLMSAGVIEVAPLAYMRGRTLNSAFIVLDEAQNTTAEQMKMFLTRLGFGSKIVVTGDITQVDLPGGATSGLRSAMEILDRVDDIHVAELTSVDVVRHRLVSEIVDAYAKFEEPGLTMNRAARRASGSRGRR

SEQ ID NO: 2960 - protein, 177 aa, Mycobacterium paratuberculosis
MSIEVSNESGIDVSEAELISVARFVIAKMDVNPAAELSMVLLDTAAMADLHMRWMDLPGPTDVMSFPMDELEPGGRPDAPEPGPAMLGDIVLCPEFAADQAAAAGHSLGHELALLTIHGVLHLLGYDHGEPDEEKEMFALQDRLLEEWVADQVEAYHQDRQQERDRRLLDKSRYFDH

SEQ ID NO: 2961 - protein, 193 aa, Mycobacterium paratuberculosis
MDQDDLPRTARVSIVAPSPEGELAEVALLFTNIVRRDTAAFREELQNLVNSLAETSETKPVITESQTPYPGGGLAQYGIAFAVGLPTALAYNVIYDALKKLSHRFSWTAGSPPQERFLMENANPLALGAIEQGFGVARDDLRPVVVDVQGLRAHVVYHAKDGSMFTVEMENTGQFAITSVRKNWPNAGWGDES

SEQ ID NO: 2962 - protein, 535 aa, Mycobacterium paratuberculosis
MTLSSRRGSGCGVVDSVVAQHGPQDVEAAAGQGEDGLGVAFSFGAFSVVVGARGGVGADADQGRQVAGAQQAPVVASGAFEVSADAAGISWYRRQAGDAGEAVGGGECGHVPAGGGEELSAQDDAESGHAQDDFGVAVAAKSLLDHRVGVADFGVEGHHLLGQAGHHSGRQLLAGHDAVLGVSGLQRGGCDGIGVAGLAFTQERGYSSATGAAQRVGSLVASKQDQRGTALVVVEGAFQRRKVFQQLGAHSVDRPGPISHQIGTSAGQDAQLDCDVIAGAQRLQVVAHPGLIGDDRSVFGVGLAFAAVTTRGVMDRAPGNIKQPLPGSDEQGDQQRGAAGVEVDRPRDLASIGQRRHRRNQLQQRGLVVGHPLREQSLRVVVNNHAVMVGLTGVHARPDRLCHNHLRNRHCPDQPSRRPRRRVLTQRSNRISQLAVESSRDAGRPISFGHPTQQPHESHTRRPWAIRTALGLLHICLLVCGRGLGCVCSVVDGLVFDRWDAAQAVHEPVGVVPVHPVGGEHFDVGQPVQRSAPER

SEQ ID NO: 2963 - protein, 320 aa, Mycobacterium paratuberculosis
LICAFITEHRARFGVAPICRVLTEHGCKIAPRTFYAWLARAPSARALWDTVITEVLAGYYEPDEHGRRKPESLYGATKMWAHLQRQGIGVARCTVERLMRANGWRGVTRRKKVRTTIADPAAARAADLVKRKFRVPAPNMLLVADFTYVRLASGAFVYTAFAIDAYAGRIVGWTCSASKEDRFLRQAIRDAAQLRSNEGNPLLGNTVHHSDAGSQYTSVRFGETLSLSGLVPSIGTVGDAFDNALAETTIGLYKTEAVRADSPFRRGPLNRLADVEMLTADWVHWYNTDRLMHRLGRIPPVEYEAIYYAANTAQSAAAHQ

SEQ ID NO: 2964 - protein, 104 aa, Mycobacterium paratuberculosis
MMPKKYDEATKSKAVRLVVDHRDEYDSEYGCIRAVATRIGVGPETLRKWVRQAEIDGGERDGVTTATNRENRELKRKVAELEQTVEMLRAATTFFVRESDPRHR

SEQ ID NO: 2965 - protein, 351 aa, Mycobacterium paratuberculosis
MMSPKEKLPLSPMLVQYLAGLCVLKWGAAASVKEVVLGDMVLDQASGEPRDVDVTVTLDTPDGEYAFMGYEVKHWKKPLNESHVEQLAAKLNDMPGVTHRAIVSTSGYYKPAIKKAAYHGVDLYVIKEWTTPLEEHFPDLAPMTGKPSEVIRAAQWLLTWKEWDIWLDVHAPDFNIAPEDPIFDERGRVHSAYPNFGAFGYEMLVRSTDILCLTKPLKDRVEPLDDAYRRGEPIPDEPPWSFGHTLGVMGDEAYIRLSDENLHQVRGVTIVGKLRWEFHPWLYCAMEKVPTGEMFSGAVVATSPIPGRMAAIVIPTQGREWDVRQVRLKPDHRNSIRDLRIPAAEDNPSAG

SEQ ID NO: 2966 - protein, 145 aa, Mycobacterium paratuberculosis
VATRHGFVRVQMRDGRREKVSQAHLIAVAAHGWPEYWTCEKCRETVPYILGRLDELGDDSPDNLKWVPDAEAMLWHVIGCCLENLMAGKPHEEEPNREWVDSFVYDIEAAEFSGETYMCHPTSPKTEKLIQWGLKKEYEAEHQVT

SEQ ID NO: 2967 - protein, 411 aa, Mycobacterium paratuberculosis; identical to SEQ ID NO: 1383

SEQ ID NO: 2968 - protein, 87 aa, Mycobacterium paratuberculosis; identical to SEQ ID NO: 34

SEQ ID NO: 2969 - protein, 227 aa, Mycobacterium paratuberculosis
LSKSRDLALKRYAKWLVDEGELSSDPLLGLKPPKGDQKVVNALTEDQLKRLIAACQGKSLMDRRDETIVRLMAETGLRANETLSLQITDVNLDAGIVTIVRGKGGKGRVSPFSVQTATAIDRYLRARRAHRLSNTGALWLGGGGKSLGYYGLSKALKQRATAAGIETFHLHMLRHTAATRWLRAGGSESGLMSVAGWKNRSMIDRYVGAAAASLAADEARRLNLGDI

SEQ ID NO: 2970 - protein, 425 aa, Mycobacterium paratuberculosis
MPAKLSRLRILAAAAIAFAPLSVVVDGPAAQAAPCAGAGSNPVSCQHCMFYVNAYHTANVCNEDRRGVQGPPSNAPTRPPEVPVPAYEPPPIPVPVQSPLVLPPPNAGQGAVPVLEINPPGPDAPRDAPVVAPPRGLDAPSLAIAAAKAAPVTRVDPANPPKPPTQVDFNQQVQNVLAAHRENVDVLKVDEQRLIRPRHWDYIDYDDAYRRPTLYNPLNSAVTFRYFYNGAYQQAYLARGARMVLDAATVGVVPFTAVGDSYVAAGSFYGGGSIPLNGYNGPPPPDYKPPAPPKLYENVTAFIPAKGETVEVGHVAVVGHDGSQPAGSQDTFLLDDSTLAWGQIDNSSSAPAQIRVIKTQPLPGAGPTDDGGFLVLLAVHHQEPGQPRQSGWGLALRFGGFAVVVGVIAWLLARRSRSEEQNADS

SEQ ID NO: 2971 - protein, 436 aa, Mycobacterium paratuberculosis
MTGWSELLGAVALIALGGLFAAIDAAISTVSLARVQELVRDERPGAVALSKVMSERPRYINLVVLLRITCEITATVLLVVFLYDNFGLRWGLFGAAAIMVVTSFVVMGVGPRTLGRQNAYSIALTTVLPLQVISWLLMPISRLLVVLGNAVTPGRGLRNGPFASEIELREVVDLAQQRGVVAAEERRMIQSVFELGDTPAREVMVPRTEMIWIESDKSASQAINLAVRSGHSRIPVIGENVDDIVGVVYLKDLVQQALLPGGSGRATPVSQVMRPAVFVPDSKPLDALLREMQRDRNHMALLVDEYGAIAGLVSIEDVLEEIVGEIADEYDQAETAPIEDLGDKRFRVSARLPIEDLGELYGVEFDDDLDVDTVGGLLALELGRVPLPGAEVISHGLRLHAEGGTDHRGRVRVGTVLLSPVESDGSPDGEEPEHHD

SEQ ID NO: 2972 - protein, 299 aa, Mycobacterium paratuberculosis
MTEFRSGFVCLVGRPNTGKSTLTNALVGTKVAITSMRPQTTRHTIRGIVHREDFQIILVDTPGLHRPRTLLGKRLNDLVRDTYAEVDVIGLCIPADEAIGPGDRWIVEQIRATAPKTTLVAIVTKIDKVPKDRVAAQLVAVSELVGDSAEIVPVSAVTGAQVDIVIDVLAAALPPGPAYYPDGELTDEPEEVLMAELIREAALEGVRDELPHSLAVVIDEVNPREDRDDLIDVHALLYVERDSQKGIIIGKGGARLREVGTAARAQIEKLLGTKVYLDLRVKVAKNWQSDPKQLGRLGF

SEQ ID NO: 2973 - protein, 485 aa, Mycobacterium paratuberculosis
MDQSDAPLLNALADYRDKNRYGFAPPGHRQGRGTDDRVLAVLGREPFLDDVLASGGLDDRRASNGYLQRAEDLMAEAVGAEIAWFSTCGSSLSVRAAMMAVAGGQGSLLVGRDSHKSIVAGLIFSGVQPRWITPRWDAERHFSHPPSPQQVEEAWDKHPDAAGALVVSPSPYGTCADIAGIAEVCHRRGKPLILDEAWGAHLPFHEDLPTWAMDAGADVCVVSVHKMGAGFEQGSVFHVQGDLIDRDRLSACADLLMTTSPNVLIYAAMDGWRRQMVQHGHQLLGAALDLARQVRDEIELIPDVEVLDDELLGVQASHDLDRMQVLIDVCGTGTSGYQAADWLREHARIDVGMSDHRRILATLSMADDKETLGRLTDALRAWRTAAQDFDPAPRIALPSPSEMQLETVELPRDAFFGRVQEVPTKTAAGRIAAEQITPYPPGIPAVVPGERLNDAVLDYLCSGVAAGMNLPDAADPSLQTIRVLA

SEQ ID NO: 2974 - protein, 503 aa, Mycobacterium paratuberculosis
VIGASESGPGALSGSGSGSGNQRLPTLTDLLYQLASRSVSSTTLVGRSLHAIHASQPTLNAFRVVLTESALADAAEADRRRAAGDTAPLLGIPIAVKDDVDIAGVPTAFGTEGSVPPATHDAEVVRRLKAAGAVIVGKTNTCELGQWPFTSGPGFGHTRNPWSRRHTPGGSSGGSAAAVAAGLVTAAIGSDGAGSIRIPAAWTHLVGIKPQRGRISTWPLPEAFNGITVNGVLARTVADAALVLDAASGNVDGDRHKPPPITASDYVGKAPGPLNIALSTRFPYTGFRPKLHPEILAATRAVGKQLELLGHTVVPGNPDYGMRLSWDFLARSTAGLRDWEERLGDGVVLDPRTVANLRLGHLLGQAILRSARRHEAADQRRVGSIFDIVDVVLAPTTAQPPPLARAFDRLSGFGTDRAMIAACPLTFPWNVLGWPSINVPAGFTSDGLPIGVQLMGPANSEGMLISLAAELEAVSGWASKQPQPWWDQSADTPPAPGQPAPTG

SEQ ID NO: 2975 - protein, 265 aa, Mycobacterium paratuberculosis
MRLYRDRAVVLRQHKLGEADRIVTLLTRDHGLVRAVAKGVRRTRSKFGARLEPFAHIDAQLHPGRNLDIVTQVVSIDAFATDIVSDYGRYTCACAMLETAERLAGEERAPAPALHGLTVSALRAVADGRRSRDLLLDAYLLRAMGIAGWAPALTECARCATPGPHRAFHVGAGGSVCPHCRPAGSTTPPPGVLDLMSALHDGDWEFAEQTPQSHRNYVSGLVAAHLQWHLERQLKTLPLVERTYHIDRTIADQRATLIGQDMDCG

SEQ ID NO: 2976 - protein, 296 aa, Mycobacterium paratuberculosis
VVRAERAPTSTGFPQLPPAPDDYPVFPDKSTWPVVFPELPPSPGGGPSRPPQHISKAAAPRIPADRLPNHVAIVMDGNGRWATERGMSRTDGHKAGEAVVIDIVCGAIEIGIKWLSLYAFSTENWKRSPEEVRFLMGFNRDVVRMRRVNLNTIGVKIRWVGSRPRLWRSVINELAIAEEMTKRNDVITVNYCVNYGGRAEIAEATKEIARLAAAGRLNPERITESTVAHHLQRPDIPDVDLFLRTSGEQRSSNFMLWQAAYAEYIFQDKLWPDYDRRDLWAACQEYASRNRRFGSA

SEQ ID NO: 2977 - protein, 142 aa, Mycobacterium paratuberculosis
MSSLQERLASVLREVLPSQEESDGALTVHHEGTIASLRVVNIAEDLDLVSLTQILAWDLPLTKKVSDHVARQARDANFGSVSLVEKVNKTAVQRNSGKNTAKLADVMLRYNFPGAGLTDDALRTLVLLVLDTGARIRHTLTD

SEQ ID NO: 2978 - protein, 135 aa, Mycobacterium paratuberculosis
MTPSGDGAGVSVRSTRQRAAISTLLETLDDFRSAQELHDELRRRGENIGLTTVYRTLQSMAAAGLIDTLRTDTGESVYRRCSEHHHHHLVCRSCGSTIEVGDHEVEEWATAVAAKHGFSDVSHTIEIFGTCSECR

SEQ ID NO: 2979 - protein, 141 aa, Mycobacterium paratuberculosis
MSPSPASMPAATDGAMGPEPGLPAHDHDGLAAAGHPGPADYPVPPPRDILDAAGELLRALAAPVRIAIVLQLRQSHRCVHELVDALGVPQPLVSQHLKILKAAGVVAGERSGREVLYRLADHHLAHIVVDAVAHAGEEPRP

SEQ ID NO: 2980 - protein, 463 aa, Mycobacterium paratuberculosis
VHRLVASVIDTVVNLAKRRGFVYPSGEIYGGTRSAWDYGPLGVEFKENIKRQWWRSVVTGREDVVGLDSSIILPRQVWVASGHVEVFHDPLVESLITHKRYRADHLIEAYEAKHGHPPPNGLADIRDPDTGEPGRWTEPREFNMMLKTYLGPIETEEGLHYLRPETAQGIFVNFANVVTTARKKPPFGIGQIGKSFRNEITPGNFIFRTREFEQMEMEFFVEPSTAKEWHQYWIDTRLQWYVELGIDPQNLRLFEHPADKLSHYSDRTVDIEYKFGFAGNPWGELEGVANRTDFDLSTHSKHSGVDLSFYDQATDSRYIPYVIEPAAGLTRSFMAFLIDAYVEDEAPNAKGKMEKRAVLRLDPRLAPVKAAVLPLSRHADLSPKARDLAAELRRFWNIEFDDAGAIGRRYRRQDEIGTPFCVTVDFDSLEDNAVTVRRRDDMSQERIGMDAVADYLSARLKGC

SEQ ID NO: 2981 - protein, 410 aa, Mycobacterium paratuberculosis
MIPAFVFFPPEINSALIAGGAGSGPLFEAASAWDGLAAELSSSASSFQTVVTDLAAGSWMGPSSVAMTAAAAPYVQWLIIAAAQAEVAALQARLAALAFEGALVATVPLPAVLANRARLLVLIATNFFGQNTAAIAQTELEYVEMWLRDVAAMLGYHAGAQSAAQALPAFTVPPAGLGGGAASAGLGGLAGLVSAPLSFASQFFEGLSSLGTAFATQLQSVLAALPPAVSSLTSLITSTPVATLTSVAQAGMYPATALMTPMVTLAQSTAPAAAPAATPTPALVNTAKMPVETPHAAANPLADLQPLAGGGLGALGVASAGLGTARFVGAMAVPPTWQGSMPAYIATPAMSGAPGAAPMTAATTGSTGSSSGVPVTAMAVGDKKPEGEDRATRAEVVRSRPKVVPRNRPG

SEQ ID NO: 2982 - protein, 143 aa, Mycobacterium paratuberculosis
MLFDTRVTYGKSAIPAYSLRFVLRCEPVGVNRFATASERFDRLWKGAGVLLPLGSPLPDDTVSAVRGESGVLGGLSVPLKWGVAVPPDDYDHWAPKPEASAEAVEETAEMPRPTAVADGVWSGWDGEAVPRTAGVIPHSPAAG

SEQ ID NO: 2983 - protein, 157 aa, Mycobacterium paratuberculosis
VLAAVAQERAAAERLARSLEQALFTAQSRVRAVSDYIDTRRGSIGPEARTRLAEAQRHLHAAADRRATDPADAIAHANAASTLAAEAQSLANGDVQAARRAYPRGGGGDMGAMLGGIIIGDLLSSGMRGGFGGWGPASFGGSTSSSGGGFLGGGGRF

SEQ ID NO: 2984 - protein, 494 aa, Mycobacterium paratuberculosis
MRTARLLAVLAALLTVGLSAGLLAPPAGAQPPLRLSDYLTDTAGVLSDSGRKAITTAVDKLYTDRHIRLWVVYVDTFSGQTATRWAQDTLRTSDLGDYDALLAVATTDRAYAFLVPPTIRGVNQSRVEALRHNKIEPALHDGDWSGAAVAAATGLDTAPGSSGRVILLATLAALLVAVMALLLVMRYRGRRRRAAALAAARRLDPTDLDALAALPLPTLDDLSRALVVDVDNALRTSANELDLAVAEFGDQRTQPFTQAVTNAKAALSQAFTVRQQLDDGMPETPAQRRELLTQVIVSAARADRELESQTEAFESLRDLVINAPSRLDGLTQQYVELTARIGPAEQQLAALHNEFSAAALTSVSGNVTAAKERLAFADRNIGTARELAGQAVSGQQGRLVDAVRAAESALGQARSLLDAVDHAAGDIRHAIDQLPSAMADIENDIKRAAELLAATRDTKSGHAAELAAARDAATRAVEGARAGAPDDPLGAFGS

SEQ ID NO: 2985 - protein, 423 aa, Mycobacterium paratuberculosis
VTRNQHDPYDDFDRQRRVAEAPKTAGLPGTEGQHRTDFARDRARVLHSAALRRLADKTQVVGPREGDTPRTRLTHSLEVAQIGRGMAVGLGCDLDLVELAGLAHDIGHPPYGHNGERALDEVAAAYGGFEGNAQNFRILTSLEPKVLDAQGNSAGLNLTRASLDAVIKYPWRRGEGPGTSKFGFYDDDREAAAWVRAGAPAGRMCLEAQVMDWADDVAYSVHDVEDGVVSQRIDLRVLADDDEAAALAKLGESEFSRVGADDFMAAARRLSALPVVAAVGKYDATLASSVALKRLTSELVGRFASAAIATTRAAAGPGPLVRYRAELAVPDLVRAEVALLKILALQFIMSDPRHQQTQAGQRERIHRVAHWLYAGAPRTLDPVFAAAFNTAADDGARWRVIVDQIASYTEGRLERIDARQAGP

SEQ ID NO: 2986 - protein, 205 aa, Mycobacterium paratuberculosis
MKKISGSPCIATLLMGLPVLAMTACSSPQHASTQPGTTPPVKSAAPTSSGATTTPAPGGGALTAELKTPDGRSVATATFDFTGGYVTVTVKTVANGVLTPGLHGLHVHEIGKCEPNSVAPTGGAPGNFLSAGGHYQAPGHTGKPESGDLATLQVRQDGAAYLVTTTDAFTRDELLAGNKTALMLHGAEDTENAMDRVACGVIGTG

SEQ ID NO: 2987 - protein, 650 aa, Mycobacterium paratuberculosis
MSSPAGSRAQGDGRARGRGRIPDRDIAAIRERVRIDEVVGDYVQLRRAGADSLKGLCPFHDEKSPSFHVRPNHGHFHCFGCGEGGDVYAFLQKIEHVSFVEAVELLADRIGHTITYSGPATSVQRDRGSRSRLIAANAAAAEFYAAALESDEAAPARQYLTERNFDAEAARRFGCGFAPSGWDTLTKHLQRKGFEFKELEAAGLSRQGRRGPMDRFHRRLLWPIRSSAGEVIGFGARRLFDDDPMEAKYINTPETLLYKKSNVMFGIDLAKRDIAKGHQAVVVEGYTDVMAMHLAGVTTAVASCGTAFGDEHLAMLRRLMMDDSFFRGELIYVFDGDAAGRAAALKAFGGEQNLAGQSFVAVAPDGMDPCDLRLRSGDAALRDLVARRTPLFEFAIRSALAELDLDSAEGRVAALRRCVPMVAQIKDPTLRDEYARQLAGWVGWSDVAQVIDRVRSQSKHSAGAGRGGSGARVSRRAEQSAAPAGPAASRPDPRDPTLWPQREALKSALQYPALAGPVFDSLTVESFTHPGYAAVRAAIEAAGGTSSGVTGGQWIEAVRDRASSPLTAGLISELGVEAIQVDDEKLPRYIAGVLARLQEVWMGRQIAEVKSKLQRMSPIEQGDEYHALFGDLVAMEAYRRSLLEQASGDD

SEQ ID NO: 2988 - protein, 101 aa, Mycobacterium paratuberculosis
MEPSIVGRNALIRYVVVLGLGYVLGSKAGRRRYEQIVGTYRALTSSPVAKSVIEGGRRKIANRISPDAGFVTLTQIDDRTAIMEREAEPADEALAPSNRPR

SEQ ID NO: 2989 - protein, 211 aa, Mycobacterium paratuberculosis
MEFLVAATTQVPDGTPAEAVDDLRARVSARCRELARQGQLLRLWRAPSPPGRWRTLGLFAAADDNALEQLLASTPLRAWRTEEVTPLPVHPNDPTARLITPEPVSGGTAEFLQAITIRVPADAPQRVVDDVLAREAERAGELGAQGCLQRLWWLHSGPGEPRVLALWRTADTESLAAVLRSLPLHAWLQVDTTTPLHTHPDDPVSGSLAGR

SEQ ID NO: 2990 - protein, 463 aa, Mycobacterium paratuberculosis
MTTRKARRRKQIHLGAHFPGVNNTTVWSDPSAGSQIAFESFVHLARTAERGLFDFFFLAEGLRLREHRGKIHDLDVVGRPDTFTVLAALAAVTERLGLAGTINTTFNQPYEVARQFATLDHLSDGRAAWNMVTSSDAFTGENFRRGGFLAHADRYRRAEEFITVARKFWDSWSPGAVIADVDAGTYADPARIGVVEHHGRQFDVRGVASLPAGPQGHPVLLQAGDSSDGRDFGAKHADALFTLHGSLEAGQRYYADVKSRAAAHGRDPEQLKVLPGATFALGDTPAEAADNARHIREQQVSGPTAIAFLEQVWGVDLSAYDPDGPLPDVEPVENPTITRGRVRHGDPKTVAETWRARARAENLSIRELIIEVTSRQQFVGTPQQVAAEIDHYVQSDACDGFILVPHLTPHGLDEFVDKVVPLLQERGSFRAEYRGITLREHLGLAPAPGNAPGADLESQCATG

SEQ ID NO: 2991 - protein, 313 aa, Mycobacterium paratuberculosis
IGQVAAATSRIRVGTAAVQIGHTTAVAVVENFGILDALYPGRIDMGLGRSGQRRAEAAASSAAASRPEARPWRQTDGLVIPAPFDQTALMKSERIRAQSSVLAPPCAQPADFGEQIADIEAMLDGSYAVNGHRLQVVPGEHAELTPWIFGSTRGQSAEVAGARGLPFVASYHITPGTALDAIEAYRNAFRPSARLARPYVVVSADVVVAEDSATARHLASSYGHWVYSIRSGQGAIPYPDPDLCDPLTEEQRALVADRTATQFVGNPDEVADRLEVLRRVSGADELVITSVTHRHADRLRSHELIAKRWGLTG

SEQ ID NO: 2992 - protein, 382 aa, Mycobacterium paratuberculosis
AVDTFPGSVMTELHLAVALDGYGWHPQAWRYAFAHNTTGGGQFSGRYWAALARTAERGLLDFLTIDDSLDAQPGRRAEISPRRLVGRADATLVAARVAPVTEHIGLIPVATVTHTEPFHVSKAIATLDHISHGRAGWQVRVSATEQEAALFGRRAVPGVDELFDEASDAVEVARRLWDSWEDDAVIRDVVTGRYIDRDKLHYIDFAGKYFSVKGPSITPRPPQGQPVVAALAHTPPVYEFAVANADLVFVTPRDDDSLRAILAEVDRARRAAGRAIRVYADLVVSLVGHPLAPAAAIASDARVFAGSATDLAELVVAWQDAGVDGVRLRPAVNALDLPAIVDDLVPRLQRAGRFRTGYRDGETLRERLGLAPAPNRYATAAS

SEQ ID NO: 2993 - protein, 229 aa, Mycobacterium paratuberculosis
MLAAIRRDIRAARERDPAAPTTLQVIFAYPGVHAIWGHRVNHWLWRRGARLAARISAEITRILTGVEIHPGAVLGPGLFIDHATGVVIGETAEVGEDVTIYHGVTLGGSGRDTGKRHPTIGDRVIIGAGAKVLGAIKIGDDSRIGANAVVVKEVPSSAVVVGVPGQVIARTHPGPGGPDDSLMPDLVGVSLQSLLTRVTKLEAKVDGSQTGRVIRPPEAGVWYGEDFSI

SEQ ID NO: 2994 - protein, 250 aa, Mycobacterium paratuberculosis
IKPDTIILEPTSGNTGIALALVAAARGYRCVLTMPETMSVERRMLLRALGAEIVLTPGADGMPGAIAKAEELAKSDDRYFVPQQFENPANPAIHRSTTAEEVWRDTDGKVDIFVAGVGTGGTITGVAQVIKERKPSAQFIAVEPAASPVLSGGQKGPHPIQGLGAGFVPPVLAMDLVDEVIAVGNEESIALARRLAAEEGLLVGISSGAALVAALQVARRPENAGKLVVVVLPDFGERYLSTPLFADLAD

SEQ ID NO: 2995 - protein, 430 aa, Mycobacterium paratuberculosis
MTILSEPDRALAPVATRRRCVVRPATALNRMTRYRGGTYSHTVDRVVFADGSWARTDLIRLNPNVHAYSLDFAGIAPAHPSRYRVDSWSALPHLRTSGHEAKVDWILRNSLPLRSTAELSRQVRDAGYPLGPANITEHEAIAATQAAIWFFTNGLALDTRPLNVPIAVHRAPGPVLTFEFDGQPQLGGYSVWSSSAGDATLKLQKSTNGVVWQDVSGSHLRLEPGQRRYQRTLGEGSTLSSSSHGRGGRGYRYYRLVATSETATPTIEHVNFRLTGARHYRNADKVVHLYNYLLAQAGRAVHHADDALLLDDRHATADAGLIGPFRVRIPLLLSADDGHQLVDADGFAVGQVVEPGTDFYIREAPGGSGITLTAKTVGDLHGRVLTGVALDEASQRFTPVALAIPTEMAIEFDISWQADEAWSYIVGDKR

SEQ ID NO: 2996 - protein, 307 aa, Mycobacterium paratuberculosis
MTSAQNESQALGDLAARQLANATKTVPQLSTITPRWLLHLLNWVPVEAGIYRVNRVVNPEQVAIKAEAGAGSEEPLPQTYVDYETSPREYTLRSISTLVDIHTRVSDLYSSPHDQIAQQLRLTIETIKERQELELINSPEYGLLAQATPEQTIQTLAGAPTPDDLDALITKVWKTPSFFLTHPLGIAAFGREATYRGVPPPVVSLFGAQFITWRGIPLIPSDKVPVEDGKTKFILVRTGEERQGVVGLFQPGLVGEQAPGLSVRFTGINQSAIATYLVTLYTSLAVLTDDALAVLDDVAVDQFHEYK

SEQ ID NO: 2997 - protein, 685 aa, Mycobacterium paratuberculosis
MTRSPCSTTSRWISSMSTSEYRAVDAESDLPISAAELAALASQLYAASIRPGPDSPPQQAPVAPRGSVPDATAATSAGRTAAGTADVYPGPVPQVGGRDVYLPPPASPAPEAPPQAAPPAPRGSAPDATAATSAGRAAAGTSDVYSSWVPQLGVADIYLGAPTPAGPEAPPQSAPPAPRGQVPDTTAAATAYGADLSAFAVPTGIVSTAPGVQAGTAPPVPVVPRAATAPSWLPEAPSVADLGWSDAPAPDAPAGDEHDYHFLTKTDPVPQFRDEHEVFDVAAIRSDFPILKETVNGKPLIWFDNAATTQKPQVVIDRLSHFYAHENSNIHRAAHELAARATDAYEEARDTVAEFIGAPSSDNIVFVRGTTEAINLVAHAWGAKHLQPGDEIVITHLEHHANIVPWQLISQKTGAILKVAPIDDAGNLLLSEFEGLLGPRTKLVAASHVSNALGTVMPVDKIVELGHRYGARVLIDGAQSIQHIPIDVAELGADFFVFSGHKIYGPTGIGALYGTEEALTETPPWQGGGHMIADVTLERSLYQGPPTKFEAGTGNIADAVGLTEALRYVQRLGVERIAAYEHALLEYATPRLADIPGVRLIGTAQEKASVLSFVLAGHEPLEVGKALNAEGIAVRAGHHCAQPALRRLGLEATVRPSFAFYNTFEEIDVFLRAVRRIAEGGANVG

SEQ ID NO: 2998 - protein, 412 aa, Mycobacterium paratuberculosis
LGGAAGVGFGGLVGHRGGGRDRRAGGGRRAPEGSVVTGVSTVRVAPDETDETADATFTSTRPLDYLPGILLLIGVGVLGKYAQIWWNALAKHEHWTVPDIEYVLWAIVIGLVITNTVGLHPIFRPGVLTYEFWLKAGIVALGSRFVLGDIAKLGGISLVQILVDMTIAGTIIIAVARWFGLSGKLGSLLAIGTSICGVSAIVAAKGAIRARNSDVSYAIAAILALGAVSLFVLPPLGHAIGLTDHEFGLWAGLSVDNTAETTATGYLYSEHAGKIAVLVKSTRNALIGFVVLGFALFWAGRGQADEIAPGVRAKAAFIWAKFPKFVLGFLVVSAIATAGWLTKGQTANLANVSKWAFLLTFAGVGLNTDIRQIARTGWRPLVVAVIGLTVVATVSLGIVLLTSRVFGWGVTT

SEQ ID NO: 2999 - protein, 267 aa, Mycobacterium paratuberculosis
VTNSPSSYLVLASQRSGSTLLVESLRATGVAGEPQEFFQYLPSTSQAPQPREWFAGVDDESILSLLDPLDAGTPDLAPPEIWRSYIRTVGRTPNGVWGGKLMWNQTPLLLDRAKNLPDRSGDGLRAAIRDVIGEEPLLIHVYRPDVVSQAVSFWRAVQTRVWRGRPDPARDARATYHAGAIAHVVTMLRAQEEGWRNWFAEEDLKPMEIPYPVLWRNLTQVVAAILEQLGLDPQLAPEPVLERQADHRSDEWVDRYRADAEKYGLPT

SEQ ID NO: 3000 - protein, 255 aa, Mycobacterium paratuberculosis
VNATAIAKPMTALGQFFLLSAEALAAAVRGPWAWREILEQIWFVARVSIFPTIMLSIPYTVLIVFVLNILLVEIGAGDLSGAGAGLASVTQVGPVVTAMVVSGAGSTAMCADLGARTIREEIDAMKVIGVNPVQALVVPRIIAATFVAVMLYAVVAVIGLTGSYIFVVFVQHVTPGAFVAGMTLVTGLPQVVISLIKATLFGLSAGLIACYKGLSVGGGPTGVGNAVNETVVFSFMALFFINILTTALGVKVTAK

SEQ ID NO: 3001 - protein, 430 aa, Mycobacterium paratuberculosis
MTEIAREPSRFAALGPRLVESTRKLGEQTVFYGQSLTAIADAIRRYPGELLRLIAEMGMGTGALAVIGGTVGIIGFLTLTTGALVAVQGYDTLSNIGVEALTGFLSAFLNVRMIAPCTAGLALAATIGAGATAQLGAMRINEEIDALEVMGIRAVTYLASTRIIAGILVVIPLYAVAVLMSFIAAKLLTIYVYGQSKGVYEHYFSTFLRPNDLLWSFFSALAMATGVMVVHTYYGFTATGGPGGRGGGGRPVGAVVDDRHRLCVPDDFAVRVRAVRQLQPVGIADEQTQQQRPHPARRKPAQRDRPHLVGAHPVHRHRRTGRVDRGLLLREVPDLRPAHAGVRPGGTGDGGRRQGQVARCADRAGRLHRHRREDRPAAAEDPAGPVPISAEQPGSRDQIDHRLRLQIRRPDRSRAAQRQPAQAGRGAAFT

SEQ ID NO: 3002 - protein, 422 aa, Mycobacterium paratuberculosis
MSKHSSSGLIRRGGNQRNGIDPIWWAPTLFIVIGGLVALTAASFSGKFQTFVPLTLVSDRAGLVMEDGAKVKLRGVQIGQVASIGTDVKTARLQLKIQPGPFRYLPSNLEAEIKSTTAFGSKFVDLIVPERPSASPLKPGAVLRSRNVTVEVNTVFENLQAVVQALDPAKLNAILSAFAQSVRGKGERIGEAITDANSLLRTVNSRMDTIGEDWRLFGATTGVYSDAAQHILSILDSASTTSNTITDNQRSLDSLLLSAVGFSQTGINVIGANESNIVRAMNLLDPTIALMQKYSPTYTCLFQGAQWYVDHGGRDALGGNGYSVILDAALLFGDDPYRYPKHLPKVNATGGPGGRPSCGSLPDPSANFPVRALVTDTGWGAAPNEIRTNVAAGNPWWANWFPTTKNPPEAPRYFWRGGQPPP

SEQ ID NO: 3003 - protein, 342 aa, Mycobacterium paratuberculosis
MRRKLSSIAWRVAIFTAVCLLFTFTLIAVFGQLRFEDRTGYQAVFTNISGLKSGNFVRIAGVEVGKVGDLTLHRDGTVTVGFAVDKGVRLSEGTKAVVRYENLIGDRYLALEEGPGSPRRLPPGATIPLARTSPALDLDALIGGFRPLFRALDPDQVNALSGQLLRIFQGQGGTLASVLSQTSMLTSTLAGRSQLIGELITNLNTVLRTFATRDHEFSDGLDKLAQLVDGLAQRRDDISTGLAYINAAAGSITDLLSQSRQPLKDVVQQTDRMSGQVLSDRDYVDNLLKELPDIYQVLARQGLNGDYFGFYFCEVLLKLNGKGGNPIFVKLLGQPSGRCTPK

SEQ ID NO: 3004 - protein, 396 aa, Mycobacterium paratuberculosis
VHTEMTWKLPKSPAPQRPLMLGVLGTVILACVTVVAFQYNKLPFIKNTDDYAAYFSEAGGIKPGNAVRVSGMGVGRVSDLRLEGTKVRIGFTVRKGVVLGDRTEAAIKTETILGAKMLELTPRGDGRLSGVIPLERTTSPYDLPDALGDLTTTISGLDTTQLSAALTTLADTLKATPENLKPALQGVARFSDTLNSRDAQLRSLLGNANHVSAVLGRRSQQIAGLVANSHALLAALLDERDSLDALMNHLTAVSHQISGLVNDNRTQLKPALDKLNGVLEILDNRKEELQKTLPKFKRYAMSFGECLGSGPFFKAYVANLVPGQFGGPVLDADMYDRFLDPDQKLPSEVVDPPTGTPPVPPENAPVPLWSQPPSPPPSTPPVRTIPPPSPHEFDQP

SEQ ID NO: 3005 - protein, 444 aa, Mycobacterium paratuberculosis
MTITRDALRKATALSLVLTLAVASVLVGGKLWRAVEKNSYAAYFAETNGLFVGDEVRILGVAVGAIDKIEPQSAGSKVTFSVDKKYAIPAAARAAVLSPSLVTARAIQLVPAYSGGPTLSPGAAIPLSRTAVPVEWDDFRKQLEKLTDALQPTTAGGVNSVGEFVNSAADNLRGQGDTARDTVLKLSEAISALGDHADDIFSTVRNLQLLVSALYSSSDLLASFNTNLAAVTTLLTNTPNEVGSALKSLDGALSDVRDFLAENREAMGVTVDRLGSITTALNDSRGDVKQILHIAPTVFQNFLNIYQPAQSAMTGILALNNFADIPQFICSSIEAASRARLARVSKLCLQYLNPIIKNRIYNYIPAGINPFVGTQARPSEITYSEDWLRPGYTPPDGGPPPEAPAPPGQPAPADQPPAEPGPPPNPTSNSLQVLRDLMLPTGPS

SEQ ID NO: 3006 - protein, 373 aa, Mycobacterium paratuberculosis
MRRAVVAALVVACAAALSGCGWRGLNSLRLPGTAGGGPGSYTIQAQMPDVVTIQENTRVRVDDVNVGNVTKIELQDWHALVTMRIDGDVHLPANSTAKLGQTSLLGSMHIELAPPKGEPPVGRLTAGSVIPLSRASLYPTTEQTLASVSILLNGGGIGQLQEITQAVAKAFAGREADMRSLLSQIDEFIAHTNEQTDDIIAAAENLNALAGQVAAADPVVDKALTSVPKALAVLAQERTKIADTIDRVGKFSAIAADTIHQSKQSLVDNLRNIAPALRSLADAGPSLTRGLDGLATYPWPASTVRNWFRGDYANLTLIVDLTLSRIDQGLFTGSRWEGNLTQLELQWGRTIGMQPSPVTGGNPLTYPYHFGGY

SEQ ID NO: 3007 - protein, 489 aa, Mycobacterium paratuberculosis
MLRLNRRTWIQLSILALVTVVSCGAMAFNFMKLPATLFGIGEYRVTVDLPQSGGLYQTSVVTYRGTDVGQVKSVDVTATGVRAVLAMRSGIEVPFDVQASVHSRSAIGEQYIELTPRPGTGDHQSRTLRDGDVITAGRVDVPVDIGRLLDMTNRALQAIPRDNLRTVIDETNRAVGGLGPELSRIVDGSTALAVAGGHTVDPLATLIDQSPAVLNSQVQTSGAIATWAERTAALMAQFKAQDAAVRDLLTRGTSGVEEGRALLDRVTPALPVLFANLVSLGDIAVVYRHDIEQLLVLLPQGIAAMAAIIVPSSNTKQEYRGAQLDFNLNLNLPPPCTTGYLPPAQRRSPASVDAPDRPAADLYCRVPQDSEFNVRGVRNIPCESKPWKRAPTVELCESDEEYVPLNDGYNWKGDPNATTSGQGVPQYPPGQDPRLPPPRGTAPAPPPVAVAPYDPATGDYIGPDGRRYTESDLAHPRAKSWQSLLVPQP

SEQ ID NO: 3008 - protein, 203 aa, Mycobacterium paratuberculosis
MADESDTPAAEEKSDAATQLDTDEGDDQDQGRVARWRELARRRRLSRAATVLAVGAVMVAALAGLSGWLGYRAYQQHDAQARRNLFVATASQGAVNLTTINYTQVDRDVQRILDSATGAFRDEFEQRSKPFAEVVKAAQSKSEGTVTDAGLESQRGDSAQVLVAVAVKSHTAGGDEPPREWRMRIEVRSVGDDAKVSNVVFVP

SEQ ID NO: 3009 - protein, 136 aa, Mycobacterium paratuberculosis
VTAPSETARTAADIRASDTDPQPTSSRGEPSIAWPRVFGYGILPGLALVLALGAGYLRWSAGSADDLAQARAQSVQAAREDAVALLSYRADSVDKDLAAARDRLTGEFKDAYAELTRQVVIPGAKEILNDVVKPPR

SEQ ID NO: 3010 - protein, 406 aa, Mycobacterium paratuberculosis; identical to SEQ ID NO: 1515

SEQ ID NO: 3011 - protein, 63 aa, Mycobacterium paratuberculosis
MSSAARVNAAASVSVAENHAVALVFVDQTVTIGDGAPTDTQPVVRMTLDKVNGRWLVSRFEPV

SEQ ID NO: 3012 - protein, 155 aa, Mycobacterium paratuberculosis
MAGAVVVSAALPVPAAHADNKRLNSAVVSAVYTLQHQAGCTNDVVRNNALTLAAEWHAEDMINNRNINDDIGSDGSTPQDRANAAGFRGRAAETVAINPAMAISSLELVNQWYANPDDMAIIRDCANTSIGVWSDNSLDRTVVVAVYGQPDPARR

SEQ ID NO: 3013 - protein, 92 aa, Mycobacterium paratuberculosis
VARECDGPDRVMKKNCPLQCPRRYGGVAENAAGDQVDWAGLPVNLDFAFSRDQRDKVYAQHLKRRHGTQFGTWRRGGQVCVCELASESISSG

SEQ ID NO: 3014 - protein, 1411 aa, Mycobacterium paratuberculosis
MAPENAVNTMCAYCGVGCGMVLQITTDPQTGRRHVAKSVGNKEHPANFGRLCTKGATTADLLAAPGRMDSAHARAGRGEPLEPIDTDQAITRCAKQLRAIIDEHGPDAIAMYVSGQMSLEAQYLANKLTKGFIGTNQIESNSRLCMASAGSGYKLSLGADGPPGSYQDFEHADVFFVIGANMADCHPILFLRMMDRVKAGAKLIVVDPRRTATAEKADLFLQIAPGTDLALLNGLLHLIVENGHTDREFIAEFTEGWEVMPSFLEQYTPDRVSEITGIPEQDIRAAAQLIGEADNFMSCWTMGLNQSTHGTWNTNAICNLHLATGAICKPGSGPFSLTGQPNAMGGREMGYMGPGLPGQRSVASVADREFVEDVWGVPRGRLRTEVGTGTVDMFSRMADGQIKACWIICTNPVASVANRKTVLAGLERAELVIAQDAYLGTETSEYADVLLPAALWAETEGVMVNSERNITLSQPAVAAPGGAMPDWQIIARIACEMGFSEAFSYSCAEEVFEEIKRFWNPTTGYDLRGVSYERLRRQPLQWPCPPQSTADRNPIRYLNDGVSQTQLVREDGTVPRLAFPTPSGRAVFFARPHLQPEEMPDDDYPFLLNTGRLPHQWHTMTKTGKVAKLNKLNPGPFVEIHPDDAARLGIGEHDRVEIASRRGRAVLPAVVSDRVRPGNCFAPFHWNDAFGEYLSINAVTNDAVDPISNQPEFKACAVTLTKVAVSHPDSAIGTGPSAGHDTPESSPTEVREISVSQVDALGELLGVATSFKPEFNELGRSYLAGMLTGLRSDVGRRAGGVPTLPPSAPFDSRTRLWVDGLLAGLFSRADASQQAALPEPPQPAAQQPPAAPAGATPAPERAPVVVLWASQTGNAEELAADVAAQLAAAELPVALHSMDDFPAAELAATRELLLITSTTGDGDAPDNGSGLWRALTGDAAPRLGNTRYAVLALGDSNYDDFCGHGRKLDARLAELGATRIAERVDCEPDYEQAAAKWVADVIDALTRTPTAVGGDGGATVSARTSPVAAPSRPNTPAPHTYSKKHPLITDMVRNTTLNGPKSTKDVRHLVFNLPEDAVSYEAGDALGVWPRNSDELVDEWLAVTGLDGQTPVEVGEHGLMSLRSALTERIEIAHISRDLVRFVQERTGDAKLAELLKPENKRALADWTWGRQSIDLLAQLPVSASAHEWLRVLKRLQPRLYSISSSPKACPGEVHLTVSPVRYNFQGVPRRGVCSTYLAARSPGDRVAVYLQPSSNFRPPSDPDTPMIMIGPGTGIAPFRGFLQERRALGHRGPNWLFFGEQHAATDFYYRDELEQMREDGFLTELDLAFSRDQQHKVYVQHLMRNRGKQLWSWLQDGAQLYVCGTADPMAKDVDRALCDIAAEFGNLDPDAAKAYVQSLSADKRYHRDVY

SEQ ID NO: 3015 - protein, 160 aa, Mycobacterium paratuberculosis
VRRLIVMVLVLLASGCGWKPPAPPQARPDTCKASDGPTADTVRQAITAVPIAIPGTIWVEIGRGHTRNCRLHWVQIIPTIASESTPQQLLFFDHNTPLGTATPNAKPYITVLPPSDDTVTVQYQWQKGNDQLCCPTGIGTVKFRIGPDGKLQTIGKIPNQ

SEQ ID NO: 3016 - protein, 485 aa, Mycobacterium paratuberculosis
MARTRRIAHWDPEDLVAWEAGNKLIARRNLIWSIATMHVAFSIWYLWSVMVLFMPQARYGFTTGDKLLVGATAALVGALVRIPYAMGTARLGGRNWAVLSSLVLLIPTLAAIVLLAHPGLPLWPYLVCAALTGLGGGNYAAALANVESFFPQRRKGFALGLTGGVGNLGAAGIQAVGLVVLATAGNQAPYWVCAVYLVLLALVGVGAALFMDNLDHSVEVGHVRSVLTVPDTWTISFLYMCASGSFIGFAFAFGQVIAHNLIAGGQTHGQAALHAAEIAFAGPLLGSMARVVGGKLGDRFDGGRVTLTVLAAMIVAGGFLVAVSTHDDLTRPSGAPVSLYTTAGYIAGFIALFICCGVGKGSVFKLIPSVFAQRSRALELGDTERRHWERARSAALIGFAGSFGALGGVVINLALRQSYASTGSSTPAFGAFMLCYVAAAALTWARYVRPRRARAAHRAGLAADGRAAGQLVRASDRFSGCSISA

SEQ ID NO: 3017 - protein, 650 aa, Mycobacterium paratuberculosis
MAPETTSTAEHLRNALDGRWRDVRNRMRETLSEDLFRPHYTPNTVIARTKVAEQMRIMAAFGAAADGFRKEHGGTGDVGAAITMIEMLAMSDLSLMVKAGVQWGLFGGAVENLGTERHHETYVPKIISLELRGCFAMTETGHGSDVQSLETTATYDPATDEFVIDSPTPSARKDYIGGAAETATVAAVFAQLITTEDGKPVNHGVHCLLVPIRDADGNDLPGVTTSDCEYKGGLPGVDNGRIVFDHVRVPRVNLLNKYGDVAPDGTYSSPIENPNRRFFTMLGTLVRGRITVGGSAGAAGRVALDIATRYALQRKQFTTPDGDSEVLIMDYLVHQRRLFPLIAKSYALQFAQNELVSKCHDIQSADDPDADEQRELEARAAGLKAANTWHATRAIQESREACGGAGYMAENRLIALRGDTDVFTTFEGDNHVLTQLVAKELLTAYADDIKSMSPVEWVRFAANAVGDRVIKRTAAETIIQTIVDARQDSEEEGSLFNRGTQIKMFEDREEYLLASVARRLQAKSKEMSEFDAFNSVQDHVLHAASAHIDRVVLEAFVAGIDGCPDEQARELLGILCDLYALSVIEDDKAWYIEHRYLSTERAKAVTRGINDRCRALRPHAQTLVDGFGIPERLRYAEMLHPENLSEALTS

SEQ ID NO: 3018 - protein, 586 aa, Mycobacterium paratuberculosis
MITSKLRAQRPSFRTDEANSTHRLPLRTAARTTGVVAYQLGLSVDGHETLSGISFTAKPGTMTAVIGPSPARNAALLALLAGTRTPSSGRVTVDGHDVHAEPAAMRARIGVVSREERLHRRLTVEQALRYAAELRLPPETSAEQRDRVVGQVLDELDLTTHRDTRIRKLAPEVRRCTALAIELVTRPSLLVVDEPTAGLNAAQQRHVMAVLRRQANLGCVVVAAISSRTSLTDVNMCDQVLVLTAAGKVAYLGTPLQAESAMGSADWSAVLARVGADPDGAHRAFRARPQSAAPTIPPEVAAPWAPPAALPVPRQVRCVARREIRLLLANRLYFAFLALLPFVLAGLTLLIPGDSGLARPAPSSANAHEAIEILALLNVAAVIIGTALTVPAMVGEHRVYRREQQVGLSAPAYLAAKIAVYALAAAVWAAVMLAVVIAVKGAPVYGAVVLHDATFELYVAVAVTAMVSAVIGLALSALGKSLGEVLPLLVPVILAAVLFNGSLVQLVSMWGLQQISWLIPARWGFAASASTVNLRRIDPLAANAETWTHYSGWWVFDMVMLVLFGVAAAGVTLYRLRSPGKIRSAT

SEQ ID NO: 3019 - protein, 162 aa, Mycobacterium paratuberculosis
MDNVVDTAKLEGGQGLGADLLAVVARLNRLATQRIQMPLPAAQARLLATIEAHGEARIGDLAAVDHCSQPTMTTQVRRLEEAGLVTRTVDPGDARAVRIRITADGRRTLNAVRADRAAAIQPQLALLDAEDRQVLRQAVDVLRRLLDNASLASSLAGRRQTS

SEQ ID NO: 3020 - protein, 714 aa, Mycobacterium paratuberculosis
MSPWLHSFAKRGLSAGACRAKHLLQRTLPRPAGRIAQVTLLRFRPAGPGALRPNELAQAAVMGALCAAIEILAAVIPFAQGLGVLGTVPMGLLAYRYRPRALMAATVAGGVIAFLIAGLGSLFMLVDCAWVGGLCGIVKRKGRGTPTVALLSLIAGVLWGAGWVAVLAVLTRLRHLFFDVITANANGVAAFLNWMHLQGVGAGLKRYVADGLQHWPLLIFPYMILLVVVVSFISWSALSRLLDRMRKIPDVHKLDPPDDGHAAIGPVPVRLENVRFRYPGAEQDALREVSLDVQAGEHVAVTGANGSGKTTLMLILAGRQPTSGTVHRPGAVGLGEVGGTAIVLQHPKSQVLGTRVADDVVWGLPPGTDIDVHRLLREVGLDGLAERDTGSLSGGELQRLALAAALARDPKLLIADEVTTMVDQQGRDALLGILSGLAKRHQTALVHITHYDNEAASADRVIKLSDSPDNAVAAETNAAAAPAVAVQHGSGVPVLELIDVSHEYASGTPWSKVALRDVSFVVEQGDGLLIHGGNGSGKSTLAWIMAGLTTPTSGSCLIDGRPTHERVGEVALSFQSARLQLMRDHVDTEVASAAGFSPTDQDRVAEALMSVGLDPAMGKRRIDQLSGGQMRRVVLAGLLARSPRALVLDEPLAGLDIGSQRGLLRLLENLRRERGLTVVVISHDTVGLEELCPRSLYLRDGALQTASTAAGGMP

SEQ ID NO: 3021 - protein, 252 aa, Mycobacterium paratuberculosis
VTAPSDTQSAAGRTRRPPRPVVLLVPVPGTSKIHELWAGTKLLVVLGVSVLLTFFPGWVTVGLMLALLVAAARLAHIPRGALPSPRRWIWIVLAVGGITAALGAGSPVVSIAGLHIGLGGTLHFLRVTALSIVLIGLGAMLSWTTNVAEMGPALATLGRPLRWLRIPSDEWAVALALALRAFPMLIEEFQVLYAARRLRPNQTPRSRRARRRQQARDMIDLLTAAIVVTLRRADEMGDAITARGGIGQLSAA

SEQ ID NO: 3022 - protein, 148 aa, Mycobacterium paratuberculosis
MDRLDDTDERILAELTEHARATFAEIGDKVNLSAPAVKRRVDRMLDSGVIKGFTTVVDRNALGWNTEAYVQVFCHGRIAPDELRAAWVDIPEVFSAATVTGTPDAILHVLARDMRHLEVALERIRSSADVERSESIVVLSNLIDRMRP

SEQ ID NO: 3023 - protein, 289 aa, Mycobacterium paratuberculosis
MTDQYVRAARPVPRSAARTGRVHRLPSVRRYAMTRPSFFAVDYAINPWMDITTPVDAGRAQAQWGALRRTYLRLGHRVDVIEPVAGLPDMVYAANGGFIAGDVAIVARFRFAQRAGESRAYAEWMRSLGYRPVLTRHVNEGQGDLLKVGDIVLAGWGFRTDRRAHPEISAALRAPVVSLELVDPRFYHLDTALAVLDDRTIAFYPPAFSDTARRQLGALFPDAIVVGPADAHVLGLNVVSDGLHVVLPSAATGFATQLRRAGFEPIGVDLSELLKGGGSVKCCTLEVFP

SEQ ID NO: 3024 - protein, 412 aa, Mycobacterium paratuberculosis
MTILDGQLTATRVDSAIRLAEKRAAHNYSPLPIVAASAQGAWITDVDGRRYLDCLSAYSAVNFGHRHPEIVATAHAQLDTVTLVSRAVHSDKLGPFCAALAYLCDKDMVLPMNSGAEAVESGLKVARKWGAEVKGVPAGQANIIVADNNFHGRTISIVSFSSDAAARDGFGPFTPGFRSVPFGDAGTLAQAIDDNTVAVLLEPIQGEAGIVVPPDDYLPAVRALCSEHNVLMIADEIQSGLARTGYTFACDRWRVVPDVYLLGKALGGGVVPLSAVVADREILGVLHPGEHGSTFGGNPLAAAIGTTVVSMLARGEYQARATALGAHLQRRLRALVGHGVDEVRGLGLWAGVDIDPSLGSGREMSLRLAERGVLVKDTHGATLRFAPPLVVTAQEIDWAVGQLAAVLREAAS

SEQ ID NO: 3025 - protein, 483 aa, Mycobacterium paratuberculosis
LPATPIGLRAQLLRRRPVVGAHVAPGTADHLRRGIGTFQLTMFGVGSTIGTGIFFVMSQAVPEAGPAVIVSFLLAGVAAGLAAVCYAELASAVPVSGSSYSYAYTTLGEVVAMGVAACLLLEYGVATAAVSVNWSGYLNKLLSNVVGFQLPHALSAAPWDAQPGYVNLPAVMLIGMCALLLIRGASESAKVNAIMVMIKLGVLVVFGILAFTAFDVHHLDDFAPFGVAGVGTAAGTIFFSYIGLDAVSTAGDEVTNPQKTMPRALIAALSTVTGVYVFVALAALGTQPWQDFGGQQEAGLATILDHVTHGSWASTILAAGAVISIFSVTLVTMYGITRILFAMGRDGLLPPRFARVNPRTMTPVNNTVIVAVAASTLAAFIPLQNLADMVSIGTLTAFVVVSVGVIVLRVREPDLPRGFRVPGYPVTPVLSIMACGYILASLHWYTWIAFSGWVLLALIFYFVWGRHHSALNDAAVDPSGQER

SEQ ID NO: 3026 - protein, 445 aa, Mycobacterium paratuberculosis
VTRPRFSTLVAGAVALVAALLAAAAVLLDYSGQPHGDKTIVTVRVWGDELAEAYRQSFAAFTRAHPDIEVHVNMVAYSTYFNTLRTDVAGGSADDIFWLSNAYLAAYADSGRLLNILDTLGTNAAADWERPVVEQFTRHGQLWGVPQLTDAGIALYYNADLLGAAGIDPAQLNGLRWDPAGGDTLRPLLARLTVDADGNRGDTRGFDPGRVRQWGYNAANDPQGIYLNYIGSAGGVFQRGDEFAFDNPAAVSAFRYLVDLINRDHVAPSAADTNDNGDFSRNQFLAGRMALFQSGTYNLAPVARDARFRWGVAMMPAGPVGRVSVTNGIAAAGNAATKHPAAVRQVLAWMGSRQGNEYLGRYGAAIPAVTSAQPVYFRYWASRGVDVTPFFAVLNGPRIAAPGGAGFAAGNDALRPYFDEMFSGRGDVATTLRRAQAAANAAARR

SEQ ID NO: 3027 - protein, 275 aa, Mycobacterium paratuberculosis
MTSPDRARANIAIYAGLLVGALITLAPFTLGLLTAFTSAHQFVTGTPLQLPRPPTLSNFADLAGAGFGRAAAVTALMTAVILVGQLTFSVLAGYAFARLRFPGRDALFWVYIATLMVPGTVTIVPMYLMMAQLGLRNTFWALVLPFMFGSPYAIFLLREHFRMIPNDLVNAARLDGAHTLDVIVHVVIPSSRPVLAALALITVVSQWNNFMWPLVITSGHKWRVLTVATADLQTRFNAQWTLVMAATTIAIVPLVTLFVIFQRHIVASIVVSGLK

SEQ ID NO: 3028 - protein, 294 aa, Mycobacterium paratuberculosis
MASAERRVAPRSTALGYALLAPSLFGVLAFLLLPILVVIWLSLCRWDLLGPLRFVGLSNWRSVLTDAGFGNSLMVTAVFVAMVVPAQTALGLLAATMLARRLPGTGLFRTVYVLPWICAPLAIAVLWRWILAPTDGAVSAVLGHSIEWLSDPSFALPLVSAVVVWTNVGYVSLSFLAGLLAIPEDIHAAARTDGANAWQRFWRITMPMLRPTTFFVLVTGIVSSAQVFDTVYALTGGGPAGRTDLVAHRIYAEAFGSAAIGRASVMAVVLFVILIGVTLVQHLYFRRRISYDLT

SEQ ID NO: 3029 - protein, 505 aa, Mycobacterium paratuberculosis
VTPNRGIDADFLDLPRHELADAALSAATAAGASHADLRVHRLITEIIQLRDGELETAVINREVGLAVRVIVDGTWGFASHAELAPSVAAETARRAVHVATTLATLSSERVELAPEPVYRDATWVSSYRIDPFDVSAADKIGVLGDYSGRLLAADGIDHVSALLTAVKEQTFYADTFGSSITQQRVRVLPSLEAVTVDAQAGSFDSMRTLAPPMGRGWEALAGDEVWNWTDELAQLPSLLAEKVKAPTVAPGPTDLVIDPTNLWLTIHESIGHATEYDRAIGYEAAYAGTSFATPDKLGAMRYGSPVMNVTADRTVEFGLATIGYDDEGVAAQSWDLVRDGIFTGYQLDRVFARRLGHPRSNGCSYADSPHHVPIQRMANVSLQPAPEQISTDDLIARVEDGIYIVGDKSWSIDMQRYNFQFTGQRVYRIRGGRLDGQLRDVAYQATTTDFWNSMEAVGGPATWRLGGAFNCGKAQPGQIAPVSHGCPSALFRGVNVLNTRTEGGR

SEQ ID NO: 3030 - protein, 457 aa, Mycobacterium paratuberculosis
MITPQHVVNVVLDEAAKLGGADETMVLVTDKVEATLRWAANSMTTNGVSVSRSVTVISVVRRGSGARIGTVVSAEADPRVLPGLVAASQQAAASAPEAGDAAPLLADAGEPADWDAPVPGTGPLIFADLDDSLGRGFRGTDRLYGFAHHSVSTTFVATSTGLRRRFTQPTGAVEINAKRGDASAWAGVGTPDFVDVPTDSLLEQLSTRLGWARRSVELPAGRYETIMPPSTVADMMIYMAWSMAGRGAQEGRTAFSAPGGGTRVGERLTDLPLTLFSDPMAPGLICTPFVAVSSSSETVSVFDNGMPIDHVDWIRDGVITALAYPRATAAKYDVDVAVAADNLVMTGGTASQADMIAATERGLLLTTLWYIRVVEPTTLLVTGLTRDGVYLIEDGQVTAAVNNFRFNESPLDLLRRATEAGVSEKTLPREWGDWATRAAMPALRIPDFHMSSVSQAQ

SEQ ID NO: 3031 - protein, 288 aa, Mycobacterium paratuberculosis
MAAPVSLREDQLTRLVAVFPGSPSEARVAALIRRVCAQTSSLPPLPAPMEVGEPESETEAAVAEFAEQFSADVSAITHAQRSRLSKQLGDRTFGVVVQMYIADFVLRVRAGLEALGVGSRYLGWLSGPISWDHGSDPSDLVFNDFLIVVARMRALDPVTSELVRLRGAAQHHCRLCNSLREGSALDAGGSETLYEEIERFESSGLLDERAKAALRYTDALIWTPAHLVADDVAEVRSRFSEAEAVELTFDIMRNASNKVAVSLAADAPRVENGTQRYLIGADGQTVFS

SEQ ID NO: 3032 - protein, 166 aa, Mycobacterium paratuberculosis
MNKYVDDLTPGVRRKQSHWCAEGGSQMTTGTRSQLRVPAVWVAGVALGASMLGAAVLSAPQASATCNLSDKDDQYINLLAQNKMVHNADYSDCHEAAEGRWFADQVRSNPNSFGEAQELVNMITNTTPLSQAQAEWEVESAIYVYAPDLIPKIKDQASKANWPTEG

SEQ ID NO: 3033 - protein, 128 aa, Mycobacterium paratuberculosis
VTTRPSSMPFRPTGTTPHRRATRRHLHGRGRGAYCGKPRPVVVVQDDRFDATASVTVVPFTTSDVDAPLFRIVVQPSETTGLAETSRLMIDKITTVPRASLTRRVGRLPDGDIVRLDMALLVFLGLAE

SEQ ID NO: 3034 - protein, 484 aa, Mycobacterium paratuberculosis
LSRDDWISADEGPRRTVSTTIPVFNPSTEEQIAEVPDSDQAAVDAAVARARETFELGVWRKAPASHRANVLFRAARIIEERKDELAALESQDNGMNLTAAGHIIPVSVDMLKYYAGWVGKIHGESANLVSDGLLGTWETYHTFTQLEPVGVVGLIIPWNGPFFVAMLKVAPALAAGCSAVLKPAEETPLTALKLEEIFREAGLPDGVLNVITGYGETTGAALTAHPDVDKISFTGSTEVGRLIVKAAAGNLKRLTLELGGKSPLIMFDDANLDKAIMGAGMGLLAGSGQNCSCTSRIYVQRGIYDQVVEGLAEFAKMLPMGGSDDPNSVLGPLISEKQRQRVEGIVNDGVAAGAKVITGGKPMDRKGYFYEATIITNTTPDMRLIREEIFGPVGCVIPFDDEDEVIAAANDTHYGLAGAIWTENLSRAHRVVNELRAGQIWVNSALAADPSMPISGHKQSGWGGERGRKGIEAYFNTKAVYIGL

SEQ ID NO: 3035 - protein, 304 aa, Mycobacterium paratuberculosis
MRVVRLFAAVLTILTAGLLWATPAGAQPPTKLTDHLTDSNRVLTDSDRAAVSSAIDRLYRDRHIQLWVVYVDNFNKFKPDNWADRTRSESGMGDRDVLLAVATNTKLFTLNPPPQLQNPTADELNSLRTNKIGPAVSAKNWAIAAIAAADGLDTSPSVSHPASPAKRAWLPIAIAVIAVVVVVVLLLVLYRARRRRRAARGVGPGGPQDRSLGEALSTAEARLRQISDYVARHHDSVGADARSRLDEATRHLAAARAKQASNDTEAIAHANRASTLAAEAQHLANDDVLGAHRTTRRRGAASKR

SEQ ID NO: 3036 - protein, 479 aa, Mycobacterium paratuberculosis
VNLGFLDFTSIEQRRADCDEELRLNRRFSPQVYLGVVDITEQNGHYRVGGEAGSGEPAVWMRRLPEDGMLPAKLAGGDVDTRLARRIGRTLAKLHGRAETGPDIEAYGSPSSVIANWQENFDQMGPFIGRTISPAINDEIRSYVQEFVGQQAALLERRVTEGHVRDGHGDLHAASVCIADGQIVLFDSLQFAPRYRCADLASEVAFLAMDFEYHGRGDLAWAFVDSYVRASGDDELPSLLDFYMCYRAYVRGKVRSLRLAQTEKVPGGEQEALIAESRGYFDLAWAHAGGLPRPLMVVTMGLPASGKTTLARALAGRLGLVHLSSDVARKRMAGIPPTRRGSDEFGSGLYDPAMTRNTYAALRRDAARWLRRGRGVVVDATFGNPGERAQLRQLAHRLGVDLHVVLCDADDDTLIARLKRRATEQGVVSDARIELWPQLRAAFTPPDEQASVLRVDATRDTEETVEQALGLLRARYRSS

SEQ ID NO: 3037 - protein, 495 aa, Mycobacterium paratuberculosis
MADSPAATSPTLVAKQTNVRRPRWDRDHPRYKWVALSNTTLGMLLAMINSSIVLISLPAIFRGIGLNPLAPANIGYLLWMLMGYLVVTAVLVVFVGRLGDMFGRVRIYNAGFAVFTVAAIALSFDPFPLTGGAVWLIGWRVVQGVGGAILMALSAAILTDAFPSNQRGMALGFNMVAAVAGSFLGLLFGGLLSEWDWRAIFWVGVPVGVLGTVWGMRSLHELGVRTPGPLDWPGTVTFGVGLTVVLVGITYGIQPYGGHPTGWTNPWVLGSIAFGLLLLIVFCFIELRAPQPMVNVRLFRSAGFGMGNLANLMSSSGRGGLQFMLIIWLQGIWLPLHGYRFESTPLWAGIYMLPTTIGFLIAAPVAGWLADRFGARPFAVAGMLLMAVTFIGLLMIPVNFDYRVFALLIFLNALGGGLFAAPNTAVIMSSVPPRDRGAASGVRSTFFNAGSALSIGVFFSLMVVGLAGTLPHALSSGLQQQGVSAAVAQDAAALP

SEQ ID NO: 3038 - protein, 231 aa, Mycobacterium paratuberculosis
VTVPHRQPLYLLADSQLLFWKRHDRPLVQAALDGLARDKPLSAAYIGASNGDRPEFYDIFEPAMEAIGVTERRMIASSFGPADRAFLDGAHLIVLAGGDVQRGWNTFERTGMKDAILDRYAKGTVLVGISAGAVQLGRYGIIGTPPEHRLLDVFNLVPAVIDTHDERTGWARLSRAIQSLERAALGVGIPSGGGAVVHADGTLEPVRRPAHEFRVVNAHLAHKLLPVGTGD

SEQ ID NO: 3039 - protein, 3051 aa, Mycobacterium paratuberculosis
MSTLLPVELGVLGPLQVRRHGTPVAIPGAKPRAVLTMLGLHGGALVSADALMELLWGEEPPRTAAKALQTHISSLRRILGDGVVLTQGAGWILADADVDAARYKVAARRGRDAAAAGDNGRAVACFDEALALWRGIPELPDGRRGTSEKTRWIEGHAALVEDRADALLATGRAAEIIGELEAAVAEAPLRERRWGQLMLALYRAGRQGEALGAYQGARAQLADELGVDPGPELRRLESAIVAQDTSLDVLVVQNLSSVTRAVTFLLTDIEGSTAAWEADAAAMAVALARHDELVEQVVTSRGGRLIKTRGEGDATFSVFDRPSAGAAAAVELQDAIGHEPWALREPMRIRVALHTGEAELRDGDYFGRAVNRAARLRSLAAGGQILCSGATAELVIDTLPDDVVLTDLGMRQLRNLPRPEHVFELRLETGAQAAPPVQPSAAPMERPGLPAVLLGPGPFVGRGRELDGLLSAWQSTLAGDMQAVLIAGEPGVGKTRLAGEWSRRVYEQGAVVLYGRCDEDLGAPYQPFAEALRMLVPCLGPDRLRGLRGVEALLPLVPGLTDVLPDLPTPTRADPDTERYALFDAVVALLAAVSAGAPVVLVLDDLHWAAKPTLLLLRHLLRFGEHARVQVVGTYRSTDLDRSHPLAAMLADLHRSAGFEPSNRLQLNGLDEQDVAAYVAEAGYDDDELARALASVTGGNPFFLIQALHHVDESGGRWDQSTLPQGVREAVSRRLSRLSPETNKALATAAVIGSRFALELVESVVGEDQVDAFDEACQAGIVIEEPGGRYRFNHAIVRQSLLAELSSVRRMRLHQRIATTLENQPGAEDELLAELAHHYFECAWAGNAAKAVQYCRRAADQAMTRLGYEGAADLYDRALHALEEIDDELPDRDDQVTELLIARCEALLAAGDVGSAVGAVSQLQSATVDSARLSAWATCFDGQLSILSHPERLDEVEAAVGAAAARLAELDDAAGEATAHTVRAGCLARLGRIGDCEIALDNALTAARRAREHRRVNAVLANAPLAALWGPNPVPRAGGRCLDVVRLLRITTDSPAVEATSTRCQAVLEAFRGRAAAARRMIDSARRTVTELGLRHALLEVEQFAGIVELVADDAAAAEPHLRKAYNGFRRMGLDADTAETAALLGRACLVLDREAEADELCTESERLAGHALKASIAWRALRALLLSRRGDYDEARRMAEEAVSVAGHTDLLVDHGGACLTLATVLNAAGETAGARAAAGRAVDLYERKGAAALAERARRLLGEHTVPSAPTPPRSPSVELDTAATRVGERVMAAVHRKDWDEFDRLFAPNVSIENRRKIVGVGFPSDAMRREVRRELEAGVTRIDHVMVAARGERVALSRMITSAVDESPGAPHDELLQVYAVDENSQVVRQVWFDVEDMDAAMAELDAAYARFEKRCPRPPLENGATRAYERLHAYFKARDWDAITDLLTDDYCGDDRRSVVGAGIRRGPDAAIEDYRSAADIDVTDAGSDTVATRGARLALARAHYARNGKESEAFRVDFLQLVEIDSDGRIAAMAAFDLDDFDAAIAALDTRYLAGEASAHARTWSVIAEGYAAFNRHEPPPTTPDCVSIDHRRGTAFAPGELFSYMRAAWDDTPDLTSYIDAVHRLNDMGALVTHVARGTSPEGVDAEWRYHHLLMVDGESITRSELFDESALDAALARFDQLTRPAPRLQNAASQADQRFWKHFPVRDWDAMAATLADDFLLDDRRQALNAGNRRGRDTEIANLKVMADLVGQGNVTSNVIAIRGERLALRRLRFSEQDRNPEAFYTEMIGIVEINADNRLGAHIAFDPDDITGAIAELDARYLAGEAAPYARTWSTIAGALVAHNRREVAVATPDAITLDHRRAVAFGPDEGSDFLRAGWELDQHLDLYVETVHRVTEVGAVFTWAGYGTSHDGFDAEWRAVDLMTVDGEMISRVEVFDESDLDEALERFDELTRPEPRLENGASRVVQQFLAKFAARDWDAMTEMLSHDISTVDRRRVVNAGIRQDRDAEINDFRSAADLDVTNATSDVIAIRGERLALIRSQVSRGDVDTEAFHVDLLWLLEIGSNQKIAGWATFDPDDFDAAVAELDARYVAGEASAHSRTWSVILRAYDALNRRETPPTTSDWVTIDHRHASSFPPGGLPALLAEWQLASDVSSAVEAVHRLDSLGAVFSTVSHETSREGFKAEWRSIAVITVDRDLVDRLEVFDEADVDAAIARFDELHPHPGRLENAASQTYERFRSCFAARDWDAMARLLTAETTVDDHRRVVSAETRRGRDVEIANMRAFAGLGATRSTATVIATRGERLVLCRTCIRGEDQQPGGFHIDMLIIVETSADKRILARVAYDPDDIEAAFDDLNARYVAGDAAAHAHTWGLVTAAFAAINRHELPEISPDWVNIDHRRGATFAAGDMTSYIHDVFDDAPDFHVDVAAVHRLSDLGAVVTMASHGTSTRGFQAEWREIGLLTFDGELLSRCELFDEADLPDALARFEELHRPAPRLHNTASEVSDRFLAYFAARDWDAMANMTADDFASDDRRRVVGAGIQSGRDVDMNNMRAWAEVGITKIASDVIAIRGQRLFLGRTRFFGREQGPGAFHSEVLGLVELDAEDRMLARVVFDPNDIDAAFEELDARYLTGEAAAYARTWSLLRASDAALDRYEVPAHTPDWANVDHRRATAFEPGGLIAYLRAGWDLAEDVKNHILAVHRMTERGAVVTHLAHGRLRNRSDVEWREVALVMFEGDLVSRCELFDEADLPDALARFEELHRPAPRPENVTSRLIELFLAHFAIRDWDAMAELLADDFYSEDRRRTLNAGIRRGRDAEMANWHATGDVWMSDVSSTVIATRGAHLALFRFAFASQEHEPEAFQAAALGVVQASDDNQATASIVFDPDDFDAAFEELDARYLAGEAAAHARIWSVITRAYSRTNRCELPDMTTDSVLIDHRTTVTTEREPLPGFLPSLWEIMPDLSVYIEAVHRLSDRGAVITQVARGTSQQGFDAEWRAIVVGILDGDLYTRIEAFDDTDLDAALTRFDELSAEVRPK

SEQ ID NO: 3040 - protein, 891 aa, Mycobacterium paratuberculosis
MAPERLRRRTVTGAGRMVPGGAAPTWPRTRPFTLVSMDSDRDDSAAIRRDRRELDRMHTQLDELMAARDQLEQLVRVIVEIGSDLDLDVTLRRVLKAAMELTGARYAVLSSRASDGALLSFVHAGLDADTARQLGELAVGDGLRIDDVSVDARSAHLSAHDPPLRALLGIPITVRAANFGNLYLADDRQGRVFTDSQEGAVRAMATAAAAAIDNARLFERERESAKWTKASREITTALLSGDPQTGPLQLIVNRALELAGAEQAILLVPREPESPGREADTLVVSATAGRYASQVIGRQVPMDGSTTGGVARRGLPLITDSFQYPIEGFTDVGERSAIVIPLIADGAVLGVIAVARDPQQPPFGNDYLDLVSDFARHAAIALALAAGRQHALNQELAQADTVDEAVRAAAEELRRLWRARRVLAVTFPSHTSATETAFGPPEVVSVGEPTQWADLPSHMHQALGALRDGDLLTPNTTQPGTAGIALQHPDGVLVVWIDLTDERSFTLEDQTLLTVLAGRLGQGLQRVHQVDQQRETALALQHAILGPADLPNGFAVRYQAATRPLQVGGDWFDIVDLEDGRVALVVGDCVGHGLASATVMGQVRSACRALLLENPSPAAALAGLDRFAARLPGAQCTTAVCAVLTPDTGELVYSSAGHPPPIVVHGDGSTQILDEGHTIALGIRRDWPRPEARVTIPARATLLLYTDGLVERRRSPLDRGIYRVATVAQDARGSSLDELATRIMSAVAPSGGYQDDVVLLLYRHPAPLELNFPADVNQLAPTRTALRNWLRRVRLDPEQTLNVLVAAGEAVANAIEHGHRHSPQGTIRLGATALGDQVRLTITDTGTWKVPQATSYPHRGRGIPLMKSLMNDVDIRSDTGGTTVQLSARIT

SEQ ID NO: 3041 - protein, 109 aa, Mycobacterium paratuberculosis
MVTPLTLDTGRGSDGNPVLVAVGEIDLSNIDAFHRALATATAEVTGSDGAVLVDLSAVEYVDSAAINALAAHADHIALVAHPVLMPVFRVSGLTELTTVEAAPPPPAPR

SEQ ID NO: 3042 - protein, 310 aa, Mycobacterium paratuberculosis
MPRTDNDTWDLSTSVGATATMVAAARAIATNADNPLIEDRFAEPLVRAVGVDFFTRWVTGDLVAADVDDHDSGWKLEHMPVAMAARTRFFDSFFQAATQAGIRQAVILASGLDARAYRLAWPAGTTVFEIDQPQVIEFKTATLAKLGATPQATLRTVAVDLRDDWPKALVEAGFDKGQPTAWIAEGLFGYLPPEAQDRLLDNITALSADGSRLACEAIPDMSEVDTEKAQEMMRRATAKWREHGFDLEFGDLGYQGERNDVAEYLDGLGWRSVGVPMSQLLADAGLEAIPQTNDSVSVADTIYYSSVLAK

SEQ ID NO: 3043 - protein, 212 aa, Mycobacterium paratuberculosis
MTAPQRRGLNDVVTRMWSFLAPAYDLPFLQQWVYRPPHNEVIAQLRNHGSRRIADIACGTGILSERIQRELNPDEIYGVDMSDGMLNQARAKSDRVQWLRAPAEQLPFDDGALDAIVTTSAFHFFDQPAALREFHRVLAPGGLVAVSALSTRRPLLQASADSRWKPQHNASAPEMRKLFEDAGFVIGDQYRIPRPAWTRLVSDLLTVGTKPD

SEQ ID NO: 3044 - protein, 237 aa, Mycobacterium paratuberculosis
VSSTPHPAEPHIGSVSSKLNWLRAGVLGANDGIVSTAGIVVGVAAATALRAPILTAGSAGLVAGAVSMALGEYVSVSTQRDTEKALLIQEHQELRDDPAAELDELAALYEAKGLTAATARTVAEELTDQNPLLAHAEVELGINPEELTNPWHAASSSALSFAIGALLPLIAILLPPPTWRIPVTVVAVLIALVITGAVSARLGGAPQLRAVARNAIGGSLALAVTYTIGHVVGAAID

SEQ ID NO: 3045 - protein, 285 aa, Mycobacterium paratuberculosis
VKGHAVAEPNVVPDQPRWADGLPYFVRDGNDLVPTEIARGGWGPSLSGHVVGGLLAWAVEQAAPDAGLQPARLTVDLPRPTALEPLRVHTQVRHDRRRLWLVEAVISQNDAVVAQASALFLRRGPQPDGRVWSPPVQMPPLPPDQTYSTLFMRTYGWGSQVQNPDPHWPQTDGPKYTWIHETRPLIDDEPLSAFTRAAMAGDITASIANWGSKALQFINADYTLTLSRLPEGDHIGLASLTHHSHDGVASGSAVLVDTAGPIGTGLSVAIAHSGFRPPSADPSAG

SEQ ID NO: 3046 - protein, 510 aa, Mycobacterium paratuberculosis
VTFWSLIAEAARRGSPRPLLADEHGRSMTARQLYDAACVAAAALAERGVRRGAVVSWQLPTTLETMVLMAALARLGAVQNPIIPVLRESEVRFITGQLNTEYFVAPGLWRGFDHGGLARALSAERGFEVITVDLAAPPAAGALRLPGADPDSLPAPPQSADEARWIYYSSGTTAAPKGIRHTDSSVIAGSAGVVGMVGATSSDVDPIAFPVAHIGGAAMLATALLTGMWLVLFEAFDPAATPLAIAAHNPTFLGTATPFFVAYLEAQRAQGNRPLFPSLRGCLAGGAPITAELSRRVRDTFGVAGIANAWGMTEFPCATSPSLTAAPEVLDHTVGPPVPGVEVRVVDGAENELAAGQEGELRLKGPQCFLGYADPTLDADAFDDQGWLRTGDLGLIDADGNVRVTGRTKDAIIRNAENISALEIENALAAHPAVADVAVIGIPDPRTGERVCAVVVPATADGVTLESLVQHCRSRGLSRYKHPERLVVVDTLPRNQFGKVIKKDLRDAFG

SEQ ID NO: 3047 - protein, 206 aa, Mycobacterium paratuberculosis
MSVARRERAALVETLRGVGPDAPTLCEGWTTRDLAAHLVIREYRPDATPGIMIPFLASHTAKVQSQVTEQNDWDELLDKVAAGPPVYSPFKLLDPVANVGEMFIHHEDVRRAQTDWTPRALEPALARTLRRALPLMARLTLAKVPARVALRTPEGKTVLTAGRGPAVTVTGAPEELLLFAVGRAARVDFEGDAAAVQAVRDAPKGL

SEQ ID NO: 3048 - protein, 644 aa, Mycobacterium paratuberculosis
MNARVEQLEFQAEARQLLDLMVHSVYSNKDSFLRELISNASDALDKLRLEAFRNKDLDVDTSDLHIQIEVDKDARTLTIRDNGIGMTRAEVVDLIGTLAKSGTAELRQQLREAKNAQNEAASEELIGQFGIGFYSSFMVADKVELLTRKAGESEATKWESSGEGTYTIESVENAPQGTSVTLHLKPEDTEDELHDYTSEFKIKSLVKKYSDFIAWPIRMEVERRTPATEEGGEETVTREVETLNSMKALWARPKDEVSEEEYKEFYKHIAHAWDDPLEVIAMKAEGTFEYQALLFIPSHAPFDLFNRDAHTGIQLYVKRVFIMGDCDQLMPEYLRFVKGVVDAQDMSLNVSREILQQDRQIKAIRRRLTKKVLSTIKELQSERLDDYRTFWTQFGRVVKEGLLSDFDNQETLVQLCSFASTHSEEEATTLAQYVERMKEGQTQIFYATGETRQQILKSPHLEAFKAKGYEVLLLTDPVDEVWVGTVTEFDGKPLQSIAKGEVDLSAEGEESQAERDEQQKEFADLLAWLKDTLSDHVKEVRLSNRLTDSPACLITDAFGITPALARLYRASGQDIPVGKRILELNPKHPLVTGLRQAHQDRADDPSVAETAELLYGTALLAEGGALDDPARFAEILADRLARTL

SEQ ID NO: 3049 - protein, 71 aa, Mycobacterium paratuberculosis
MAEFRVIDPHGRVVATQNFAAAEAAHAWFVHSVGGNTELGWRMEVNDDGQWAFFDDTEGFTAPVSRRPERR

SEQ ID NO: 3050 - protein, 341 aa, Mycobacterium paratuberculosis
MHVDAMTVLQPLGQIGDLARRTQSAGFSGLLFTETGRTAYLNAAVASQAAPGLELSTGVAVAFPRSPFVTAAVAWELQEATEGRFRLGLGTQVRTHVVRRYGAAFERPGPRLRDYLLAVKACFAAFRSGTLEHHGDFYDLDFITPQWSPGPIDAPDPKVDIAAVNPWMLRMAGEVADGVHVHPIGEPGYLARHVLPTVAEGAAKAGRSPSDIAIIVPVMTIVGDNDEERDQQREAVRASMAFYGSTPNYAFIWDEAGFEGTTARIREKQKAGDYAGMAAQVSDDHIAVFATESTWDGLADALIEKYSGTATRLVMYNSAADPERFERYGEVARRIQHAVSG

SEQ ID NO: 3051 - protein, 551 aa, Mycobacterium paratuberculosis
VSSAGENTRRAEPVEPRGAAVLDSAHLGDIEGAFGRIRVGETEHARTWKTRLLTLLAIVGPGIIVMVGDNDAGGVATYAQAGQNYGYSLLWVLLLLVPVLIVNQEMVVRLGAVTGVGHARLINERFGRGWGWFSVGDLFLLNFLTIVTEFIGISLAAEYIGVSKYVVVPVSAAALVAIMASGSFRRWERAMFIFIAITLLQIPMLLMSHPQWGRAAKSFVVPSISGGVSSDAVLLIIAIVGTTVAPWQLFFQQSNVVDKRITPRFMGYERADTVLGAFVVVIGAAALVMTGDWAARSTDTVGGFTDAGATAHLLGQHRQVLGSIFAIVLMDASIIGAAAVTLATSYAFGDVFGLKHSLHRGFADAKQFYLSYTAMVVVAAAIVLIPGAPLGLITTAVQALAGLLLPSASVFLLLLCNDREVLGPWVNRAWLNWVAGLIVGTLLLLSGILMATTLFPDLNVVAVAGYLTLALIILAAGAAPVLRWLARRQPARPGPRLPARGVDRSTWRMPPLALLEPVTWSPGTRLAMIALRGYLVVGALLLVVKAIQLSR

SEQ ID NO: 3052 - protein, 440 aa, Mycobacterium paratuberculosis
VGTSEDKAPGQPVIHLSQLLRAPVLARSGETVGRVEDVIVRLRGADEYPLVTGIVAGVGGRRVFVGDKSIHEYSADRVLLTKNKIDLRGFERREGEVLLRTDVLGHRLIDVATVELVRAYDIELEQTTAGWMVARLDTRRPPRLFGLIKHSGGHASRDWKAFEPLIGHARSDAVRRLSDRFGELKAAEIADLLEEADKAEGGEILDRVHSDPELEADVFEELDPEKASRLLDEMPDDEVAALLGRMRADDAADAIVDLRQSRRRRVLDLMPAPQRTKVITLMGFNPESAGGLMNVDSVSCAASATAAEALALIASSHSIQPEALIKVHVLDEDRRLDGVVWVITLLQVDPSETLERLMDSDPVRVNADADLTDIALLMADFNLYSIPVVDEQDHLLGVVTVDDVLEATIPEDWRRREPAPRPIREITTAEDRPLPGGNAP

SEQ ID NO: 3053 - protein, 247 aa, Mycobacterium paratuberculosis
VRRLAATLAATGMLVAGCGAGNHGAAPSSTATGSTASPKTPLARAALPDLMLSPNDIDTALGVTGTTSDPPFTALGEDPVRRTDYTFPAECKYTTHAGLASEYAGSGSTAVYGYHDLAPTPAGANQLESPEVYQFVVLFPSPEQASAFLSASSARWPACANRQDTVPADGTNPELRWKVGPVTNANGMLSTQVTVTVNGNGVNVTMPCQRALTARNNVVIDVDACRKDVGDLGIDIAKQIAGKVDKQ

SEQ ID NO: 3054 - protein, 122 aa, Mycobacterium paratuberculosis
VSVVQFTSVSPIVPVRDLDVALDRYRRLGFDARAYQGPERYGFADRGSVSIHLTEWDEHDPSRTAASVYFYVGDADALYAEWAALDNLGGRLLAPHDTPYGLREFAYVDPDGTAHRVGSPRS

SEQ ID NO: 3055 - protein, 317 aa, Mycobacterium paratuberculosis
LSLGAKTRVAGVDTHGRELVGRTDIATVLAVAAALMVGAGDVAQQQSAQQVTDQPVGTVALFRRLLRDRRWWTGSLVAAGGFGFQAAALGFGSVVLVQALLVTSLLFALLISARVNHRRITGRQAVWALLLAAAVAVVVTVGDPQEGTPRGSLQTWTIVALVMGPALVGCVLGARLYPGPVAALLLGLMSGSLWGLFAVLTKGVVDQLDRGIPALLRTPELYVWVLLAIAATAWEQSAFRAGPLTASLPAVTVAEPVIGSVLGVTVLGETLRTNGIGLVALGISVAVMAAATVALARSQAASAPTADETPPFSTEKT

SEQ ID NO: 3056 - protein, 130 aa, Mycobacterium paratuberculosis
MTTRSAAARDATELAAYRVAAMLLGVGTLHFLAPKPFDSIIPAELPGSPRLYTYGSGVAELTVGALLVPRRTRRAAALAAAILFIGVFPGNLNMVRLWWDKPWPMRIAALARLPLQIPMITTALRIRRNS

SEQ ID NO: 3057 - protein, 391 aa, Mycobacterium paratuberculosis
MGTPVIVGAVRTAIGRSFKGTLVNTPPETLITAVLPEVIRRSGVDPAAIDDIIFAESHYGGGDLARYAAAATGLEDIPGQSVNRHCAGSLTAIGNAAAQIGSGMERVLIAGGVQSLSMTPLVNWRIPGPELKFEERWMPPTHVEAPDAPTRDMSITVGWNTAKTVGITREEMDAWAARSHQRAIAAIDAGKFVDEILPLKITQVDGSVTEFAIDEHPRRDTTVEKLAGLKVLHPEIEGFSITAGNSSGTNDAAAAVALVDREYAEAEKLNVMGTVRAWAAAGVPPRDCGLGAVKVIGKVLQRAGLSPGDVALWEINEAFASVPIAACREYGLDEEKVNFSGSGCSLGHPIAASGARMVTTLTYELARRGGGIGVAAMCAGGGQGGAVVIEV

SEQ ID NO: 3058 - protein, 204 aa, Mycobacterium paratuberculosis
VSGNVPLSRRSRHISRGRLIVIGIVAAVLIGVLTAVGMQLDRGDHGATAPAAGPPPTPESYAIPGCYNPSVLPVERPKKLNVLGCASVAVALQDMSWSSWGPQGADGTGTAVFKLCDPNCATGSQLTEPVVVHAWNPQPPRREAICQAGLKIFADMILAFPKDVPPPDVQKMNTQYHGMPAVHFANYSSGDTRGTQFIGYTFCN

SEQ ID NO: 3059 - protein, 242 aa, Mycobacterium paratuberculosis
MNDHELAARLATEAGRLLLGVRDEFADAPASERKAAGDKRSHDFLIEALAAERPGDAVLSEEGADDPVRLRSERVWIVDPLDGTREFSELGRDDWAVHVALWEAGELVAGAVALPAQGVTFATPEVASPPVAPGKPRIVVSRTRPPAIALNVRDALDGVLVEMGSAGAKVASVVQGLSDVYVHAGGQFEWDSAAPVAVARAAGLHTSRIDGSTLAYNQPDPKLPDLVVCRPELADAVLAVTR

SEQ ID NO: 3060 - protein, 301 aa, Mycobacterium paratuberculosis
MHVLRTPDSRFENLEDYPFVAHYLDVTARDTRPLRMHYLDEGPIDGPPIVLLHGEPTWSYLYRTMITPLTDAGNRVLAPDLIGFGRSDKPSRIEDYSYQRHVDWVVSWFEHLNLSDVTLFVQDWGSLIGLRIAAEQPDRVGRLVVANGFLPTAQRRTPPAFYAWRAFARYSPVLPAGRIVSVGTVRRVSSKVRAGYDAPFPDKTYQAGARAFPQLVPTSPADPAIPANRKAWEALGRWEKPFLAIFGARDPILGHADSPLIKHIPGAAGQPHARINASHFIQEDRGPELAERILSWQQALL

SEQ ID NO: 3061 - protein, 242 aa, Mycobacterium paratuberculosis
MAIRRAVLLIADIGGYTHYMQWNRTHLAHAQLTVAGLLESVINAGKGLKLAKLEGDAAFFWAPDSSAKVVVCERLSRMRTSFLQRRERMKNDIACQCASCAQLEQLSLKFVVHVGEVADQRVKRHVELAGFDVILVHRMLKNLVPVAEYVLMTDPVVDCLDEPMRALCMPLVHVFEGIGETPTYYIDLAEVRVPVTEPQRSLLRRLGATMRFEFNSLPFTLGMKEPAEGFRNLGRGGEEIPA

SEQ ID NO: 3062 - protein, 401 aa, Mycobacterium paratuberculosis
VTFNPFEELTLDQLRLRTSMKWRAHPADVLPLWVAEMDVRLAPTVAQALRTAIDNGDTGYPCGTAFAEAVSEFAARRWQWHDLDVRRTALVPDVMLGAVEVLRLVTDPGDAVVVNPPVYAPFYAFVSHDGRRVVEAPLGDGGRIDLGALEEAFAHARSGNTAKVAYLLCNPHNPTGSVHTAAELRGVAELARRFGVRVVSDEIHAPVILPGSRFTPFLTVAGAENAFALTSASKAWNLSGLKAALAIAGPEAAADLNRMPEEVSHGPSHLGVIAHTEAFRSGDGWLDATLQGLDQNRALLGELVAEHLPGVKYQWPQGTYLAWLDCRELGFAEDAAQGLAVVADLSGPARWFLEHARVALSSGHVFGTGGAGHLRLNFATSRAILTEALSRMGRALAGRSG

SEQ ID NO: 3063 - protein, 325 aa, Mycobacterium paratuberculosis
VYTLRFDMRDPEWAAPPADLYAAAPEMAAWAEEHGGLAAVLCEHHGSEDGYLPSPFLLASAVAARTQRLALSLILILPFYEPVRLAEDMAVLDIISNGRASYILALGYRPEEFEHFGVPIKKRGRLCDEKLALLRRLLAGETVVEDGRRITVTPRPLTPGGPGLMWGGGTIAAARRAGRYGLGMLGNANAPGIQEAYEEACREHGHPPGPTMFPDRNTPSVVFVAEEVDQAWKEIGEHLLHDVRTYAAWNPGDETTAGFSHVNTIDELRETGTSHVIISVPEAISRVKAGQVLNLSPLCGGLPPDIAWPYLKRVGEVVLPEALGH

SEQ ID NO: 3064 - protein, 261 aa, Mycobacterium paratuberculosis
MSAQMTPVMQAASEFALIGGIGFTAFGIYLSVRRRRLHPLLLLCISAMSFSWIEAPYDWAMYAQFPPAIPRMPSWWPLNMTWGGLPLFVPIGYISYFVLPAVTGTALGRWLSARFGWRRPQTLLVVGLVVGFCWALFFNGFLGAKLGVFYYGRVIPGLAIREGTVHQYPLYDSVAMAIQMMLFTYLLGRTDAQGPNVIEMWAEHRSKSRVGASVLSVVAVVVVGNALYGAVFAPHLVTKLGGWVTAGPTGELFPGVPNQPR

SEQ ID NO: 3065 - protein, 219 aa, Mycobacterium paratuberculosis
VAQRPSTRRGAAAAPASIRRPRGAPRQLLLDTARARFARQDYRSTTTREIAQAAGVTEHLLFRHFGSKAALFREALVLPFTDFVAEFGRTWQAVVPEETDEEELARRFVGQLYDVFVEHQGLLLTLMASEALSEEEKADAGIAEVRRAITTLGRISAEGMHLRGLRSDHPDLPAHSTVAMIAGMAALRSTYFGAEPPAREVIVDELIQAILHGFLHRNG

SEQ ID NO: 3066 - protein, 404 aa, Mycobacterium paratuberculosis
LVMTGTSAIELYYDPFDSGIDDNPYPVWQRMREEAPLYYNEKYNFYALSRYEDVARELPNWQTYRSGRGTTADILFSNVEVPPGILLFEDPPLHDLHRRLLSRVFTPRRMLAVEDLVRGFCVRELDPLVGAGGFDFIRDLGAMMPMRTIGYLLGIPEEDQEKIRDRSVANIELSRDSDPAAVDANVFANSIALFADYIEWRADHPSDDLMTELLRAEIDEPDGTRRPLSRTEVLAYTAMIAGAGNETTARLIGFMGQLLSDHPDQRRELAADPSLIPGAVEETLRFEPPSPVQARYVARDAEHYGRVVPEGSFMLLLNGSANRDPRRFTDPDRYDIHRQGGGHLSFGQGLHFCLGSALARMEARVAFEEVLKRWPDWEVDYANAERARTASVRGWARLPVVTGG

SEQ ID NO: 3067 - protein, 217 aa, Mycobacterium paratuberculosis
CRRSGLHSKAAGRQRQPRTPSPRTFKPLYALSSSPPLPRSPPRSAQPTRATVGIIAELNRQITDLEAELATHFETHPDADIYRSLPGLGVILGARVLGEFGDDPNRYTTAKCRKNYAGTSPLTVASGRKRAVLARHVRNRRLYDAIDQWAFCALNTSPGARLFYDRRRAAGDLHHQALRALGNRLVGILHGCLRHRTHYDEHKAWAHRQTNPDSQAA

SEQ ID NO: 3068 - protein, 207 aa, Mycobacterium paratuberculosis
VIFVGDDWAEDHHDVHLMDESGARLASRRLPEGLAGIGEFHQLLARHAEEPDQVVIGIETDRGLWVEALTAADYQVYAINPMAAARYRDRHHVSGAKSDAGDAKLLADLVRTDRHNHRRVAGDSADTEAVKVLARAHQNLIWTRNRHTNALRSALREYYPGALEAFDDLHDRDALGDPGAEGAHPHASGEPESVEDPVCTQKPLGDN

SEQ ID NO: 3069 - protein, 333 aa, Mycobacterium paratuberculosis
DADCLDIFAQWQGGGTELRWRSTTAANDGREVGVFSRRCGTPGAPALVLVHGFPTSSIDYFALAGELSRDFDIHLIDFPGYGLSDKPSEPYVYSLYDDARLLVHAITEVWRLSDYRMLTHDRGSSVGMIASGMLAALDPPAAPVDLILTNANIYLPLANLTAFQSALLDPATARATAAATTPELLAAGMGASTFMPRRTLDDPEIAALAKCFAHNDGIRVLPDTIQYLNERAADETRWLEALSTSDVNTTMVWGLHDNVAPLRVPNHVWQTYLKTKPGRNRYWVIPGADHYLQCDAPAQLAEIVRLTARGEDVPLQTLGDRPDGAVLVDASAS

SEQ ID NO: 3070 - protein, 180 aa, Mycobacterium paratuberculosis
MTSSGGPTMRNLNDRRRVVGAATALGVLALGAGLPGCSGKDGHPAATPSSTATLASTTVMIDGNKHTMIAGVDCTSAAAQPNASPPESGDLTTRISVHDDSASVSLAVSDEQPPTVDGFAISLKLDNGQYQLPYQGTKSPTQVQATKDSKSYTVTGTGQATTPGQSGTRDVTFGIHVTCP

SEQ ID NO: 3071 - protein, 242 aa, Mycobacterium paratuberculosis
MVALAVLFLIALAAGALGGMVGTGSSLVLLPALVMMYGPRIAVPVMGIAAVMANVARVAAWWRQIRWRPVLAYALPGTPAVVLGANTLLSIPQAVVDGLLGVFFLAMIPMRRVALARRWRIRLRHLAVAGVVVGFLTGLVLSTGPLSVPVFTGYGLSGGAFLGSEAVSALLLYIGKIGTFSQLGALSFAVVTRGLVIGAALMIGPFVTRPLVRRTDQRHYALLIDCVLVVAAAGMFIATATH

SEQ ID NO: 3072 - protein, 284 aa, Mycobacterium paratuberculosis
VGARDQVLITATELADVIEAGDPVSILDVRWRLDEPDGRAAYLQGHLPDAVYVSLEDELSDHTVSGRGRHPLPSGPSLQAAARRWGIRQDTPVVVYDDWNRAGSARAWWLLRAAGLDNVRILDGGLAAWRATGGRLVSGPVEPVPGNVTVPHGDLHSGNRPTVTTEQVAAGAATLIDARAPERYRGEMEPLDPVAGHIPGAENLPSGEVLAADGTFLGDDALARVFAEHRIERHGAVAAYCGSGVTATVTIAALAAVGRTAALYPGSWSEWCADPARPVERGGA

SEQ ID NO: 3073 - protein, 381 aa, Mycobacterium paratuberculosis
MRVVQVANFYGPRSGGLRTAVDRLGAEYCAHGHEVFLIVPGQRTERARLYTGVVRITLPARLIPFTGGYRAVLPGPVKALLEALRPDALEVSDRLTLRSLGRWGRDHGVTTVMISHERLDRLVGQVLPRRAAQKFADLANARTAADYDTVVCTTGFAREEFDRIGAGNTVTVPLGVDLQTFHPRHHSQLVRRRWAAPTQLLLVHCGRLSVEKRVDRSIDALGELCHAGVDARLVVVGEGPLRARLQRQAARLPVDFTGFVSDRTTVAQLLASADVTLAPGPHETFGLAALESLACGTPAVVSRTSALTEIVTPDSGASAANDPAAIARAVSAIVSRPERQRRISAQRRAEDFTWHRAAAGMLASLRAPVFDDPGGDSEQTA

SEQ ID NO: 3074 - protein, 394 aa, Mycobacterium paratuberculosis
MLHTVAVRGYRSLREVVLPLGRLSVITGANGTGKSSLYRALRLLADCGRGEVIGSLAREGGLQSVLWAGPEQPAGSRRSGKTEGTVRSRPVSLELGFAADDFGYLVDLGLPQSAGKSVFARDPEIKREVLFAGPVLRPSTTLVRRSRGFAEASADSGSGFDELSRSLPSYHSVLAEYAHPHALPELAAVRERLRGWRFYDGFRVDAGAPARHPQVGTRTPVLADDGSDLAAAIQTILESGFDDLNRAVAEAFDGATVSVAIHDGLFDLQLRQRGMLRALRSAELSDGTLRFLLWAAALLSPQPPSLMVLNEPETSLHPDLVAPLASLIRTTAASTQVVVVTHSRSLLEFLDTVPLGEGGADGEAVEIELYKDWGETRIGGQTLMTTPRWDWGTR

SEQ ID NO: 3075 - protein, 536 aa, Mycobacterium paratuberculosis
VFGLVLIVALVSTVIVGTVIGRRYRVGPPVLLIVLGVLLGLVPQFGHVRIDGEIVLLLFLPAILYWEGLNISFREIRANARIIVFLSVALVIATAVAVSWTARALGMDPHAAGVLGAVLSPTDAAAVAGLAKKLPRRSLTVLKAESLINDGTALVLFAVSVHVAIGAPAISPPEVTLRFIGSYLGGIAAGLLVGGAVTLVRKRIDAPQEEGALSLVTPFAAFLLAQSVECSGVVAVVVSALVLAYSGPVVIRARSRLQSYAFWDIATFLLNGSLWVFVGVQIPGALRGIAGVDGGVRHALFVALVITGVVIVSRIFWGEFTTMLIRLIDRRAVQRERRVGWRQRFVTAWAGFRGAVSLAAAVAVPMTTLSGAPFPDHSLLIFIVTVVILVTVLVQGSTLPAVVRWARLPADVAHAEELQLARTRAARAALAALPAVADEVGVSDELRRRLHKEYEEKAALVLATENGSPDNRILKTREKVRQVRLGVLEHKRREVTALRNQNRIDDTVLRELQNEMDLEEVQLLAAAADEDDGDTE

SEQ ID NO: 3076 - protein, 144 aa, Mycobacterium paratuberculosis
VKVRLLATVAALILSTVLGCHFESRNPPSTKTLQVPMNDVLTQSDISQNITLAVGNTLVVQLGSNYTTPYRWTPDAKIGDSAIVKQTSHEFVPPTSDALGAPGTEVWTFAALKPGSTTITTSYSSFVDKNAKPACTYTLSVTVR

SEQ ID NO: 3077 - protein, 119 aa, Mycobacterium paratuberculosis
MMPGLLIKSIIKQRPATHLETFAAASPITHVNPDAPPFFVLHGRNDSLAYVEQARAFVERLRQVSTQPVVYAELPFTQHAFDIFGSVRAAHTAVAVEQFLAEVYSARDRLPDQLIARSR

SEQ ID NO: 3078 - protein, 357 aa, Mycobacterium paratuberculosis
MRKARIVHLIRQIGSLTVSAVTAASTLNAYRPLARKGYPSLYAWMFGLVVTELPLQTMLSQLGGLALTARRLTRPVRIIAWLVAGLSALGLLNLSRAGHRANVPLTDALDSELGADRLTESADLWRRPTGAGTAKTPGLLRMLRIYRDYAHDSNISYGEFGSANHLDIWRRPDLDLTGRAPVLFQIPGGAWTTGNKRGQAHPLMSHLAELGWICVAINYRHSPRNTWPDHIVDVKRALAWVKQHIAGYGRRSRLHRHHRRGRPAGHLSSLAALTPQRPAVPARLRRRRYPGAGGGAVLRHLRLHPLRRQPAPDDARTADQVDHQTTARHPPGDVRRRLTDHPRKPGRTTVFRAARPQ

SEQ ID NO: 3079 - protein, 118 aa, Mycobacterium paratuberculosis
VNHYTYRVAWSPYLGEYVGTCLELPYVRRQGATAQEAMGAIEEAVDWYIASAESSGETLPTPMADRHYSGTIVVRTSPELHSRLAMEAAEQRVSMNQWVVQKLSGRRPSETFGLSGFD

SEQ ID NO: 3080 - protein, 108 aa, Mycobacterium paratuberculosis
VAYVIAEPCVDIKDKACIEECPVDCIYEGARMLYIHPDECVDCGACEPVCPVESIYYEDDLPPEHSQYLQINADFFTELGSPGGAAKVGLTENDPAPVKNLESRAEAS

SEQ ID NO: 3081 - protein, 315 aa, Mycobacterium paratuberculosis
MPLSPRMPELASFEAFLAIAETGSLGRAARELELTQQAISRRLATMEAQIGVTLAVRTTRGSQLTPAGLIVADWAARLLEVAHEIDAGLGSLRKEGRERIRVAASQTISEQLMPHWLLSLQAEATRRGEAAPQVILTATNSEHAIASVRDGSADLGFVENPGTPKGLGSCVVGEDELVIVVPPTHKWARRSRVVTARELAQTPLVAREPHSGIRDSLTVALRKVLGEDMQQAAPVLELTSAAAMRAAVLAGAGPAAMSRLAVADDLAVGRLHAVEIPKLDLRRKFRAIWIGGRTPPAGAIRDLLSHIIARTAVSK

SEQ ID NO: 3082 - protein, 86 aa, Mycobacterium paratuberculosis
MGLRHNGFATRPEASVARAADQLRRRGARRLVIAPWFLAPGFITDGVSTFARDNGIRMAAPLGAHRLVAETVLDRYDEALSADAAA

SEQ ID NO: 3083 - protein, 183 aa, Mycobacterium paratuberculosis
MSTLVLTAHGSRDPRSAANAEAVADRLRRMRPGLDVRLAFLELNAPNFVDVLAGLPDSRRAVVAPLLLASAYHARLDIPEQIARAGARGIRQADVLGEDDRLVAVLRGRLAEIGVSPLDDDLGVMVVAIGSSNIAANARTAKVASRLAAGTRWACATTASRPGPRRRWPAPPTSCAVAARAGW

SEQ ID NO: 3084 - protein, 247 aa, Mycobacterium paratuberculosis
MSDVATDFTEEQLRELAERGASELEGASAIDILRWTDEHFGPVDGPRGWATCKYVVACNMQDAVTVSLASDVRPGVPVLFLDTGYHFAETIGTRDAVEAVYDIHLLNVTPEHTVAEQDELLGKDLFARDPNECCRLRKVEPLRRALRGYAAWVSGLRRVEAPTRADAPLISFDESFKVVKVNPIAAWTDEQVDEYIERNRVLVNPLVQEGYPSIGCAPCTAKPAPGEDPRSGRWRGRNKVECGLHAS

SEQ ID NO: 3085 - protein, 555 aa, Mycobacterium paratuberculosis
MTTARPVKTRNEGQWALGDREPLNDTEKIKLADGPLNVRERIINVYAKQGFDSIDKSDLRGRFRWMGLYTQREQGYDGSWTGDDNTDKIEAKYFMMRVRSDGKAMSAHTMRTLGQISTEFARDTADISDRENLQLHWIRIEDVPEIWRRLESVGLQTTEACGDCPRGIHGSPLAGDSLDEVLDPSPAIEEIVRRSLNNPEYANLPRKYKTAVSGLQDVSHETHDVAFVGVEHPEHGPGLDLWVGGGLSTNPMLAQRLSVWVPLDEVPDVWEAVTQLFRDYGYRRLRAKARLKFLVKDWGIEKFREILEQEYLNRRLIDGPAPAPVKHTIDHVGVQKIKNGLNAVGVAPIAGRVSGTTLSAVADLMEQVGSDRARWTPFQKLVILDVPDDKVDELVTGLDALGLPSRPSSWRKNTMACTGIEFCKLSFAETRVRTQTLVPELERRLADVDAQLDAPISVHLNGCPNSCARIQVADIGFKGQWIDNGDGTSVEGFQVHLGGGLGEQSGFGRKLRQHKVTSEELGDYIDRVTRKYLEGRNDGETFASWALRADEEELR

SEQ ID NO: 3086 - protein, 203 aa, Mycobacterium paratuberculosis
VAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFPGAGTRLRLQQEPCRADPAYWLPNSRRAAQRRWRSSSRVLA

SEQ ID NO: 3087 - protein, 198 aa, Mycobacterium paratuberculosis
LRKRKARNADTVAATALQAANAQHSIVPGQQLAATVVARLAKEVMALDTEIGDTDAMIEERFRRHRHAEIILSMPGFGVILGAEFLAATGGDMAAFASADRLAGVAGLAPVPRDSGRISGNLKRPRRYDRRLLRACYLSALVSIRTDPSSRTYYDRKRTEGKRHTQAVLALARRRLNVLWAMLRDHAVYHPATTTAAA

SEQ ID NO: 3088 - protein, 437 aa, Mycobacterium paratuberculosis
MRVRLGARWMAMHGLPRAYFAVQARRGDPLARLLRSGTTGEDRYALMEQIRARGPLMRAPFVWASVDHALCRQVLRDKRFGVTSPTEMELPRPVRALIARTDPGVANPVEPPAMVIVDPPDHTRYRQLVAQSFTPRAIEALNTRVAQVTLELIERIATIPQPDLIADFATRLPVAIIAEILGMPPDSYPRMLAWGRSGSPLLDLGIDWRTYRDAIDGLRGVDEYLLAHFHQLRADPHSDNPFGRMAADGSLTDRELTANAALIVGAGFETTVNLIGNGIVLLLRHPEQLALLHDNPDLWPSAVEEILRIASPVQMTARTPACDVDIAGAHIGAGEMVGLFLGGANRDPKVFSDPTTFDVTRPNAREHLAFASGIHACLGAALARIEGATALRALFENFPDLRLTAAPQRRSLINLHGYTRLPAQLGGRRTTSATIPV

SEQ ID NO: 3089 - protein, 211 aa, Mycobacterium paratuberculosis
VRRLTEPDPVVLAQVDNPDEITARILAATLEQAELVGMRRTTMEDVARRSGVGRATLYRRFPTKAALVDAVVLAEARRYLEGDAQAWAQGATFEDRMVNSTVFSVTFMREHALLKKLLRTEPETILPSLTVDAGVILDYATEYTVGLLRRELYGTETTPAQERHLRTVAELHTRLTLSFIVTPHTSINLATIEDTRSYVRNYLMPMVVGPR

SEQ ID NO: 3090 - protein, 485 aa, Mycobacterium paratuberculosis
VSSSSRGSRLGTRFGPYELRSLIGTGTLGEVYRAYDTVKDRLVALKLLRGELDAGFRQRLWRDCRAVTRLQEPHVLPLHDFGEMDGVPFIDMQLVDDGGSLKELLREQGGLEPSRAASITGQVARALDAAHAAGLMHLDVKPENILLTHDHFTYLADFGLAQAAGDDKLSRTYMAPERFTTGSLGPQTDIYSLACVLYECLTGQPPFEGADPGELRSAHLLSPAPRPSIMRRGVGRAFDDIITRGMAKQRSARFGSAGELARAASEAVFAAYEPVSAAAGLGGPRPLPTPPAQFDGPDDTLGPPAAERPPRGRVGRLPVVVTAVAVLMLIAGVVLSVKSVVGTHHNSSAPPPAPSTRALAPPPPTTPPPPLTPTLSRPVTGADGLGFIGETARCDPGNPPAAVVRTAKSLAVVCQNLSGSYYYRGERIRDGAHIELSNAERVEDGFDVTNPVDGVVYEVRPNRLRIISFGHVDSSEPVLQYATAS

SEQ ID NO: 3091 - protein, 422 aa, Mycobacterium paratuberculosis
MATRPNVSPDAIVDFDHHSDAFNLNELAVNAELRQRCPVAWNENYGGFWFLSSYDAVSQTARDGDTFAHKYEPNAADGVDYQGEMGVPRPEGQPALGLGEVDGPYHQALRHALAPFFSPGAVEKLKPFMEHSAHWFLDQQITTGQMDLVLDYASPVPAILTMKLMGLPYDNWHLYANLFHSVMAVSQDSDEYAAAIAKVPAMMQEVLDYAATRRAKPEEDLTSFLIRFEFDGHRLTDEQLLNILWNLIGGGVDTTTSQTALTLLHLGTHPDLRQQLIDHPELYRTATDEFLRYFSVNQTLSRTVTHDVVLAGQRLRKNDRVVISWLSANHDENEFHRPDEIILDRAPNRHVAFGLGPHRCIGSHLARLMSEVMVRAVLVRIPDYQVDVDNVHQYLGNPSMTGLGQLPVTFAPGRSRKALRPW

SEQ ID NO: 3092 - protein, 150 aa, Mycobacterium paratuberculosis
MTSHRTVFNHVGLCVADRERSRRFYEGLLGFQFWWEIDPPDDRTAQLVGLPEPLGVHATYLVRDGLVLELIDYSKRWVHAGSQRAMDQIGLTHISFSVSDLPGVLARVRQFGGAVVGGSVSDGAAMIRDPDGQLLELLSDGWLAALPARP

SEQ ID NO: 3093 - protein, 86 aa, Mycobacterium paratuberculosis
MSEVASRELRNDTAGVLRRVREGEDVTITINGRAVAMLTPLRPQRRRWLSKAELLSRLRRAQADPGLRQDLATLAGDTTEDLGPIR

SEQ ID NO: 3094 - protein, 135 aa, Mycobacterium paratuberculosis
MTARPAAGVLDTSVFIASESGRQLDEARIPDEVATTVVTLAELHAGVLAATTSNVRAQRLATLESIADMEMLPVDDDAVRMWARLRIHLAEAGRRMRANDLWIAAIAASRGLPVVTQDDDFAALDGAANLAIIRV

SEQ ID NO: 3095 - protein, 514 aa, Mycobacterium paratuberculosis
MKSLVGTSFGQYEIRRLIGKGGMGEVYEAYDTKKGRAVALKLLTDNYADDEKFRERFLRESRAAAILQEPHVIPIHDWGEINGVLYIDMRLVQGQTLHEMLKTGSLEPRRATDIIRQVASALDAAHAAGLIHRDVKPQNIIVTPDDFAYLVDFGIAEARGDTHLTMAGHTVGTFDYMAPERFGDEETTSAVDVYALACVLYEALTGAKPFPVHSAEQAIRAHLSSPPPRPSAVNPHVPASFDDVIARGMAKHPDDRYGSAGALGRAAKRALAPDPATSAGTNTLLAPQYVSAPSSYPPFAAQYPYPATGPVSATDADQGGSKKLMVLTIVGVAVALLVGGTGLVIGLTTQRNSSTSEPSTSPLVSYTNPVPTYETEPARLPSTPTSAPQDATQQLHQIANDDRAFVRAQLADRWVPQLSSKRPGVVDNGVVWDNAMTLREHLQLRQRYPNVKLLWSGDWSTFSGPDFWVTVAGLTFADSSGPLAWCRFQGFDRDHCAAKLVSTTHPEAGSTAYN

SEQ ID NO: 3096 - protein, 154 aa, Mycobacterium paratuberculosis
LERPDTLDVLRLIANAPNIFESWSQMASQLFDTETFSPRMREVIILRVAHLQDSPYELAQHVVFARAAGLTDRQIDALQDKADLDAAGFTDDERILIDTVTELCTTHRLDDASFAKAHTLLGDEALTELLMIVATYYGLALVLNATDLDIDAPT

SEQ ID NO: 3097 - protein, 163 aa, Mycobacterium paratuberculosis
LTARRGNLNVYRTLANAEKVFTSWMVAGDAALSSPVLPRRLRELIVLRTASAMDCAYELGQHRDVARTVGIDPDTIDAVISETGWQAGDLTPTELAVLHLTTELVTTRRVAQPLFDRVHRALGTEATVEALMVINRYAGLALMLNALEVDLDETARLPIPPTS

SEQ ID NO: 3098 - protein, 193 aa, Mycobacterium paratuberculosis
VAPKPKSTRLSVEDWLEVGYTVLAEEGVRALKVERLCQQAGVTRGSFYWHFEDIDNYRAALVESWNKFLERDRQALSELDSLPPRQRLSAMMGTLVSPQYWMLERAMREWARLDPVAAENIRAADRHLLRTVTKAYRDYGFSPEDAKLRAELTFAAGIGLLHLTGSAEQAQSLAQRERFLDLMLTEAGVASDH

SEQ ID NO: 3099 - protein, 391 aa, Mycobacterium paratuberculosis
VRMSVVEHHPLHGITDEFMARLGERAEEAERLRRLPAATVDEFRQTELFRLLLPARFGGLEASFPELLQPIRRMAHGCASSAWTLGFYALHNWMLSLFDPRAQREVFASGPVLAPAPLAPTGRGTPADGGVRLTGRWSWATGAMEADWLIVGALIERTDRIDPALVVVPAGQVEVVDTWHTAGMRGTGSHDVVITDVFVPEHRLVAVADIYGGTAPGAREHAAATYRWPMVPALALTAAMPVLGAAERVVQLFADRLGERVLAYSAVAQKDQPAAQIRLGEARVRLDALRALVAQTADRIEAIVAGGDRVSRSVRADARLAAARTVHESRAIIADVMEASGASAHFLSSPMQRAKRDVDIAAGHVVFDYDTSRELAGALAIGAKISPISMI

SEQ ID NO: 3100 - protein, 249 aa, Mycobacterium paratuberculosis
VARRDVLRLAGAMPVILAAGAVLPGPRAAAGVAGMSVFLDPGHNAVNDASINRPVPNGRGGSKPCQTSGAAADDGYPEHAFTWAVVGLINASLNQMGVHTQLSRADDSGVGPCIDQRADAANAMRPDAIVSIHADGGPGSGSGFHVNYSSPPLNDVQAGPAVQLAHAMRDALAQAGFQPATYIGSDGLYGRDDLAGLNLAQYPAVLVELGNMKNAGDAARMESPDGRAAYAAAVTAGIVAFLNAKAASG

SEQ ID NO: 3101 - protein, 267 aa, Mycobacterium paratuberculosis
LTGLGGACMGIFDGMFARHIVRSLGSALVMAASGVAASAVSGSVIPTAAAQCPDIQVVFARGTGEAPGVGPTGQAFVDALHQRVGGRSFDVYPVNYPASDQWDTGIEGIRDAGAHVNSMAHDCPNTKMVLGGYSQGAAVMGFVTSASVPDGVDPNTVPKPLDPEVANHVSSVVLFGMPNVRAMNFLNEPPVVIGPAYQDKTLKVCATEDPVCSDGMNFAAHNTYANDNEMIDKGVAFASSHLGLGGPATVAAPSGAVAAPSGGGVGS

SEQ ID NO: 3102 - protein, 80 aa, Mycobacterium paratuberculosis
MATGETGFDDVTYDLISVQYHSLKAGHDYGQYVRDAKNAGMEEIASFFSEVMAQDSERARRCHEFLGQLQGTPAAGPATR

SEQ ID NO: 3103 - protein, 495 aa, Mycobacterium paratuberculosis
VVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAGELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKTVIDTLVLATGFDLWEANFPAIEVIGRKGRNLGKWWRETRFQAYQGVSMPYFPNYLSLASPFAFSGLSFFHTIEYQMRHMDRLLGEVKRRGATIFEVTEEANDRFMERMTKLLDNSVFYAGNCATSRSYYFSPSGEASLLRPTSTLNSIREASSFPLSDYVIA

SEQ ID NO: 3104 - protein, 158 aa, Mycobacterium paratuberculosis
MRVRRLRTRCGLAAVAAVGCWANASLATPTVTAAPLPPGSHSEKWIDLQPGQCVADLPPADGSRVDVTVVDCATAHLAEVYLRAPMAVDAAIASVANRDCAAGLPGYTGGDGGRFSITYLIDSNQDRTGANPTPSTVICLLQSSDGQPLTGSAHRRAG

SEQ ID NO: 3105 - protein, 170 aa, Mycobacterium paratuberculosis
VLAARQKLVLDHFHDEVRHAWDDVLSTFPHPRYELIPQMIVHDGEAAVRDYYAYTRTAFPDQDHEIIALRHSADAVIVEFWLMGTHRGYLGKVPPTGSQFRVRMTAYFLFDDTETLVCERIYFDTLTMIKQLLGGLDMRRPGNWLLAARCVRGFLAMSSEKPEPALTGAP

SEQ ID NO: 3106 - protein, 435 aa, Mycobacterium paratuberculosis
VSLKTRPKKGLATRINGAPPPRVPLADIHLESLDFWGYDDDFRDGAFATLRREAPISFWPAIEMDGFVAGNGYWALTKHEDVHFASRHPEIFSSVPNITINDQTPELAEYFGSMIVLDDPRHQRLRSIVSRAFTPKVVARIEASVRERARRLVSSLVANHPNGEAELVSELAGPLPLQVICDMMGIPEEDHQRVFHWTNVILGFGDPDLATDFEEFLQVSMDIGAYATALAEDRRVNHHDDLTTSLVEAEVDGERLTSSEIASFFILLVVAGNETTRNAISHGVLALSRYPDERDKWFSDFDRLTPTAVEEVVRWASPVVYMRRTLTRDVKLRGTKMKAGDKVALWYNSANRDESTFGNPWLFDVARTPNPHLGFGGGGAHFCLGANLARREIRVVFDELRHEIPDIVATEEPARLLSQFIHGIKRLPVAWTPPR

SEQ ID NO: 3107 - protein, 115 aa, Mycobacterium paratuberculosis
MSKHLAGSSMLVAVGFGFANACGVAHALPQMPQVRYEVNGPAVAEFIYYQTDTGQLHQVNAPLPWSTQFTGFGGEVFTVSAQGPGPISCKILVDGNVVSAATASVGTPARTVCTH

SEQ ID NO: 3108 - protein, 361 aa, Mycobacterium paratuberculosis
MSEHGSKRVVVWGTGFVGKMVIAEIVKHPLFELVGVGVSNPAKVGRDVADICGLPEPTGVIATDDVDALIALKPDALVHYGPTAMHAKENIALITRFLRAGIDVCSTAMTPWVWPTMHLNPPNWIAPITEACELGESSCFTTGIDPGFANDLFPMTLMGLCSEVRRVRASELLDYTNYEGDYEVEMGIGREPEYSPMLENRDVLIFAWGATVPMIAHAAGIMLDEITTTWDKWVTPTERTTAKGVIKPGHVAAVRFTINGVYRGETRIQLEHVNRIGLDAAPDWPSGHDNDVYRVDIEGTPSIFQETAFRFTDGSGRDAAAAGCLATGLRALNAVPAVNELRPGWVTPLDLPLIPGAGTIR

SEQ ID NO: 3109 - protein, 555 aa, Mycobacterium paratuberculosis
MANGAGTALGLSIGATNLAAVTSDHAVTRKPVLTRYPDRPAEVGVPAENPRLQGPGVVITGFVNRVGDPRPVVASDGSVHRSEILLADALRALAYAATGGRAQPDDIAVTYPAHWESAAVEALGAALGEIPEWSRRARPIVLIPDAAAALLAVRTSPGLPARGTVAVCDFGGSGTSITLMDADGDYRALAPTVRHRDFSGDVIDQALLGVVVANMPTTGAFPTGTAAIGSLSRLRGGCRVAKEQLSANTTTTLTDGLTGVRGEIRLTRAELDDAIAPALGGFVSVLRETLSRNGIRDLAAVVSTGGGANLPAVTTTLARLFRVPVATTPHPQLTAAVGAALRVAHADAGATFTAPAAPATATARAAARPEPRADATATAAVPPANPAPMAVQAWSDTGTDAAAPPPRRKRLFTRSRLFPAAAVVIPAAAVLLVGTALMIGLTAQNKSDKSVTTPAPTLSTTPAPPPPSVTAEPAPPPADIPVPSTSDTNPPAETETPMTTTPRATPQAAPPAHPLPPRRVAAPAIPPIPGLNEPIPGLDRVNQIIQEIEGNLGVG

SEQ ID NO: 3110 - protein, 115 aa, Mycobacterium paratuberculosis
MSARDDQASGRDDDQRLTEKPEPDEDDKKKAAEMMEAYEDKATIVLPGTGGSVSGTAVNEWLDEDGNPKHEVAEGTDHADEGRDEQALRDQIEKDKALNEVLREAAAAPNKGEKG

SEQ ID NO: 3111 - protein, 355 aa, Mycobacterium paratuberculosis
VVRPEPTYTEASRLRAAGLTKAIAQFERAAEQVALPKAPQPIVVADYGAANGHNSLKPLSAAVSVLRRRTRPDHAILVAHTDLPGNDFSALFDTVADDPESYLHADAATFTSAIGRSFYNQIVPSRTVNLGWTSWATRWLSRTPGAVPDHVHVSCSRDDAVLAAYADQAALDWHNFVAFRGRELAPEGRLVALTLAADEEDGRCSAGFAALLDAIVEALEDQRRDGLLRPDELQRMTIPTFARSEKDFRAPFAPKGRFEGLMVEQLEIFNAEDRFWARFQADHDAEAFGAQWAAFARSALFPALVAGLDDGIRDPRAPRFVEQLQSAIAQRLSSAPEPMRIPQALVVLVKREAAQ

SEQ ID NO: 3112 - protein, 207 aa, Mycobacterium paratuberculosis
MAGIDKIVTHGTFELDGGSWEVDNNIWIVGDDSDVVVFDAAHTAEPIVAAVGNRNVVAVVCTHGHNDHVTVAPELGAALDAPVLLHPGDDVLWRMTHPDKDFRTIADGDTIDVAGTELLALHTPGHSPGSVCWYAPELGVVFSGDTLFSGGPGATGRSYSDFPTILQSISGRLGTLPGETVVHTGHGDSTTIGDEIVHYEEWVARGH

SEQ ID NO: 3113 - protein, 361 aa, Mycobacterium paratuberculosis
MSQTVRGVISRKKGEPVELVDIVVPDPGPGEALVDVIACGVCHTDLTYREGGINDEYPFLLGHEAAGRVEAVGPDVTAVQPGDFVVLNWRAVCGQCRACKRGRPHLCFDTFNATQKMTLTDGTELTPALGIGAFADKTLVAAGQCTKVDPAADPAVAGLLGCGVMAGLGAAINTGAVARDDTVAVIGCGGVGNAAIAGAALVGARRIIAVDTDDTKLDWARGFGATHTVNARQADVVAAIQDLTDGFGANVVIDAVGRPETWKQAFYARDLAGTVVLVGVPTPDMTLEMPLVDFFSHGGSLKSSWYGDCLPERDFPTLIELYLQGRLPLEKFVSERIGLGDVEAAFHNMHDGKVLRSVVML

SEQ ID NO: 3114 - protein, 353 aa, Mycobacterium paratuberculosis
VTALETTDEFTDRITAAIDGASLALLLSIGHQTGLLDTMAGVPPATSDRIAEAAGLNERYVREWLAGMTTGRVVDYHPATAEYSLPAHRAKVLTRAAGPDNLALVALFLPLLAEVEQKIIGCFRTGGGLPYTEFPRFHALMAEQSGVVFDTALVDVVLPLVDGLVPRLRRGVDVADFGCGSGHAINVMAQAFPASRFTGIDFSEHAIAAGIAEAAERGLANVSFESRNLADLDRADAYDLITVFDAIHDQAQPARVLANIHRALRPGGVLLMADVKASSRLEDNIGVPMSTYLYTTSLMHCMTVSLAAGGAGLGTAWGTQLAVAMLGEAGFADVRVAEIESDPINNYYIARKS

SEQ ID NO: 3115 - protein, 272 aa, Mycobacterium paratuberculosis
MAALDALDEWPVGAVAAAVIGPTGVLAGHGDAERVFALASVTKPLAARAVHVAVEEGAVELDAAAGPPGATIRHLLAHTSGLSMHSDQVLAPPGTRRIYSNQGFTVLGQTLEEETGIEFARYLHEAVCQPLGMTATRLDGGAVAAGFGATSTVADLAAFAGDLLRPTTVSGRLHAEATTVQFPGLDGVLPGYGVQRPNDWGLGFELRDGKAPHWTGAANSARTYGHFGQAGGFIWADPDIERALVVLTDRDFGEWAMDRWPAISDAVISEYS

SEQ ID NO: 3116 - protein, 177 aa, Mycobacterium paratuberculosis
VEPKEQEMRASNQFADVTTGVVYVHASPAAVCPHVEWALSSTLGAKANLTWTPQPAMPGQLRAVTNWVGPVGTGAKLANALRSWSVLRFEVTEDPSPGVDGHRFSHTPQLGLWSGAMSANGDIMVGEMRLRAMMAQGADTLAAELDSVLGTAWDEALEAFRDGGDAGEVTWLSRGVG

SEQ ID NO: 3117 - protein, 310 aa, Mycobacterium paratuberculosis
VTSPAARLRRYEIGKVIALTNPVSGHGAAVAAAQRAIARLHRRGVEVVEIIGDDAQDARHLVGAALDKGADAVMVTGGDGVFSNALQVLAGTDIPAGIVPAGTGNDHAREFGIPTKDPEAAADIIVDGWAETVDLGRIRADNGFDKWFGTVAATGFDSLVTDRANRMRWPHGRLRYYVAMLAELSQLRLLPFRLVLDGAQEIDAEITLAAFGNTRSYGGGMRICPAADHADGLLDITMVHEASRAKLVRLFPTVMTGTHVELEQVSTVRAKSIHVECPGINVYADGDFACPLPAEISAGSGRAADPAGRS

SEQ ID NO: 3118 - protein, 526 aa, Mycobacterium paratuberculosis
MKWNAWGDPAAAKPLSEGIRSLLQQAVGIEGSRTAEPRPEQVRLRPSTLSPADREALAAIVGPEYCRTADSDRLLHAGGKSTIDLLSRNGPGPQDAPDAVLLPGDDESVAAILRYCSQHRIAVVPFGGGTSVVGGLAPERAGFGAAVAVDLRRFDQLISLDPVSGLAVLGAGVTGPDAEKLLGAHGFSLGHFPQSFEYATIGGFAATRSSGQDSAGYGRFNDMVRGLRVITPVGTMDLGRGPESAAGPDLRQLLIGSEGTLGVITRVRLRVHRIPQAVRYEAWSFPDFETGAAALRVVTQNGTGPTVIRLSDEAETGVNLATTEAIGESRITGGCLCITMFEGTEQHVDSRHAETRALLAAQGGTSLGDGPARAWERGRFGAPYLRDSLLAAGALCETLETATDWSNISALKAAVTQALTTALAQTGTPALVMCHISHVYPTGASLYFTVVAGQRGDPIEQWKTAKKAASDAIMATGGTITHHHAVGTDHRPWMREEVGELGVQVLRAVKATLDPAGILNPGKLIP

SEQ ID NO: 3119 - protein, 230 aa, Mycobacterium paratuberculosis
MTGCPRRAVWPRRDPPRRSISSAAAAASDASCVTVLQMLSIRNDKPDAVLDTGERILAAAASCVVDFGVDRVTLAEIARRAGVSRPTVYRRWPDTRSIVAALLTRHVTDVMRAAPLLGDDRESLVRQIVTVADLLRQDRLVMSVLHSELAPIYITERLGTSQHMLIDALAARLRVAQRNGSVRPGDPVQMATMVLLIAQSTIQSAQIVEPLLDAEALAKELAYSLNGYLS

SEQ ID NO: 3120 - protein, 513 aa, Mycobacterium paratuberculosis
VIPDPSALNAARRTADLAALAEGEPLDVLVIGGGITGAGIALDAAARGLRVALVEKRDLAFGTSRWSSKLVHGGLRYLASGNVGIARRSALERGILMTRNAPHLVHAMPQLVPLLPSMSRATRALVRGGFLAGDALRFLAGTPASTLPRSQRVSAQRVVQLAPTVRRDGLDGGLLAYDGQLIDDARLVTAVARTAAQHGARILTYVAASRATGTSVRLTDVRGGGSFDVSAGAVINAAGVWAGEIDGSLRLRPSRGTHLVFDAAAFGNPTAALTIPIPGELNRFVFAMPEQLGRVYLGLTDEAAPGPIPDVPEPSVEEITFLLDTVNTALGTALAATDVSGAYAGLRPLIDTGEGRTADVSREHAVVESASGVISVIGGKLTEYRYMAQDVLDRAVRVRRLRAAKCQTRNLPLIGAPANPGITGAPHVALPESLVSRYGAEAAKVVATAGCERPTEPVVDGIDVTRAEFEYAITYECALEVSDIVDRRTRIGLVPRDRERVVAVAEEFLARFG

SEQ ID NO: 3121 - protein, 551 aa, Mycobacterium paratuberculosis
MTTRVPVLIVGAGVGGLSMSALLTQHGVRSLLVEKRREVFLYPKARNLSFRSLEILRGMGLGDEVHAVAEHVSTVVAKPALNSPEERPALDLEGIFAGLERFSPEPAAQYCPQSRLEPILLAATRRGGSEVRYRTELSSIDMDEAGVTAVVRDADSGTAETIRADYLIGADGVHSPIRNLLGITTSGYGALPIYVVFVYFRAPWRKFIPHLHDGDGVQVKNADVDGIFLVAEGDLGMFITTYFPDDGETAEQFTPQRCRELLTKAIGEPLDIDVIEVAAWQPYEQVADRFDCGRAFLVGDSAHTMPPFKAGGANTAIQSAHNLAWKLAAVLRGAAGPALLDTYHAERHPVGVFAARQSLTGPSMALLRPGGKRPQLPADEEAPIFALMIGYRYGANGIELVDELRAQPGTRVPHVWVRDGVSTLDLVGPEFTVLTGDERWCAAAVSVSLPAHRVCNDQWAAITGLAPDGALLIRPDDFVGWRADELPTDPQTALRQALSLCLGRARRARADAKAPDARRVPPRLPVLPESGVTAGCSCDGRGVPAPGPAPR

SEQ ID NO: 3122 - protein, 473 aa, Mycobacterium paratuberculosis
MTITAPETVGESLDPRDPLLRLSNFFDDGSVALLHERDRSGVLAAAGTVNGVRTIAFCTDGTVMGGAMGIEGCSHIVDAYDTAIEEQSPIVGIWHSGGARLAEGVKALHAVGLVFEAMIRASGYIPQISVVVGFAAGGAAYGPALTDVVVMAPESRVFVTGPDVVRSVTGEDVDMASLGGPETHHKKSGVCHIVADDELDAYERGRRLVGLFCQQGHFDRTKAEAGDTDIHALLPESPRRAYDVRPIVTAILDDETPFDEFQANWAPSMVIGLGRLSGRTVGVLANNPLRLGGCLNSESAEKAARFVRLCDAFGIPLVVIVDVPGYLPGVDQEWGGVVRRGAKLLHAFGEATVPRVTLVTRKTYGGAYIAMNSRSLNATKVFAWPDAEVAVMGAKAAVGILHKKKLAAAPEHEREALHDQLAAEHEKIAGGVDSAIEIGVVDEKIDPAHTRSKLTEALAQAPARRGRHKNIPL

SEQ ID NO: 3123 - protein, 390 aa, Mycobacterium paratuberculosis
MRAAPARKVAGQVREGIFARPMTELVTGKTLPNVVVTGIAMTTALATDAETTWKLLLDSQSGIRTLDDPFVEEFDLPVRIGGHLLEEFDSQLTRVELRRTGYLQRMSTILGRRVWENAGSPEVDSNRLMVSIGTGLGSSEEMVFSYDDMRARGMKAVSPLGVQKYMPNGAAAAVGLEHHAKAGVITPVSACASGSEGIAQAWRNIVFGEADIAICGGVETKIEAVPIAAFAQMRIVMSTKNDDPVGACRPFDRDRTGFVFGEAGALMVIETEEHAKARGANILARIMGASITSDGYHMVAPDPNGERAGHAMSRAIQLAGLTPGDIDHVNAHATGTSVGDVAESKAINNALGPHGGNAAVYAPKAALGHSVGAVGAVESILTVLALRDQV

SEQ ID NO: 3124 - protein, 416 aa, Mycobacterium paratuberculosis
VSKPSTANGGYPSVVVTAVTATTSIAPDVESTWKGLLAGESGIHVLEDDYITKWDLPVRIGGHLKEPIDERMSRLDLRRMSYVQRLAKLLSTQLWETAGNPELDPDRFSVVVGTGLGGAERIVESYDLMNEGGPRKVSPLAVQMIMPNGAAAVVGLQLGARAGVITPVSACSSGSEAIAHAWRQIVMGDADVAVCGGVEGPIDALPIAAFSMMRAMSTRNDEPERASRPFDKDRDGFVFGEAGALMLIETEEHAKARGAKPLARLMGAGITSDAFHMVAPAGDGVRAGRAMTRSLELAGLSPKDVDHVNAHGTATPIGDTAEANAIRVAGCQEAAVYAPKSALGHSIGAVGALESVLTVLTLRDGVIPPTLNYETPDPEIDLDIVAGEPRYGDYQYAINNSFGFGGHNVALAFGRY

SEQ ID NO: 3125 - protein, 115 aa, Mycobacterium paratuberculosis
VAVSQEEIIAGIAEIIEEVTGIEPSEVTPEKSFVDDLDIDSLSMVEIAVQTEDKYGVKIPDEDLAGLRTVGDVVAYIQKLEEENPEAAEALRAKLETENPEAVANVKARLEADSK

SEQ ID NO: 3126 - protein, 302 aa, Mycobacterium paratuberculosis
VIALLAPGQGSQTEGMLSPWLELDGAADQLALWSKASGLDLVRLGTTASTEEITDTAVTQPLVVAATLLAHQELTRRGLLADADLVVAGHSVGEIAAYAIAGVMAADDAVALAATRGAEMAKACAVEPTGMSAVLGGDEAEVLARLEQLDLFPANRNAAGQIVAAGSLAALEKLAEDPPAKARVRALGVAGAFHTKYMASALDGYAAAAAAVQTAEPTATLLSNRDGKPVASAAAAMEALVAQLTQPVRWDLCTATLRELEVAAAVEFPPAGTLTGIAKRELRGVSARAVKSPADLDALAEL

SEQ ID NO: 3127 - protein, 441 aa, Mycobacterium paratuberculosis
VNDNPFAGPIAKHPRSPLETLDTVPESVLRRLKQYSGRLATEAVSVMQDQLPFFADLEASQRASVSLVVQTAVVNFAEWMQDPKSNVRHTAQAFELVPQDLARRIALRHSVEMVRVTMEFFEEVVPLLARSEEQLTALTVGVLKYSRDLAFTAATAYADAAEARGTWDSRMEASVVDAVVRGDTGPELLSRAAALNWDTTAPATVVVGTPAPGRDGSTGPGDSERASQHVRDIAAQHGRAALTDVHGTWLVAIVSGQLSPTDKFLGDLLEAFSDGPVVVGPTAPMLTAAYHSASEAISGMNAVGGWRGAPRPVLARELLPERALMGDASAIVALHTDVMGPLADAGPTLIETLDAFLDSGGAIEACARKLFVHPNTVRYRLKRITDFTGRDPMQPRDAYVLRVAATVGQLNYPTHPPSAAGAAMPAVPLPVNGAARGQSGG

SEQ ID NO: 3128 - protein, 929 aa, Mycobacterium paratuberculosis
LTTEFVRHDLATNPTGPAEPDRVRVIREGVASYLPDIDPEETSEWLESFDELLERSGPSRARYLMLRLLERAGEQRVALPSLTSTDYVNTIPTELEPWFPGDEDVERRYRAWIRWNAAIMVHRAQRPGVGVGGHISTYASSAALYEVGFNHFFRGKSHPGGGDQIFIQGHASPGIYARAFLEGRLTADQLDGFRQEHSHAGGGLPSYPHPRLMPDFWEFPTVSMGLGPLNAIYQARFNHYLHDRGIKDTSDQHVWCFLGDGEMDEPESRGLIQVAANEALDNLTFVINCNLQRLDGPVRGNGKIIQELESFFRGAGWNVIKVVWGREWDALLHADRDGALVNLMNTTPDGDYQTYKANDGAYVRDHFFGRDPRTKALVENMTDAEIWNLKRGGHDYRKVYAAYRAAVDHKGQPTVILAKTIKGYSLGAHFQGRNATHQMKKLALEDLKHFRDAMRIPISDAQLDENPYLPPYYHPGSDAPEIRYMLDRRRTLGGFLPERRTKAKALRLPGRDIYAALKKGSGTQEVATTMATVRTFKEVLRDKEIGPRIVPIIPDEARTFGMDSWFPSLKIYNRNGQLYTAVDAELMLAYKESEVGQILHEGINEAGSVGSFIAAGTSYATHNEPMIPIYIFYSMFGFQRTGDGLWAAADQMTRGFLLGATAGRTTLTGEGLQHADGHSLLLAATNPAVVAYDPAFAYEIAYIVESGLARMFGENPEDVYFYITVYNEPYVQPPEPENFDPEGLLRGLYRYHVATEQRANKAQILASGVAMPSALNAAKMLADEWDVAADVWSVTSWGELNRDGVAIDRARLRHPDRPAGVPYVTQALSDASGPVVAVSDWMRAVPEQIRPWVPGTYVTLGTDGFGFSDTRPAARRYFNTDAESQVVAVLEALARDGEIDPSVPVAAARQYRIDDVLAAPEQTSDPGVA

SEQ ID NO: 3129 - protein, 247 aa, Mycobacterium paratuberculosis
LAGCVPWGGSHPDHHRAAPVFDADSRRLVADSAGNAPAGRGQPHTPPGNVRTVLIRWRGVPQVQVGAFPRRGALALGCVAAALIGIVGCTSVTNGTATPDTRVAPAYRQSVSASVSASSVTSSVRESQRQQSLTTKAVRTACAALVTTSKNAIDKTNEFVQAFNSGRGTGPTEGPAIDALNDSANTVANSFNDAMSQQIKDAFNAYIDAAHAVANAIGTHASTSEFNKRVDQLNDTKKKAIQLCLAT

SEQ ID NO: 3130 - protein, 147 aa, Mycobacterium paratuberculosis
MVEGGSTVVAADHAPSYARKLGIQRDQVVQEWGWDEDTDDEIRAAVEEACGSDLLDEDTDEVVDVVLLWWRDGDGDLVDTLMDAISPLAEDGVIWVLTPKTGKPGHVLPAEIAEAAPTAGLMPTSSVNLGDWSASRLVQPKSRAGKR

SEQ ID NO: 3131 - protein, 153 aa, Mycobacterium paratuberculosis
MLSVGTPAPDFTLRDQNQQRVTLSSYRGSKNVLLVFFPLAFTGICQGELDQLRDHLPEFENDDSAVLAISVGPPPTHRIWALESGFTFPVLSDFWPHGAVSQSYGVFNDEAGYSNRGTFVVDRSGIIRFAEMKQPGESRDQRLWTDALAALKA

SEQ ID NO: 3132 - protein, 266 aa, Mycobacterium paratuberculosis
MRPVHPQLTARVEHHRSLPVLVWSFAEPRLCISSGPLGGGIGARDWLVNATVPLDYDRTDPHRHLVEIGAALGLAGTGCGLLTAVDVTRHHLGADGGVQVTATVGLSSPAWAAAPDHHFRREAPHRVGTINIVVAAPVRLSEAALVNAVATATEAKAQALHEAGIRATGTASDAVVVHCPTDGAAEAFGGPRSTFGARIARAVHAAVLAGARSWMSGAAHRPPAGNPTPPRHFEPASAAGSAPRAAGRRAGHRVGADGIEPPTAGV

SEQ ID NO: 3133 - protein, 401 aa, Mycobacterium paratuberculosis
LAGGRQRASPGRISGPDRRGGHILAHYERVKPFRIDVPDDVLDDLRARLARTRWPEAECVDDWSQGMPLAYTRELADYWANDYDWRAREAALNRFDQFVTEIDGLDIHFIHQRSPHADAFPLLITHGWPGSIVEFHKVIEPLTNPASGRAEDAFHVVCPSLPGYGVSGKPTRAGWGVERIARAWETLMLRLGYQRYGAQGGDWGAAVTTQIGRNRGHCVAIHLNMPIGRPGQQALTNPTEQERAALAALANHRKWGTGYSKQQSTRPQTLGYGLADSPVGQLAWIVEKFWDWADCDGHPEKALSRDELLDNVMVYWVTNTAASSARLYWESFSAWGGGDRVELPTGVAAFPGELLKAPRSWCEPAYNITHWTDMPRGGHFAAFEQPELFVEDLRVFFATVR

SEQ ID NO: 3134 - protein, 271 aa, Mycobacterium paratuberculosis
MKRPAKRVADLLNPAATLLPAANVIMQLSLPGVGYGVLESPVDSGNVYKHPFKRARTTGTYLAAATIGTDYDRALICAAVDVAHRQVRSRPSSPVSYNAFDPKLQLWVAACLYRYFVDQHEFLHGPLDEASADAVYRDAARLGTTLQVPERMWPPARAAFDEYWKRSLDELRIDPPVREHLHGVASLAFLPWPLRVLAGPFNLFATTGFLAPEFREMMQLDWTPAQQRRFGWLLFSLRLADRLIPHWVWILGYRIYLWDMRSRARQGRRVV

SEQ ID NO: 3135 - protein, 313 aa, Mycobacterium paratuberculosis
LATHPLGVLIGYLADRALGDPRRGHPVALFGRAVAGLENLTYRDGRVAGALHVGVSIGAVGLLGLAVHRAAARAGPRWSIAATAAAGWVCSGGTSLTRTGLAMAELLQRGDVDAARRLLPSLCGRDPAALDAAGLARAALESVAENTSDAQVAPLLLAAAGGVPAVLAYRGINTLDAMIGHRSPRYLRFGWAAAKLDDIANYPAARVTASLTVLLAPVAGGSPSGAARAWRRDAARHPSPNAGVVEAAFAGALGVRLGGPTQYGHELQIRPTLGAGREPTVTDLRRAVRLSAAVQAAAVALAAGLLAAYRRRP

SEQ ID NO: 3136 - protein, 275 aa, Mycobacterium paratuberculosis
MPRWLRGLSFLLRPGWVVLALVVVAFAYLCFTVLAPWQLGKHSRTSQQNHQIEHSLTTPPVPLKTLLPQQNSAAPAEQWRQVSATGHYLADVQVLARLRVIDSKPAFEVLAPFVVDGGPTVLVDRGYVRPLEGSRVPPIPRPPADTVTITARLRNSEPAAGKDPFVGDGVRQVYSIDTEQIAVLTKVPLAGSYLQLVDGQPGGLGVVGVPQLDAGPFLSYGIQWIAFGILAPIGVGYFAYSELRARRAERQPAAPAPEAPQSVQDKLADRYGRRR

SEQ ID NO: 3137 - protein, 163 aa, Mycobacterium paratuberculosis
VSEPLHVTFVCTGNICRSVMAEKMFADQLRRRGLADAVRVSSAGTGNWHVGECADERAAGVLRAHGYPTEHRAAQVGAEHLSADLVVALDRNHARMLRHLGVDEDRIRMLRSFDPRTGAHTPDVDDPYYGDSKDFERVYTVIEAALPGLHDWVDERLAQNGSS

SEQ ID NO: 3138 - protein, 222 aa, Mycobacterium paratuberculosis
VTGTTSADPAAPAAQLVIFDLDGTLTDSAEGIVASFLHALESIGAPVPRGDLVAQIVGPPMDDTFRSMQLGEDAEAAIAAFRAEYGARGWAMNTLFDGIEALLADLRAAGMRLAVATSKLEPTARRILAHFGLDHHFEVIAGASPDRSRKAKVEVLAHALAQLEPLPERVLMVGDRSHDVHGAAAHGIDTVVVGWGYGHADSHPDGVTRVATIDELRRALGV

SEQ ID NO: 3139 - protein, 356 aa, Mycobacterium paratuberculosis
VLLRAAGPATNVSRMASLNLSPPAARYHGDQAVAPGMLDFAVNVRHSRPPQWLLDRLAARLPDLARYPGDDDVHRAQDAAAERHGRRRDEVLPLAGAAEAFALLSNLRPARAAVIAPSFTEPAAALSAAGVPVHHVVLEPPFGLRGVAVPEEADLVVVGNPTNPTAVLHGREQLLALRRPGRLLVVDEAFADAIPGEPQSLAGDALPDVLVLRSLTKTWALAGLRVGYALGAPEVLARLTAQRAHWPVGTLQLTALAACCGRRAVADAAAGAERLSRLREKMAAGLASVGADVLDGRAPFVLFRMPDAVRVRKLLHDKGIAVRRGDTFVGLDERYLRAAVRPEWPLLVQAIAEVQR

SEQ ID NO: 3140 - protein, 377 aa, Mycobacterium paratuberculosis
VSVKLADVIAVLDQAYPPWLAEPWDSVGLVCGDPDEPVESVTVAVDATPAVVDEVPAGGLLLAHHPLLLRGVDTVAASTPKGALVHRLIRSGRSLFTAHTNADSASPGVSDALAEALGLTVEAVLEPARPASDLDKWVIYVPGENADAVREAVFAAGAGHIGDYSHCSWSVTGIGQFLPHEGASPALGSVGQVERVAEERVEVVAPARARAAVLTAMRAAHPYEEPAFDIFALLPPPGDAGLGRIGRLPQPEPLRRFVSRVDAALPATSWGVRAAGDPELAVSRVAVCGGAGDSLLAAAAGAGVQAYLTADLRHHPADEHRRASEVALIDVAHWASEFPWCAQAADLLRSRFGERLDVRVSAIRTDPWNVGHDGGEG

SEQ ID NO: 3141 - protein, 245 aa, Mycobacterium paratuberculosis
MKADVAQQRSLLELANVDAELSRLAHRAEHLPEQQACERMQQEYDAAGDRLGAVRIALEDIDAHVLRLEAEVDAVRQREDRDRSLLQSGAIDAKQLADLQHELETLQRRQTSLEDSLLEVMERREELQAQLDGEQQALKELEAEMATARRDLDAARGEISESRALHSSRRDALSAELDPELFALYERQRARGGPGAGQLLGRRCGACRLEIDRGELSRISAAAEDDVVRCPECGAILLRVKGSGQ

SEQ ID NO: 3142 - protein, 377 aa, Mycobacterium paratuberculosis
VKVVIEADGGSRGNPGPAGYGAVVWTPDRGTVLAENKQAIGRATNNVAEYRGLLAGLGDALKLGATEAEVYLDSKLLVEQMSGRWKVKHPDLIELHAQARSLAARFDRISYTWIPRERNSHADRLANEAMDAAAAATGTAEKPGPAEQSDPTAADAGKTAAAPSPAAPGWTGARGTPTRLLLLRHGQTELSVQRRYSGRGNPALTETGRRQADAAARYLAARGGISAVFASPLQRAYDTAAVVAKALGLDVTVDDDLIETDFGAWEGLTFGEAAERDPGLHRRWLRDTSTAPPGGESFDSAAERVSRVRQKIIAAQQGSTVLVVSHVTPIKMLLREALDAGPGILYRLHLDLASLSIAEFYSDGAASVRLVNQTGYL

SEQ ID NO: 3143 - protein, 69 aa, Mycobacterium paratuberculosis
MRRVVVDAERCTGHGRCYTLAPDVFDADEFGHCVVRVGRVSGELEVQAGVGEQNCPEQAITVHPPAGDG

SEQ ID NO: 3144 - protein, 389 aa, Mycobacterium paratuberculosis
MTEAGGFVDQTVTGVAEPQPMYKALRESNPVFRSTQAVVLSRLADIEMALKHTELFSSNMDAVDLGNVRPLIPLQIDPPDHAKYRRILDPLFTPREMARREPLVTELVNEMIDRFAPRGECDFHAEFAVPLPCTVFLQLLGLPLEDLDRFLLWKDGVIRPAGDSGFDRRHESSAGVAQQIYEYFDKAIDEHIAVPRDDVLSAMIAADVGGQPLSREELLDICFLFLIAGLDTVTDSLDCFFVYLARHPQHRRQLVERPDVLPGAVEELLRWETPVPGVARVATQDVEVGGCPISKGERVSPLLGAANTDPAEFPDPEIVDFTRSPNRHRAFGGGPHRCLGSHLARMELRVALREFHRRIPDYEIRPGTQLTYTAALRSVESLPLVFPVR

SEQ ID NO: 3145 - protein, 189 aa, Mycobacterium paratuberculosis
MQANTDIDVQVRRRLRELRVQRGLTLQEVGARAGIDVSTLSRLESGKRRLALDHLPRLARALSVSTDELLQPAQAPDPRVRGSAHTHHGVTYWPLTRQGPAGGLHAFKIRVSARRRTPPAELPVHEGQDWMYVLAGRMRLILGDRDFTIDPGEAVEFSTWTPHWFGVVDGPVEAIVIFGPHGERLHLHS

SEQ ID NO: 3146 - protein, 216 aa, Mycobacterium paratuberculosis
MDTSCEPGEAGRFWEERYRGAERVWSGRVNPRLAELAADLPAGRALDLGCGEGADALWLAQRGWTVLAVDISATALRRAAEAAALRKLLARIDFQRHDLNESFPEGMFDLVSAQYFHSPVHLDRDAVLRRAATRVKPGGVLLIVDHGAAPPWAQHDGHHIPGVEEVLGSLRLDPDGWTRLRAEAAGREMTGPNGEVGTLMDNIMMLRRTEQAYAAS

SEQ ID NO: 3147 - protein, 236 aa, Mycobacterium paratuberculosis
MDRWHRRVDSGDWDAIAAAIGEFGGALLPRLVTPREAARLRELYADDGLFRSTIDMAPKRYGAGPYRYFRAPYPEPIEQLKQALYPRLLPIARDWWGKLGRDPVWPDRLDDWLAACHAAGQQRSTALMLKYGAGDWNALHQDLYGDLVFPLQVVINLSDPQTDYTGGEFLLVEQRPRAQSRGTATQLPQGHGYVFTTRERPVRSARGWSAAPVRHGVSVVRSGQRYAMGLIFHDAA

SEQ ID NO: 3148 - protein, 110 aa, Mycobacterium paratuberculosis
LACKPDSVPRRRKTGAAAATIHLDTPSPGASSGLPAGSGEQPSDACAAVPAARPSWPCFGWGLPSHPGHPGCWCALTAPFHPYHREGGGLFSVALSRESPRIAVSNHPAL

SEQ ID NO: 3149 - protein, 539 aa, Mycobacterium paratuberculosis
MPAQAPQTSRHLEVERKFDVVESTVMPSFEGIAAVARVEQSPTQILDATYFDTPAHDLARNKITLRRRTGGSDAGWHLKLPAGPDARTEVRAPLDASDADTVPTELVDVVLAIVRNRPLRPVARITTERDTQVLYDAAGQPLAEFSNDHVTAWATPSAPEGPDDGSGGVDEGSGGFDDTAASPTDQVPTQHPPTQQEWREWELELLGGNGHAEGAAELLNRLSNRLLDAGAVPAGHGSKLARVLGRAPSPNGARPPEDPLQRAIAEQVRELLVWDRAVRADAFDSVHQMRVTTRKLRSLLRDYQDSFGLGDDGWVLDELRELAGILGVARDAEVLAERYERDLGALPPELVRGPVRERLVGGARRRYQVGLRRSLIAMRSQRYFRLLDSLDAIAARRPGFPGAEEQAPVTIDTAYRKVRKAAKAAARVDREHPGDRHLRDEAIHRIRKRAKRLRYTATATRAVRVAERAKAVQSLLGDHQDSVVSREHLSQEAQAAHAAGEDTFTYGLLYQREADLAQRCRDELDDTLRKLGKAVHKAD

SEQ ID NO: 3150 - protein, 150 aa, Mycobacterium paratuberculosis
MERSIRRFCRKAGVRMANHKGFLAARAPIRGEELRGRQAIISDSRPPPAHDGTMQSGGNQSVGRGARMNARRCRAALLVLCGLAAVPAILVAVPGADRADATVCVGAGRRVTVSGCTNIGDNIARYAPPPAVYAPLPEDDTSTPPPPPPP

SEQ ID NO: 3151 - protein, 123 aa, Mycobacterium paratuberculosis
MGERIAAGAAGVAMTVAGLVATLVLTAGPAAADWPMDDPEPAPASLPNCTAADLAQVSAGVAAATSAYLFSHPDVNAYFTSLKGQPRDEMRAQLKQYMDANPQTHSDLEGIRQPLTDFQDRCR

SEQ ID NO: 3152 - protein, 391 aa, Mycobacterium paratuberculosis
VHRRLVFKLPLLLAGGMALARAPHASAQPPRTSPQASRWSPERANRWYQAQDWPVGANYITSNAINQLEMFQPDTFDPRRIDTELGWARRNGFNAVRVFLHDLLWEQDHRGFQGRLARFVDIAARHGIKPLFVLFDSCWDPFPQPGPQRAPRPGIHNSGWVQSPGAARLDDHGYLHTLRGYVTGVLAQFRTDDRILGWDLWNEPDNPADAYASVERTDKLDRVAELLPQVFAWARSVDPCQPLTSGVWQGEWADPARRSVISGIQLDNSDVITFHCYGEPAAFEKRIADLVPLGRPILCTEYMARPLGSTVQTILPIAKRANVGAFNWGLVAGKTQTFFPWDSWEHPDPAMPREWFHDLLDPDGRPFRDSEIQTILELSDLAMHLQPPPAG

SEQ ID NO: 3153 - protein, 285 aa, Mycobacterium paratuberculosis
MSEHNVYGAAQPAQPGQPAQPRTRIRTHHLQKMKAEGHKWAMLTAYDYSTARIFDEAGIPVLLVGDSAANVVYGYDTTVPVSIDELIPLVRGVVRGAPHALVVADLPFGSYEAGPAAALAAATRFMKEGGAHAVKLEGGERVAEQIAHLTAAGIPVMAHIGFTPQSVNSLGGFRVQGRGDAAEQTIADAIAVAEAGAFSVVMEMVPAELATQITGKLTIPTIGIGAGPNCDGQVLVWQDMAGMSSGKSARFVKRFADIGGELRRAATQYAHEVAAGVFPADEHCF

SEQ ID NO: 3154 - protein, 463 aa, Mycobacterium paratuberculosis
MQRLSGLDASFLYLETSSQPMHVCSIIELDTSTVPGGYTFERLRDALVRRIRAIPPFREKLADSPLNLDHPVWVDDEDFDIDRHLHRIAVPAPGGRAELSQICGHIAQTPLDRRRPLWEMWVIEGVAGTDCHRDGRLAVMTKVHHAGVDGVTGANLMSQLCATEPDAAAPEPAAGVGGGAGWRIAAGGLVSFAARPLRLANVVPDTVSSVLATVRRALDGAAMARPFAAPATVFNARISNRRCIAYAELNLDDVKAVKNHFGVKVNDVVMALVSGVLRQYLAERNALPNSSLVASVPISVHGKSGRPGRNQVSAMFASLHTEIADPVQRLKAIAHANSVAKEHSSAIGASLLQDWTQFAAPAVFGIAMRLYARTRFTDSMPVHNLVVSNVPGPQVPLYLLGCEVKAMYPLGPIFHGSGLNITAMSLRGKLDVGLIGCPDLVPDLWELADEFAVAMEELRAAAR

SEQ ID NO: 3155 - protein, 520 aa, Mycobacterium paratuberculosis
VGMGLSRRGKSARTLLIWMSIAAVALLLAGCVRVVVGRAVMSGPKLGQAVEWTPCRAANPKVKLPAGALCGKLAVPVDYDHLDGDVATLAMIRFPATGDKIGSLVINPGGPGESGIEAALGVVQSLPKRVRERFDLVGFDPRGVGASRPAVWCNSDADNDRLRTEPNVDYSPAGVAHIEDETKQFVGRCVDKMGKKFLANVGTVNVARDLDAIRAALGDDKLTYLGYSYGTRIGSAYAEAYPHNVRAMILDGAVDPNADQIEADLRQAKGFQDAFNNFAAECAKQPNCPLGTDPAKAVDVYHSLVDPMVDPDNPMVGRPIPTNDPRGLSYSDAIVGTIMALYSPNLWHHLTDGLSELVDHHGDTLLALADMYMRRDAHGHYTNATDARVAINCVDQPPITDRAKVIDEDRRSREIAPFMSYGQFTGNAPLGTCAFWPVPPTSKPHTISAPGLAPTVVVSTTHDPATPYKAGVDLANELRSSLLTYDGTQHTVVFQGDGCIDNYVTAYLVGGTIPPSGAKC

SEQ ID NO: 3156 - protein, 522 aa, Mycobacterium paratuberculosis
MTAMSRLRSLSSALLSFGLVLGGTSGVGLPVAGATPEPGAGQTPAPNPPAAAAPQGWGSCSQFVTDTSDIPTAQCTTVSVPIDYNNPGAGQAKLAVIRVPATGQRLGSLLVNPGGPGGSAVDMVAAMASDMDNSAIRRSFDLVGFDPRGVGHSTPPLRCRTDAEFDAYRREPMVDYSPAGVAHIEQLYRQLAQQCVNRMGTAFLANAGTASVARDMDAVRQALGDEQINYLGYSYGTELGTAYLEKFSNHVRAMVLDGAIDPTVGPVDENINQMAGFQTAFNDYATDCARSPGCPLGTDPAQFVNRYHALVDPLVTRPGRTADPRGLSYADATTGTINALYTPAHWKYLTSGLLGLARGTDAGDLLALADDYQGRDRNGHYSNDQDAFNAVRCVDAPNPTDQASWVSADQKIRQAAPFLSYGPFTGNAPRDLCALWPVPATSAPHAAPPMPAGKVVVVSTTHDPATPYQAGVNLARQLGGPLITYDGTQHTAVFNGDQCVDNAVVRYFVAGTPPPASYRCQS

SEQ ID NO: 3157 - protein, 446 aa, Mycobacterium paratuberculosis
MDRQKEFVLRTLEERDIRFVRLWFTDVLGFLKSVAIAPAELEGAFEEGIGFDGSSIEGFSRVSESDTVANPDPSTFQVLPWASPNGHHHSARMFCDITMPDGSPSWADPRHVLRRQLQKANDLGFSCYVHPEIEFFLLKPGPDDGTPPVPVDTAGYFDQAIHDSASNFRRHAIEALEFMGISVEFSHHEGAPGQQEIDLRFADALSMADNVMTFRYVIKEVAIENGARASFMPKPFGQHPGSAMHTHMSLFEGDVNAFHSPDDPLQLSDVGKSFIAGILEHASEISAVTNQWVNSYKRLVGGGEAPTAASWGAANRSALVRVPMYTPHKTSSRRVEVRSPDSACNPYLTFAVLLAAGLRGVEKGYVLGPQAEDNVWDLTPEERIAMGYRELPTSLDSALRAMESSELVAETLGEHVFDFFLRNKRTEWATYRSHVTPYELRTYLSL

SEQ ID NO: 3158 - protein, 998 aa, Mycobacterium paratuberculosis
VVVTKPATQRPRLPSVGRLGLVDPQAAERMAQLGWYDHDDQAHVDLLWALSRAPDPDAALLALVRLAETPDAGWDELGAALLTERPLRGRLFAVLGSSLALGDHLVAQPRSWKLLRGNVSLPTHDELCAMFTGCVDEALADPGSAMVRLRTLYRDRLLVLAALDLAATVEDEPVLPFTVVAAHLSDLADAALAAALRVAEHNVCGDRTPPRLAVIAMGKCGARELNYVSDVDVIFVGERADTVTTRVASEMMRLASEAFFQVDAGLRPEGRSGELVRTVESHIAYYQRWAKTWEFQALLKARAAVGDAELGRRYLDALMPMVWVACEREDFVVEVQAMRRRVEQLVPADVRGREIKLGSGGLRDVEFAVQLLQLVHGRSDESLHVASTVDALAALGQGGYIGREDAANLTASYEFLRLLEHRLQLQRLKRTHLLPEADDEEAVRWLARAAHIRPDGRHDAAGVLREELRHQNLRVSQLHAKLFYQPLLESIGPAGLEIRHGMTSEAAERQLAALGYEGPQSALKHMSALVNQSGRRGRVQSVLLPRLLNWMSYAPDPDGGLLAYRRLSEALAGESWYLSTLRDKPAVARRLMHVLGTSAYVPDLLMRAPRVIQDYGDGPSGPRLLETDPAAVARALVASASRYSDPVRAIAGARTLRRRELARVASADLLGMLEVTDVCKALTSVWVAVLQAALDAMIRANLPDDGPQRGKAPAAIAVIGMGRLGGAELGYGSDADVMFVCEPAPGVDDSAAVRWAASVAEQVRTLLGTPSVDPPLDVDANLRPEGRNGPLVRTLASYAACYEQWAQPWEIQALLRAHAVAGDAELGHRFLLMADKTRYPADGVSPEAVREIRRIKARVDAERLPRGADPNTHTKLGRGGLADIEWTVQLLQLLHAHEVPALHNTSTLECLDAIAEAGLVPADEVDLLRQAWLTATRARNALVLVRGKPTDQLPGPGRQLNAVAVAAGWPTDEGGEFLDNYLRVTRRAKAVVCKVFGS

SEQ ID NO: 3159 - protein, 185 aa, Mycobacterium paratuberculosis
LADAVRELVDATIRTEVDDAVVAEARSAIEAVTASLRRRTRPVGVSYRVNGRPLPLGNAAIGVCNPIAPPIVVHHEGDGRCWSEFVLGSAYEGPPRLVHGGVSALVLDHMLGEAASEGLSKARFTGTITVKYLRGTPLGPLRCDAWIDRREGVKVFARGTISDAAGVTVEADGVFIEPAWARETQ

SEQ ID NO: 3160 - protein, 286 aa, Mycobacterium paratuberculosis
VRFYVSSAFLNTREIIEIARAADELGYDGIGIPDHVVNLETLDTPYPYTRDGQRRWQPFTDWPDPWVLIGALAQVTTRLRFVNTVYIPAMRNPYSAAKAIGTAAVLASGRVELGVGVGWCREEFALMGERFEARGKRTDEIIELMRALWAPGWTEFDGEFYSAPRLEMQPTPPPIPVYVGGLSDIALRRAARNDGWIGDLIKTERAIEAVGRLRELRAENGLTMDDFTILTPLTDAFTTADYRRAEDAGITGIITMPWMFYAGPQASLDDKIDGMQRFRKDLALDG

SEQ ID NO: 3161 - protein, 478 aa, Mycobacterium paratuberculosis
VTETTPDDVFKLAKDEKVEFVDVRFCDLPGIMQHFTIPVSFFDESVFEDGLAFDGSSIRGFQSIHESDMLLLPDPATAQIDLFREAKTLNLNFFVHDPFTLEPYSRDPRNIARKAENYLISTGVADTAYFGAEAEFYIFDSVSFDSRTNGSFYEIDAISGWWNTGSPNELDGSPNRGYKVRPKGGYFPVAPVDHYVDLRDQMLSNLIKAGFSLEKGHHEVGTGGQAEINYKFNTLLHAADDMMLYKYIVKNTAWQNGKTVTFMPKPLFGDNGSGMHTHQSLWKDGSPLMYDETGYAGLSDTARHYIGGLLHHAPSLLAFTNPTTNSYKRLVPGFEAPINLVYSQRNRSACVRIPITGTNPKAKRLEFRCPDSSGNPYLAFSAMLMAGLDGIKNKIEPQAPVDKDLYELPPEEAANIPQAPTQLSAVIDRLEEDHEYLTEGGVFTPDLIETWISFKRETEILPVQVRPHPYEFALYYDV

SEQ ID NO: 3162 - protein, 176 aa, Mycobacterium paratuberculosis
LWGHGSQDRIFSVRAAHRLPVPPVPDRRAPRRRSGAMTPESRSAYPGENLGLPQRGPSSLAPMGPRLGALMIDWLISYGLAALAMRLGWFSASALATAVLVIWFVLGVVSVRLFGFTPGQLVLRLQVVTVDGRGLVGTGRAVVRGVLVGTVVPALFTDWDGRGLQDRLTATAVVRR

SEQ ID NO: 3163 - protein, 250 aa, Mycobacterium paratuberculosis
MAKSRSAADNKAARAQAQAARKAAARERRAQLWQAFNIQRQEDKRLLPYMIGAFLLVVGVSVGVGVWAGGLTMITLIPFGVVLGALVAFIVFGRRAQKSVYRKAEGQTGAAAWALDNLRGKWRVTPGVAATGHFDAVHRVIGRPGVILVGEGSPTRVRPLLAQEKKRTARLIGDVPIYDIIVGNGEDEVPLAKLERHLTRLPANITVKQMDTLESRLAALGSRAGAAVMPKGPLPNAGKMRGVQRTVRRK

SEQ ID NO: 3164 - protein, 307 aa, Mycobacterium paratuberculosis
VTVAPEGRKLLRLEVRNAETPIERKPPWIRVRARMGPEYTELKSLVRREGLHTVCEEAGCPNIFECWEDREATFLIGGDQCTRRCDFCQIDTGKPAELDRDEPRRVADSVRTMGLRYATVTGVARDDLPDGGAWLYAETVRAIKELNPSTGVELLIPDFNGRPDRLAEVFGSRPEVLAHNVETVPRIFKRIRPAFTYRRSLDVLTAAREAGLVTKSNLILGLGETPDEVRTALADLRGAGCDIITITQYLRPSARHHPVERWVKPEEFVEFARHAEELGFSGVLAGPLVRSSYRAGRLYRQTARARA

SEQ ID NO: 3165 - protein, 233 aa, Mycobacterium paratuberculosis
VIDSIRSSRALIDVRRLGTVDYRAAWQQQRDLADARVAGGPDTLLLLQHPAVYTAGRRTEPHERPLDGTPVVDTDRGGKITWHGPGQLVGYPIIGLAEPLDVVDYVRRLEEALIKVCADLGLDTVRVPGRSGVWVPGDAGRPDRKVAAIGVRVSRATTLHGFALNCDCELGAFNAIVPCGISDAGVTSLTAELRRPVAVDDVVTSVADAVCDALDGVLPVREHSPGARVASAM

SEQ ID NO: 3166 - protein, 307 aa, Mycobacterium paratuberculosis
LARAGQKAVIAIAGSSGLIGSALAAALRADDHRVLRIVRRAPANGDELSWNPESGDLDPDALRGVDAVVNLCGVNIGKRRWSGAFKQSLRDSRITPTEVLAHAVADAGVATLVNASAVGFYGNTKDRVVDENDRAGTGFLAQLCQDWEAATLPAQYGGARVVLARTGLVFSPAGGALGRLRPLFRTGLGTRLGSGRQYMSWITLEDEVRALLFAIFEPALSGPVNMTGPAPVTNAEFTTAFGRAVNRPTPLMLPGFAVRAALGEFADEGLLTGQRAIPAALERTGFVFHHNTIGEALGYATARPAHD

SEQ ID NO: 3167 - protein, 590 aa, Mycobacterium paratuberculosis
MAFSVQMPALGESVTEGTVTRWLKQEGDTVELDEPLVEVSTDKVDTEIPSPAAGVLTKIIAQEDDTVEVGGELAVIGDAADGAAGGGAQAPSQPSQPQAPAQPEPQAQEPAQAQPEAPAQPQAPAQPAPQESGGGAATPVLMPELGESVTEGTVTRWLKKVGDSVQVDDALVEVSTDKVDTEIPSPVAGVLISITAEEDSTVPVGGELARIGTGAQAPAPAAPQPPPAPKPEPKPEPAPQPQAQPAPQPQAQPAPEPKAQPAQAQPAAGGEGTPYVTPLVRRLAAENDIDLSSITGTGVGGRIRKQDVLAAAEQKQRQQQAAAQPSAAPAPAAAEARKPAAPTPAPALAHLRGTTQKASRIRQITAAKTRESLLATAQLTQTHEVDMTRLVGLRARAKAAFAEREGVNLTFLPFIARAVIDALKIHPNINASYNEETKEITYYDAEHLGFAVDTEQGLLSPVVHNAGDLSLAGLARAIADIAARARSGNLKPDELSGGTFTITNIGSQGALFDTPILVPPQAAMLGTGAIVKRPRVIVDEFGNESIGVRSICYLPLTYDHRLIDGADAGRFLTTIKHRLEEGAFEADLGL

SEQ ID NO: 3168 - protein, 592 aa, Mycobacterium paratuberculosis
MPAPQHSPQHFVHSADGTRIAVYDEGNPEGPTVVLVHGFPDSHVLWDGVVPLLAERFRILRYDNRGVGASSAPKPVSAYRMDRFADDFAAVIGELSPGGPVHVLAHDWGSVGVWHYLKRPGANDRVATFTSVSGPSQDQLVDYIFSGLRAPWRPRAFARALGQALRLSYMILLSIPVLAPLVLRLTLSIPALRRNAVDNIPVEQIHHSDRLAADAARAVKTYPANYFRSFAIRKQGVAVIDVPVQLIVNTEDRYVRPYGYDHTPRFVPRLRRRDIRAGHFSPMSHPQVMAAAVHDFADMAEGKPASRALLRAQVGRPRKAFGDTLVSVTGAGSGIGRATAFAFAREGAELIVSDIDEAAVKATAAEIAGRGGVAHAYVLDVSDAQAVEEFAERVSAAHGVPDIVVNNAGIGQAGGFLDTPAEEFDRVLAVNLGGVVNGCRSFARRMVQRGTGGHLVNVSSMAAYAPLQSLSAYCTSKAATFMFSDCLRAELDAAGVGLTTICPGLIDTNIINTTRFDAPAGARAERVDDRRGQLGKMFALRHYGPDKVADAILSSVQKKKPIRPVAPEAYALYGLSRVMPQGLRNAARLRVI

SEQ ID NO: 3169 - protein, 113 aa, Mycobacterium paratuberculosis
MTVRRLIIGVGAVLLLAGVIGLLAPVSVSDGNGHSIGCGNAVVTDLSAARNANDNSVANVPILNQIVPHTDYVAQCQSSVGGRRAWTIPLAVLGIIAIGATLLTGRRGAATGA

SEQ ID NO: 3170 - protein, 149 aa, Mycobacterium paratuberculosis
VITATREVAAPCERVWEVMAQGWTYTQWVVGNSRTRAVDADWPNPGASIRHSVGVWPLVIDDATVVERSDPPHELVLRAHLGPLGAARITLRLHATRVGCRVEMIEVPARGSVRLIPNQLALLAVYPRNQECLLRLAALAERQEPNPVT

SEQ ID NO: 3171 - protein, 515 aa, Mycobacterium paratuberculosis
MSTEPGYASPVVNVASSLPRRAAASTVLIVPVVSTGDDDKPGAVVASAGSFLSSDAVAEIESGLRALAATGGAEQLHRLVVGSLPVSSVLTVGLGKPRSEWPADTVRRAAGVAARSLSNTETVFTTLAALPGEGVASAAVEGLILGSYRFTEFRSAKTAPKDKGLQKITVLATAKDAKQEVAHGAAVATAVATARDLVNTPPSHLFPDEFAKRARALGESVGLEVEVLDEKALQKGGYGGILGVGQGSSRPPRLVRLIHRGSRLAKKSKQAKKVALVGKGVTFDTGGISIKPAASMHHMTSDMGGAAAVIATVALAAQLQLPIDVIATVPMAENMPSGTAQRPGDVLTQYGGTTVEVQNTDAEGRLILADAIVRACEDNPDYLIETSTLTGAQTVALGARIPGVMGSDEFRDRVAAISQRVGENGWPMPLPDELKEDLKSTVADLSNISGQRFAGMLVAGVFLREFIADGVGWAHIDVAGPAYNTGSPWGYSPKGATGVPTRTMFAVLEDIAANG

SEQ ID NO: 3172 - protein, 178 aa, Mycobacterium paratuberculosis
VSADRPNRHLTVKEATSMVVVGADVHKRTHTFVAVDDVGRKLGEKVVAATTAGHAEAVMWARERFGTEVVWAIEDCRHLSARLERDLMGFGQSVVRVPPKLMAQTRASARTRGKSDPIDALAVARGFLREPDLPVASHDEVSRELLLVDRREVPVAQRTATIKPGCVAGARTRSRPRT

SEQ ID NO: 3173 - protein, 259 aa, Mycobacterium paratuberculosis
VHARGVSLTRSMRWRWRGGFCGSLICRSLLMTRFRGNSCWWIVAKSLWRNALRRSNPAVWRVHELDPDHAPKAGSLDLAKHRRILGDWLVTVPGLVAELARDELADITRLTETINALAKRIGERVRVVAPVLLSLPGCAELTAAKLVGEAAGVTRFKSEAAFARHAGVAPIPVWSGNTAGRVRMTRSGNRQLNAALHRIAVTQIRLDGLGQTYYRHRIAVSGSKTEALRCLKRRLARVVFHHLHTDHQNRIQPCQPAAA

SEQ ID NO: 3174 - protein, 367 aa, Mycobacterium paratuberculosis
VSNEADLLHGPLEDRHRDLGASFAEFGGWLMPVSYAGTVSEHNATRNAVGLFDVSHLGKALVRGTGAARFVNSALTNDLNRIGPGKAQYTLCCNESGGVIDDLIAYYVDDDEIFLVPNAANTAAVVEALQGAAPAGVTVRNLHRSYAVLAVQGPRSANVLAELGLPSDMDYMAYADTSFRQVPVRVCRTGYTGEHGYELLPPWESAGVVFDALAAAVSQAGGQPAGLGARDTLRTEMGYPLHGHELSPDISPLQARCGWAIGWKKEAFFGRDALLAEKEAGPRRLLRGLRMVGRGVLRAGLTVLVGDTPVGVTTSGTFSPTLQAGIALALINTDADVRDGQEVTVDVRGRAATCEVVRPPFVAVKTR

SEQ ID NO: 3175 - protein, 371 aa, Mycobacterium paratuberculosis
MTSGSLEFTVSRSTRPATGAERETILAEPGFGKYFTDHMVSIEYDETEAGRGWHDARVIPYGPIELDPSAIVLHYAQEIFEGLKAYRWADGSIVSFRAQANAARLRSSARRLAIPELPEELFLESLRQLIAVDNAWVPAAGGEEALYLRPFVIATEPGLGVRPSKQYRYLLIASPAGAYFKGGISPVTVWVSTEYVRASPGGTGAAKFGGNYAASLSAQAEAAANGCDQVVWLDAVERRFVEEMGGMNIFFVFGSGGSARLVTPELSGSLLPGITRDSLLQLAIDAGFAVEERKIDIDEWQKKAAAGEITEVFACGTAAVITPVSHVKYGETEFTIADGQPGEVTMALRDTLTGIQRGTFADTHGWMTRLG

SEQ ID NO: 3176 - protein, 251 aa, Mycobacterium paratuberculosis
VMRSLATAFAFGTVLPVPAGGRGPMGRGAMTALPVVGLALGALAAAVAWGGAVVFGRSSPLGGLLAVAALLLITRGLHIDGVADTADGLGCYGPPDRARAVMRDGSTGPFGVAAVVVVVMAQALAFSALAAGRPVPVGVAVAVFAGRVAAVLACRRTVPAAAGSSLGATVAGSQPATVAAAWVAVLLGMSLVAGPRPWHGPVAVLLGLGCGGVLVRHCVRRFGGISGDVLGAAIELTATVSAVALAALVRV

SEQ ID NO: 3177 - protein, 370 aa, Mycobacterium paratuberculosis
VRPGGAGGGRPAGADQNAGGLMEFATVSPPDPGTAAAARARQDTLTKPRGALGRLEDLSVWIAACQGQCPPRQFERARVVVFAGDHGVARCGVSAYPPEVTAQMVANFDAGGAAINALAGVAGASVRVADLAVDADPPDDRIGAHKVRRGSGDITVQDALTAEETERALSAGAAIADEEVDAGADLLIAGDMGIGNTTAAAVLVAALTNVEPVVAVGFGTGIDDAGWARKTAAVRDALFRARRVLPDPVALLRCAGGADLAALAGFCAQAAVRRTPLLLDGMAVTAAALVAEHLAPGARLWWQAGHRSTEPGHALALTALDLEPILDLRMRLGEGTGAALALPIVRAAVAALSSMATFAQAGVSDPSAHP

SEQ ID NO: 3178 - protein, 178 aa, Mycobacterium paratuberculosis
VRTLVLGGIRSGKSQWAEDAVADGLPAGRPVRYLAPGPPGAHDAAWAHRVAEHRDRRPAHWSTIETDDIATELRRCPQVPTLVDDLGGWLTGMLDRHDGWQGGSVTAPVDDVLAAVAEFAGALVLVSPEVGLTVVPATASARRFADELGSLNQRLARLCDRVVLVVAGQPVPIKTPGV

SEQ ID NO: 3179 - protein, 230 aa, Mycobacterium paratuberculosis
VKLLGRKKDQDEDLDEQTAASGGSDVAGAADAASREPRRTGPKGRPTPKRSEARRNARKGPVAPAPMTASEARARRKTLAGPKLSREERRADKAANRARMSERRERMMAGEEGYLLPRDQGPVRRYVRDIVDSRRNLLGLFMPSTLFLMFIMFGVPQLQLYISPAMLVLMAVMSIDGLILGRKVSRMVDAKFPNNTESHWKLGLYAAGRASQMRRLRAPRPQVKHGSSVD

SEQ ID NO: 3180 - protein, 383 aa, Mycobacterium paratuberculosis
LMDDGSMASDDAASSLAPGRLQLPAMQVLVAPDCYADSMSALEASAAIATGWTRSRPGDRFIVAPQSDGGPGFVEVLASRLGETRRLRVSGPLKAMVEAEWVFDRGSATAYLECAQACGLALLGGPPTPETAMAAHSKGVGQLIAEALRVGATRIVVGLGGSACTDGGQGMIAELGGLDTARRQLGNVELIAASDTEYPLLGPWGAARVFGPQKGADTATVAALEVRLQAWALILEAVAGRDVSAEPGAGAAGGIGAGLLALGGRCESGAAIIAEHTRLSDDLDTAELIVTGEGRFDEQSLHGKVVGFLADAARPRGIPVIVLAGQVDLDTATVRSAGIMAALSMAEHAGSARLAQADAANQLMGLASVAAARLGNSGPSRYR

SEQ ID NO: 3181 - protein, 125 aa, Mycobacterium paratuberculosis
MRHVGEAMTVQNESNAKTHGVILTEAAATKAKSLLDQEGRDDLALRIAVQPGGCAGLRYNLFFDDRSLDGDLTAEFGGVTLTVDRMSAPYVEGASIDFVDTIEKQGFTIDNPNATGSCACGDSFN

SEQ ID NO: 3182 - protein, 225 aa, Mycobacterium paratuberculosis
MAGPHSPNHTVGGQGPTPPSESQPLEFPDHPNAGDTGYAAAPQAPPGSANYAGPPPAPAPYPPRRSKRRLIVGLALAVALVAVMTVAIVYGVRTNGANTGATFSEGAAKTAIQGYLDALEHRDIDEIARNALCGLYDGVQDKRSDQALAKLSSDAFRKQFSEVQVTSIDKIVYLSQYQAQALFSMRVSPVSGGPARGQVQGIAQLLFQRGQIMVCSYVLRTGGSY

SEQ ID NO: 3183 - protein, 324 aa, Mycobacterium paratuberculosis
VTIAVTGSIATDNLMRFPGRFSEHLLAEHLQKVSLSFLVDDLVIHRGGVAGNIAFAIGVLGGDVALVGAAGDDFGEYRDWLQRHGVNCDHVLISQTAHTARFVCTTDQDMAQIASFYPGAMSEARNIKLADLVSSLGKPELVIIGANDPEAMVVHTEECRKLGLPFAADPSQQLPRLSGEEIDKLVDGAAYLFTNDYEWELLLSKTGWSEADVQQKVGLRVTTLGAKGVDIVERDGTTTHVGVVPETSQTDPTGVGDAFRAGFLTGRSAGLNLERSAQLGSLVAVLVLESTGTQEWSWDHEVAKSRLAGAYGEDAAAEIAALLA

SEQ ID NO: 3184 - protein, 643 aa, Mycobacterium paratuberculosis
VCGLLAFVAARAGAVGADDAIARASHLMRHRGPDEPGTWAGADGSVVFGFNRLSIIDIAHSHQPLRWGPPETPDRYELVFNGEIYNYLELRDELAARHGAVFATDGDGEAIVAGFHHWGTDVLTRLRGMFAFALWDTVTRELFCARDPFGIKPLFVATGTGGTAVASEKKCLLELAELIGFDTAIDERAVQHYTVLQYVPEPETLHRGVRRLESGCYARIRPGAAPDVTRYFVPRFAAVPITRDTEQARYDEITAVLEDSVAKHMRADVTVGAFLSGGIDSTAIAALAIRHNPRLITFTTGFEREGFSEIDVAVASAEAIGARHIAKVVHPDEFVAALPEIVWYLDEPVADPALVPLFFVAREARKHVKVVLSGEGADELFGGYTIYREPLSLRPFDYLPRPVRRSMGKVSRPLPDGMRGKSLLHRGSLTLEERYYGNARSFSDTQLRDVLPGFRAEWTHTDVTAALYAQSIGWDPVARMQHIDLFTWLRGDILVKADKMTMANSLELRVPFLDPEVFAVASRLPVEAKITRTTTKYALRRALEPIVPAHVLHRPKLGFPVPIRHWLRAGELQDWAYSMVASSQAGHLVDLGAVRRMLDEHRNGVSDHSRRLWTVLIFMLWHAIFVEHSVVPQISEPVYPVQL

SEQ ID NO: 3185 - protein, 360 aa, Mycobacterium paratuberculosis
VTPREQDRSQPLSQGRFPGRVGRRVLRPLALAVTLGVLAIVLSGCSSWADALALGWPKGITPQAHLNRELWIGAVIASLVVGAIVYGLIFWASAFHRKKATDTELPRQFGYNMPLELVLTVTPFLIISVLFYFTVVVQEKMLHIAKDPEVVVDVTAFQWNWKFGYQKVNFKDGTLTYDGADPERKKAMVSKPEGKDAHGEERVGAVRGLNTSDRTYLNFDKVETLGSSDEIPVLVLPTGKRIEFDLASADVVHTFWVPEFLFKRDVIPNAEANNSIHVFQVEEINSPGAFVGHCAEFCGTYHSMMNFEVRVVSPNDFKAYLQQRMDGKSNAEALQAIGQSPVAVTTHPFDSKRGQLAGSQ

SEQ ID NO: 3186 - protein, 139 aa, Mycobacterium paratuberculosis
MHIEARLFEFIAGFFFLTALLYGVLTALFATGGEEWAGTTALALTGGLALIVATFFRFVARRIDTRPEDYEGAEISDGAGELGFFSPHSWWPILIALSGSVAAVGIALWLPWLIVAGVMFILSSVAGLVFEYYLGPEKH

SEQ ID NO: 3187 - protein, 266 aa, Mycobacterium paratuberculosis
MSGSRPPGWEPEEPDPAADPIDHQPDPGGPPADEFPGEDFPAGGDHEDAVEPFDDSVEFDAADQTGQTDAYSRAYSAPESEHFTSGPYVPADLRLYDYDDYDEPAELDEEHGTARWPWVVGVAAIVAAIALVVSVSLLFARTDTTKLANPNTTTASTPPLQDEITTTKPPPPTTPTGPRQVTYSVTGTKAPGDIISVTYVDASGRRRTQHNVYIPWSMTVTPISQSDVGSVEASSLFRVSRLNCSITTSDGTVLSSNSNDAPQTSC

SEQ ID NO: 3188 - protein, 210 aa, Mycobacterium paratuberculosis
MVSRYSAYRRGLGDDTVSPEVIDRILIGACAAIYLALLGVSVAACVALADLGRGFHKAASSPHTTWVLYAVIIVSALIIAGAIPILLRARRISQAEPTARAMTAPARPPVRLGAGVARPATERAPHAPATTPDVGWSGEAVDRIWLRGTVILTGTMGAALIAVATATYLMAVGHDGSSWVGYGFAGVITAAMPVVEWLHIRQLRGAVAEQ

SEQ ID NO: 3189 - protein, 171 aa, Mycobacterium paratuberculosis
VHPPAMRFLLSPAREGCRPGRAPHVGSAARRRRADPVRLSVGCELGRAIDGAWWPRADRITNELPELVAVLTPLLGQIGAINVNWPPLQRPPDFNWPGWERKRQHVMTLIGGDARINLLIIPYATYSALARMVLRCAAGLPVEPRDRGKPAFLTAGSILRAAEQQRVDSAP

SEQ ID NO: 3190 - protein, 219 aa, Mycobacterium paratuberculosis
LALIMGAVFVLLIIYPFLEKRFSGDYAHHNLLQRPRDVPVRTSIGAMAIAFYMVLTLSAMNDIIALKFDISLNATTWIGRIGMVIVPPIVYFVTYRWCIGLQRSDRAVLEHGIETGIIKRLPHGAYIELHQPLGPVDEHGHPLPLEYQGAPLPKKMNKLGSAGSPGIGSFLYADPPSEDAALREAAHASEQRALTALREHQDSIVGSTNGSTNGEDGQH

SEQ ID NO: 3191 - protein, 371 aa, Mycobacterium paratuberculosis
MSPKLSPPKIGDVLARQGEDIDTRYHPSAAVRRQLNKVFPTHWSFLLGEIAMYSFIVLLLTGVYLTLFFDPSMAEVTYNGVYQPLRGVEMSKAFASALDISFEVRGGLFVRQVHHWAALIFSAAIMVHLARIFFTGAFRRPREANWVIGSLLLILAMFEGYFGYSLPDDLLSGIGLRAALSSITLGMPVIGTWLHWALFGGDFPCGGVGSECAAAGYIIPRMYALHILLLPGIILALIGLHLAMVWFQKHTQFPGPGRTEHNVVGVRVMPVFAVKSGAFFAAIVGVLGLMGGLLQINPIWNLGPYKPSHVSAGSQPDFYMMWTEGLARIWPPWEFYFWHHTIPAVVWVGADHGRGVRAADHLPVPGEAVQR

SEQ ID NO: 3192 - protein, 422 aa, Mycobacterium paratuberculosis
VGSPPAAQRRRGRTEEEERRKMSDGDVRGSDTDKGAGAPNEPDEAALAAMSQQELVTLGGKLDGVETVFKEPRWPVEDTKAEKRAERGVALWLLLGGGFGLALLLIFLFWPWEYKPKEAAGSFLYDLATPLYGLTFGMSILSIGIGTILYQKRFIPEEISIQQRHDGASREIDRKTVVANLADAYNGSTIGRRKMVGLSLGVGLGAFGLSTLVAFAGGLIKNPWKPVVPTANGKKAVLWTSGWTPRYPGETIYLARATGTYTGAPFVKMRPEDLDAGGMETVFPWRESDGDGTTPESQEKLRAINQGVRNPVMLIRIRPTDMPRVVKRQGQESFNFGEFFAYTKVCSHLGCPASLYEEQSYRILCPCHQSQFDALHFAKPIFGPAARALAQLPITIDTNGYLVANGDFVEPVGPAFWERTTT

SEQ ID NO: 3193 - protein, 286 aa, Mycobacterium paratuberculosis
MSGRWTNRSARLKKLRSTRTDRSRRRLRRRLSGGLLLLIALTIAGGLAAILTPRPQVAVADESNSALLRTGKQLFDTSCVSCHGANLQGVPDRGPSLIGVGEEAVYFQVSTGRMPAMTGEAQAPRKEPVFDEAQTDALGAYVQANGGGPTTVRNPDGSLAMRSLRGEDLGRGGDLFRLNCSSCHNFTGKGGALSSGKYAPDLEPANEQQILAAMRTGPQNMPKFSDRQLSFEAKKDIIGYIKAVTEERQPGGYGLGGFGPAPEGMAAWIIGMVAAIGLALWIGARA

SEQ ID NO: 3194 - protein, 203 aa, Mycobacterium paratuberculosis
VTSAVGTSGTAITSRVHSLNRPNMVSVGTIVWLSSELMFFAGLFAMYFTARAQSGGKWPPPPTELNLYQAVPVTLVLIASSFTCQMGVFAAERGDVFGLRRWYVITFLMGLFFVLGQGYEYYHLMGHGTTIPGSAYGSVFYLATGFHDLHVTGGLVAFIFLLARTAMSKFTPAQATASIVVSYYWHFVDIVWIALFTVIYFIR

SEQ ID NO: 3195 - protein, 367 aa, Mycobacterium paratuberculosis
VALSSESSAASAARRPSGGPATSWRQVLARLTGGDDLARGQAAWAMDQIMTGEASPAQIAAFAVAMQVKVPTSAEVIELAEVMLNHALPFPAGAIRDDTVDIVGTGGDGVNTLNLSTMAAIVAAAAGVPVVKHGNRAASSLSGGADTLEELGVRIDLGPEQVARSVAEVGIGFCFAPLFHPSYRHTSAVRREIGVPTVFNLLGPLTNPARPRAGLIGCAFAELAEVMAGVFAARRSSVLVVHGDDGLDELTTTTTSTIWRVQAGTVDRLTFDPAGFGFPRAELDDLLGGDAQTNAAEVRAVLAGGQGPVRDAVVLNAAGAIVAHAGLSSRAEWLPAWEDGLARASAAIDSGAAEQLLARWVRFGQQL

SEQ ID NO: 3196 - protein, 643 aa, Mycobacterium paratuberculosis
VSVVLPTVTTVASDGATQLSFADVGPAFGPDEVALRDTTFVVVDLETTGGRSTSTEETAPDAITEIGAVKVRGGVVLGEFATLVDPQRSIPPQIMRLTGITTAMVSDAPAIDAVLPMFLEFAGLDRGAVLVAHNAGFDVGFLRAAAQQCDIAWPRPRVLCTVRLARRVLSREEAPSVRLASLARLFAVTTQPTHRALDDARATVDVLHALIERVGNQGVHTYADLRGYLPDVTPTQRRKRVLAEGLPRRPGVYLFRGPSGEVLYIGTAVDLRRRVAQYFTGADPRGRMKEMVALAGAVDHVECAHALEAGVRELRLLAAHAPPYNRRSRFPQRWWWVALTDEAYPRLAVVRAPRHDRAVGPFRARADAADTAELLARFAGLRTCTNRLGRAALHGPLCPEAEVAPCPAARGVTATQYAAAVARVAALIDGADNSALAAAVDQVAALAERRHFESAARLRDRTATAVETLWRGQRLRALASLPELVAAAPDGQGGYQLAVVRYGRLAAAGNARRGVPPMPVVDAITAAAQAIWPEPGPLGGALVEETALIARWLEAPGVRIVRVKGTPDAAGWASPLRSAGAWAAWAAAARSARLASEQALRASELLTEPHPTREQLFGRAGVDGGAGAGQPVLPGRQPFGAAG

SEQ ID NO: 3197 - protein, 91 aa, Mycobacterium paratuberculosis
MASRTGPTDRGATAGAAPAATPEPGAPVVIDCDDCAARGPGCRDCVVSVILGVPDTLLQDERAALEVLADAGLAPRLRLVPIRRDCGTGVA

SEQ ID NO: 3198 - protein, 385 aa, Mycobacterium paratuberculosis
LRLDSRYPVARALTRSALGTLAGFAILFGIVTAPACADPAEDAMAKLNELSRQAEQTTEAMHSAQLDLNEKLAAQRAAEKKHDDDQAAVDAAKAHLASYQNAVNNLAAATYMGGRVDGMETILTAGSPQGLIDKLAVQRLMATQMASQMKSYRIAGEQAAKAERESAKSAADAKSAAEQAAAVRASLQSKQSQLQVQIAVVKSQYMSLTADQRTALANPGPAVPAAATAPGAPAPEAAPPGTPPGGPGPGEAPPPGGAPGMAPGGGGVGGGDRATVVQAALTQVGSPYVWGGAAPGGFDCSGLVMWAFQQAGISLPHSSQALAHGGQPVSLSDLQPGDVLTFYSDASHAGIYIGDGMMIHSSTYGVPVRVVPMNSSGPIYDARRY

SEQ ID NO: 3199 - protein, 270 aa, Mycobacterium paratuberculosis
VVAAAVPFDAERDGRTRPAQLVSPVRSQFSASSRSLVVGDRTVRLLGLGGPASDRLLARVAAGMGAAITAVEAFWGADWSREISVVAAGTDEEFRAAAGGGPATQWADIAAVTVSDRVDPVRRIASGQRIVFAPGAANMSPASLRIVLAHELFHYASRADTVADAPRWLTEGVADFVGRPPAPVPADALLPLTLPSDTDLDVPGPQRSSAYDRAWWFARFVADSYGPPKLRELYLATCGLRRADLATAAQEVLGTSPAGLLTRWHQWLTH

SEQ ID NO: 3200 - protein, 377 aa, Mycobacterium paratuberculosis
VSRVLLVTNDFPPRPGGIQSYLGEFVGRLAAAGSHELTVYAPHWKGAQAHDEAVGYRVVRHPGTLMLPGPAVDARMRRLIAEHGIDTVWFGAAAPLALLAQRARAAGARRVLASTHGHEVGWSMLPVARSVLRRIGEQTDVVTFVSRYTRSRFAPAFGPRARLEYLPSGVDTDRFRPDPAGRARLRERYGLGERPTVVCVSRLVPRKGQDMLIRAMPSIVQRVDGAALVIVGGGPHLQSLRALARDCGVAAQVTFTGGIPATELPTHHALADVFAMPCRTRGAGLDVEGLGIVYLEASASGVPVIAGRSGGAPETVQHNKTGLVVDGRSVTEIADAVTELLSDPDRAAAMGAAGRQWVTSQWRWDTLAARLAGLLGD

SEQ ID NO: 3201 - protein, 600 aa, Mycobacterium paratuberculosis
VREYSVPARFSVGENENIATMVFEHERDDPNFVIYQRQVDGEWTDVTCAEAAAQIRSAALGLISLGVQAGDRVSIFSATRYEWAILDLAILAVGAVTVPIYETSSAEQVRWVLQDSEAVLAFAETDEHAAMVTELTAELPALRRVLHIDGSGPKALDVLAEAGAGVEPAELTARLDGLRAQDPATLIYTSGTTGRPKGCQLTHSNLLYETRGAKESLPTLLDEGQRLLIFLPLAHVLARSLTLSAFANKVTVGFTSDIKNLLPMFAVFKPTVVVSVPRVFEKVYNTAEQNAANDGKGRIFAMAVQTAVDWSEAADRGRRGPLLRAKHALFDRLVYHKLRAALGGDCHASVSGGAPLGSRLGHFFRGVGLTIHEGYGLTETSSAITVNQVGNVKIGTVGTLLPGNSMRIAEDGELLVRGGVVFTGYWRNEQATADAFTDGWFKTGDLGVLDEDGFLKITGRKKELIVTAGGKNVAPAVLEDRLRAHPLISQAMVVGDNKPFIGALITIDPEAFDGWKQRNHKGAGASVADLTTDPDLVAEVDAAIKDANQAVSHAESIRKFRILPVDFTEDTGELTPTMKVKRNVVAEKFASDLEAIYAKD

SEQ ID NO: 3202 - protein, 132 aa, Mycobacterium paratuberculosis
MHSIQIADETFVAADGARVGAAVADRASWRRWWPDLRLQVVEDRGDKGIRWSVTGALTGTMEVWLEPLKEGLDGVVLHYFLHAEPTGVAAWQLAKLNLAKMTHRRRVAGKKMAFEVKTTLERSRPVGVSPVV

SEQ ID NO: 3203 - protein, 145 aa, Mycobacterium paratuberculosis
VAEKTTQTIYIEADPDTVMKVIADIDSYPQWISEYKEAEVVEKDADGYPKVARIVMDATVLKDTMVMSYQWPKDRRSVSWTLVSSSLLRALEGSYRLAPKGSGTEVTYELSVDLAMPMIGLLKRKAERRLTDTALKDLKKRVEAE

SEQ ID NO: 3204 - protein, 383 aa, Mycobacterium paratuberculosis
VLVVSTDQAHSLGDVLGVPVPPSQAELVRVLADLETGRAEAGGGFLDALALDTLALLEARWRDVVATLDRRFPDSELSTIAPEELSALPGVQEVLGLHAVGELARSGRWDRVVVDCASTADALRMLTLPATFGLYVERAWPRHRRLSLTAEDARSAAVVELLERVSASVEALSALLTDGDLVGAHLVLTPERVVAAEAARTLGSLALMGVRVEELIVNQVLLQDDSYEYRNLPEHPAFYWYTERIAEQQSVLEELDAAIGEVALVLTPHLSGEPIGPKALGALLDAARRRGGAAPPGPLRPTVDLESGTGLGSIYRMRLALPQLDPSALTLGRVDDDLIISAGGLRRRVRLASVLRRCTVLDAHLRGSELTVRFRPDPEVWPK

SEQ ID NO: 3205 - protein, 129 aa, Mycobacterium paratuberculosis
VSGAHPDIGPELRRLAQSILDGIDPAVRAAAALTAGAGPGTGKCQQVWCPVCALAALATGDQHPLLTAIADHSIALLDVIRDIVADIDRASGPTPEPPPDGPPGGAPDTPDTGQAPRTRYQPIPVTFEE

SEQ ID NO: 3206 - protein, 241 aa, Mycobacterium paratuberculosis
MWYWLFKYVLLGPLLSLLGRPKVEGLEHVPSSGPAILASNHLAVMDSFYLPLVVRRRITFLAKSEYFTGTGLKGWFQRWFFTAVGQVPIDRTDADSAQAALTTAQQVLAQGKLLGMYPEGTRSPDGRLYKGKTGLARLALQTGVPVIPVAMIGTNVVNPPGSNMLRFGRVTVRFGKPMDFSRFEGLAGNRFIERAVTDEVIYELMGLSGQEYVDIYAASLKKGGAEAPGGEAARIPETAAG

SEQ ID NO: 3207 - protein, 429 aa, Mycobacterium paratuberculosis
MSTRQAPGAGFPGKRPGWALWWGLAWLTAAAALGYAAWQLFGHTPYRIDIDVYQMGARAWMDGRPLYRGDVLFHTPIVDLPFTYPPLAAIVFCPFAWMHMPTASVAITALTLVLLVVSTVIVLARLDVWSTSALLPGPAWLRRWWLAVVVAAAATIWLEPISSNFAFGQINVVLMTLVIADCLPRRTPWPRGLLLGLGMALKLTPAVFLLYFLLRRDHRAVLTALASFAGATLLGFVLAYTDSWEYWTHTVHHTDRIGSASLNTDQNIAGALARLGLAQQPRSLLWVAASLLVLAVTVWAMRRVLRADEPTLALVCVALFGLVVSPVSWSHHWVWVLPTVLVTGVLGWRRRNAALLVLSVVGVALMRWTPIDLLPKHHEASAVWWRQLAGMSYVWWALAVIVAAGVTVTARAASRDAAPQQLTPVTAIG

SEQ ID NO: 3208 - protein, 268 aa, Mycobacterium paratuberculosis
VLPGRLHPDVLRHPLVRAVHPAPRRDRPAGPVVAPAQRPRRGGHIHHVTFGVVLTLLSGLTLVTLSINGHEPEFTVAATFFGIGAALVLDEYALILHLSDVYWSEDGRTSVDAVFAAVAVGGLLIMGLHPLMFFLPMWHGADSMMLRALVGGAMVLTLPLAVVVVLKGKVWTGLLGMFLVVLLVIGAVRLSRPHAPWARWRYSTQPEKMRRALQRERTLRRPVVRAKLYLQCAIAGTPRFPDERTVDATLDHEVHPAPAPTGPILIGR

SEQ ID NO: 3209 - protein, 162 aa, Mycobacterium paratuberculosis
VRYFYDTECIEDGRTIELISIGVVAEDGREYYAVSTEFDPERAGPWVRANVLPKLPPPASQLWRSRRQIRDDLEEFFGVRAAQSEPIELWAWVAAYDHVALCQLWGPMPDLPRAIPRFTRELRQLWEDRGCPRMPPRSPDAHDALVDARDQLRRFRIITGAG

SEQ ID NO: 3210 - protein, 462 aa, Mycobacterium paratuberculosis
MNWTVDIPIDQLPPLPPLPGDLRARLDAALAKPAAQQPSWPTDQATAMRTVLESVPPVTVPSEIVRLQEQLAQVARGEAFLLQGGDCAETFTENTEPHIRGNIRTLLQMAVVLTYGASMPVVKVARIAGQYAKPRSADIDALGLKSYRGDMINGFAPNAAVREHDPSRLVRAYANASAAMNLVRALTSSGLASLHLVHDWNREFVRTSPAGARYEALATEIDRGLRFMSACGVADRNLQTAEIYASHEALVLDYERAMLRLSDSDAGEPQLYDLSAHTVWIGERTRQLDGAHIAFAEVIANPIGVKIGPTITPELAVEYVERLDPHNKPGRLTLVSRMGNSKVRDLLPPIVEKVQATGHQVIWQCDPMHGNTHESSNGYKTRHFDRIVDEVQGFFEVHRALGTHPGGIHVEITGDNVTECLGGAQDISDMDLVGRYETACDPRLNTQQSLELAFLVAEMLRD

SEQ ID NO: 3211 - protein, 481 aa, Mycobacterium paratuberculosis
MGSTTQGVDSPNRLGEHAVVLGAGIAGLLAARVLSEFYDSVSVVERDKLPDYPCHRRGIPQGRHVHNFYSRGLQVLEELFPGLLDDLARAGAVVVDDGDLSRFYVRFGRYEMKNSGAFADPDALALHMTTRPFMEFHLRRRVKSLPNVTFLDGHDVCDLLNTADIVNGVRITRRYSGFLMALDADLVVDAMGRSARTPAFLESLGYQRPTEERAVARYGYASQQLSMPEASIAQRLVMFNPGGGRPGGLLLANEHDTFILAIGVPADTGEPPTDFAAMLAMAEPSLPPAIVEGLRRAYPIGEAVTYHHTAAFWRRYDQLAEFPSGLLVMGDALCSLDPTYGQGMTIAALEALTLRECLRAGDALLAQRFFRATAQYIGATWAVNQARDRTTSGVYHGVRQRLQGWISRATLNASTQDVVLTERCFRVFNFIDPPSRLRDPALLPRIVWGNLRARFAAKRHRSETAPVGPASPPGNRIAVRS

SEQ ID NO: 3212 - protein, 396 aa, Mycobacterium paratuberculosis
LLDGRYLIESKIASGGTSTVYRGVDTRLDRPVAVKVMDPRYAGDDQFLTRFQREARAVARLKDPGLVAVYDQGLDARHPFLVMELIEGGTLRELLGERGPMPPYAVAAVLRPVLGGLAAAHRAGLVHRDVKPENVLISDDGEVKIADFGLVRAVAAAGITSASVILGTAAYLSPEQVRDGAATPRSDVYAAGIVAYELLTGRTPFTGDSMLAIAYRRLDADVPPPSAAIDGVPAQFDDFVQRATARDPADRYADAVEMGADLDAIADELALPGFRVPAPRNSALHRSAALHREAGRRAPAAEPPARHPTRHLTRGPEEWPQPDPPAHVGAEPDDDEDDYEYQSVTGEFAGIPISEFVWARQHNRRMVLVWLALVLAVTGMVATAAWTIGRNLNGLF

SEQ ID NO: 3213 - protein, 154 aa, Mycobacterium paratuberculosis
VVIGRRNTGSTRASTPTLARVSSIPAGDDVLDPDEPIYDLPRVAELLGVPVTKVHQQLREGHLVAVRRGEALVVPQVFFTKSGEVVKSLPGLLTILHDGGYRDTEIVRWLFTRDPSLTVTRDGSRDAISNARPVDALHAHQAREVVRRAQAMAY

SEQ ID NO: 3214 - protein, 505 aa, Mycobacterium paratuberculosis
MATGTDTPAADPPAAKPSRGQWFSRLKAFAGSADSGPAKLGMLGSVLITLGGLGAGSTRQHDPLLESIHMSWLRFGHGLVLSSIVLWTGVGLMLIAWLSLGRRVLAGEATEFVMKATTGFWLAPLLVSVPVFSRDTYSYLAQGALLRDGLDPYAVGPVANPNSLLDNVSPIWSITTAPYGPVFILVAKIITILVGNNVVAGTALLRLCMLPGLVLLIWATPRLARHLGADEPTALWICVLNPLVLIHLMGGVHNEMLMVGLMAAGIALTFGGRPVAGVTLITVAIAVKATAGIALPFLVWVWARQLRDRRGYRPVPAFFAATAASLLIFAVVFAALSAVAGVGLGWLTALAGSVKIINWLTVPTAAANLIHAIGSGFFPVSFYPILRVTRLVGIAIIAISLPLLWWRFRRDDRDALTGIAISMLIVVLFVPAALPWYYSWPLAVLAPLAQSRRAVAIIGGLSTWVMVIFKPDGSHGMYSWLHFSLATAVALVAWYSLYRVPQPAQ

SEQ ID NO: 3215 - protein, 348 aa, Mycobacterium paratuberculosis
LTGAITEQLRRYLHDRRAETAYIGDDYSGLIAALEEFVLNGGKRLRPAFAYWGWRAVATEAPDDQALLLFSALELLHACALVHDDVIDDSATRRGRPTTHVRFASLHRDRQWQGSPERFGMSAAILLGDLALAWADDIVLGVDLTPQAARRVRRVWANIRTEVLGGQYLDIVAEASAAASIASAMNVDTFKTACYTVSRPLQLGAAAADRPDVHDLFSQFGTDLGVAFQLRDDVLGVFGDPAVTGKPSGDDLRSGKRTVLLAEAVELAEKSDPLAAKLLRDSIGAQLSDAEVDRLRDVIESVGALAAAEQRIATLTQRALATLAAAPINTAAKAGLSELAKLATNRSA

SEQ ID NO: 3216 - protein, 302 aa, Mycobacterium paratuberculosis
MERSRVTLNTIALELVPPNADEGRERALEEAHKVVRHSAESGLDGRIRHVMIPGIIAEDDDRPVPMKPKLDVLDFWSVVKPELPGIKGLCTQVTAFMDEQSLHGRLTELCSAGMEGVVFVGVPRTMNDGEGSGVAPTDALSIYRDLVTNRGVILIPTRDGEQGRFSFKCDRGATYGMTQLLYSDAIVGFLREFARQTDHRPEILLSFGFVPKMESRVGLINWLIQDPGNAAVAREQEFVKTLAASEPAQKRRQMVDLYKRVIDGVGDLGFPLSIHLEATYGISGPAFQTFAEMLAYWSPRPS

SEQ ID NO: 3217 - protein, 243 aa, Mycobacterium paratuberculosis
VRARPAPPRRRGSQAARMRRRRLLAFAMLLLVVPLATGCLRVRASLTISPDDLVSGEIVAAAKPKTPKDTGPQLDSNNLPFSQKVAVSNYDSDGYVGSQAVFSDLTFAELPQLANMNSDAAGVNLSLRRNGNLVLLEGRADLTSLTDPEADVELTVAFPGVVTSTNGDRVEPDVVSWKLKPGVVSTMTAQARYTDPNTRSFTGAVVWLGIASFAAAGVVGLLAWVSRDRSPRLTAPRDQPPPE

SEQ ID NO: 3218 - protein, 200 aa, Mycobacterium paratuberculosis
LAIFLIDLLPHDMERRLGDALAVYVDAMRYPRDTENQRAAMWLEHIRRRGWQGAAVVEAEVDDDDQMPSAEELASAPLLGVAYGYPGAPGQWWQQQVVLGLQRGGSPPQEIARLMNDYFELTELHIHPRAQGRGLGEALARRLLAGRAEKNVLLSTPETNGEPNRAWRLYRRLGFTDIIRRYHFAGDPRPFAILGRELPL

SEQ ID NO: 3219 - protein, 133 aa, Mycobacterium paratuberculosis
MPLSDHEQRMLDQIESALYAEDPKFASSVRGGRFRAPTARRRLQGVALFVIGLAMLVSGVAFKATMIGNFPILSVFGFIVMFGGVVFAITGPRLPGRPDLSGPAPTSLRQRRNRSGGSFTSRMEDRFRRRFDD

SEQ ID NO: 3220 - protein, 143 aa, Mycobacterium paratuberculosis
VFLGTYTPKLDDKGRLTLPAKFRDALAGGLMVTKSQDHSLAVYPRAEFEQLARRASKASKSNPDARAFLRNLAAGTDEQHPDAQGRITLSADHRRYASLSKDCVVIGAVDYLEIWDAQAWQDYQQTHEENFSAASDEALGDII

SEQ ID NO: 3221 - protein, 386 aa, Mycobacterium paratuberculosis
MKHSATSSEAHARATWPLPEPTLAYFPNARFVPSDRDLDAGAARPIRGGVAVVDDSPDFGHVPVLLERCVELLTPALTRRHPDGSGAVLLDATLGAGGHAERFLADLPGLRLIALDRDPSALEIARERLARFADRITLVHMRYDGIAAALTESGYAATESVDGILFDLGVSSMQLDRPERGFAYAQDAPLDMRMDPGSPLTAADILNTYDEAELADILHRYGEERFARRIAAQIVRRRAKEPFTSTADLVSLLYQAIPAPARRTGGHPAKRTFQALRIAVNDELDTLRRALPAALDALAVDGRIVVLAYQSLEDRIVKRLFAQAVASRTPVDLPVELPGHEPRFRALTHGAGRADAAEIERNPRSAAVRLRALQRTQAPQATGKGD

SEQ ID NO: 3222 - protein, 425 aa, Mycobacterium paratuberculosis
LMRAERETAKRRGGSDRRGARDGAARRGRRPAADAGAARRARGGRASAPARESRAPKPGPQTSPVARPAERSARPRNTSQAKARAKARKAKAPKVVRPRLTERLAARLAAIDLRPRTLASKVPFVVLVIGALGVGLGLTLWLSTDSAERSYKLSHARERTRLLQQQKEALERDVREAEAAPALAEAARKQGMIPTRDTAHLVQDPSGNWVVVGTPKPADGVPPPPLNSKLPDEAPQPPKPAPPAAEVPIRVEPAPGGPVPARSGPEALLRAPDGASTLGGQHLAPAVPPVPGAPPGVPGGPVAAPPALPGGPVAAVPPALPAVPTGPATGRPPGLTPGLPMPGLPMPAGPAVAPAPAEVSIPLGGLPVPAPGQLPAPLPPEVPVPVQLGRPGAAPQPVVPAAPLPQPVNGAQPGPAPVATPGAPR

SEQ ID NO: 3223 - protein, 663 aa, Mycobacterium paratuberculosis
VSRGDSARARRSQSVRPTRGPRKDVQGKAIRQPKRRGKANQAEAAPGHSARQRRTRQIAQLTSRGGSFVFRHRAGNVVMLVAMVVAAAQLFVLQVTNASALRAQAAGQLKVTDVEKAVRGSIIDRHKDQLAFTIESRALTFQPKRIHKQLEEAKAKNPSAPDPQQRLRDIAKEVSGRLGNKPDSATVLKKLQSDENFVYLARAVDPAVASAISDKFPEVGSERQDLRQYPGGSLAANIVGGIDWDGHGLLGLEESMDSVLSGTDGSVTYDRGSDGVVIPGSYRNRHRAVNGSMVQLTLDDDIQFYVQQQVQQAKNVSGAHNVSAVVLDAKTGEVLAMANDNTFDPSQDIGRQGDKQLGNPAVSSPFEPGSVNKVITASSVIEYGLSNPDEVLQVPGSIQMGGVSIHDAWDHGVMPYTTTGVFGKSSNVGTLMLAQRVGPERFYDMVRKFGLGQRTNVGLPGESAGLVPPIDQWSGSTFSNLPIGQGLSMTLLQMTGMYQTIANDGVRIPPRIIKATIAPDGTRTEEPRPEGVRVVSPQTAQTVRNMLRAVVQHDPMGYQQGTGPAAAVTGYQMAGKTGTAQQINPACGCYFDNVYWITFAGMATVDNPRYVIGIMMDNPERNADGTPGHSAAPLFHNIAGWLMQRENVPLSPDPGPPLTLQAT

SEQ ID NO: 3224 - protein, 520 aa, Mycobacterium paratuberculosis
VVSVPTGLRPSAVPGVRLPALADQVGAVMAGPDRRAAVPDVTVTGVTLRAQDVLPGDLFAALPGATTHGARHAAEAIERGAVAVLTDAAGVAQLTGGRTTPTLLHPRPRSVLGQLAAAVYAHPSERLTVIGITGTSGKTTTTYLVESGLRAAGRTAGLIGTVGIRIDGADIPSALTTPEAPALQALLAAMAEQRVDTVVMEVSSHALALGRVDGTRFAVGGFTNLSRDHLDFHPTMADYFEAKALLFDPNSPLRAHRAVVCIDDEAGREMAARAGDAVTVSAEGQPAHWRAVEVAPLGTGGQQFTVIDPAGVQHRAGIRLPGHYNVANCLVALALLDAVGVSPEQAAPGLLQTRVPGRMEEIDAGQDFLALVDYAHKPGALRAVLSSLKRPDRRLAVVFGAGGERDPGKRAPMGATAAELADLVVVTDDNPRGEDPAAIRREILAGVTESGCAAEVVEIGDRRAAIRHAVAWAGPGDVVLVAGKGHETGQRTGEHTRPFDDRVELAEALREAVGPRKAQG

SEQ ID NO: 3225 - protein, 519 aa, Mycobacterium paratuberculosis
MIELTVAQIADIVGGTLADITAPDAARRRVTGTVEFDSRAVGPGGLFLALPGARTDGHDHAEAAVAAGAVAVLAARPVGVPAIVAPPVDAADALAGVLEHDADGSGAAVLAALAKLARAVAAELVAGGLTIVGITGSSGKTSTKDLVAAVLAPLGEVVAPPGSFNNELGHPWTVLRATADTDYLVLEMSARHPGNIAALAEIAPPAVGVVLNVGTAHLGEFGSREAIARTKSELPQAVPASGVVVLNVDDPTVAAMAEVTAARVVRVGRAEHTEAGPSDVWAGPVSLDELARPGFTLYHRHAGGTRQARVQLGVSGDHQVGNALCAAAVALECGATVEQVVAALAGAGPVSRHRMQVSTRGDGVTVIDDAYNANPDSMRAGLQALAWIARGGAEPGAPARRSWAVLGEMAELGDDAIAEHDRIGRLAVRLDVSRLVVVGTGRSVSAMHHGAVMEGSWGSADKGAVNVPDAEAALELLRAELQPGDVVLVKASNAAGLGALADALARDDREGDSAGGTRR

SEQ ID NO: 3226 - protein, 359 aa, Mycobacterium paratuberculosis
MRQILIAVAVALTVSILLTPALIRLFTRQGFGHHTREDGPPTHHAKRGTPSMGGVAIIAGIWAGYLGTHLAGLAFDGEGISASGLLVLGLATVLGIVGFLDDLIKIRRSRNLGLNKTAKTIGQVAAAVLFGVLALGFRNANGLTPASADLSYVREIATVTLAPGLFVLFCVVVVSAWSNAVNFTDGLDGLAAGSMAMVTAAYVLITFWQYRNACVTAPGLGCYNVRDPLDLAIVAAATAGACIGFLWWNAAPAKIFMGDTGSLALGGIIAGISVTSRTEILAVVLGSLFVAEVSSVVLQILTFRTTGRRVFRMAPFHHHFELAGWAETTVIIRFWLLTAIACGLGVALFYGEWLAAIGA

SEQ ID NO: 3227 - protein, 489 aa, Mycobacterium paratuberculosis
MSAAEPALAPLSPGAPVLVAGGGITGRAVLAALRRFGAAPTLCDDDPATLRGYVDSGVDTVSTSAAAERISRYALVVTSPGFAPTAPLPLAAAAAGVPVWGDVELAWRLDVAGHYGPPRRWLVVTGTNGKTTTTSMLHAMLTAAGRRSLLCGNIGSPVLDVLDQPAELLAVELSSFQLHWAPSLRPEGGAVLNIAEDHLDWHGTLADYAAAKARVLDGRVAVVGLDDSRAAALLSTARAPVRVGFRLGEPAAGELGVRGGQLVDRAFADDLTLLPVDSIPVPGPVGVLDALAAAALARCVDVPASPIAEAIVSFRVGRHRAEVVAVADGITYVDDSKATNPHAAEASVLAYPRVVWIAGGLLKGASVDAEVARMASWLVGAVLIGRDRREVAEALSRHAPDVPVVHVVTGEDAGMDATPVVFGANVTKVKHLGGDLGAAVMSAAVAAARDLAKPGDTVLLAPAGASFDQFAGYADRGEAFAAAVRAAIR

SEQ ID NO: 3228 - protein, 606 aa, Mycobacterium paratuberculosis
VGNALTRLLGRGKDTTKTAEPADDDGAAAETGAVPDCAPEAADEQDQQATDEPTKTSQKASQKASKKESKKAPKDKPTDGSSHSRFGAWLSRPMTSFHLIIAIAGLLTTLGLIMVLSASGVRSYDADGSAWVIFGKQVLWTVIGLIACYASLRMSVRFIRRVAFTGYVVTVILLVLVLVPGIGNLANGSRKWFVVAGFSMQPSELAKIAFAIWGAHMLAARRLDRASLRELLIPLVPAAVIALALIVAQPDLGQTVSLGIILLALLWYAGLPLRVFITSLLAVFMAGAVLAMSAGYRSDRVRSWMNPENDPQDTGYQARQAKFALAHGGIFGDGLGQGVAKWNYLPNAHNDFIFAIIGEELGFIGAFGLLVLFGLFAYTGMRIARRSADPFLRLLTATTTMWVLGQAFINIGYVIGILPVTGIQLPLISAGGTSTAATLFMIGIMANAARHEPEAVAALRAGRDDKVNRLLRLPLPEPYSPTRLEAFRDRKRTGPQPAPKSAPKSRPAPRKGAKPAGRKPTRNAGRNATRNAGFHADAPLPPPLPRTAGRAGRQSGGNTRARARHHGSGQRYASLGANSGANQAASSRAGQRQPRRARALEGQRYG

SEQ ID NO: 3229 - protein, 408 aa, Mycobacterium paratuberculosis
VNDTVKKPTGGRGDDPLPAGAALSAVAPHEPVSVVLAGGGTAGHVEPAMAVADALKALDPHVRITALGTARGLETRLVPERGYDLELITPVPLPRKPTGDLARLPSRVWRAVRETRAVLHAVDADVVIGFGGYVALPAYLAARGVSPRKPRVPVVIHEANASAGLANRVGARTAQRVLSAVPDCGLPGAEVVGVPVREAITSLDRAALRAEARRHFGFADDARVLLVFGGSQGAASLNRAVSGAAAQLAAAGVSVLHAHGPKNTLDLREPQPGDPPYVAVPYLDRMDLAYAAADLVICRSGAMTVAEVSAVGLPAIYVPLPIGNGEQRLNALPVVDAGGGMVVADADLTPELVAREVAGLVGDPPRLAAMTTAAARVGHPDAARRVAQAALDIGRTARLARGATGGRP

SEQ ID NO: 3230 - protein, 496 aa, Mycobacterium paratuberculosis
VTTDQLPAELERVHMVGIGGAGMSGIARILLDRGGLVSGSDAKESRGIHALRARGAQIRIGHDASSLDLLPGGPTAVITTHAAIPKTNPELVEARRRGIPVILRPAVLAKLMDGRTTLMVTGTHGKTTTTSMLIVALQHCGRDPSFAVGGEMGEAGTNAHHGSGDCFVAEADESDGSLLEYTPDVAVVTNIETDHLDFYGSADAYVAVFDAFVERLAPGGALVVCVDDPGAAALARRTAELGIRVLRYGSGSHGQAPSGQPLAATLVSWQQQGTEAVAQIRLAGEQQHPLVMRLSVPGRHMALNAMGALLAAIEIGAPTEAVLDGLAGFEGVRRRFELVGTAGGPAPSSTVRVFDDYAHHPTEIAATLAAVRTLLEQSGGGRSIAVFQPHLYSRTKAFAEEFGRALDAADEVFVLDVYGAREQPLAGVSGASVAEHVSVPVRYLPDFSAAAEQVAAAAAPGDVIVTMGAGDVTLLGPEIVTALRVRANRGAPGALR

SEQ ID NO: 3231 - protein, 324 aa, Mycobacterium paratuberculosis
GAAPAGPPRTSRTPRRAGPGHGHRGGAPRGQAQGRRAAGQPAQTRCARRGSGPEDVDGDHPAGGRRDRSGPGPLLHAGDVGAQHRRRRHRRGDPGGSAGRGAGAAGHAAAADRHRPGRRPGGGDPAGGQRTSAAPVPVRAADHHRRANPGGGQRLSRRAAPVRPRRRGLRDRAAAAGAALPRRRRPGAQRPGDQGRPAGADRAAARGRGSGGPDRCALGGVDHPDPGRRPGGDLGDHRPHRREGREAGGAADPAGQDLRRVQPRPADGQVAMFVTPTPPGSAIPSAHRRRGGKNAQNLRDARRRACRVSARRAHTVLVARNYLT

SEQ ID NO: 3232 - protein, 386 aa, Mycobacterium paratuberculosis
MTPPHNYLAVIKVVGIGGGGVNAVNRMIEQGLKGVEFIAINTDAQALLMSDADVKLDVGRDSTRGLGAGADPEVGRKAAEDAKDEIEELLRGADMVFVTAGEGGGTGTGGAPVVASIARKLGALTVGVVTRPFSFEGKRRSNQAEAGINALRESCDTLIVIPNDRLLQMGDAAVSLMDAFRSADEVLLNGVQGITDLITTPGLINVDFADVKGIMSGAGTALMGIGSARGEGRSLKAAEIAINSPLLEASMEGAQGVLMSIAGGSDLGLFEINEAASLVQDAAHQDANIIFGTVIDDSLGDEVRVTVIAAGFDAAGPGRKPVIGGSADKGEKTGGAHRIESAKAGKLTSTLFEPVDAVSVPIHTNGSTLNIGGEDDDVDVPPFMRR

SEQ ID NO: 3233 - protein, 251 aa, Mycobacterium paratuberculosis
MDSTRLADKRFADTGHVSVRIRRVTTTRAGGVSKPPFDSFNLGDHVGDDPAAVAANRARLAAALGLKPERVVWMNQVHGDRVEVVHGPRDGAVDATDALVTGTARLALAVVTADCVPVLLADARAGVAAAVHAGRVGAQRGVVVRTVEAMRALGAQPADMSALLGPAVSGANYEVPAAMADEVEAALPGSRTTTAAGTPGLDLRTGIACQLRELGVTAIDIDPRCTVADPALFSHRRDAPTGRLASLIWME

SEQ ID NO: 3234 - protein, 264 aa, Mycobacterium paratuberculosis
VTAMTAGTPAPDSAGDRETELTHALAAVRSRLAAAAEAAGRNVAEIEVLPVTKFFPATDVVTLSRLGCRAVGESRDQEATAKVAEVTRLLATSARTNVAIPRWHMVGHIQRNKARSVARWAHTAHSVDSTHLVSALDRGVAAALADGGRTDPMRVYVQVSLDGDESRGGVDISRPGAVDEVCAQVAAANNLDLVGLMAIPPLNSDPDEAFDRLQSEHRRVLETHRNAVGLSAGMSDDFEIAVKHGSTCVRVGTALLGRRPLPSP

SEQ ID NO: 3235 - protein, 236 aa, Mycobacterium paratuberculosis
VVTAVTASSLTPAISGARRVNAMSTLHKVKAYFGMAPMDDYEDEYYDDRAPSRGFPRPRFDDGYGRYDGDDYDDPRREPADCPPPAGYRGGYAEESRYGAVHPREFERPEMGRPRFGSWLRNSTRGALAMDPRRMAMMFEEGHPLSKITTLRPKDYSEARTIGERFRDGTPVIMDLVSMDNADAKRLVDFAAGLAFALRGSFDKVATKVFLLSPADVDVSPEERRRIAETGFYAYQ

SEQ ID NO: 3236 - protein, 96 aa, Mycobacterium paratuberculosis
LVLFFQILGFALFIFWLLLIARFVVEFIRSFSRDWHPTGITVVVLEIIMSITDPPVKLLRRLIPQLTIGAVRFDLSIMVLLLVAFIGMQLAFGAAA

SEQ ID NO: 3237 - protein, 260 aa, Mycobacterium paratuberculosis
MPLTPADVHNVAFSKPPIGKRGYNEDEVDAFLDLVEAELTRLIEENSDLRQRIEELDQELAAGGGAAAPAAAAPTQAIPVAEPEPVKAAPAAAVSNEEQAIKAARVLSLAQDTADRLTSTAQAESEKMLADARANADQILSEARSTAETTVAEARQRADAMLADAQARSEAQLRQAQEKADALQADAERKHSEIMGTINQQRTVLEGRLEQLRTFEREYRTRLKTYLESQLEELGQRGSAAPVDSSADAGGFDQFNRGNN

SEQ ID NO: 3238 - protein, 131 aa, Mycobacterium paratuberculosis
LMLIIALVLALIGLVALVFAVVTSNELVAWVCIAASVVGVVLLILDALRERQQRDLGGDEAHEDADEDADEAGADEDDFVDYPEDAPTQSSADADATESTEATEPSDQSGQAGPSEESAVPADGRGDEATH

SEQ ID NO: 3239 - protein, 238 aa, Mycobacterium paratuberculosis
LEDTFGTPPMNRPNGFLRRTAMRSFRDRREAGRALAGELMGYRNRGDVLVFGLARGGLPVAWEIAAALHAPLDVFLVRKLGVPNWSELAMGALASGGGVVMNDDVVSSLRITDEQVRAVIDSETAELARREHAYRGDRPMADLRDKVVILVDDGIATGASMLAAVRALRSGPTGATPKSIVVAVPVGPESACRELGREADEVVCLSTPPGFEAVGQVYGDFHQVSDDEVRELLATPTG

SEQ ID NO: 3240 - protein, 75 aa, Mycobacterium paratuberculosis
MADNKLDKWVMLRNTKLHNTLRDGPGECDIRLDDRTVRVRHDLSGRRVDVLPAVGAIPWNDGSEAGSPMRGRSCQ

SEQ ID NO: 3241 - protein, 451 aa, Mycobacterium paratuberculosis
VTIQSGASEVTANPSDDVVEVVSTLIRFDTTNTGEPETTKGEAECAQWVAEQLAAVGYAPHYVESGAPGRGNVFVRLPGADSSRGALLIHGHLDVVPAEPTEWSVHPFSGAVKDGFVWGRGAVDMKDMVGMMIVVARHLKRAGIVPPRDLVFAFIADEEHGGTFGAQWLVDNRPELFAGVTEAIGEVGGFSLTVPRRDGGERRLYLIETAEKGLSWMKLTARGPAGHGSMVHDQNAVTAVAEAVARLGRHQFPLVLTDTVNQFLAAVSEETGLTFDTQSGDLRGVVEKLGPMARMLKAVLHDTANPTMLKAGYKANVVPAIAEAVVDCRILPGRKAAFEAEIDELIGPDVTREWIKDFSSYETGFDGDLVDAMNDAVLALDPDARTVPYMLSGGTDAKSFARLGIRCFGFSPLRLPPDLDFTALFHGVDERVPIDALRFGTDVLTHFLTHC

SEQ ID NO: 3242 - protein, 176 aa, Mycobacterium paratuberculosis
MSTAPDPYASLPKLPTFTLTSQSLTDGGTLAKPQVSGIMGAGGEDVSPQLSWSGFPAETRSFAVTVYDPDAPTASGFWHWAVANLPADVTELPAGAGDGSNLPGDALTLVNDAGQRRYIGAAPPPGHGPHRYYIAVHAVDTEKLDLPEDASPAFLGFNLFQHAIARAVIHGTYEQK

SEQ ID NO: 3243 - protein, 468 aa, Mycobacterium paratuberculosis
MHSSTREEIRADVDALRAAVSRVLGHSYDALTTPERLRLLEIFERETRRLRAPGHQLINQLAEQSDPTELGGRLSFALAERLHITRSDASRRIAEAADLGPRRALTGEPLPALLPATAAAQRYGAIGTDHVAVIRQFFDQLPEAVDVETCEHAERQLAAQATQFRPDQLSKLARRLMDCLNPDGRYSDEDRARARGLVLGNQQADGMSRLSGWLTPEARASWEAVLAKLAALGMCNPDDDAPVVDGPPPEAAAQRDSRSAAQRNHDGLNAALRALLAGGKLGQHNGLPASIIVTTTLRDLESAAGKGLTGGGTLLPMSDVIRLARHAHHYLAVFDNGKPLALYHTKRLASPGQRIVLYAKDRGCSHPGCDVSGYSCEVHHVTGYAKCGRTDIDQLTFACGGHHPLAEQGWITRKNGRGETEWIPPPHLERGQPRVNSFHHPEDMLCDTEDQQDQADQQDGADEEDGAA

SEQ ID NO: 3244 - protein, 370 aa, Mycobacterium paratuberculosis
VSGAPPAPRGGGHRWYGVARQLFFLVPAERIHTLVFALLRGVTAVGWPRRLLRRLLAPTDPVLASTVFGVRFPGPLGLAAGFDKDGLGLHAWGALGFGYAEIGTVTAGPQPGNPAPRLFRLPADRALLNRMGFNNLGAGALAVRLARRQPDIPIGVNIGKTKATPPDQAVDDYRASARLLGPLASYLVVNVSSPNTPGLRDLQAVGSLRPILSAVLAETSTPVLVKIAPDLSDSDVDDIADLAVELGLAGIVATNTTVSRDGLRTAGVDQLGAGGISGPPVARRAVEVLRRLYGRVGDRLVLISVGGIETADHAWERITAGASLLQGYTGFVYGGGLWAKQIHDGIAQRLRDGGFASLRDAVGSSARESG

SEQ ID NO: 3245 - protein, 89 aa, Mycobacterium paratuberculosis
LTAARRARLPAGWDSELSDEYEWVPLRLPPEVTRVSASTRLSIEAEYRGWELTRVRLYTDGSRRVLLRRKKSRVDAGGFEGRRPDQPQL

SEQ ID NO: 3246 - protein, 375 aa, Mycobacterium paratuberculosis
LSRRRTQGNPLLLPHALLRRGRHKLAIQGCIWGVALLLSGCSSNPLRGAPPTIEPAGAAVSPPSAQQPAGSVRPLAAHAAAAVFDAGTHQLAVLAAASDPASVTLFGDPQVPPRVAALPGPATALTGDGRGTVYLATRGGYFVLDLATGRVVRVGVADAAQTEFTAVAQRADGVLVLGSADGAVYTLASPTPAVPTAGPTTGSTTGSTAAVANRNKIFARVDSLVTQGNTTVVLDRGQTSVTTIGADGRAQQALRAGRGATTMAADAAGRVLVVDTRGGQLLVYGVDPLILRQAYPVSQAPYGLAGSRALAWVSQTVSNIVIGYDLSTGIPVEKVRYPTVQQPNSLAFDEASDTLYVVSGSGAGVQVIDHAAGKR

SEQ ID NO: 3247 - protein, 264 aa, Mycobacterium paratuberculosis
MTVILLRHGRSTSNTAGVLAGRSDGVDLDDKGREQAAGLIDRIGDLPIRALISSPLLRCRRTLEPLADTLCLAPLVDDRLAEVDYGEWTGRKIGELVSEPLWKVVQAHPSAAVFPGGEGLAQVQARAVAAVREHDRRLAAEHGADALWVACTHGDVIKAVIADAYGIHLDGFQRVTADPASISVIRYTELRPFVLHVNHTGARLSAPLRAGPAPPPDQHDDQHHDKHHDTGDKAHTDPKSNGESQAAPATSVPSSDAVVGGSTD

SEQ ID NO: 3248 - protein, 195 aa, Mycobacterium paratuberculosis
MARAIHVFRTPDRFVAGTVGQPGNRTFYIQAVHDSRVVSVILEKQQVAVLAERIGALLLEVNRRFGTPVPPEPDEVEDLNPLITPVDAEFRVGTMGLGWDSEAQTVVVELLAVTDAEFDASVVLDDTEEGPDAVRVFLTPESARQFATRSNRVISAGRPPCPLCDEPLDPEGHICARANGYRRSALLGSDDDPEI

SEQ ID NO: 3249 - protein, 272 aa, Mycobacterium paratuberculosis
VLRDGELTVIGRIRSASNATFLCEATLGDRAVHCVYKPVAGEAPLWDFPDGTLAGRELGAYLVSTQLGWNLVPYTVIRDGPAGPGMLQLWVRQPGDAVGEVSEAGESGAEQPDPGPDLVDLFPVGASPPGYLPVLRAYDYAGDEVVLMHADDPRLRRMAVFDVLVNNADRKGGHILCGVDGRVYGVDHGVCLHVENKLRTVLWGWAGKPVDDDTLAAVACLAEALTGPFGDELAEQITRAEIAALRLRAHALLDNPVMPGPNRHRPIPWPAF

SEQ ID NO: 3250 - protein, 263 aa, Mycobacterium paratuberculosis
VTPRNPSDEMTDAALATDLAAEAGELLLKVRDEVGFGYPWALGDAGDSLANALILGRLQAERPDDAVLSEEAYDDLSRLQHDRVWIIDPLDGTREFSTPGRDDWAVHVALWQRPTNGRREITDAAVLPARGNIVYRSDTVTASAARVGVTDTIRIAVSATRPPAVLHRMRQRLPIQPVAIGSAGAKAMAIIDGVVDAYLHAGGQWEWDSAAPAGVVMAAGMHASRLDGSPMRYNQLDPYLPDFVMCRAELAPVLLGAIRDAWR

SEQ ID NO: 3251 - protein, 415 aa, Mycobacterium paratuberculosis
MRSWSSPQVPQLPGRGPELRLYDTSDRQVRPVAAGAGPGSAATMYVCGITPYDATHLGHAATYLAFDLIYRQWLDLGHDVHYVQNVTDVDDPLLERAARDGVDWRALAEREVSLFREDMAALRILAPRDYVGATEAIADVVELVEKMLASGAAYVVDGEFPDIYYRADATLQFGYESGYDRETMLRLFAERGGDPQRPGKTDALDALLWRAARPGEPSWPSPFGNGRPGWHVECAAIALSRIGSGLDIQGGGSDLIFPHHEFTAAHAECVRGERRFARHYVHAGMIGWDGHKMSKSRGNLVLVSQLRGRGVEPAAIRLGLLAGHYRGDRYWSDQVLDEATARLRRWRTATALPAGPDATDVIARVRQYLADDLNTPKALAALDGWTTDALDYGGHDTAAPRLVASAVDALLGVAL

SEQ ID NO: 3252 - protein, 901 aa, Mycobacterium paratuberculosis
MPGEVGSWPIVGREAELRRSLAALSNAEFHGVALVGDAGVGKSTLARMLAKTVESAGRTVRYALGTQTGSAVPLGAFSHAVSLTAVNEPAVMLAAAHNTLSQDKNLVVVVDDAQLLDPLSATLVNQLAAWRSARLIVTIRSGEPVLDAVTALLKERLLLTVHLDPFTREQTELLAGTVLGGPVDPRVVDELLQRSSGNPLLLRGFLTAARDTGALFRTAEGWQLRGPLRGDRELHDALEYRLQSLSSEEREVVEILATAGLLNWDILRDICDAEAVAALERRGLIRLATDGSHAVAQLTHPMLGEAATRHAGMVRTRQLNGKLARALQKHERTGSRHLRLSHLQSRIRLAEFMLHSDMEPDLDVITEAARDALAMSNVQLGEELARFALDRGGGLPAALVLAEAVSWQGRGEEAGFVLAHAEPDGDDDWLIARWGCLRAANLFWGCGDVEAARREADTVKKRVSSEAGLHLIDALELSMAFFRGDVETTTELGPGLCESDAVPMATTWAAVPTCAALAAAGRYSEVGRIADIGVRAAVSCGMGLHRFNIGISEIIAATDAGDDRAAERIYKRYAAMAEGLPGAEAMVDAMLGLVRLARGEFPAACAAFTRSISLFAKGFPSPWLVVVGAFQAQAEGARGDSTAAAAALWRADRAYGPHAAVFLPELELARAWERAAAGDTQAATTHATQAAEIARAAGMHAAEMRTRHAAVRFGDRSQTARLERLARILDTPLAEAAADHARGLTQRDGDLLDAAAQKFADLGALACAADAAAQAAGEHARRGDRGKKFESSAWAHALASRYELHTPAVEAAARPLPFSGRERQIVNLVAAGLSNREIADRLVISVRTVEGHLYRLFTKLGINSREQLTLLVAREPRGRRELLGHSNPSLGDQDDVHPHAG

SEQ ID NO: 3253 - protein, 854 aa, Mycobacterium paratuberculosis
VGRDVEFRRSLAALNNGEFHGVALVGDGGVGKSTLARMLAKTVESAGRTVRFALGTQTGWAVPLGAFSRAVSLGVGHEPAIMLAAAHNTLGQDKNLVVVVDEAQLLDPLSATLVNQLAAGRSARLIVTIRSGEPVLDAVTALLKERLLLTVHVDPFTREQTELLAGAVLGGPVDTRLVDELFERSAGNLLLLRGFLTAGVESGALVHTEQGWQLQGPLRGDRELHDALEYRLQSLSSEEREVVEVLATAELLEWEILRDICDADAMASLERRGLIQLVTDGSHTLVQLNHPMLGEAATRHAGVVRSRQLNGILAKTLRKHLRAAGRRSQISDPRGRIQLAQFIMRSDLEPDLDVVIKAAADAMAMSNVVLGEQLATFAVDRGGGLPAALVLAEAVSWQGRGEEADSILLGADVDDADEWLIARWGCLRAANLAWGCGDAEGATRVLAEVKQRLATEGSLQLIDALDVLIGFFRGDIARTIEFGPRLCEPDVVPMATVWAAVATCGALTAVGRFSEVGRIAAAGVRATAQCRAGAQRFAIGLAEVMAATAAGDYPAAERIHKRYAALATGLPAAEAMVDAMLGVTLDRSISQLSQGFPLPWQLVVGALQAQAEGARGDSAAAAVALRRVEEAYGPHVAVFLPELELARAWERAAAGDTAGAQTQAMQAAQTARKAGMHLVEMRARHAALRFGDRAQAARVDELASILNSPSAQAVADHARGLAQHDGDLLDAAAHRFADLGALAFAADAAAQAASEHARRGDRRKEVESSTWAHALAGQCGSRTPALDAAARPLPFSGRERQIVNLVAAGLSNREIADRLVISVRTVEGHLYRLFTKLGINNRDQLIQLIRRDAS

SEQ ID NO: 3254 - protein, 575 aa, Mycobacterium paratuberculosis
MSHSHRLVDHIVGYLASIGVDCIFGVDGANIEDLYDAAFLHSDMDAVLAKHEFSAVAMADGYRRSGGGFGVVATSAWGALNFVAGLGELFTSRVPLLALVGQPPSTMDGRGGFQDTSGRNGSPNAEALFSEVSVFCRRVQTPADIALALPAAVAAARTGGPAVLLLPKDIQQADVTSNGYLPEPGIERPRDIGDPRPIVAALRRASGPVTIIAGEQVVRDDARAELASLRAVLRARVACVPHAKDAAGTPGFGLSSALGITGIMGHPGVVEAVADSALCLVVGTRLAVTARAGLDDALAAVPTISLGSAPPYLACTHIHTDDLRASLRMLTGALTGRERPTGIRVPDAVSRTELNPPRFDGPGVRYREAMSMLDRVLPDGSDIVVDVGSCGAAAVHYLPVRRGGRFVVAPGMGYSFGAGIGMAVRRRKFGRRGHVVVIAGDGAFFMHGMEVHTAVQYRLPVAFVLINNNAQAMCAMSEKLCYGNRHSYNTFAPSRLGAGLAAMFPELPSVDVDDVDGFRAAVQSALEVDGPSVIGVECSAEEVPPVSTFLGLVTPKSVECQHGMAQDRIDAIVGA

SEQ ID NO: 3255 - protein, 77 aa, Mycobacterium paratuberculosis
VSTNPFDDDNGSFFVLVNDEEQHSLWPAFADIPAGWQMVYGEADRAACLDYIEQNWPDIRPKTLRDRLAAQRRGAGK

SEQ ID NO: 3256 - protein, 729 aa, Mycobacterium paratuberculosis
MTIDDRALHVGREQLTELDGGPFPLTRGQLDIWLAQETDQQGARWQLGYLLRIEGTVDPWLLEHTIRQVVREAEPLRAAFFQVDGQVFQKAVDYPDVELACYQRMGSQDPVQEAYRLAASIQRTVMPLDGPLFKFALLQTRVDEFYLFVCCHHIVADGIGLALICHRIGDVYNALASGAPIPPAYFGSLSDLIACEAEYEASTDYLDDRAYWAENLPSESEPGYRLAPASEREPYESSAPIELDPVAVAGIQKLSQQLGVRRSSVLAAACALLVGGCDLENSEIVFEFPVSRRVRPEAQTVPGMITGFVPLVLKASPGSSVASFCEHVDTRLGEALQHQRFPVHTIENKRRGSTQTSNRVILNFIPTTNLANIAGARVSGTLTHTNLVDQLGLDFFSDHDRLFLGMQPGATTGGFGGAGQWLSDCDVHDVVGRLERVLVAMTADPGRRLSSVDVLGMGERVRLDELGNKAVLAGPQGVSVSIPDLFARHVAGTPDAVAVSFDGRSVSYRQLDEASNRLAHLLVARGVGPGERVALLFSRSVDAVVAILAVLKTGAAYLPIDPGVPDERIGFVLADAAPIAAITGTGLAERLDGHDVAVIGVDDPDVVPAVDAQPSTGLPGPAPDDVAYVIYTSGTTGVPKGVAITHRNVTQLLGSLDAGLPAPGVWALCHSLAFDVSVWEIFGALVRGGAVGGGAGVGDRFSAGAARHVGGRTGQRVDPDPLGGGGIAG

SEQ ID NO: 3257 - protein, 1458 aa, Mycobacterium paratuberculosis
VPESVTVSPQELHGMLVAEQVSVLTQTPSAVAALPADGLESVALVVVGEACPVEVVDRWAPGRVMVNAYGPTETTMCVAISAPLKPGSGVPPIGAPVSTAALFVLDRWLRPAPPGVVGELYVAGAGVAVGYTNRAGLTGSRFVACPFGAPGTRMYRTGDLVRWRADGQLDYLGRADEQVKIRGYRIELGEIRSALVGLDGVEQAAVIAREDRPGDKRLVAYVTESATGTADPAEIRARLAQRLPEYMVPAAVVVLETLPLTANGKLDTRALPAPGYQNSDHRAPSSPVEEILAGVFADVLGLDRVGVDDSFFDLGGDSLVATRLIAAIETTLNADLSVRAVFEAPTVSQLALCVGSDRGRREPLVAVERLAVVPLSFAQQRLWFIDQLQGPSPIYNMAAALRLTGRLDADALGTALADVVARQETLRTLFPAVDGIPEQVVIPAERADFGWQVVDATGWPTDRLQQAIEATVRHSFDLATEIPLRARLFRIADDEHVLVAVLHHIAADGLSMAPLVADLGMAYASRCAGHAPGWAPLPVQYADYSLWQRALLGDVADAESPMAAQLAYWEQQLAGLPERLALPTDRPYPPVADYRGASVMVEWPTELQQRVRTVAREHNATSFMVIQAALAVLLAKLSASRDLATGFAIAGRREPALDELVGFFVNTLVLRVDLAGDPSFTESLAQVRARSLAAYDHQDVPFEVLVERLNPTRSLAHHPLVQVVLAWQNFAREDGVPAGLALGDLQVTPLAADTQVARMDLTFTLGERWTSAGEPAGIGGSVEFRTDVFDAERIPTLIQRLERVLAAMTADPGQRLSSVDLMDTDEHIYLDEIGNREALTQPAARVSIPAMFADQVIRAPQAVATRCAGHSMTYRKLDEASNRLAHLLIEAGAGPGESVALLFNRRAEAVVAVLAVLKTGAAYLPIDPAHPTARIEFMVADAAPIAAITTTELAERLDGCGLPIIDIADPRIDSYPHTALPVPDPDDIAYLIYTSGTTGVPKGVAITHNNVTELLGSLAPDLARPGQVWSQWHSYSFDISGWEIYGALLHGGRLVVVPEEVAASPDDLHALLIDEKVTVLCQTPSAAGTLSPQGLESVTLLVGGEACPSELVERWGPGRVMINEYGPTETTMWVALSAPLTAGSTGSDAVPIGSPVPGAAFFVLDQWLRPVPAGVVGELYVAGTGVGVGYVRRAGLTASRFVACPFGESGTRMYRTGDLVRWGADGQLRYLGRADEQVKIRGYRIELGEIRSALAGLDGIEQAAVIAREDRPGDKRLVGYVTESVTGAADPADIRARLGQRLPAYMVPAAVVVLDALPLTVNGKLNARALPAPEYIERERYCAPATPTEETLAGIYAQVLGLERVGVDDSFFDLGGDSLSAMRVIAAINKTLDAGLAVRTLFHAPSVRGLCRQLGQGADEVENQVEIIPRRVPQGGHRRSAVLHSSRERAELAVSRSR

SEQ ID NO: 3258 - protein, 201 aa, Mycobacterium paratuberculosis
MAKNYADRIQGVDPTGPYNLLGWSFGGVVAHEIAIELQRRGCPVRHLILLDALLVIPSSDVLNSDVLVEQALNEVLRFCGIQVPEGDEPLTYERAEKLLRERGIEELPRYKPLLDSIVRNDNTNLALARAHEPGVFDGDVKLFAAAREKGDQNSSSLRSWRPYVTGEISSYPVDCTHQQMMSTESLIQYGQQLKVVLEGGG

SEQ ID NO: 3259 - protein, 494 aa, Mycobacterium paratuberculosis
LTMSVAPTTRLWSRQFVAVIVAIGGMQLMVAMDGPVAVFALPKIQNEMGLSDAARSWVITAYMLTFGGLMLLGGRLGDTIGRKRAFLVGVALFTFASGLCGIAWAGGTLIAARLLHGAAAAIIAPTNLALIATTFPRGSARNAATAVFGAMTGLGGVLGLVVGGALTDVSWRLAFLVNVPIGLAVIYLVLITRQETQTERIKLDVTGAVLATVTGTAAVFGISMGPEAGWRSPITIGSGVVALAAFVAFVVVERTAENPIVPFNLFLDRNRLAAFAAMFLAGGVFFTLTVLVGLYVQTMMGYSPLRAGVAFIPFGLAMAIGVGVASKLVTWFPPRVVVIASGGLILGATLYGSTFNRGMPYFPNLVVPLIVCAIGIGAVFVTLTLSVIASVDVDRIGPTSAIAVMLQTLGGPLVLVVVQVAITSHALRLGGTLGPVKSMNAAQLHALDRGYTYGLLWLAGVVALLGGVALLIGYTAAQVARAQEVKKAVDAGEL

SEQ ID NO: 3260 - protein, 146 aa, Mycobacterium paratuberculosis
VTTYPIDDVIQRSPSTDSSPPIRTTPVVPVAVIGMACRLPGAVDSPERLWEALLRGDDFVTEIPPDRWDADEYYDPEPGVPGRSVSRWGAFIDDVAGFDPEFFGINERPRWTRNTACCWRPHGRQWNTPVSPRSASPTPAPGCSSG

SEQ ID NO: 3261 - protein, 2073 aa, Mycobacterium paratuberculosis
VGGIVARRRLRHRNPARPLGRRRILRPRAGCAGPVGIALGRIHRRRRRLRPRVLRDQRATAMDPQHRLLLETSWEAMEHAGLTEERVADSRTGVFIGLTHGDYQLLAADTRSVEGAYGFSGSNFSLASGRIAYALGVHGPALTVDTACSSGLTAIHLACRSLHEGESDLALAGGATLALDPRKFSAGSAEGMLSPTGRCRAFDVAADGFVGGEGSVMLLLKRLNDALRDGDRILAVVRGTAANQDGHTVNIATPSKSAQTAVYRAALAAAGVDAGTVGMVEAHGPGTPVGDPIEYASLAEVYGIDGPCALASVKTNFGHAQAASGALGMMKAILALQHGVVPRNLHFTQLPDDLARIDTKLFVPQQTTPWVSNGGHPRRAAVSSYGLSGTNVHAILEQAPEPAPETVAPEHISAESPLLFPLSSTSADELRRTAGRLADWVHAHDDLALPDLAYTLARRRVHRPVRTAVLAGDRAQLIEALREVADGDTPYPAAVGRGDRGPVWVFSGQGSQWAAMGADLLATERVFAATVAQAEPLIARESGFSVAEAMSAPQTVTGQDRVQPTLFTMQVALAATMKAHGVRPGAVIGHSLGEAAAAVVAGALSLEDGARVICRRSRLMSRVAGTGATASVELPAQQVLSELTARGISDVVVAVVASPQSTVIAGAAPTVRDLVTAWQERDVMAREVPTDVAFHSPQVDPIMDDLTDALAEISPRPPEVPYYSATLFDPREQPVCDARYWANNMRRMVRFATAVQAALEDGYRVFAELAPHPLLVRALEQTARSREIPMAALASMRRGQALPHGLRGFVADLHNAGAAVDFSVLYPTGRLVDAPLPTWTHRRLWLTDGGLESPTHGGCTVAVHPLLGPHVHLQEEPERHLWQADVGTAAQPWLADHQIRNVVVLPGAAYCEMALAAARSVLGAAAEVRDIRFEQALLLDEQTTIDASASVSSPGVLHFTVQSHQGGEQARHASAVLGAAVDEQPAAHDLSALLAAHPHDDDGAEVRRRMDRRGVQYGPAFAGLGAVHTGDETGTVLAEVALPRQIRSQQAAYGVHPALLDACFQSVEAHPAVRALGDGALGLVLGIRRLRAYSAARNAHYCYTRVTKADTSGVEADIDVLDEHGAVLLAVQGLRVGTSASESGTRDRVLAERLLNIEWRQRELPEPEHADAGSWLLIGTTATADVLASTLADTLKNRGAQCTTMAWPQQADHTVHAEQLRNHWRGDGFTGVVVLTGPKNGDNDQESALLSRDHVQHLVRIARELTDLPGEPPRLYVVTRNAQTVLPDDVPNLGQAGLRGLVRVIGMEHPQLGAGQIDVDESTDAEALARQLLAGCEEDETAWRDGAWYTARLCPAPLLPEERHTAVANHECDGMRLQIRTPGDLESIELVACDRIPPGPEQIEVAVSASSINFADVLVAFGRYPAFEGRLPELGTDFAGVVTAVGPDVTDHKVGDHVGGLSANGCWGTFLTCDARLAVTVPPGLADDQAAAVTTAHATAYYGLHELARIGAGDRVLIHSATGGVGQAAIAIARAVGAEIFATAGSEQRRQLLRDMGIEHVYDSRTVEFADLIRHDTDGYGVDIVLNSVTGAAQRAGIELLAFGGRFVEIGKRDIYGDTRLGLLPFRRNLTFYALDLALMSFSHPDRLRGLLRTVYRLTADGALPMPESTHYPLADAASAIRVMSAAQHTGKLVLDVPDAGRSRVVVPPAQVRAFRSDGAYIVTGGLGGLGLFLAEKMASPGSRAGCGRIVLCSRALPNPKALATLERIRQMGADIVVERGDIAEAGTAQRLLDVATATGLPVRGVLHLAAVIEDATLANITDELIERDWAAKVYGAWNLHLALQESGAEQSLDWFCSFSSAAALVGSPGQGAYAAANSWLDAFTRWRRARGLKATAIAWGAWAQIGRGAALADSADVAITPDEGAYAFEALLRHDRACTGYAPITGTPWLTAFAQRSPFAEAFRANGQSATGTSKLRAELEELPPEEWSTRLRRLISDQVSLILRRNVDPDRPLPEYGLDSLGGLELLTRIQTETGIRVSPADIAAIGTIRGLADLLRDKLTPAGAAQAERV

SEQ ID NO: 3262 - protein, 423 aa, Mycobacterium paratuberculosis
LRHKGGEVSAPENLDFFTDKSVVDDPYDYYDAIRRCPVWREPAHGVVMVSGYDEALAVQRDTDHALSVCNIVSGPWSGIPVNTGSDDISELIERYRKKVTFGDYFITFDPPMHTAHRSLLSRLFTPKQLKNNEDFLWRLADEQLNRFIANGKCEMVIDYNFPFTLDAITDLLDVPEADRERFRRAAIASRLEGDRSGFVGVKEEWFVEYVEERRRNPRDDVLTELALAKVPDGTTPEPIDVARVATFMFAAGHGTTIDLLSLSMLTLAERPDLQDLLREDNSKIPAFIEEMLRIESPIKSNFRLARRTTRIGDVEVQAGTSILVMNGAANRDPRRFDEPNEFRLDRPNILHHMAFGRGIHTCPGAPIARAEVRVSLERILSRMADIRLSEAKHGPAGARRLRWDPTLLFRRLKELHLEFTPIR

SEQ ID NO: 3263 - protein, 121 aa, Mycobacterium paratuberculosis
MRRPAGDTHRMATQAVTRSAVAVCGLALAFTAAGPASADRDLSPFVNTTCDYGQVMSALQAADPQAAAQFSASPESVSFLRQFLASPPGQRQQMAQMLASQPGADQQFGLVQRVFSTCNNY

SEQ ID NO: 3264 - protein, 222 aa, Mycobacterium paratuberculosis
MRRIRFSGPRLQGLGWTPGQHIRLQVESLRESMLRLHPYPVLRTYSIYAADPDRGALDIVMVDHDGDPKGATPARRWAMAATLGDHVRMTRPQGKFVIRDDAPYHVFVGEETASVAFAAMLRSLPPTAEVYGVVEAATEADHLPRARPLERVERGGAPAAKSAVLADALRRLPLPDHPGVAYLAGEARTVQALRQILITERGWKRNQVRTKPFWSPGRTGME

SEQ ID NO: 3265 - protein, 220 aa, Mycobacterium paratuberculosis
MVETSISDLLCERASLQPNDTAFTFIDYERDWNGVAETLTWSQLYRRTVNAARALQHCGATGDRAVIMAPQGLDYIVAFLGALHAGQVAVPLGGVSDERVDSVLRDASPTVILTTSSAAETVAGYVKSQSGRPVPSVVEVDLLDLDTQAASGAGGQNRPELAYLQYTSGSTRQPAGVMGSQRNLLANFGQIMSDFCAEYGGSPRRTPPSCRGCRFITTWV

SEQ ID NO: 3266 - protein, 379 aa, Mycobacterium paratuberculosis
LRGVRGVAPPDTTIVSWLPFYHDMGLILGVCAPVLGGIPAVLTSPVSFLQRPARWMQLLAKESHTFSAAPNFAFELAARKTSGEDMAGLDLADVLVILSGSERVHPATLRRFTEKFARFNLPGKAVRPAYGLAEATVYALSRTPAQPPEIAHFDSEKLVTGTAERCESPTGTPLVSYGVPRSPMIRIVDPDTGIECPEGTVGEIWIHGDNVAMGYWKKPQETERAFCGRLAAASSGAPEASWLRTGDSGFLSDRELFIIGRIKDLLIVYGRNHSPDDIEATVQEITRGRCAAIAVPQGGMEKLVVIIEVKNQDPSREAADKLALVEREVTSAISNSHGIGVADLVLVAPGSIPITTSGKVRRASCVEQYRQGQFARLSR

SEQ ID NO: 3267 - protein, 299 aa, Mycobacterium paratuberculosis
MTSLRDKVVFITGGARGIGAEVARRLKAKGARLVLTDLNDAELTSLAAELGEERVLTAVADVRDLSAMQAAADRAVERFGGIDVVLANAGIASYGSVAQVDPDAFRRVLDINVLGVFHTVRATLPAVIERRGYVLIVSSLAAYAACPGLAPYNASKAGVEMLANALRLEVARHGVKVGSAHMSWINTALVRDTQNDLPAFDRLLASLPWPLNKTTTVDKCAAAFVKGIQRRRARIYCPRWVALFRWAKPVLSSRLGEMPLHSPTAELLPALDAQVAALGRSMSAANVELLRPDRGSARN

SEQ ID NO: 3268 - protein, 300 aa, Mycobacterium paratuberculosis
VTPPDGPPYGAPSGQAALPELHHTVVVAAFEGWNDAGDAASDALEHLEAIWEADPILEIDDEAYYDYQVNRPVIRQVDGVTRELVWPAMRISHCRPPGSDRDVVLMHGVEPNMRWRTFCAELVAIADKLNVDTVVILGALLADTPHTRPVPVSGAAYSPESAKRFGLEESRYEGPTGIAGVFQDACVAAGIPAVTFWAAVPHYVSQPPNPKATVALLRRVEDVLDIEVPLADLPTDAEEWEQAVTEMTAEDEDLAEYVQSLEQRGDAEVDMNDALGKIDGDALAAEFERYLRRRRPGFGR

SEQ ID NO: 3269 - protein, 1262 aa, Mycobacterium paratuberculosis
MEGVHVTAPVTTPASDSFAPNIRPDCTDELTAALRQRIMVIDGAMGTAIQRDRPDEAGYRGERFKDWPSDLVGNNDLLNLTQPQIIEGIHREYLEAGADILETNTFNANAISLSDYGMEELSYELNYAGAALARKAADEFSTPDKPRYVAGALGPTSRTASISPDVNDPGARNVTYDELVAAYLEAANGLVDGGVDLLIVETIFDTLNAKAAVFALETLFEQRGRRWPVIISGTITDASGRTLSGQVTEAFWNSIRHAKPIAVGLNCALGAPEMRPYIAEVSRIADTFVSCYPNAGLPNAFGEYDESPERQASYIADFTEAGLVNLVGGCCGTAPPHIAEIAKVVEGKPPREVPQIPVATRLSGLEPLNITDDSLFVNIGERTNITGSARFRNLIKAEDYDTALSVALQQVEVGAQVIDINMDEGMIDGVAAMDRFTRLIAAEPDISRVPVMIDSSKWEVIEAGLKNVQGKPIVNSISLKEGEEKFVREARLCRKYGAAVVVMAFDEQGQADNLERRKQICARAYRVLTEEVGFPPEDIIFDPNCFALATGIEEHATYGIDFIEACAWIKENLPGVHLSGGISNVSFSFRGNNPVREAIHSVFLFHAIKAGLDMGIVNAGALVPYDSIDPELRDRIEDVVLNRREDAAERLLEIAERFNKSADASEDSAAAEWRGLPVRERITHALVKGIDAHVDEDTEELRAEIAAAGGRPIEVIEGPLMDGMNVVGDLFGSGKMFLPQVVKSARVMKKAVAYLLPFIEAEKEESGVSGSKDTNGTIVMATVKGDVHDIGKNIVGVVLQCNNFEVIDLGVMVPAQKILDAAKEHDADIIGLSGLITPSLDEMSNFAAEMEREGLQIPLLIGGATTSRAHTAVKISPRRSGPVVWVKDASRSVPVAAALLDDKQRPALLEATEKDYASLRERHAQKNERPMVTLEKARANRTPIDWDGYTPPVPAIGAGIREFQDYDLAELREYIDWQPFFNAWEMKGRFPDILNNPATGEAARKLYDDAQEMLDTLIEEKWLTPNAVIGFFPANAIGPGFEDIELYTDDTRTEVLTTLHNLRQQGEHRDGIPNRSLGDFIAPKETGHRDYIGAFAVTAGLGSQEKIAEFKAALDDYSAILLESIADRLAEAFAERMHQRVRKEFWGYQPDEQLDNDALIDEKYRGIRPAPGYPACPEHTEKVTLWKLMDVKERTGIELTESMAMWPGAAVSGWYFSHPQSQYFVVGRLAQDQVADYAKRKGWTLAEAERWLAPNLGYNPED

SEQ ID NO: 3270 - protein, 255 aa, Mycobacterium paratuberculosis
VIPRILAALVLLTAATIPGTGKAHASAPSFCGELGGDWDGQYCHTSVTSERNAVRDIKVAVPDDLVDNPTTGPVIRDYLRTLVNNWRNANSSMAADSYGEENFEVFRHASLLSAVFHEAYHADGPKPNNAYRTFTFDMASGRRVQLADLTTSNPLTAIPPLAQPFIETALNQAPPPHDPGTYPFVVDRWTPDKVYSGAYKAWAITPDELILYMPDYPVGHDEPINFATGLPQWFMDGGTVQAHIPLSALGSVLRV

SEQ ID NO: 3271 - protein, 227 aa, Mycobacterium paratuberculosis
MIVIVTTEKNPKPDTAAETEPADDAGDDVENAIAEQAGEQTDEAETDEAEDGGELLTGKRRGRERRKRPWRRYLRRSVLPLLLAASLAVSGFLGWRQWQEHQVKAAGEQAQQAAIAYAQVLTSIDSNKVDENFKQVLDGATGEFKDMYTQSSVKLRQLLIDNKATAHGVVVDSAIQSASTGKVVVLLFIDQTVTNTAAPDPRIDRSRIKMTMEKVDGRWRASKVQLL

SEQ ID NO: 3272 - protein, 419 aa, Mycobacterium paratuberculosis
MIRAVAGFANLVVRAVRTGHRQQVWLSVAGLVLILVVATAYLLIGALRVTPFASSYRVTVQLPESGGLLPNQDVALRGVRIGRIESLQITDNGVNAVATITSKVRIPANTVAHVSALSPAGEQFINFEAASDAGPYLHDGSFITSERTTVPVSLAQLLGDADGLLAQVDPRKIELIKKELSLSKEGPAKLTAIVDGGLFLLSTLDSVLPETTSIIKTSRVVLNLASDKNNGLGAAATELNHTLTGVARMQAGYRRLTSQTPQTLSAVDNLFADNSDTMVQLLGSMATMSQLLYLRVPALNALFPDYRGSVLDAVTSVFHDHGVWATADLYPRYVCDYGTPAHASSAADYYEPFMYTYCRDDDPAVSIRGAKNAPRPGGDDTAGPPPGADLGRRTDPTPRGRYTIPTPYGGPQLPIEPPH

SEQ ID NO: 3273 - protein, 409 aa, Mycobacterium paratuberculosis
MTATGARGRLTALAAAMAVTTAVTMATAGCATNGLASLPLPAPGLGSGGYSLNAVFSNALNLPMNAKVKLAGADVGQLESMVARNYTALTRLRIRDGVQLPRGSTAELRTATPLGDVFVALKPPPGDHDAPLLKNGDTIGLESTAAAATVESVLSSAAVLVNGGAVRNFTNIINGFGKATGDQGQAFGDLIRKSNELLGTLDARSDQISAALTQLSTLADQLDAKNHTITDLMTAAGPATSALADNTSELSEVAQQVGDTSRLLARFPALGGTDTSGRSMIRDLNTIAGAANDVAMSPDTSWQSINRLIPALVKSTAGNSISVNVSVDKIMLGSLPDIGFPGDIGLHGPHHYNVNLLVGTLKYTLWRLQERVVGRGPNSPQVPVVPDPTVPGQIDVAPGPIPPQPGSPP

SEQ ID NO: 3274 - protein, 371 aa, Mycobacterium paratuberculosis
VTRLGTKALAVVAGVAVVAAAVGIGWWLLRPDDDTITVTAQFDSASGLYEGNVVAVLGMPVGKITKINPRGGYVEVEFTVDRGVKVPANAQAVTVSTSILTDRQIELTPPYRGGPVLGNHDTIGLPRTKTPVEFSSVLNVLDKVTKSLEGDGHGGGPIADVLGDGAEVVNGNGEKIKAALGELSKALRLSSDGGAATREQITTIVKNLSTLFDAVASNNTKLREFASTIHQVSQIMADEDLGSGNTGHKLDQLIQRAGDLLDANRDNIKHAALSGNDTLKTVTDQRRDLAELLDLAPLVADNAYNMIDRANGSVRARFLTDRLLFDSQYTKEICNLMGLRQLGCSTGTIQDFGPDFGLTYVLDGLAAMGQK

SEQ ID NO: 3275 - protein, 363 aa, Mycobacterium paratuberculosis
MVELMAGTTAGSMLDRSVRQRLSALTKRPLESYNKTWLGFVAVAVVAAVIAVMLVVHALGAGYRHYTAEFAQAASLRAGNPIVVAGIPVGTVTSMKLVGDHVEAGLKVRDNISFGKDSRAQIRVTTILGSRYLALEPNGPARLPGNTFDLAHTEVPYDLQAALQDATTTFEQVDSDRFAQSLAVLGKQLEGLPAVVPQAITNIDTLSSIIATRRDQLGQLLRSTEQVTNTLRRQQAGIGALVDQGQDLLGQFVARRAVFHAMMRSLSSLVDTLSRVVVDDRSGVDALLKDIRDFTGLVSAHDDLLHSLLQVSPIFFREAANLTGDGNAINFNAPNVPLIDSWMCAISGRAKQFGMIQYFKDCK

SEQ ID NO: 3276 - protein, 351 aa, Mycobacterium paratuberculosis
MRFRGPLIALTLFMIVSLTLTWLVYVSLRRDVAGDTARYSAVFSDVYGLREGDDVRMAGVRVGRVEKIELDGKLAKVSFVVQSEQRLYGNTLASVTYQNIVGQRYLGLSLGKEGNPAQLPPGSTIPLERTEPSFDVTTLLNGYEPLFSLLNPHDADNLTKGIIASLQGDTSSLTTLVGQTSTLTQTFAGRDQALGNVITNLNKVVGNLAAQNDNLDGVITQTRSVVGELDRRRPDLVASVGSLARLSDRLSASAADVYPALREFIDRQPGVTKHIMDVEPQVAFFGDNIPLLLKGLTRVGNQGAYGNAYVCDVNFMGFFPGLNDVVPIIINAATPGNRAWHTPRCRSTVDG

SEQ ID NO: 3277 - protein, 530 aa, Mycobacterium paratuberculosis
MPNSFELDGRGPSDRQLFGIGIAVLVVSALLTTVMLVKSTGRLDDYVRVVADLVNVGDGLPQKSDVKYHGVLVGMVDDVVPAAHGKPNYVHINLKEDYAKSIPASVTARVVPSNVFAVSSVQLVGNGPGTKIRDGAHIPEDKRLPTVLFQTTVSKLRDLLAAAGRGRDDRSVGILAALGAATDHRRVSLLNAGAQLNRLLDQLNSIVSTDTGPSTVSALLDATRGLAQTAPDLLDALHQAVEPMQTFAETRGQLASLLSGADYTVGTTRQSFDNHIDQLIRITADFTPVLGVLAQKSNNFVPAVTKLDNLANQFMEQVWNPQTNLGNMRAMLTFTPSSTYTRADCPHYGELKGPSCFTAPLIPVRPDLPDVLLPQNYQPPKDLAPPPGTVIGPDGNLVAVGPPLINPTPNLTDPNPPLAPGITPSPPVPGSANPDNPSPGAPATPQPQQPWVAPVAPKAPWIPQSSFRPSFGGNVGPVGSQYERTMLGAITGGPASEATELLLGPVARGTTVSLAHPPGPSPAPRPGEGK

SEQ ID NO: 3278 - protein, 287 aa, Mycobacterium paratuberculosis
VTASAYQPFAPISVPLARLYRRGKVPVIRLGHLLVFFVRALVAVPLALRQYSGEFLRLLSNITWGNGSIVVGGGTAGVAVVLGMTVGALVGIEGYNFLDLLGLGPATGFVSSLVNTRELAPLMASLAFAMQGGCRFTAQLGSMRIAEEIDAMESIAIRPIPYLVTTRLIASVVAIVPLYAACLAIGYLSTQIVVSIGSGGSTGSYLHYFTLMLAGQDIVYSLFKAVVFVWIASTIQCYYGYYASGGPEGVGVAAGHGMRASITVVIIVNMLLTMALWGVDSGARFGG

SEQ ID NO: 3279 - protein, 286 aa, Mycobacterium paratuberculosis
MTATLTTPLDGVDGVAAIRNWSVGYVKRHPVASLTTVGEQFVLGVRTIQYFFYDLITGRFQWQEFVRQGAFMAGTAVLPTILVSLPISVTLSIQFALLAGQVGATSLAGAASGLAVIRQGASLVAAVLMASAVGSAITADLGSRTMREETDAMEVMGVSVVRRLVVPRFAAAVMIGVALTGVVCFAGFFASYMFNVYFQNGAPGSFVSTFASFATTGDMILALLKAIVFGAIVAIVSSQKGLSTKGGPTGVANSVNAAVVEAILLLMIVNVAISQLYIMLSPRTGL

SEQ ID NO: 3280 - protein, 222 aa, Mycobacterium paratuberculosis
VGFECRIDEGDGMPSANSSSLRDRRRAELLSQIQQTAHQLFAERGFEAVTTEDIAAAAGISISTYFRYAPTKEGLLVDPAREVAATIVGAYRTRPAHESAVEALIQLFITHAKEVGAAGDFDTWRHAVATAPHLLRKSVLMSETDHSNLIQQVAQRMNVTAALDIRPALLVHTSLATVQFVLDGWLSSDIDESRPFHEQLEEALRITLAGFDRPSDATPGRR

SEQ ID NO: 3281 - protein, 93 aa, Mycobacterium paratuberculosis
VKQSLAVKTFEDLFAELGERARTRPAGSATVAALDGGVHGLGKKILEEAGEVWLAAEHESDDALAGEISQLLYWTQVLMTARGLSLDDVYRKL

SEQ ID NO: 3282 - protein, 284 aa, Mycobacterium paratuberculosis
MLRVAVPNKGTLSEPATEILAEAGYRRRTDSKDLTVIDPVNQVEFFFLRPKDIAIYVGSGELDFGITGRDLVGDSDAPVRERLALGFGSSSFRYAGPAGRDWKIADLAGKRIATAYPNLVRKDLAERGIEATVIRLDGAVEISVQLGVADAIADVVGSGRTLSLHNLVAFGEPLCDSEAVLIESDRGGQDDTQAARDQLVARIQGVVFGQQYLMLDYDCPRAVLDKATAITPGLESPTIAPLADADWVAIRALVPRRGVNEIMDELAAIGAKAILASDIRFCRF

SEQ ID NO: 3283 - protein, 184 aa, Mycobacterium paratuberculosis
LHRPPVVHPRRRIPVTHALIVLLALLIGVVAGLRSLTAPAVVAWAALIGWVDLHGTWASWMANIITVIVFTVLAVGELVNDKLPKTPARTAAPIFAARIVLGGLAGAALGAWPHWTFTALGAGVIGAVLGTLGGYHVRRRLVAATGGKDLPIALLEDVVAIAGGFAILAATGHVLTDYLLTAVK

SEQ ID NO: 3284 - protein, 456 aa, Mycobacterium paratuberculosis
VTKHFDAIIVGAGQAGPPLAGRLTAAGQRVAIIERKLIGGTCVNTGCIPTKTLVASAHAAHLARRGADYGVGTGAVSVDMAKVKARKDEIMLGDRKGVEDWLAGMAGCTVVRGHARFRDPHTLQVGEDLLRAERIFLNVGGRAVVPDIPGLAEVDFLTNVSILELDTLPTHLVIVGGSYIALEFAQMYRRFGAAVTVVERGPRLASREDEDVSAAVQEILRAEGIDIVVNADDVRIAKTGNGFELTPRDGAPPIRGSHLLLAVGRRPNTDDLDLAAAGVRTDARGYILVDDQLKTNVEHIWAMGDCNGRGAFTHTSYNDFEIVAANLLDDDPRRVSDRITTYALYIDPPLGRAGMTVAQVRASGRRALVGKRPMTRVGRAVEKGETQGFMKVVVDADTREILGAAILGVGGDEAIHGILDVMSAKAPYTTLSRTMHIHPTVSELIPTMLQEMSPLA

SEQ ID NO: 3285 - protein, 301 aa, Mycobacterium paratuberculosis
MIVQPEARQSAARPAGQVSRPALSPSRAADFKQCPLLYRFRAIDRLPEAPSPAQLRGSLVHAALQQLYELPAAQRGPETALALVDPAWEQLLAATPELTADLDPTQHGQLLAEAQALLAGYYRLEDPTRFDPQCCEERVEVELADGTLLRGFIDRIDVAATGELRVVDYKTGKAPPAARALAEFKAMFQMKFYAVALLRSRGVPPTRLRLIYLADGQVLDYSPEYDELLRFEKTLMAIWRAIQTAGRTGDFRPTQSRLCDWCPHQQLCPLFDGTPPPYPGWPDTLGTQDNSTLSDPVDLAG

SEQ ID NO: 3286 - protein, 281 aa, Mycobacterium paratuberculosis
VSVTGPFTVGERVQLTDAKGRHYTMVLAAGAEFHTHRGSIPHDAVIGLEQGSVVKSSNGAVYLVMRPLLIDYVMSMPRGPQVIYPKDAAQIVHEGDIFPGARVLEAGAGSGALTCSLLRAVGPQGRVISYEQRADHAEHAQRNVSVFFGGEAPDNWQLIVDDVADSDLPDRSIDRAVLDMLAPWEVLESVARLLIPGGVLMIYVATVTQLSRAVEAVRAQQCWTEPRSWETLQRGWNVVGLAVRPQHSMRGHTAFLIFTRRLAPGVIAPAPLGRKREGRDG

SEQ ID NO: 3287 - protein, 99 aa, Mycobacterium paratuberculosis
MWVGWLEFDVLLGDVRSLKQKRSVIRPVVAELQRKFSVSAAETGSHDLYRRAGIGVATVSGDRGHAVDVLDAAERLVAAHPEFELLSVRRSLVRSDDLG

SEQ ID NO: 3288 - protein, 204 aa, Mycobacterium paratuberculosis
MHRALSVALSAATALAAVGLAACSTSHPRSETSAASSLPPATSTPIAPPATTPLPPPEALTDVLGRLADPNVPGANKVSLVEGATPESAATLDKFTNALRDNGYLPMTFTANDIAWSDQNPSNVKASIAVHTNQPNNANFTFPMEFTPFQGGWQLSRHTAETLLALGKSPQAPTSAAPEGPGAPAPPAEPAPPPEPAPTQTPPG

SEQ ID NO: 3289 - protein, 130 aa, Mycobacterium paratuberculosis
MSDSRGVPKASERSELPILRSFPTPNWRGGYFKATGDCRLMWVVKYPRKVKIFVTLVISATNPDDRKGREERRDRKKPRHGLGSGRSRRRRRRRCDFGCTHRPDLSEFPDPRSGQSRLAGRPTGCTEHCP

SEQ ID NO: 3290 - protein, 609 aa, Mycobacterium paratuberculosis
LQCRGSGAGSRHPRPLQVLAQVGLGVDGPRRARALAGDQGADVDDPLALLARNPRPVIGVGGVGQVLVLGELVDDRVEQVLDAQTRLAGLQHRLDRVLLRAVDDVLDHRPGVEVLEVHDFLVAVGVGDLQEPVVVDLGVHPLDDLLDHRLDAGGAVAAELGQVVGVQRQLLGQVLREDILRRFGIRALDLDLHVEAAGPQDGRVDHVLAVGGADHDDVLEPLHAVDLGQQLRDHRRLDVRADPGAAGAEDGVHLVEEHDHRRALGGLLAGALEDQPDVPLGLADELVEQLGALDVEEVRLGFAGVVAAHLGHLLGQRVRHRLGDQRLTATGRAVEQHAFGWPQRVLAVELLVQERQLDGVTDLLDLAGQATDVLVADVGDLLEHQVLDLGLGDALEGIAGLGVHQQRVAGPQLARPGVVVEGVRVTVGQVVGDQRLGQPHDALLVGVADHQGPVPVGQQLAQGGDLADRFEGAGFHHRQRLVETNRLALAQQRNIDVRRAGQPHLAARGEHVDGVVLVRGEQDAVAAGRLPEPVDFLAQGQQLLTGLFEGLHQLRVPGRKGVDAGLQLMHVTRGAGAAVRADGVLELLAQHRRLATQFLQLGLVAAGHV

SEQ ID NO: 3291 - protein, 214 aa, Mycobacterium paratuberculosis
VSAPGSDGAVGKHALDLAGKRYGEVLLVTPGEAGPQATVYNSFPLNDCPAELWSALDPHAIAKEHGAAMALLNGPRYWLMNGIEKQPQGPRITKTFGGIEMIQQATVLLSSMNPAPCIPNTVNRHTVFVFDAGQEIYELIDPENQHWVMQTWSQVSDPTLSRADLPGLAGRLDLPAGWSYQPRVLTSELRVDTTSRPARVLQDDLTNSYSLVTA

SEQ ID NO: 3292 - protein, 502 aa, Mycobacterium paratuberculosis
MQRIIGTEVEYGISSPSDPTANPILTSTQAVLAYAAAAGIQRAKRTRWDYEVESPLRDARGFDLSRSAGPPPVVDADEVGAANMILTNGARLYVDHAHPEYSAPECTDPLDAVIWDKAGERVMEAAARHVASVPGAAKLQLYKNNVDGKGASYGAHENYLMSRQTPFSAIIAGLTPFLVSRQVVTGSGRVGIGPSGDEPGFQLSQRSDYIEVEVGLETTLKRGIINTRDEPHADADRYRRLHVIIGDANLAETSTYLKLGTTALVLDLIEEGPAHGIDLSDLALARPVHAVHAISRDPSLRTAVALADGREMTGLALQRVYLDRVAKLVDSRDPGPRAADIVQTWAHVLDQLERDPMECAELLDWPAKLRLLEGFRQRENLSWSAPRLHLVDLQYSDVRLGKGLYNRLVARGSMKRLVSEHQVLEAVDNPPTDTRAYFRGECLRRFGADIAAASWDSVIFDLGGDSLVRIPTLEPLRGSKAHVGALLDSVDSAAELVEQLTS

SEQ ID NO: 3293 - protein, 64 aa, Mycobacterium paratuberculosis
MAQEQTKRGGGGDDEDDFASSTAAGQERREKLAEDTDDLLDEIDDVLEENAEDFVRAYVQKGGQ

SEQ ID NO: 3294 - protein, 303 aa, Mycobacterium paratuberculosis
VTWQFPDRLSTNSALPGPAFSGQPAVDLSSFADFLRRQAPELLPAALGGAQSGPASSSGGTGQLPHGTTIVALKYPGGVVLAGDRRSTQGNMIAGRDVKKVYITDDYTATGIAGTAAIAVEFARLYAVELEHYEKLEGVPLTFAGKVNRLAIMVRGNLAAAMQGLVALPLLAGYDIDAPDPEGAGRIVSFDAAGGWNLEEEGYQSVGSGSIFAKSSMKKLYSQVVDADSAVRVAIEALYDAADDDSATGGPDLVRGIYPTAVTIGAEGALEVPESRIAELAREVIQSRSRADTFGPDAAGGDK

SEQ ID NO: 3295 - protein, 256 aa, Mycobacterium paratuberculosis
VSFPYFISPEQAMRERSELARKGIARGKSVVALVYAGGVLFVAENPSRSLQKISELYDRVGFAAAGKFNEFDNLRRGGIQFADTRGYAYDRRDVTGRQLANVYAQTLGTIFTEQAKPYEVELCVAEVAHYGETKPPELYRITYDGSIADEPHFVVMGGTTEPITTALKDSYAENANLREATRIAVRALRAGSESSNGDQSALDVGSLEVAILDVNRPRRAFRRINRPTLENLLRELDSNGSDGNGDAPELNGGSSD

SEQ ID NO: 3296 - protein, 452 aa, Mycobacterium paratuberculosis
VQRRIMGIETEFGVTCTFHGHRRLSPDEVARYLFRRVVSWGRSSNVFLRNGARLYLDVGSHPEYATAECDNLVQLVTHDRAGEWVLEDLLVDAEQRLADEGIGGDIYLFKNNTDSAGNSYGCHENYLIVRAGEFSRISDVLLPFLVTRQLICGAGKVLQTPKAATFCLSQRAEHIWEGVSSATTRSRPIINTRDEPHADAEKYRRLHVIVGDSNMCETTTMLKVGTAALVLEMIEAGVPFRDFSLDNPIRAIREVSHDITGRRPVRLAGGRQASALDIQREYYSRAVEHLQTREPNAQIEQIVDLWGRQLDAVESQDFAKVDTEIDWVIKRKLFQRYQDRYNMELSDPKIAQLDLAYHDIKRGRGVFDLLQRKGLAARVTTDEDIAEAVDTPPQTTRARLRGEFISAAQAAGRDFTVDWVHLKLNDQAQRTVLCKDPFRAVDERVKRLIASM

SEQ ID NO: 3297 - protein, 351 aa, Mycobacterium paratuberculosis
VPMATSKVERLVNLVIALLSTRGYITAEKIRSSVAGYSESVSAEAFSRMFERDKNELRDLGIPLEVGRVSPMDPTEGYRINRDAYALAPVDLTPDEAAAVAVATQLWESPELITATQGALLKLRAAGVDVDPLDDGAPVAIASPAGVPGLRGSEEVLGILLSAIDSRQAVQFPHRPSRAEPYATRTVEPWGVVTQKGRWYLVGHDRDRDATRTFRLSRIGPGVTPIGPPGAVTVPDGVDLRRIVAQTVTDVSATPAGGQARVWVADGRATALRRAGRPVGTRQLGGRDGEVIELDIRATDQLARDIAGYGADAVVLEPQSLRDDVLARLRAHAGADAVGAGRPGGRGGVSA

SEQ ID NO: 3298 - protein, 322 aa, Mycobacterium paratuberculosis
MTPISTRLVRLLNMVPYFQANPRVTRAKAAADLGVSAKQLEEDLNQLWMCGLPGYFPGDLIDFEFSGDTIEVTFSAGIDRPLRLTSPEATGLLVALRALADIPGVVDPEAARSAIAKIEGAAGAVGHDTTQAATAVDEPAPAESRAAAAVRAAVQSRHALAIDYYSASHDTLTSRVVDPIRVLLIGGHSYLEAWSREAEGVRLFRFDRIVEASELDEPAAPPEPVLHAPPDTSLFDGDPSLPSATLRVAPHASWMFEYYPMRDVRELPDGSCEAVMTYASEDWMTRLVLGLGSGVQVLAPHSLAQRVREAAAAALAAYEALS

SEQ ID NO: 3299 - protein, 93 aa, Mycobacterium paratuberculosis
VGSLSPWHWAILAVVVILLFGAKKLPDAARSLGKSMRIFKSELREMQSENKTETSALGAQSESSAANPTPVQSQRVDPPAPSEQGHSEARPAS

SEQ ID NO: 3300 - protein, 318 aa, Mycobacterium paratuberculosis
VKAFKVSARTSGLLKRLNPRNRRSRTNPDATMSLVDHLTELRTRLLISLAAIALTTIFGFFWYSHAIFGLESLGEWLRHPYCALPQSARAEISANGQCRLLATAPFDQFMLRLKVGLTAGVVLACPVWFYQLWAFITPGLYQKERRFAIAFVIPAVALFVAGAVLAYFVLSKALGFLLTVGSDVQVTALSGDRYFGFLINLLIVFGVSFEFPLLIVMLNTIGVLTYPRLKAWRRGLIFAMFVFAAIFTPGSDPFSMTALGVALSVLLEFAIQIARLHDKRKAKREAQAVIPDDQASVIEPPTAIPEPSLSAGQHDDVT

SEQ ID NO: 3301 - protein, 821 aa, Mycobacterium paratuberculosis
MSPDPSAPDAATELVELTRFSSELPFALDGFQRRACAALERGHGVLVCAPTGAGKTVVGEFAVHLALAAGGKCFYTTPLKALSNQKHTDLTARYGRDRIGLLTGDMSVNADAPVVVMTTEVLRNMLYADSPALQGLSYVVMDEVHFLADRMRGPVWEEVILHLPDEVRVVSLSATVSNAEEFGGWIQTVRGDTTVVVDEHRPVPLWQHVLVGKRLFDLFDYRNAEAPGQPGAGREPRVNPDLLRHIAHRREADRLSDWQPRRGAGRGRPPARAGRPRFYRTPGRPDVIATLDAEGLLPAITFVFSRAGCDAAVQQCLRSPLQLTTQEERVQIAEVIEHRCGDLADADLAVLGYYEWREGLLRGLAAHHAGMLPAFRHTVEELFTAGLVKAVFATETLALGINMPARTVVLERLVKFNGEQHVALTPGEYTQLTGRAGRRGIDVEGHAVVLWNPTEETTEPSAVAGLASTRTFPLRSSFAPSYNMTINLVQQMGPEQAHRLLEQSFAQYQADRSVVGLVRGIERGQAMLDEIAAELGGPKAPILEYARMRARISEMERAQTRASRLHRRQAASDALAALRRGDIINIAHGRRGGLAVVLESARDSSDPRPLVLTENRWAGRISSADYSGNSAPVGSMPLPKRVEHRQPRVRRDLASALRSAAAGLSIPAKRRRGDSDEGFHDPELASLREQLRRHPSHHTPGLEAQVRQAERYLRIERDNAQLEKKVATATNSLARTFDRIVGLLTERGFIERRDGDPRVTDDGRLLARIYSESDLLVAECLRTGAWSGLKPAELAAVVSSVLYESRGGEGPGTAFAAEAPT

SEQ ID NO: 3302 - protein, 112 aa, Mycobacterium paratuberculosis
LRQALLQTSRLSSALRADEQTHRIAPSREPDDGFVAVIYRWARTADLAAALAAAEPAGTGSPLLAGDFVRWCRQVLDLLDQVRNAAPDPELRATAKRAINDIRRGVVAVDAG

SEQ ID NO: 3303 - protein, 263 aa, Mycobacterium paratuberculosis
MPRYKGLRRKMSGPQGSDQQWQPPGQGQGSDHSSDPTQVAPTWQDHATQEASWQAPAYTPPAEYPQYQQPGEQAYPQPYPQQQGYAQPGQYGQYGQPGQYGQPGQYAQPGQYGQPGQYPQPGQYPQPGQYGQYGQPGQYPQQYQPYEQPGKKRPVGLIAGVAGGIALLLIAVVLVLGFWQPGFFVTTKLDVNKAQAGVQQVLSDETNGYGAKNVKDVKCNHGQNPTVKKGATFDCDVSIDGAPKHVTVTFQDNKGTYEVGRPQ

SEQ ID NO: 3304 - protein, 318 aa, Mycobacterium paratuberculosis
MRLPLVLLDGASMWFRSYFGVPSSITAPDGRPVNAVRGFLDSLAVVITQQRPSRLVVCLDLDWRPQFRVDLVPSYKAHRVPEAEPAGEPDVEEVPDDLTPQIDMIAELLEAYGIPTAGAEGFEADDVLGTLAARERDDPVVVVSGDRDLLQVVSDDPVPVRVLYLGRGLSKATLFGPVEVAEHYGVPVDRAGPAYAELALLRGDPSDGLPGVPGVGEKTAATLLAQHGSLERVLAAAHDPKSKMAKGLRAKLLGALDYIEAAGAVVRVATDAPVKLSTPSDAVPLVAADPHRTAELATELGVGSSIARLQKALDALPG

SEQ ID NO: 3305 - protein, 424 aa, Mycobacterium paratuberculosis
MQQPLAEGLLMRSSRYAVVGRRFWELVRAGMSADDAGVAVGVSMAAGRLWFADAGGVRPRFVDQSIPRRRPRLTVEEREEIQDGVARSESIRVIARRLGRHPSTVMREIERNAICRGRYRARYRFGVRWRGGHDPRPRYRASLAHTRAHVKARRSRPGKLATNQLLHDEVQTRLNEQHSPQQIAWRLRRDFPDDAEMWVSQETIYQAIYVQGKGNLRRELHTCLRTGRALRKPRRRPGERRGHLRDMVNISERPPEVADRAVPGHWEGDLILGSTASGSAIGTVVERTTRFVMLLHLPDGHGAEAVQEAIVAKMAGLPATLRQTLTWDQGKEMANHAAIAAATELDIYFCDPHSPWQRGTNENTNGLLRQYFAKGTDLSAFPADYLDYVASKLNRRPRQTLDWKTPAEALDELLCKPFTPPAVA

SEQ ID NO: 3306 - protein, 307 aa, Mycobacterium paratuberculosis
MESHRFDADVYARRLAAAASATAAAGLGGLVITPGYDLRYLVGSRAQTLERFTALVLPASGEPTVVVPRLEVASLKGSAIAELGLPVRDWVDGENPYELVAAALGGAPAATAVTDSMPALHLLPLAGVLGVLPVLATDVLRGLRMVKEECEVDALRKAGAAIDRVHARVPSFLIPGRTEADVAADIAEAIVAEGHSEVAFIIVGSGPHGADPHHGYSDRELQVGDIVVVDIGGSYEPGYHSDSTRTYSIGEPSPEVAQQYSILQRAQRAACDAVRPGVTAEQVAAAARDVLAAAGLAEYFVHRTGHG

SEQ ID NO: 3307 - protein, 1020 aa, Mycobacterium paratuberculosis
VAPLAVDPEAMYAAGSAVAAIGDSLAANLTILTAGFSAHTGVDRAGEVFGLGYQDSAESMLKAAAGVVNACRKCGALIQQGASNYSAAEAASTLGGGSGALPAASAPADLAAPGPPGTWGKGGPPPLLWAVIQALVSEVWPDGDVAGLHAAASRWHGFAAAMNGVQGTLNASKALFDSQHIPEGEKIDHALAEIGAAAAAIGQQCDALARTVDEFADRAGHAQQAIRDLLHRIEALGDIGHDIMLIIDGDAWDEIQKIARDVNAVLQHLGQEARAFEQEIRLLMQAADREIVTCQKYARRGLITFLGEDVGNPVATALDFGINVQEGVVKGAVGMGLGLVDLSPHWIALDPEGAGATWGGLVKNAWKESFVNAAVNPQEFAQARLQELKGLVHADDWTRDRPGLGAGEVAFDAATLVAPGLGEAGAAADGASAAARGAEAEADAAGAAGRVGGLAGARGALTDIAKSTADLPKNLEGVTKDLPEIKPPTGGAPVVLGPGGKPIEAPVESAPRPADGTPGAQRSSPPVATSPASPGRAGDSGAGPHGPSSSPAPAAPPGGPVGAHDRAPAPAPAAPAGGPGGLGGVHDPAPAPAPATPFGGSGGPHDPAAEPEPAAAPAASGSPGDPASVPSGGPHEPASVPAEEPREPVSVPAGGVHDPVAEPTGGPHEPASVPAAGSRLASVHAAAGDGLPSATPELFDHTPSQVPVSAGGSSGEAASVGAHSPSSASSAAPHFESPGRPSEVPAPNGGAHGPGESGPPGGHPPGEPPHGGKPSGDGDGHGGPPDGKDPDGHHVSGHGHDGSSGGEPQDPVHSKDPSGDGWHRLPDEPLDPHYGEPLDEHWDFADDPVDLDKINSDVRNLIRDPEALYGRDPEGHPYTQEQYAERFNSMGSEGQHWMSFPGNHGAVPQTRVAYTDAASYLRDYGPLLDRIGKTNGKYLAVMQDGQAASWEQRALHVNSLQDPYHAYTFEHLPDNWTIEVSEVAPGVGQPGGSLQVRVFNSEGRPMTVEELTEPDIGVLR

SEQ ID NO: 3308 - protein, 178 aa, Mycobacterium paratuberculosis
MTSGIQLSQRLEEWAKLADYTLTPSSSTRDGRPIFWSGLGESRLFVGKKPDGWLVITDSDRMESEWFVLAAPSIDTIEKYLFGKFGMYIRGTRNLPRIGVPVSAGDQHSDFNIETREYEGVERFALVAPDGSAIAVGSADKITATADLKKLALYLNATIDQIEASMLDPDGKPLFERR

SEQ ID NO: 3309 - protein, 145 aa, Mycobacterium paratuberculosis
VMANTTTRLTDDALAFLSERHLAMLTTLRADNSPHVVAVGFTFDPKTHIARVITTGGSQKAINADRGGLAVLSQVDGARWLSLEGRSKVNSDVDAVRDAELRYAQRYRTPRPNPRRVVIEVQIERVLGSSDLLDRGVRVVNSFQT

SEQ ID NO: 3310 - protein, 187 aa, Mycobacterium paratuberculosis
VDDTGAAPVLILGGRSEIGVELARRLAPGTTVVLAARNADRVNDQVDALKAAGASAVHTREFDADDLASHGPLVASVVADHGPIGTAVLAFGILGDQARAETDAEHAVAIVHTDYVAQVSMLTHLAIAMRAAGRGQLVVFSSIAGARVRRANYVYGSAKAGLDGFASGLADALHGTGVRLLTCARDS

SEQ ID NO: 3311 - protein, 67 aa, Mycobacterium paratuberculosis
VRPGFVIGRMTEGMTPAPLSSTPAQVAAATARALAKGRRTVWIPWALGPAATVLRMLPQFIWRRMPR

SEQ ID NO: 3312 - protein, 389 aa, Mycobacterium paratuberculosis
MIVVVGIGADGMAGLAEASRAELRSAAVIYGSKRQLDLLDDTVRAPRRQWPSPMLPALQSLLDDHTGDVHIVASGDPLLHGIGGTLIRLHGAGRVRVLPHVSSVTLACARMGWNVHDTEVISLVTAPPHTAVRRGGQAIILSQGAATPTELAALLTAHGRGDSQFTVLERLGAPDEHRRDGTARDWADAAGDIDALNVIAVRYLPDERVWPLPDDAFTHDGQITKQGIRAVTLAALAPRPGERLWDVGAGSGSISVEWCLGGNGCRATAFERDAQRRRNLAANAAAFGAAIDLRGDAPDAFDDAEPPSAIFIGGGLTRPGLLDACFDHLPSGGRLVANVVTTESEAVVIQAYTRFGGQLRRFQHYHGKALGAFTGWHPQFPVTQWAVTR

SEQ ID NO: 3313 - protein, 251 aa, Mycobacterium paratuberculosis
VTVYFIGAGPGAADLITVRGQRLLQSCPVCLYAGSIMPDDLLALCPPDARIVDTGPLTLDQITTELRRAHAAGHDVARLHSGDPSLYSALAEQCRRLDALGIGYEIVPGVPAFAAAAAALKRELTVPGVAQTVTLSRVATLSTAMPPGEDLATLARTGGTLVLHLAAAQIDSIVGQLLDNGRQSQTPCAVVAFASWPQQTVLRGTLDDIAAQMHDARITKTAVIIVGDALTAGGFTDSYLYSTGRARGSRH

SEQ ID NO: 3314 - protein, 244 aa, Mycobacterium paratuberculosis
MRLLLLGGTGEARALAKALHPRIDIISSLAGRVPDPALPVGPVRIGGFGGVDGLRRWLRDEHIGAVVDATHPFASTMTAHAAQACAELGLPHLVLARPAWDPGAATVVDSDTHAAEAVAEQGYSRVFLTTGRSGARAFKDSDAWFLIRAVTEPDATTLPRRHRVVLSRGPYRYDDELALLGEHRIDALVTKNSGGQMTRAKLDAAAALDIPVVMVARPALPAGVSAVGSVAEAAEWVAALAIKD

SEQ ID NO: 3315 - protein, 184 aa, Mycobacterium paratuberculosis
MIAPSDDEAVTELALSAARGNARALEAFIKATQQDVWRFVAYLCDAGSADDLPQETFLRAIGAIERFSGRSSARTWLLSIARRVVADHIRHLQSRPRAAVGADPEHVLRTDRHARGFEDLVEVTTMIASLNPEQREALLLTQLLGLPYADAAAVCGCPVGTIRSRVARARDALLADGERSDLTG

SEQ ID NO: 3316 - protein, 274 aa, Mycobacterium paratuberculosis
MRNDAGMRCDVAREALSARLDGERPQVLAQQVDAHLEACRGCRSWLIGAAVQTRRLASVTPGEGPDLVDKIMASIGEQPTGRPAWMRWLRSHYRRWGLIGVGLFQVAIAAAQISGIDFGMVAGHMHGAMSGEHLMHESTAWLLALGLAMIAAGVWPASASGVAAITGVYSVALLGYVIVDAFDGEVTATRIASHMPLLLGLAFALLVARERVGSRRPGSSDATADAGFAAWAADAPAGRRRGHLRPINRAAPDPTASSTTTRRRIGKPAQLRWL

SEQ ID NO: 3317 - protein, 550 aa, Mycobacterium paratuberculosis
MTAPVWIAFPPEVHSTLLSSGPGPAPLLAAATAWSSMSTEYAAAAAELDGLLAAAHAGAWEGPSAEQYVAAHAPYHAWLLESAAKSSTAASLHETAAGAYTAALAAMPTLGELATNHAVHGALVATNFFGINTIPIAVNEADYARMWVQAATTMSTYQAVSQSALAAVPPTTPAPTIVAPGAEAGAATAAAVQSAAAAPATDSGSNLNHADTSSIQQQASTAAQSYPSWQDQLTAWLKQYTQNFAWPVSKDLNPGGWPFPPVPFVNGLASFFGQLGFSPALSTALGWAIFHTLMIFWPFMQAAIQMAVVLAPVVVAAIGAAAAGGAAAAVTAISVAAPLSMAAPVPVAAAPAPVATLPAPTIAGAPAGVSHVPTTASAPAPTMAGSAGGGPVGGGPGVGFGPTATDGIGAGMSDALYAVGLSGLSARGSASSRSRRKSEEPAPDDLDAPAAAAAAAAGSKKARARRRRRGTATDRAYRYEYMDLDTDGGPEDGGPEDGAVASEASAGQLGFAGAATKSEAARPAGLATLTRDGLSEGPGVPMMPSTWDRD

SEQ ID NO: 3318 - protein, 496 aa, Mycobacterium paratuberculosis
MTAPANPRGTLWGVGLGPGDPELVTVKAARVIGEADVVAYHSARHGRSIARGIAEPYLRPGQIEEHLVYPVTTEVTDHPGGYAGAIEDFYVEATARIAAHLDAGRDVALLAEGDPLFYSSYMHLHTRLTQRFDAVIVPGVTSVSAASAAIATPLVAGDEVLSVLPGTLPVSELTRRLADADAAVVLKLGRSYHAVREALSQSGQLDDAVYVERASTSAQRIVPAADVDAAGVPYFSLAILPGGQRARRAPGAGTVAVVGLGPGDAQWMTPQSRRELAAATDLVGYGRYLDRVPVRDGQRRHPSDNRDEPERARLACALAEQGRAVAVVSSGDPGVFAMATAVLEEAKQWPGVRVRVIPAMTAAQAVASRVGAPLGHDYAVISLSDRLKPWEVIAARLEAAAAADLVLAIYNPASKTRTWQVGAMRDILLARREPGTPVVIGRDVSGPDEDVRVVRLADLDPAEIDMRCLLIVGSSQTQWYSDDSADRVFTPRRYET

SEQ ID NO: 3319 - protein, 208 aa, Mycobacterium paratuberculosis
VLDYIRDAAEIYRLSFATIRAEADLARFPADVARVVVRLIHTCGQVDVAEHVAFTDDVVERVGTALRAGAPVLCDSSMVAAGITAARLPADNEVVSLVADPLSAELAARRQTTRSAAGVELWADRLPGAVLAIGNAPTALFRLLELVDDGVDPPAGVLGGPVGFVGSAQSKQELVDNPRGMSYLVVRGRRGGSAMAAAAVNAIASDRE

SEQ ID NO: 3320 - protein, 366 aa, Mycobacterium paratuberculosis
VARTRDADACPGALQVHQAADGALARVRLPGGMLTPAQLTVLCDIADRLGSPTLELTARGNVQLRGLTDVTAAAGALAAAGLLPSATHERVRNIVASPLSGRSGGNLDVRRWVGELDAAIRAQPRLSELGGRFWFSLDDGRADVSGLRADVGVHVLPDGCAVLLAGRDTAVRLPPDQVVATLVGVATRFVQVRGSAWRVQELDDPNQLLPGAECGPIAYPAVTKPPVGWITQDDGRVTLGAAVPLGLLSARVAEYLAALQAPLVITPWRSVLVGDLREEVADAALRVLAPLGLVFDENSPWLSVSACTGSPGCARSTADVRADAALAVREGTAPGHRHFVGCERACGSPLAGEVLLATGEGYRQLR

SEQ ID NO: 3321 - protein, 295 aa, Mycobacterium paratuberculosis
LPSARPKPLPKASTAPTVGTVSIATALDAAPKRLGGAASGAPGGLWARRKWEVVRLVSPLALLALWQLGSAIGVIAQDVLPAPSLILQAGVELTRNGQLADALHISTVRVVEGLALGGVIGIVAGAAVGLSRWVEATVDPPLQMIRALPHLGLIPLFILWFGIGELPKVLLVALGVVFPLYLNTFSAIRQVDPKMLETAQVLGFSFFQRFRRILVPGTAPQVLVGLRQSLAIAWLTLIVAEQINADKGIGFLINNARDFLRIDIIIFGLTIYALLGIITDAVVRLIERRAVRYRH

SEQ ID NO: 3322 - protein, 251 aa, Mycobacterium paratuberculosis
LTLTAESGPLAGSRTDVAGELRHVDKWYGNRHVLQDVSLQIPSGQIVALIGRSGSGKSTVLRVLAGLSHDHTGRRLVAGAPALAFQEPRLFPWRDVRTNVGYGLTRTRLPRAQVRRRAERALADVGLADHARAWPLTLSGGQAQRVSLARALVAEPRLLLLDEPFGALDALTRLSMHTLLLDLWRRHGFGVLLVTHDVDEAVALADRVLVLEDGRVVHELAIDPPRRTPGEPGAHTERYRAELLDRLGVRQ

SEQ ID NO: 3323 - protein, 336 aa, Mycobacterium paratuberculosis
VIRGVVALTATVGLLLTGCVSRTTTSGPTPPPAAVPLSDLSGLTLQVGDQKGGTEALLRAAGQLDNLPYRVAFSTFTSGPPQVEAATAGKIDFAITGNTPPIFGAASNARIKAVSAYGGGGAGNRILVHADSPITSVSDLRGKAIAVAKGSSSHANLLAQLDRAAIKPADVKFVYLQPADALSAFSQHQADAWAIWDPYTAQAEQQIPVRSIAEAQGVTNGDWIGVASDQALADPKRNTALGDLLVRFETAVRWARAHPQQWAQSYAATVGLDPQVAAVSQARSLRLPTELGDDVVASEQKLADLFAAAGQLQSAPRFANWVDRRFNAALRPGLVS

SEQ ID NO: 3324 - protein, 238 aa, Mycobacterium paratuberculosis
LGAARGGHPAAVRTLRYAPGRWADVFGEPASPTVLLWHGAQTDARAAVGPLAGLLAAHGLMVVAPDWNSHAADGGRADLLRSLDFTRGLAGDSGAVALVGWSLGGAAAAGVTLQADRFGVAPLHTFCLAGAFMVPDPLTGRAATDTVPPDRSRTAFTLLHGVADDVVPVSASRDFAAHLQRIGRPVQLVEVAADHGSIAGADYDPVADRYQPGAREETLRVAGEVAARIAATLRYLGG

SEQ ID NO: 3325 - protein, 1191 aa, Mycobacterium paratuberculosis
VAEPTILLLSTSDTDLISARSSGKNYRWANPSRLSDDELPDLLADAAIVVVRILGGYRAWQHGIDTVLASGVPTVLVSGEQAADAELTGLSTPAAGIAVQAHIYLAHGGVENLRQLHAFLSDTVLMTGFGFAPPVMTPTWGEPARPNAIDTDGPTIAVLYYRAQHLAGNTGYVEALCAAIEDAGARPMPIYCASLRTAEPELLQRLREADAMVVTVLAAGGLKPAEAAAGGSDDSWNVEHLAALDIPILQGLCLTTPRAQWLQNDDGLSPLDVASQVAVPEFDGRIITVPFSFKEIDDDGLISYAADPERCARVAGLAVRHARLRHVGPADKRVALVFSAYPTKHARIGNAVGLDTPASAVALLRAMRAHGYRIGDLPGVEANDGDALIHALIERGGQDPDWLTEGQLAGNPIRVSAADYRAWFATLPAEFTGAVQQHWGPPPGQLFVDRSNDPDGEIVIAAIQSGNLVLMVQPPRGFGDNPVAIYHDPDLPPSHHYLAAYHWLDAGFGAHAVVHLGKHGNLEWLPGKTLGLSAGCAPDAALGDLPLIYPFLVNDPGEGTQAKRRAHAVLVDHLIPPMARAETYGDIARLEQLLDEHANVAALDPGKLPAIRQQIWTLIRAAKMDHDLGLTERPEEDSFDDMLLHVDGWLCEIKDVQIRDGLHVLGQKPTGEAELDLVLAILRARQLFGGEQVLPGLRQALGLAEDGTDERSAVDGAEAAARELVAALQATGWDPDAAGRLTDNADAAAVLRFAAAEVVPRLAGSSAEIDQVLRALDGRFIPAGPSGSPLRGLVNVLPTGRNFYSVDPKAVPSRLAWEAGVALADSLLTRYRGDHGRWPQSVGLSVWGTSAMRTAGDDIAEVLALLGVRPVWDDASRRVVELAPIPLAELGRPRIDVTVRISGFFRDAFPHVVTMLDDAVRLVAGLDEPAADNYVRAHAQADLAQHGDQRRATTRIFGSKPGTYGAGLLQLIDSRNWRDDADLAAVYTAWGGFAYGRDLDGREAVDDMNRQYRRIAVAAKNTDTREHDIADSDDYFQYHGGMVATVRALTGQAPAAYIGDNTRPDAIRTRTLSEETTRVFRARVVNPRWMAAMRRHGYKGAFEMAATVDYLFGYDATAGVMADWMYEQLTERYVLDPENRKFMAESNPWALHGMAERLLEAAGRGMWAQPQPETLDGLRQALLETEGDLEG

SEQ ID NO: 3326 - protein, 126 aa, Mycobacterium paratuberculosis
VTPTFADLAKAQYILLTTFTKDGKPKPTPIWAAADKDRLLVITQEKSWKVKRIRHTPRVTLATCTMNGRPTSEAVEGTAAILDKSQTAAVYDAIGKRYGVVGKVFNFFSKLRGGMANNVGLELKVA

SEQ ID NO: 3327 - protein, 233 aa, Mycobacterium paratuberculosis
MTTIQIDTPDGPIDALLSTPAGQGPWPGVVVIHDAFGYGRDKQSINDRIARAGYLALTPNMYARGGLVRCITRVMKELAAQRGRALDDILAARDHLQAMPECTGRVGIAGFCMGGRFALVMSPKGFSASAPFYGTPLPGNLDEVLEGACPVVASFGGRDLTGKGAPEKLRKVTADKNITADIKVYPVAGHSFANELPAQPLLRIAGFGYNEEATEDAWRRVFSFFGEHLAATP

SEQ ID NO: 3328 - protein, 191 aa, Mycobacterium paratuberculosis
LQSRRIAPRELRPVRGRWPDMVARLLLLYAVVELAVTFALVSTIGWGWTLLVLLATFLLGWGVVAPMAGSQLLRRIGQLRSGLTEPRAAAGDGALISLATALVLIPGLLSTALGLMLFIPPVRGAAAPRLTALTLRTLQRHAPPYPTAFRAATDPRGPYEHRDYIDGEGIDVHEVPAPARNQPFDSRRATG

SEQ ID NO: 3329 - protein, 538 aa, Mycobacterium paratuberculosis
VDVADRPTPVTLLVNGRVHTPAAPDATAMAFRGGVITWLGGDDVGRSLFPDADVEDLDGGFVTPGFVDSHIHLTATGLTLCGLDLRPARSRAHCLQLIADHAAAHPGRPVWGHGWDETSWPERTPPSTADLDAVLGDRPAYLTRVDVHSALASTGLRRRVAQLPSATGFSPDRPLVGDAHHLVRAAARNLLTAEQLAEARAAALRAAAAAGIVAVHECAGPEIGGMDDWLQLRALDHGAEVIGYWGEPVSTAADARALIEATGARGLAGDLFIDGALGSRTAWLREPYADAPDRTGTCYLDPDAVEAHLLACTEAEITAGFHVIGDAAVAAAVDAFEKVAARLGPVAVARCGHRLEHVEMIDAEQAAKLGRWGVIASVQPNFDALWGGADGMYAQRLGAERGSQLNPFALLASQGVPLALGSDAPVTGLDPWTSVRAAAHHRTPGSAISVRAAFAAATRGGWRAAGVRDGMTGTLVPGAPASYAVWDAGDLEVSVPRDTVARWSTDPRSRVPALPRLGPTDALPRCRRTVHRGAVIHG

SEQ ID NO: 3330 - protein, 592 aa, Mycobacterium paratuberculosis
MRPRLLRLICAVVGGGLLCASFPAVNWWWAAVPAAALLAWVLTHPATTPAGGLGYAFVFGLAFYLPLLPWVGLLVGAVPWLVLAAVSALFPAVFGLFAVLVRRLPGWPVWFALLWAAQEWLKSIFPFGGFPWGSVAFGQTHGPFLPLVQLGGVALLSFAITLVGFSATALALEIVKWWRSGYPAAQSSAGPAAPPAVVLPGVCICLVLFAAVIVWPQVRHSGTGSGGEPSVTVAAVQGNVPRLGFGFNEQRRAVLDNHVRETLRLAEDVRAGAAPQPQFVIWPEDSSDIDPLVNGDAALEISQAASAIGAPILIGSVLEVPGRPAQDPRYTNTMIVWNPATGPADRHDKEIVQPFGEYLPMPWLFKHLSGYADRAGAMVPRAGSDVVHMAGVPVGVATCWEVIFDRVPRRAVTHGAQLLVVPANNATFNQRMSEQQLAFAKVRAVEHDRYVMVAGTTGISAVIAPDGAELARTDFFQPAYLDMQVRLKTRLTPATRWAPLLQWVMVAVAGAVILVGIRQNGWFPRSIRQRPRRSGAPKHPDASPAETEGDTHPAHDAAPDEDGDHAPPEDGGDDTGPPEGGRPHIGRHRGAT

SEQ ID NO: 3331 - protein, 297 aa, Mycobacterium paratuberculosis
RRPRSARGRRRRHWTARGRPTPYRATQRSYMTTSQPAPPDPGTRPSQRVLVIIPTYNELENLPVIHRRLKDACPHVHLLVVDDSSPDGTGRLAEELAAADAGRTHVMHRTAKDGLGAAYLAGFAWGLSRDYSVLVEMDADGSHAPEQLHRLLDAVDGGADLAIGSRYVDGGTVRNWPWRRWALSWTANTYARLALGIGVHDITAGYRAYRREVLEAIDLDGVDSKGYCFQIDLTWRTICNGFTIAEVPITFTERELGVSKMSGSNIREALVKVTRWGIQGRRSGARRARPTRADHRS

SEQ ID NO: 3332 - protein, 111 aa, Mycobacterium paratuberculosis
MADRVLRGSRLGAVSYETDRNHDLAPRQIARYRTENGEEFEVPFADDAEIPGTWLCRNGMEGTLIEGDLPEPKKVKPPRTHWDMLLERRSIEELEELLKERLEIIKSRRRG

SEQ ID NO: 3333 - protein, 116 aa, Mycobacterium paratuberculosis
VSRRTHPQPCRWCGRDVTDAGMGRRRQYCRQSCRQRAYEQRSSLNRHGAAAVPEDAVVLSADDAADLSDRVYQVRCAAEDVATAVDEGAGPAELRQLCDALIQAARAADGWRRAGV

SEQ ID NO: 3334 - protein, 4170 aa, Mycobacterium paratuberculosis
MVDQLQHATEALRKALVQVERLKRTNRALLERSSEPIAIVGMSCRFPGGVDSPEALWQMVAEGRDVISEFPTDRGWDLAALYDPDPDARHKCYVNTGGFVDNVADFDPAFFGIAPSEALAMDPQQRMFLELSWEALERAGIDPVKLRGSATGVFAGLIVQGYGMLAEEIEGYRLTGMTSSVASGRVSYVLGLEGPAVSVDTACSSSLVALHMAVQSLRSGECDLALAGGATVNATPTVFVEFSRHRGLAPDGRCKAYAGAADGVGWSEGGAMLVVERLSDARRLGHSVLAVVRGSAVNQDGASNGLTAPNGPSQQRVVRAALANAGLSAAEVDVVEGHGTGTTLGDPIEAQALLATYGQDRGQPLWLGSIKSNMGHTQAAAGVAGVIKMVLAMRHELLPATLHVDEPSPHVDWSAGAVSLLTEAQPWPGERPRRAGVSSFGISGTNAHVIIEAVPAAEPAHADAPALPVLPWMVSAKSAAALRAQAARLAEYVRAHGELDIADVGWTLAGRATFEHRAVVVGGDRDRLLAGLDELSTDDPAASIIRGVATPAGKTVFVFPGQGSQWLGMATELLDTAPVFAQHIQACEEAFAEFVDWSLIDALRGAPGAAGMDRVDVVQPALFAVMVSLAELWKSVGVSPDAVIGHSQGEIAAAYVAGALSLRDAARVVTLRSKLLRSLAGPGGMLSIACSTERARELLAPYGNRVSIAAVNGRSSVVVSGEGAALDELAAFCADLALRTRRIDVDYASHSVEVEAIREDLAQALTGIEPRSSRIAFFSTVTGNRLDTAGLDADYWYRNIRQTVQFDQAVRSAAEHGYRTFIESSPHPALVAGIEDTVNDSLPGDTEAIVIPTLGRDDGGLERFLTSAATAFVAGVNVAWRGVLDGAGFVELPTYAFDRRRFWLSGEGAAADASGLGLGTSEHPLLSAVVELPASGGVVLTGRLSPSLQGWLTDHAVSGTVVFPGAGFVELAIRAGDEVGCSTVEELTLQAPLMLPAKDSGIGSVAVQVVVGEADESGRRDVSIFSRPDSDSPWVCHAQGTLSTGSIEPGADLSAWPPAGATKVDIADGYQRLAARGYGYGPAFQGLTAAWVRGDEVFAEVRLPDAAGGVTGFGVHPALLDAAMHALIVGHQIAGDRDEVVLPFAWQGVSLHAAGASAVRARLAPAQAPGTAASRAVSLELADGLGLPVLSVRAMVARSVSERQLRAAVSAAGPDRLFEVAWAPVTVPAAHGEPPVHQVFESLAAEGDPVGESYRRTHEALAAVQSWLTEHDSGVLVVVTRGAMALAGEDVTDLSGAAVWGLVRSAQTEHPGRIVLIDSDAALDDSALTAALATGEPQVLLRDGTVYTARVHGSRAVDGIMTPPEDRPWRLGISSAGTFENLQLEPVPNPDAALQPGQVRVALRAIATNFRDVMITLGMFTHDALLGGEGAGVVVEVGPGVTEFSVGDSVYGFFPDGSGTLVPGDVRLLQHKPAHWSYPEAAGISAVFTTAYMAFIHLADVKPGQRVLVHAAAGGVGMAAVQLARHLGLEVFATASRGKWDTLRAMGFDDDHIGDSRTLDFEDKFRSATGGAGMDVVLDSLAGEFVNASLRLVAPGGVFLEMGKTDIRDPGVVVREYPGVRYRAFDLFEPGRPRMHQWMVELAGLFDAGVLNPLPVTTFDIRRGRAALRYLSQARHIGKVVMTVPGALSAGTVLITGGTGMAGSTLARHLVTGHGVRDLALLSRTGPDAPGAAELVAELEAAGARVQVIACDAADRAALAGVIAGISAQRPLSGVIHAAGVLDDAMITSLTPERIDAVLRAKVDAAWNLHELTRDMNLSAFVMFSSMAGLVGSSGQGNYAAANSFLDALAAHRRAHGLPAISLAWGLWDQASAMTGGLDAADLARLGRDGILALSSDEAMELFDTALIVDEPFLAPARIDLGALRAHAVAVPPMFAELVNAPTRRRVDDSLAAAKSKSALAHRLDGLPEAEQHAVLLELVRSHIATVLGSPTAEAIDPDKAFQELGFDSLTAVEMRNRLKTATGLALSPTLIFDYPTPNALAGYIRTELAGAPQEITHAPVVRATDDDPIAIVGMSCRFPGGVDSPEALWQMVAEGRDVLSEFPTDRGWDLAGVYNPDPDVPGTCYTRTGGFVDNVADFDPAFFGIAPSEALAMDPQQRMFLELSWEALERAGIDPVKLRGSATGMFAGVYTQGYGMGAAPIAEGFRLTGQSSSVASGRVSYVLGLEGPAVSVDTACSSSLVALHMAVQSLRSGECDLALAGGATVNATPTVFVEFSRHRGLAPDGRCKAYAGAADGTGFSEGGAMLVVERLSDARRLGHSVLAVVRGSAVNQDGASNGLTAPNGPSQQRVVRAALANAGLSAAEVDVVEGHGTGTTLGDPIEAQALLATYGQDRGQPLWLGSIKSNMGHTQAAAGVAGVIKMVLAMRHELLPATLHVDEPSPHVDWSAGAVSLLTEAQPWPGERPRRAGVSSFGISGTNAHVIIEAVPAAEPAHADAPALPVLPWMVSAKSAAALRAQAARLAEYVRAHGELDIADVGWTLAGRATFEHRAVVVGGDRDRLLAGLDELSTDDPAASIIRGVATPAGKTVFVFPGQGSQTLGMGRQLHAGYPVFAEAFDAVVAELDRHLLRPLRDVIWGDDENVLNSTEFAQPALFAVEVALFRLLESWGVRPDFVMGHSIGELSAAHVAGVLSLQNAAVLVAARGRFMQALPEGGAMIAVQATEAQVRPLLGPDVGIAAVNGPAAVVISGDHDAAVAIAERLRAEGHRVHRLSVSHAFHSPLMEPMIDEFGTVAAGLASDKPVIPIISNLTGQPAADDFGSPEYWKRHVRDAVRFADSVRFAQSAGATRFLEVGPSSGLTAAIEETLADAPVVTVSALRKDRPEPVALVNAVAQGWVCGMDVDWRGALGTGHLVDLPTYAFDRRRFWLSGDGAASDAAGLGLAAGDHALLGAVVELPASGGVLLTGRLSSASQGWLADHAVGGVVLFPGAGFVELAIRAGDEVGCGIIDELNLAAPLVLPAGGSVAIQVVVDGPDDSGARAVSVFSRADAGAGWLLHAEGVLRAGSAQPATDLSAWPPVGAVPVDLGDGYEQLAERGYRYGPAFRGLTSMWRRGDEIFAEVNLPTDAGVSTTGFGVHPVMLDAALHAVMLASDGDELPAGSMLVPFSWQRVSLHAAGAAAVRARIVPVSPSAVSIELADGLGLPVLSVASMVARPVTDQQLLAAVSNSGPDRLFELIWSAQPSTAVQPVSLLNWGATELDATDTDSDSGRFAVLFESAPVAGDVVTEVYAATRAVLPVLQTWLARDGAGTLVVSTRGAMTLPREDVTDLAGAAVWGLVRSAQTEHPGRIVLVDTDAPLDADAVAAVLAVGEPQTLLRNGTVYTARVLGSRAVGALLVPPEDGPWRLGMSSYGTIENLRLEPIPDADAPLGPGQVRVATSALAANFRDVMIALGLYPDPDAVMGIEASGVVIETASQDGRVAVGDRVMGLFPDGTGTVAITDQRLLVKVPAGWSHTAAATASVVFATAYYALVDLADARPGQRVLVHAAAGGVGMAAVQLARHFGLEVFATASRGKWDTLRDMGFDDDHLGDSRGLDFEDKFRAVTGGAGMDIVLDSLSGDSVDASLRLVAPGGIFLEMGKTDIRDPEVVAAEHPGVRYRAFDLFEAGPDRIARLLDELAAMFGEDVLRPLPVTRFDVRRAPAALRYLSQARHVGKVVMTMPDAWTAGTVLITGATGMAGSAVARHVVTRHGARNLVLVSRRGLDAPGAAELVAELTAAGARAEVVACDAADREALAKVIADIPMQHPLTGVIHAAGVLEDAVVTSLTPQRIDTVLRAKVDAAWNLHELTRDLDVGAFVMFSSIAGLAGASGQGNYAAGNSFLDGLAAHRRAHGLPAISLGWGLWDQASAMTGGLGAADLARFGRDGIVAMSSQEALELMDTALIVDEPFLLPAHIDLAALRAKFDGGTLPPMFVDLINAPTRRQVDDSLAAAKSKSALLQRLEGLPEDEQQAVLLDLVRSNIATVLGSSSPEAIHPDRAFQELGFDSLTAVEMRNRLKAATGLALSPTLIFDYPNSAALAGYMYRELVGTSEQPTAAAAPGEAEIQRVVGSIPVKRLRQAGVLELLLALANESTGTAQSATPAVTTEKDIADMDLDDLVNAALLDDDDE

SEQ ID NO: 3335 - protein, 868 aa, Mycobacterium paratuberculosis
MRIAVTGASGVLGRGLAARLLSKGHDVVGIARHRPDSWSSAADFIEADIRDAAAVNRAVTGADVVAHFAWAHDTREGTGSQVNIAGTANVLAAMAETSARRIVFPSSPHVYGGGDTPRSEADAPAPSAADAVQQARVEEMLVASGLESVTIRCALVVGRNVDNWVRRVLALPAFPGGTVDRPIQLVHLDDALRLLESAVLSHEIPSGTVNLAAPGTTTFRRIAATLRRPVLRLGRPAPAELEPVLSAPLMDTALLHERWGFRPAWQCGECVEDMALAVRGRVTVGRRVVSLPWRLANVADLPAVDAPAQDGVVPVPAGPEGVNGEFDTPIDPRFPTFLATNLSEALPGPFSPSSASATVRGVRAGGVTIAERLRPGGLVQREIALRTVGVFAHRLYGAITSAHFMADTVPFAKPSMIVSNSGFFGPSMASLPVFGEQRPAETGWARRLLRNTRNIGVFGVNLVGLSSGAARDTDDFIADVDRLERLAGDAAELDERRLLSLIALARDQVVHGWVLASASFMLCAAFNVLLRAVCGRDTSAPAGPELVSARSVEAMQRLVVAAQRDPNVARVLTEPGERLDKLAVDAPEFHAAVLAELALIGHRGPAELEMLSTSYADDPELLVRMVAKAMAATAAPPPQHPRIPLQAKPIAALAARQLRDREARRDKVVRANWVLRALLREYGRRLTHAGVFGSADDVFYLLVDELDALPADVAAVVARRRAEHRRLAGIVPPTVFSGSWQPTATSVPALAGGGTLRGVGVCGGRVRGRVRIVRPETIDDLQPGEILVAEATDVGYTAAFCYAAAVVTELGGPMSHAAVVAREFGFPCVVDVQGATKSLPPGALVEVDGATGEIRVLELASEQATGGG

SEQ ID NO: 3336 - protein, 144 aa, Mycobacterium paratuberculosis
MTSPSVPSTTDDKDSAAGLEPGTTPYYARMHKWIKRAVLVCLVALVIEGAFTLPFMAVYYGYPTLSLTQICSELLKIRYSNDTLECKYPYPPFGPPEGAEGKATAQDVWGIQPIPKYHRLGFRELVKIHNDRLARQAAQQHSAP

SEQ ID NO: 3337 - protein, 480 aa, Mycobacterium paratuberculosis; identical to SEQ ID NO: 2670

SEQ ID NO: 3338 - protein, 406 aa, Mycobacterium paratuberculosis; identical to SEQ ID NO: 1515

SEQ ID NO: 3339 - protein, 180 aa, Mycobacterium paratuberculosis
MRGVWLQRRALRAGLSVRPMIVTLIGYLVLIDGMLNSLGWALDLVANHTLINRVLMVGWGNMFDAGYFWHYNELWIGGAAGPGEKAYVAGLILTVFSMRVAAAIGFLQMKRWGHQWMVVTCWMGVVIWSAYVFNMTMFADVRYAGVVFPVIGWWLYDIFYITPFLAIPYLHTVNRETFSD

SEQ ID NO: 3340 - protein, 42 aa, Mycobacterium paratuberculosis
MDRQEQKRKRALIVFQIFIYGYLLAMFGVQLYMSFARGWWNL

SEQ ID NO: 3341 - protein, 281 aa, Mycobacterium paratuberculosis
MSIANWSPRECRPIEEEMTTDTYFANGNEVQLFEQAFARRLPVMLTGPTGCGKTRFVEHMGSLLQRPVVTISCHDDLTSSDLVGRFMVTGGDVVWTDGPLTRAVKAGAICYLDEVVEARHDSLAILHSLTDHRRSLYLDRAGAVVKAPEGFMLVCSYNPAYRSSLKELKPSFRQRFVTLAMHYLPPDREADVIVAESGIPLATAQRLVRCAVAIRTADEAFHFEPPSTRVLVNAAQLIAAGATELDAADACILAPLSSDGAVTDGLREVAAASLATSNSSP

SEQ ID NO: 3342 - protein, 512 aa, Mycobacterium paratuberculosis
MTERSEYSDGRAMALERSCAVTAVALSEQRREGVRLVTGERRGFGLDAALTFVHLPYPAPSDWTRRTLTCGVALQCSPSKERVTEFRLNELSARELRALTLVEGAVALGWIASRWPGLLPEVQRLLPDVHPQAADMDGAQMLDRAIGLAATGLELTVPPLLGALPLAYTAPQGLTDRLRRSFGRMPWTTTQKRRPRPYSVPVGGDGGVRNPNLPPPSRPQDNDLDVTPQHRPGIPYPEWNMWTQRFMHDHVAVVEHADGRRLRRPVPVAVDVRKWFEEHTHRAMTSRLEDGSDLDVDQYVSHYIDLTTGEAKEPRVFRDLLPSGRDVTTALLLDGSSSLGVHGGRVFQLELACADALSRAMTLARERHGVFVFTGNTRHRVEVRCLKDFEDRRFVPPSTLGLSTRGYTRLGAPLRHLTSRLLAQPAERRLLIVIGDGLISDEGYEGRYAWADAAHAVEEANDAGVSMYYVGVGPTRVDPLPEVFGPRRSQRIRRIEELPRVLAHVHRELVAA

SEQ ID NO: 3343 - protein, 235 aa, Mycobacterium paratuberculosis
MLPRLESSDAAQAGMSIDEHLHRSQLAQRRADKWLISGSLLIGTAALGVFGLPLFLWGVRLLRRAQREGLSVRPMLVTLLGYLVIIDAAINTVGWALDLVANHTILARVLLNGWGNMFDAGYFWHYNELWVGGAAGPGEKALEVGLILTVFTMRIAAAIGFLQMKRWGHQWMVITCWMGVVIWITYVFNMTMFADVRFAGVVLPVVGWWLYDIFYITPFLAIPYLHTVNRELFAD

SEQ ID NO: 3344 - protein, 199 aa, Mycobacterium paratuberculosis
MAVADRLSAREAKRLQTRERLMGAAIAEFARAGMAEADVGAIVAAAGVAHGTFFFHFPTKEHVLLELERREEERIAKQFAQFLKSEHDLASALNEAVRLVVGLERRLGDMLFNDFLALHFSQTRPQTEDGRDHPLIVLVANEIEGAQQRGETDPHVNPMNSAVFFLLGLYALLITTNHWPTGHALLEDYVARTLRSLKP

SEQ ID NO: 3345 - protein, 699 aa, Mycobacterium paratuberculosis
LSGRRTNRSPEGTAYGFDAIREAISPNGGLAVLPQHAAHGRRERNVLDTDEPLGRPAHPVDRVDHPGGRRNAPGVSGIEQRMGDMGVDLDPRLARHDHAVHPGVTVGRIFPVGRRGPGEPGDVLEGDDGLAVADALGGEPDRGHPSGLHRHHGAVDALRGEPALDALAHVVELDAQMVREAADLTAPHRHDHPGQKHHRRVVVRGGSETHCGTGELGVVVVSVVEDLLHGDRRDPGGQADGGVHQRIAGEAGIDAVDVERGVARLAGTLQGFAQPLLGVTGRHQPDHRRADHVGARGQEPGHLLDGVHRPGLPLRRVDHAVGVQCHQGVDVVGGDDAGRFVQPAQLRRVPADFLRTGGVHADQFQIGPADDRPQRMPANVAGGELNDSAHDCLVLCGGSVIRYRQRRIVRVEATVDVKDRIGGIAVPGAQVHREPAEVLDVAQPVQGRGRQHLLQRSGHQVQAAPQTVGGERAQRNGVDPDLGREFLPHGAGERLEAALRDAVGGQCPDPEPGRARRDVDDRAVPGGEHVRGHELAHDERRGHAPVEGVPEVLVGDVQKPCIAGAADVVDQDVDAAETLHGGVDHALSVRTAHRIGHQRQALAARRLDALDRATISASVRAVPTTVAPASASTRAMPAPTPFPAPVTIATCPSSRNCSNAMPDSLGRGVMSAPFNVGSILTIVNDYAQAISRFARCREE

SEQ ID NO: 3346 - protein, 289 aa, Mycobacterium paratuberculosis
LSIVIDYSQYATYIERRRHHPATEGVRHGVGAIPAGRTGRDRHGRREGSRGGHRPGAGRGGRHCRRDRAHRGRYRRTIEGIEAAGGKGLALVADAMSRPDGERVVNTAMERLGRIDILVNNVGGSSYARFLDITDEDFRHTFDWCVTSAFIMSQLVAAHMLAAGHGSIVNISSGSARFGIRALTAYCVAKGGLEALTRAMGQELAPKIRVNAIALGSFATDGLRGSLDLMPGSLEKMLAATPLHRLGDVEDLGRLTVYLCTRDCYATNAIFHVDGGLDSNNSPLPIPDY

SEQ ID NO: 3347 - protein, 360 aa, Mycobacterium paratuberculosis
VRRVIQFSTGNVGRHSLRAIIGRPDLELVGVHAAGPEKIGRDAAQLCGLDEPTGIIATDDIDALVALNADCVVYTSQGETRPMDAIEQMSRFLAAGTNVVGTSMVWLVAPRHAEEWLREPLQRACEAGNTSLYVNGIDPGFSGDTLVHAAVSLATRVSSITVQEIFDYGNYDDAEFTGAAMGFGTAPDDDSPMMFLPGVIVAMWGGQVRSLADHLGVELNDVRQRIERWFTPERIDCTMMTVQPGRMAAVRFATEGVRDGEPVITLEHVTRLTRAAAPDWEYPPDGHTGVHRVVVAGEPRVEINTHVSHPLFDSTDAGCISTAARVVNAIDWVCRAPQGLIGVEDIPLAATMRGVLWQDR

SEQ ID NO: 3348 - protein, 198 aa, Mycobacterium paratuberculosis; identical to SEQ ID NO: 3087

SEQ ID NO: 3349 - protein, 177 aa, Mycobacterium paratuberculosis
VAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFRRWNAPSTTTRAVPR

SEQ ID NO: 3350 - protein, 142 aa, Mycobacterium paratuberculosis
KPGDVGPNVTADGPPSQNPSGITGVGQVFKNPDGKRTIMDTIAVFPDPATAAQTAANMRDVVGKKVNGPQQPIDIGSNGFMVIGQGSDPANPMEISEAVFVEGRAMVDLESDCVIGNPTPADVLLDLARKQDAAVKAGLPAG

SEQ ID NO: 3351 - protein, 209 aa, Mycobacterium paratuberculosis
MTAVEDRPLRSDAARNVERILRAAREVYAELGPDAPVEAVARRAGVGERTLYRRFPAKADLVRAALDQSIDEDLTPVIDSARHAKDPLHGLTRLVEAAISLGAREQNLLAAAHRAGSLTSDISVSLNEALGELVREGQRAGRIRADLVADDLPRLVAMLYSVLSTMDAGSEGWRRYVALVVDAISVDERRPLPPAAALRYASQPNSWPL

SEQ ID NO: 3352 - protein, 412 aa, Mycobacterium paratuberculosis
LETWVMSISFETSESRADAELPVLPMPRAAHCPLAPPPEFVDWRQQPGLRRALFQGNPVWVVSRYHDIRAALVDPRLSAKTIPDSIMPTDADNKVPVMFARTDDPEHHRLRRMLTGNFTFRRCESMRPQIQDTVDHYLDRMLDGGAPADLVREFALPVPSLVIALLLGVPPEDLELFQFNTSKGLDQKSSDEEKGKAFGAMYAYIEELVQRKAREPGDDLISRLITEYVATGQLDHATTAMNSVIMMQAGHETTANMISLGTVALLGNPEIYARLGQTDDSAVVANIVEELMRYLSIVHSQVDRVATEDLTIAGQLIRAGEFVVMNLPAGNWDTEFVDNPESFDADRNTRGHLGFGYGVHQCIGANLARVEMQVAFATLARRLPGLRLAVPPEQLKFKDANIYGMKELPVSW

SEQ ID NO: 3353 - protein, 211 aa, Mycobacterium paratuberculosis
MRIAAMIAASVLVAGCAHTTGGRSEPTPSGAATPSGSAAGPSSSKPPGPSAAPAAGAAMSDVITWIEAGHPADPSRYHTATRDGVATPLGDDIAVSALAGKVSCMTDAKHTGGAVVCLVSLTHPAPPPATAYGQWQGGWVDFDGTSLQVGSARADPGPFVNGNGTELANGDSLAFGEYRCRADQAGLYCVNYAHQSAAKLSPAGVEPFGCL

SEQ ID NO: 3354 - protein, 519 aa, Mycobacterium paratuberculosis
LRARRRRHVGYRRFMHDRTVRARTATGIVEGFTRDGVHRWRSIPYARPPVGDLRFRAPQPAQPWSGVRHCHGFANCAPQQRRYTLLGLSGLGGRYQPMSEDCLTLNVVTPEAPAEGPLPVMVFIHGGGYFLGSSATPLYDGAALARRGCVYVSVNYRLGALGCVDFSSLSTPEIPLESNLYLRDLVLALQWVRDNIAEFGGDPDNVTIFGESAGACITATLLAVPAAKGLFAQAISESPASGLVRSQEVAAEFANRFANLLGVRRQDAANALMQASAAQLVKTQHRLIDEGMQDRLGAFPIGPVVGDDILPTDPVEAMRRGEAHRVPLIVGTNAEEGRLFTRFLAMLPTNESMVEELLADAEPAVRERITAAYPNYPDRSACIQLGGDFAFGSAAWQIAEAHCAHAPTYLYRYDYAPRTLRWSGFGATHATELLAVFDVYRTRFGALLTAAADRRAALRVSNQVQRRWRAFSRTGVPGEDWPRYTAAERAVLVFDRKSRVEFDPHPHRRMARDGFSLAR

SEQ ID NO: 3355 - protein, 665 aa, Mycobacterium paratuberculosis
MHAETEQVIERPSDLSASWLAAVIGTGPIADFSVERIGTGQMSECYRIRLRYAQADARGPESVVLKVAATDPVSRQTGLALGLYEREVRFYGDLAPRLGGPIAPCYHAAVDTSTGVFDLLLGDAGPAVVGDEIAGATIEQARLGVVELGRLHGPLLGDISLAQAPWLNRDAPLNQAMIAPLYAGFVERYGDQIAPEHRAVCERLVAAFDGYLAQEPGVRGLVHGDYRLDNMLFGTAGAERALTVVDWQTVSWGPALTDLAYFLGCALPAKDRREHYDALLRAYHEALGPQPPITLADVADGVRRQSFFGVMMAIVSSMLVERTDRGDQMFMTMLRRHCDHVLDTDALATLPAASAPEPLRPSPEDELAHDPTTEPLWSESWYADFADPAQGLGGWFRLGLVANQQTAWVHALVCGPDMPTVAVDAQVPLPPDPWTVRTDTFEITHSAGAPLRSYRVDVRALAQAYADPAALLRGEPGTPVAMTMNLDWHTDGTPYKYAMTTRYEIPCTVTGSVTIGDTAYRIESVAGQRDHSWGVRDWWSMDWIWSALHLDDGTHLHGVNIRIPGAPAFSIGYTQGADGEVTELQTVDSRESFGDNGLPLDATLELNPGEITAQVDVRGQAPVRLVAADGRVSQFPRVWAAVSTGDGRRGVGWLEWNRNLGERIG

SEQ ID NO: 3356 - protein, 174 aa, Mycobacterium paratuberculosis
MEPQSRRTDRVSGSAPVVVMGVSGSGKSTVGVTLARRLRVPFVDADTLHPPANIAKMAAGTPLGDDDRRPWLDEVGEWLAAHRDGGVAACSALKRAYRDRLRAHCPDVAFLHLSGSAALLGPRLAARSGHFMPAALLQSQLDALEPLGPDEAGLTVDAGREVDSIVDVVLRARR

SEQ ID NO: 3357 - protein, 129 aa, Mycobacterium paratuberculosis
MAEAVDRVTRVASDLMDSAAAEGARQSRSAKQQLDHWARVGRAVSSQHTASRRRVEAALAGRLSTAEITAEEGVVFNAEISAAIDESLARTNYGATLAGQGVTTVALNDDGEIVEHRPDGTAVVLAGRR

SEQ ID NO: 3358 - protein, 192 aa, Mycobacterium paratuberculosis
MERLDVVVGPNGAGKSTFIALTLAPLLPGSVVVNADEIARQRWPQDPASHAYDAAKVAADTRAKLIDLGRSFIAETVFSHPSKLDLLHAARRAGFTVVLHVLLIPEDLAVERVRHRVRAGGHDVPETKIRERHRRLWTPVAEAMTLADLATGYDNSRLRGPRVVARLSGGLTVGAVDWPAWAPETLRSRWPV

SEQ ID NO: 3359 - protein, 355 aa, Mycobacterium paratuberculosis
MVIRRIARPLLSVAFIGQGVNSLLNPKSAAEAAAPAVDGLQALPDPVSGNIPSDPETVAQITAAVQIGGGLLLATGKLPRVASAALALTVLPANLGAHSFWNESDPVAKAQKRQQFLTDLSLLGGLLIASADTAGKPSLGWRGRRAAERLSERVSSAWPGSDDSGFEADLSELGERIAHGLQIGAERGRELASTAAERGAPYAEAALERGRELASTAAERGAPYAEAALERGRELASTAAERGRPLAKKARKRGEELADEAAERAAYLAQKARKRSEELAEEAAERGKSLAKKARKRSEKLAKKARKRSEKLAGTARVRGEELAETARQRGSLLADTARERVGGQVGTGRRKLSW

SEQ ID NO: 3360 - protein, 187 aa, Mycobacterium paratuberculosis
VVRALIIVDVQNDFCEGGSVPVAGGAAVAPAINAYLDDAPGYDYVVATQDFHIDPGDHFSDRPDYSSSWPVHCLAGSAGADFRPELDTTRVDAVFRKGAYAAGYSGFEGVDDNGTPLLEWLRRRGVDEVDVVGIATDHCVRRTAEDAARAGLTTRVLVDLTAAAAQDSAARALDEMRSAGIELVGVR

SEQ ID NO: 3361 - protein, 267 aa, Mycobacterium paratuberculosis
LMVAPLDRQQLLAAVERSPQAAAEHDRAAWVALFTPDGRIEDPVGSRPHLGRTQIGRFYDTFIAPRDIRFHRDLDIVFGTTVLRDLELEVAMGPAVTMYIPAFLRYDLRETNGEWLIGALRAYWELPAMMVQFLRSGPGAARPAVDLCRGLLRNQGWRGSAGFMAGFRRVGAPHQRLVRRFLDAVAAGDKFAAAQALSSTAAITLGDRDPIELAELAEQLAGAGLTKMNSAGPAVAVSLHSGHGRAIMFADVAWRANAINRIRYFPA

SEQ ID NO: 3362 - protein, 138 aa, Mycobacterium paratuberculosis
VYPRGRPRREPRKRLRGKGFMHMNTVFVGIILFTAAITAAIAVADFVPARFVLANSAEVGVPRSWLPALGAAKLAGAAGLVVGLLGLPALGIAAAAGLVVFFVGAVLTHLRAGVLYNIAFPGAYLCLSAASLAWMALR

SEQ ID NO: 3363 - protein, 207 aa, Mycobacterium paratuberculosis
LRDAIGSLCKDTSAWSSAGLIWTMTVTEVVVAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFRRWNAPSTTTRAVPR

SEQ ID NO: 3364 - protein, 198 aa, Mycobacterium paratuberculosis; identical to SEQ ID NO: 3087

SEQ ID NO: 3365 - protein, 311 aa, Mycobacterium paratuberculosis
MNAPRNLAELAQRFDDDRRHLRSVAFQLLGSLADADDAVQSAWLKASRADFAAVDNLSGWFTTITAREALDQLRARKRRAELPLAAPEELDRLAVPASSPADEDTLLAESVSTALLVVLDRLSPAQRVAFVLHDVFAMPFETIAELLNRSPDAAKKLASRARARLASFAPAGPPRRDGHRIERHVEVVQAFLAASRGGDIAALLQLLAPDVLRTVDPVLVPADVPTALRGATRVAQETRRFAGRARAGAVMLIDGTPGIVIAARGRAQILLMIGIGADDRIHTIDITGDPERIRRATLALPPAGRFRNITT

SEQ ID NO: 3366 - protein, 442 aa, Mycobacterium paratuberculosis
MLDRPFGRRSLLRGAGALSAAALAPWSAGCGSDDDGALTFFFAANPEERDARMRIIDEFARRHPDIKVRAVLSGPGVMQQLSTFCVGGRCPDVLMAWELSYAELADRGVLLDLGPLLARDKAFAQQLQADSIPALYETFTFNGKQYALPEQWSGNYLFYNKRLFDEAGVPSPPAAWEHPWGFSEFLNAARALTKRDASGRAAQYGFVNTWGSYYSAGLFAMNNGVPWSDPRLNPTHFNFDNAAFQEAVQFYADLANKYRVAPNGSETQSMSTPNLFAVGRAAMALGGHWRYQTYLRAEGLDFDVAPLPVGPAVGKGQPACSDIGATGLAISSSSPRKEQAWEFVKFATGPVGQALIGESCLFVPVLRSALKSDGFARAHRRVGNLGVLTDGPAFSQGLPITPAWEKVNALMDRNFGPILRGSRPATSLAGLSRSVDEVLRSP

SEQ ID NO: 3367 - protein, 314 aa, Mycobacterium paratuberculosis
MTALDTGAGRRTPKNPSPWRRHAWAGRLFVAPNMVAVAVFMLFPLGFSLYMSFQRWDVFTPPKFVGLKNFTDLFSSDPLFLIAIRNTVIFTLGSVVPTVAISLAVAGVLNQKVRGIGIFRTIVFLPLAISSVVMAVVWQFVFNTDNGLLNIMLGWVGLGPVPWLVEPRWAMASLCIVSVWRSVPFATVVLLAAMQGVPETVYEAARIDGAGEIRQFFAITVPLIRGSISFVVIISIIHAFQAFDMVYVLTGPSGGPESATYVLGIMLFQHAFSFLEFGYASALAWVMFAVLLVLTVVQLRVSHRRSLETSRGLK

SEQ ID NO: 3368 - protein, 280 aa, Mycobacterium paratuberculosis
VGSSEAVIKRTVLRAATVYAALLGIAWCALFPIAWAVSGSLKTEGEVSEPTLVPARPRWSNYTEVFALMPIGRMFVNTVLYAGCVTAGHVFFCSLAGYAFARLDFRGRNTLFVVYLGTLMVPLTVTVIPQFLIMRTLGWVDTPWAMIVPGFFGSAFGTYLMRQFFRTLPTDLEEAAILDGCTPWQVYWRILLPHARPAVMVLAVLTWVNVWNDFLWPLLMIQRSSLATLTLGLVRMKGEYVARWPVLMAASMLIMLPLVIIYAIAQRSFVRGIAVTGMGG

SEQ ID NO: 3369 - protein, 356 aa, Mycobacterium paratuberculosis
MASVTFQQATRRYPGADRPALDNLNLIVGDGEFVVLVGPSGCGKTTSLRMVAGLETVDSGRILIGDRDVTNVDPKQRDVAMVFQNYALYPHMTVAQNMGFAMKIAKIPKAQIRERVLDAAKLLDLQPYLDRKPKDLSGGQRQRVAMGRAIVRRPQVFLMDEPLSNLDAKLRVQTRNQIAALQRRLGTTTVYVTHDQVEAMTMGDRVAVLRDGVLQQFAPPRELYRNPSNVFVAGFIGSPAMNLFTLQVVDSAVSLGDWPIALPREIAAAASEVVVGVRPEHFELGGLGVEMEVDVVEELGADAYLYGRITGSGKVIDAPIVARVDGRNPPEKGSRVRLHPAPGHLHFFGRNGQRIG

SEQ ID NO: 3370 - protein, 322 aa, Mycobacterium paratuberculosis
MVNTVRADLVCEGGGVRGIGLVGAVDALAAAGYRFPRVAGSSAGAVVASLVAALQTAGEPLSRLTDIMRTIDYRKFLDRNLIGHVPVIGGGLSLLTSDGVYRGAYLEQLLAGLLGDLGVRTFGDLRTGEAPEQFAWSLVVTASDLSRRRLVRIPWDLGSYGIDPDDFPVARAVHASSAIPYVFEPVRVGGATWVDGGLLSDFPVELFDRPDGQPQWPTFGIRLSARPGIPPTHPVHGPVSLGIAAIETLVSNQDNAYIDDPCTVRRTIFVPAEDVSPIDFDITAQQREALYERGRQAGQQFLQTWNYADYLKACGGPVPETP

SEQ ID NO: 3371 - protein, 95 aa, Mycobacterium paratuberculosis
MDLAHWVTSIVAFVRAGYPAGMPATGHVPLVASAHRRLCHDDITAIATDLIARRLWPISSVDIGVEITRFTNQLPSPQDVNLVLRRVHAIRCSRG

SEQ ID NO: 3372 - protein, 186 aa, Mycobacterium paratuberculosis
VMDRYGTDVLAPGRRKPRSTEHPAEPGLVVEDVETGYVGAVVRVEYGRVDLEDRRGHVRGFPLGPGFLLEGRPVILTAPRRPAPAAAARTASGSVAVPGARARVARASRIYVEGRHDAELIAQVWGEDLRIEGVVVEQLGGVDDLVDIVAEFAPGPGRRLGVLVDHLVPGSKEARIADAVRRGPGG

SEQ ID NO: 3373 - protein, 536 aa, Mycobacterium paratuberculosis
MQGVFGVFIGTFLIGLREGLEASLIVSIVAAFLKRNGQTLRPMFAGVAVAVLLSVAVGVGLDLLATSLPQAQQEMMETVINAVAVVFVTSMIIWMNRNAAQLKGELEREARQAVHRGGALALGAMAFLAVLKEGFETSVFLLAAAETSHGSRWFAVLGGVLGIATSIGLGVGLYFGGLRLNLGRFFRVTGVFLVLIAAGLVLGALRTAHEAGWLNIGQRQLFDLSGWIPSDSVLGAVTTGVLGIPADPRLVEVLGWLLYAVPVLVVFLRPARLAATPRARGRLLATAATLLLAIAAVLAVAAPARDTVDAARTRTVTDRAGHAAAVSMATGPHGRELTVTPAGTSTVHHIQLVPADDQSVDGLPVQAWQASETAGVDGAPEITLDQLRDMTGGRLPVGLAAARTPGPFQGQWSTTTVYTVLTRGDAVISAKAASNRTAVLTGGGLTGAKTVSLGGLATDWSTSAAEDHATAAAIAAGDRNRGEGQLWNVWLPLVIAGFAVACALSALASVRVDRKREDERKAIDGEAHRRGNVPVS

SEQ ID NO: 3374 - protein, 357 aa, Mycobacterium paratuberculosis
SAGKDGCALDTTNVPAGPVTFTVANTNAPGISEVELLRDQRIVGEKENLAPGLDPVSFTLTLDGGSYQLYCPGASTEYQTLTVTGKAPATPTGTIATVLSQGTKDYAAYIVNQIGQLNDGAKALDAAVQAGNLDAAKAAYAKARLYWERSESTVEGFVLPGFAVGDNAGNLDYLIDMRESTPVDGKVGWKGFHAIERDLWQAGAITPGTKALSTELVGNVGKLHGIVATLQYKPEDLANGASDLIEEIQNTKITGEEEAFSHIDLVDFSGNVEGAQQAYASLRPGLEKIDNNLVHQIDQQFQNVLATLDGYRDPGALGGYRTYTPALKASDAPKLTAVIQPLHQSLSTVAQKVVSAG

SEQ ID NO: 3375 - protein, 421 aa, Mycobacterium paratuberculosis
VEPDSTAVSRRRALGGAVLAGLSGAAIGAVGGGFAGHAVAAGQRGDDHDTVDLRRSYPFYGQPHQGGIDTPPQRYAMFMSFSLASGAGRTELQTLLARWSAAAAILQQGKPVGTVQPQVDVQPPADTGEADGLSPASLTVTIGLGPSLFGDRFGLAARRPAVFTDLPPLNGDNLDPRLHGGDLSVQACADDPQVCYHAVRNLARLGRNIVSPFWAVLGFGRASAGPGQHTPRNLLGFKDGTRNISSQAEYDRFVWVDNSDQPWMNGGTYQVVRKIRMLLETWDVDRIGNQQRIFGRTKEEGAPLSGRHEFDTPDFTAKGPDGNPLIDPMSHVGLAARENNDGIMIRRRSYNYTDGLDANGQLNAGLLFVSYQKDPQDFIRLQNRLGAHDLLNEYIRHIGSAIFAVPPAPAEGHYIAQSLFR

SEQ ID NO: 3376 - protein, 174 aa, Mycobacterium paratuberculosis
MTDALVIDAEGLDRLSCNAKANPETGKKTLKAKTVCEKGFRNMTYVRGLAPMLVGEPPALLGDDSAPNPSETALAALGSCVSVGLLANATHRGVTLTKIEVEMEADIDISAVWGVGDTPPGKRLGFSAVRCTVSLAGDADEATLKEIHDNAIAWSPVVNTFRNPVSVDSTLVTG

SEQ ID NO: 3377 - protein, 355 aa, Mycobacterium paratuberculosis
MTATVDAATGLLDAALVEDIRAHAAVLDRGQDSARRSFTALGEAGVLGIGAPGNRDGRLPVMAEVIRSISGICMSTGFSLWAHRMTVEYLLTAATPFSAVAVRPLLRGSALGVTGMAAAFKEAAGCGSVELTATPVAGGYRVSGPIRWASNLYPDSTMVTAVRTEAGERLIVAVPLDTPGVILGEHFDLLALGSTASSYLNFDGAHIADEQVLSRDFDGFLQAVRPTFLVLQSAMCLGLSRTAVRQAGLGLGGVNAVFRADVEAITEKLGAAEETLAKLAAAVGGPAAPSKKELLSLRLAAAELAAASADVEIRTAGGKGYASRTSASRRYREAAFIPVQSPSEAQLRWELAGCG

SEQ ID NO: 3378 - protein, 209 aa, Mycobacterium paratuberculosis
MVTPVAVPPEGTDAGRLVGGVPLARLVRDFHRPMLNFARTMVDSPAVAEEAVQEAWLQVLRSSDSFQGRSSVGTWLFGIVKHTAARHRRREARIRRHEVLADADIEAVDPLSGRMHPAGHPDAGHWRVPPSRRFLPEDRTVHRELLGYLREALDALPARQRQLVILRDLVGISAEEAAELLQLSAEAQRALLYRARGNLRNELEKRYQP

SEQ ID NO: 3379 - protein, 89 aa, Mycobacterium paratuberculosis
MTVPDNTVPAIDCVDFVRLVDDLVDADPQQWGPIVAKHLDECPPCLVYLQQMLDLKILLRHVFDGEQLGEHDVTRILNALNTLTKGEHR

SEQ ID NO: 3380 - protein, 314 aa, Mycobacterium paratuberculosis
MTINASAPQRQGAVAVVDTVTALPAAVAGDGHTADPFEPLTVGAMVDRVSAIAVEKAAHPWAFLMRSLVGGAMVAFGVLLALVVSTGVKTPGVASLLMGLAFGMSFVLILVSGMSLITADMAAGFLAVLQRALSIRSYVVLVAVGLVGNIVGALVFVTVCAAAGGPYLGAFADRAATVGTQKAGQPFWTALLLAVLCTWFLQTSMCMFFKARSDVARMALAFYGPFAFVIGGTQHVIANVGFVGLPLLLNLFHPIAARGDIGWGIGDHGLLTNIGVTTVGNLIGGTVFVALPFWIIAHLQRRRILSTGALRPDG

SEQ ID NO: 3381 - protein, 294 aa, Mycobacterium paratuberculosis
MSAPVQQLGIAVAVDGSPASNAAAYWAAREAAMRHCPLTIVHAVSTPTTMYPPVPYPEALATNLEDEGKQAILHATKIAEEAMPADRQVPIGRKLLYSAPVPALLELSGAVRMLVLGSAGHGLLARGLLGSVSSAVVRHANCPVAVVRDEELPDPHSAPVLLGTDGSPASELATEIAFDEASRRGVDLVAIHAWSDTAVTEVFEIDWPIVEAEAERHLAESLAGWRERYPDVTVHRLVARDRAAQHIISSSETAQLVVVGSHGRGGLARLLLGSVSNAVLHSVRVPVIVARPPA

SEQ ID NO: 3382 - protein, 436 aa, Mycobacterium paratuberculosis
MQHANSARPARNLAVDYYRVSGVVLIVLGHWLAGSVTYHEGQFGRQNPLVDMPWTQWLTWPFQAVPTFFLVAGYAGAVSWTHRHDEEGVPRRSWLQRRLARVLGPTAVYAVLVSAVVVALAACGVAGSVLEYAGWAVAMHLWFLAVYLVVVSSTPIALVAQRRWGLWVPAALAVTVAVVDAARIGAHLPHLSWVNYVLGWGTLYQLGIAWHEGSLAGRRPWLLAGVSAVLLAALIWLRVYPVSMIGVPGQTIDNTTPPTVALLAFGGAQTGIVMAAAPALNRALRAIRAERGLSIANNNIMALYLWHMIPVVIVAIVGYPAGLLPQPPEGSVQWWQARLEWVAVLSAVTAVEMVLLWWARRLFAAPLPLLGVPLPARAAEPVLLAGAALAAYTLSVVAAEGFAPDGRFPWPTALVFAAGVLLAALRPTARPVERPA

SEQ ID NO: 3383 - protein, 323 aa, Mycobacterium paratuberculosis
MKQAQLGGLQVGRLGLGAMGMSVAYAGAGTDDAESIRTVHRAIELGVTLIDTAEVYGPYVNEELLARALRGRRDRVVLATKFGLISHTGRDGLDSSPANIRVAVDGSLRRLATDRIDLYYQHRLDRQTPIEDTVGALAELVAAGKIRHIGLSEVGVNTIRRAHAVHPITAVQSEYSLWTRDQEDEILPVLRELGIGFVAYSPLGRGFLTGAIRSAHELPDTDYRRTNPRFAEQNFAHNLRCADELRDIAADVGATPAQVALAWLLAKGPDVVPIPGTKRVARLEENVGADALELTTEQLSRLDRLTPPVGGHHADAQLAWIDR

SEQ ID NO: 3384 - protein, 389 aa, Mycobacterium paratuberculosis
MTANTVLVTGAFGQVGKRCTQLLLQRGRTVVAMDLRNDNTAAVATELAAGGYPGTLIPAYTDLLDAEAVRDLVTAHQPDAVVHLAAVVSPLSYRKPDLARRVNVGGTENLLAACTALPRPPLFLMASSAAVYGSRNPYRQPERITPDTPVNPIDQYGQDKVLAEAAIRASGLPYALFRLGGIISPDTHASINGDYLLLMRSMPSDNRMHAVDARDVALAFANGVDRAATISGKVLLIGGNESYVLTQRELEDAMMEAVGLGRLGPSASLPGNPADDRGWSFTGWYDTTEAQQLLDFQEHDWSQTVAWLAESQGRSRLALRLLGPLLRPLLRTILIVQRRLGGTRPLRRPVDVDRKEVRHSGIGDRRLTGSVSGRSTPAARRRGVRPPAA

SEQ ID NO: 3385 - protein, 172 aa, Mycobacterium paratuberculosis
MTERAHSAVADTLPAIESIKQLKARYCRYLDTKDWAAWRTIFTDDFLSDTSEAGGAVIAGADDFVAFTRRALGRATQPTAHQVHNPEIELTSATTARGTWALQDVVRFGPGITLVGYGHYHETYENIDGQWFIKSSKLTRLREDIVTPLFSIYVSPRIRAAIGTFAGRLMDR

SEQ ID NO: 3386 - protein, 268 aa, Mycobacterium paratuberculosis
MTDTHVFDEALHLDTLGADARRGRTHPEWANMVGPFGGITAATLLSAVHAHPDRIGDPLALTVNYAAPIADGDFDVTLRAARTNRTNQHWIVELRQDDVVKTTATAIFALRRDSWSDTEARPPGTPPPERLPSVDPGLVRWTGRYDMRYVEGAMPGRDEEPSPSSTSTLWVRDKAGRPVDYPALAALCDIFYPRVFLRRGGFVPSGTISLTTYFHADQHELDAVGDDFVLASAHANRFDRGYFDQSARVWTRQGGLLASSHQVVYFKG

SEQ ID NO: 3387 - protein, 415 aa, Mycobacterium paratuberculosis
VTSESVEEFRGRARAWLAANMPRLDPARAALLQRDELSSWHRARELQKLLYDGGFAGICFPREYGGLGLSYEYKKAFDAESVGYETPLLLNVPSFAICCATILDMGSEQQKRTHIAAALRGEEVLVQLLSEPSGGSDLAGVLTRAERRGDRWIINGAKTWSTWAFAADYGLCLARTDWQVPKHEGLTMFLVPLAHPGVTINRIRQVNGSVEFCEEFFDDVDVGDDAVLGEPGKGWDVASRQLYHERRTMGDGSEYTSGPGIAEAQDVSVDLLSLIDAVGGPGDPRLQEAVGRALVHRAVHGQLSEHVFHAVVDGTLPPAAGSIIRLSMAEVHNVETDTALAVAGPAAVVDGAGGLLDIGTRYLGRQIASIGGGTTEMARNVIGERVLGFPRERADDRGVPFNQVRRGRNPGGQRN

SEQ ID NO: 3388 - protein, 288 aa, Mycobacterium paratuberculosis
LSDRLRDIRELAGHTDTYRDELYRRWTGLLSYRYIGRKHSSMNLGETDDTVTIRRDMRNEAGGIMVAPLAISSPEGCQTDMVAVPNPVIASVQIIDPGYDVKRVEIVGSGIVHQGRTMGYGRCTIVDADNPGRVIAFNEGQGAIIGVPPEGLDRMDVSGTELVIEDSDELPPLWRAFGASRRADGHWTLPELNTELASPDAALHIGPQHVVLETAAIDLAAEVAGTRKLQVVSWHVMFMSRGKVGPFRVEGTAHPGASGRVGVRMLLHDEGNADKAVTSAAAIFEVVG

SEQ ID NO: 3389 - protein, 342 aa, Mycobacterium paratuberculosis
VSRQGEGSTDMTNRFPDEGTIRTVLALASRAPSVHNTQPWRWLVGQESLHLYADGGRQLPNTDPDGRDLILSCGAALHHCVVGFAAVGWQARVTRLPNPADPDHLAAIELSGGTADPVDIALAAAIPRRRTDRRHYSSWPVPVGDIALMAARAARNRVTLCQVEDADKLHEIVKQSVWDHMNRDYLVELAAWSGRYAAVAGVPARNTPKSDPGAKIPGRLFAGPMLAMPSGSSAAEDNSVLLALGTRGDDRLARLRAGEATSMVLLTATSMGLASCPVTEPLEVADTREAVRAEIFGGSNYPQMLLRIGWPPINADPLPATPRRELRDFVEWMTDREPGIAE

SEQ ID NO: 3390 - protein, 125 aa, Mycobacterium paratuberculosis
MIEMLPDMPPGATGVRVSGRLSGQELREVRPTLEKSLKSGEIRIVEVIDSDYQGFGPGGLVEDLKLGLGAVLPHHSAFRRIAVVSDKEWVAHTLHALAWMVPGELAVFGLGELERAKQWAAGADS

SEQ ID NO: 3391 - protein, 154 aa, Mycobacterium paratuberculosis
MSTTRPPELRTRMFARVLGPFLVVFTATTVARASDMRKLLSDFDSKSALPLVTGGFLLLASLVIIGLHQCWRGAPAVTVSVVGWVFAVRALLLMAFPHAFMAAADAAVRMTALWVSGDVVVGVVGLYLAYVGWKPVTSPSTPAPTSTPDVPRAA

SEQ ID NO: 3392 - protein, 333 aa, Mycobacterium paratuberculosis
VMMQMTADTEVITAAIELACHAPSLHNSQPWRWVAGSTGVDLFVDPRRTVKSADKSGREAIISCGAALDHFRVAMAAAGWSSNVAQFPNPNNLDHLASIDVVPTEYVARARRDLADAILRRRTNRLPFRAPKHWSALEPVLRDAGRDHSVALDVLGPDARPGLVEAARLTEALRRYDDDYHHELDWWTSPSRKFDGIPESALVSEADDRRVDVNRRFPVDPLDERSSAGSYDDAKILVLSTPEDTRADALRVGQVLSRILLECTAAGLATCPVTHVTELEAGRDLIQHLMADPAAVPQVLIRVGVEPEGELPPRLTPRRPLGDVLQFRPLSDR

SEQ ID NO: 3393 - protein, 293 aa, Mycobacterium paratuberculosis
MSDPKHRGILVCVHGSAASDAAVAWAAREAAMRGLPITVIHAVAPVVVGWPVGQLYADMPAWQQDGAQQVIDQARKIVIANQGGGTPPEMRTEIIYSAVTPTLIDASRDAWMIVAGSQGLGALGRLLLGSVTAALLAHAHCPVAVVHADDHAARAADAPVLVGTDGSPASEAAIALAFDEASRRGVGVVALHAWSDVGVFPILGMDWRDSEAKGEELLAERLAGWQEQYPDVHVKRLVVCDTPSRWLVAEAERAQLVVVGSHGRGGFPGMLLGSVSSHVAQSATAPVIVVRGR

SEQ ID NO: 3394 - protein, 294 aa, Mycobacterium paratuberculosis
MAASSKRCGVLVGVDGSPASNFAVCWAARDAAMRNVPLTLVHMVNAATVWPQVPMAAEAVAWQEDDGRRVLQEAVKIAEDATRNGRKLAITTELWHAPPAPTLAQLSEEAELVVVGSTGRGAIGRLLLGSVSSGLVRRARCPVAVIHDEDPMMPYPQRAPVLVGIDGSPASELATAIAFDEASRRGVDLNAVHAWSDTQVFGLPGIDWPAVRSEAERSLAERLAGWQERYPDVTVHRMVVCDRPARQLIEQSESAQLTVVGSHGRGGLAGTLLGSVSNAVVHSVRMPVIVARPS

SEQ ID NO: 3395 - protein, 512 aa, Mycobacterium paratuberculosis
LPDSVIHRRHPASCAGARSRGSGSRPGGSICAVGGNQRGPRLMTSPGADRYLSAAFRNKSLPERLRDLEAMVEAITDCAIIQLDANGDVARWCPGAEAMTGYSAAEVLGRPVALLYTSEDRAAGLAESELAAARESGRCEFEGWRARKNGQRFRAGVALSVFTDDAGSAIGFTTVMRDVTAEHQRAETMFHALLESAPDAMVIVGPDGRIVMANAQADQMFGYPREELIGREVEILIPPRHRGSHERYRTGFFAAPAARRMGAGLELWGMRCDGTVFPVDVSLSPLQTEQGVMVSAAIRDITEQLAVQAELTETRAQAEVLAERDRIAGDLQDHAIQRVFAVGLALQGTIPRARSADVQQRLNAAVDDLHAVVQDFRTAIFDLRHTKTDVPGLRQRFDEVIGRLAEGLATTVQYKGPLSVVEGELADQAEAVVAEAIGNAVRHAAATKLTIAVEVADEVSIKVIDNGKGLPDDVSEAGLKTLRRRAERVGGTLTVGAAAGGGTRLRWVAPLP

SEQ ID NO: 3396 - protein, 260 aa, Mycobacterium paratuberculosis
VAERLAGKVALVSGGARGMGASHVRSLVAEGAKVVFGDILDDEGKAVAAEVGEATRYLHLDVTKPEDWDAAVATALAEFGRIDVLVNNAGIINIGTLEDYALSEWQRILDINLTGVFLGIRAVVKPMKEAGRGSIINISSIEGMAGTIACHGYTATKFAVRGLTKSAALELGPSGIRVNSIHPGLIKTPMTEWVPEDIFQSALGRAAEPKEVSNLVVYLASDESSYSTGSEFVVDGGTTAGLGHKDFSNVETDAQPDWVT

SEQ ID NO: 3397 - protein, 966 aa, Mycobacterium paratuberculosis
MSTTFDDTRTDAIPVVKEPVREKIPRFIRTFAVPIIIGWIALIAVLNVVVPQLDEVGKMRSVEMTPDDAQSVVATKRMGAVFNEYKSNSSVMIVLEGQQPLGADAHAYYDEIVRRLNADTKHVEHVQDMWSDPLTGAGAQSNDGKASYVQVYLAGNQGEALANESVESVQNIVKSVQAPNGVKAYVTGPAALSADQHTAGDRSLQLITAATFTVIIGMLLLVYRSVITVLLTLVMVVLELSAARGMVAFLGYYKIIGLSTFATNLLVTLAIAAATDYAIFLIGRYQEARAVGESREDAYYTMYKGTAHVVAGSGMTIAGATFCLHFTNLPYFQTLGIPLAIGMVVVVAAALTLGPAVISVASRFRQTLEPRRTQRIRGWRKVGTVVVRWPGPILVLTIGVALVGLLTLPGYRTNYNDRNYLPTDLPANEGYAAADRHFSQARMNPEVLMIESDHDLRNSADFLVIDKIAKTVFRVPGIGRVQAITRPQGTPIEHTSIPFQISMQGVTQQMNQKYQQDQMADMLHQADMMQTTIDSMEKMQSITVQMSNDMHVMVQKMHDMTIDINDLRNKMADFEDFFRPMRSYFYWEKHCYDIPVCWSLRSVFDALDGIDTMTDDIQSLLPIMDHLDTLMPQMVALMPSMIENMKAMKTTMLTMYSTQKGLQDQQNEAQKNSNAMGKAFDASKNDDSFYLPPETFNNKEFKKGMKNFISPDGHAVRFIISHDGDPMTQEGISHIGAIKKAAYEALKGTPLEGSKIYLAGTASIYKDLSDGNNYDLLIAGISSLCLIFIIMLIITRGVVASAVIVGTVLLSLGASFGLSVLIWQHLIGIELHWMVLAMSVIILLAVGADYNLLLVARFKEEIHAGLNTGIIRSMGGTGSVVTSAGLVFAFTMMTMAVSELTVIGQVGTTIGLGLLFDTLIVRSLMTPSIAALLGKWFWWPQRVRQRPVPSPWPKPAAQEREVLADA

SEQ ID NO: 3398 - protein, 138 aa, Mycobacterium paratuberculosis
VRNAWLPLLIVAVVLVGGFAVVRVKSFFGAHDTGILTSPRLDDSKPFKPKVVKYEVFGSASQANVNYLDLSADPKRVDGAPLPWTLVLSTTAPSVFPNLSAQSDGNTLGCRITIDDEVKDENITHGVHALTFCLVKSA

SEQ ID NO: 3399 - protein, 202 aa, Mycobacterium paratuberculosis
MANPVGLRERRRRQTSADIRDAAVRLTLERGFDKVTVDEICAEAGISTRTFFNYFPNKESAIAYGPSDIPPELVADFVAAGPAPYSVVLAELITLAAHHLRDVPPRREHAANMLELAKTSPAVLAAFLADLERFQNQLTDIIVRRQGMQPDDEMAPLISALALTAVRSGIEKWASGEASETDDTPMPYVERAAALVNSIFTK

SEQ ID NO: 3400 - protein, 308 aa, Mycobacterium paratuberculosis
MADRLPDDAFTAPQVVDPGLRKVARFLPRGYALHRGLKLQRAIMNLMGNAGRLRTVPVVAVNEHVTVRLHRPPNLAEHAPALLWIHGGGTVMGRAAQDDKYLRKLSHRTGVAIAAVEHRLAPEHPYPAPVEDCYAALLWLARQPWVDPERVAVGGASAGGLFAATLAQRAHDRNDVKIAFQMLVYPMLDDRTGAQRDGPRRLMWTESDNQLAWQWYLNGADPDEAAPARRKDLSGLAPAWIGVGTLDLFYPECLEYARRLREAGVPAQEEIVPGAFHAFDQIVDKAPISAKFFESQCDFLRGALAPNG

SEQ ID NO: 3401 - protein, 427 aa, Mycobacterium paratuberculosis
MRFKPEPGKGPSAAQYAAAHAPYVAWLTQASADSAAMAARQETAATAYTTALAAMPTLGELAANHAMHAALVSTNFFGVNTIPIALNEADYSRMWVQAATTMSTYQAVSTTAVASAPQATAAPKIMNAGMSGGSGMSGGNPYVMGTALPQNLQEWLEALFPFNPFSPQGWSMHPSLSMFLSRVETLIPMYAHNPAQLLETIVMLALQFVIHRTLYLIWLILYNPAGLLSFFLSNPVYTLALTTPLLIVPAGAAGGLAGLTGLAAVPAPTLTPPVSPSAIPVTDAPPPPTVGAAPTMGTASSPGAAPMPASPATAAPRAHHPHRHRRSLDPKHRLLHRLSFHPTWWGFSGRRRSRAFRARTAGRPPMPPRRLRPRRARPRPIDKPGDACEMPPAASTAATATNSSTRRRTPSRTSGPRQMLPHNRIRL

SEQ ID NO: 3402 - protein, 208 aa, Mycobacterium paratuberculosis
MGPGPRQAALNHRSAVVFIHPAELPGPTVPGVAPFAADFLLDTTRSAYLLVRNGIRNRYPNIRFLLSHAGGFVPYASHRMAMAIMADTGRSFADVLDDFSSFYFDTALSSSAAALPSLLAFARPGHITFGSDWPFAPVAVGKLFAAGLETYPALDTSTRGAIERTNALALFPRLGTPPHPIPQSPAQRIRHSLSRGAMRIVARMTSTS

SEQ ID NO: 3403 - protein, 215 aa, Mycobacterium paratuberculosis
VRRAEMAATKQPKRRKRADGEMSRERILDAATEIAAERGYEATSIGLVSAKCGLPASSIYWHFKNKDDLIAAVIERSFADWRKAWQVPDEGAPRDRLAGLAMQIAKVLMDSPDFIRLGLMLALERRPVEPRARAMFIQARAQAYDELADIVRELAPGLTDKQIDQLVTYAIAGADGLFIAREIGGDAVNLVGLFELHAGALYDAALRMISENAGQ

SEQ ID NO: 3404 - protein, 89 aa, Mycobacterium paratuberculosis
MLRHNAIREAADLLHDAQRTRRPIGPLTERFPGLDVAAAYAIQQANLNRRTGEGRLVVGHTSWSSTPPPPPRIVPTGPNWSAVGVRDDA

SEQ ID NO: 3405 - protein, 340 aa, Mycobacterium paratuberculosis
VEGEALAAIPVIALTGHLGAGKTTLLNHLLRHPGTRIGVIVNDFGDINIDAGLVAGQVDEPASIAGGCICCLPDGGGLDEALGKLADPALRLDAIVVEASGLADPVAIARLIGFSEIRGVRPGGLVDVVDAVNHFDTVDRGPLPPVRYGAASLIVVNKLDQVPERERSVVVQRVRERAAQRNPRIHVVGTIGGRIAPELLFDASARPEQIGQLSFVDLVPEHEHDHVHADAVTAHSDGCIDPDALLNLLENPPPQVFRMKGVVAVRQRATVRNYVVNLVGSAIDIAKAPPKATANRLVAIGMHLDVAAVGARLDRALQPVYGPASGQASRRLQRYLRLSA

SEQ ID NO: 3406 - protein, 275 aa, Mycobacterium paratuberculosis
MSSSLGDVLATLELERVGQWRFVGQQLPAPANHILGGHISAQALLAASRTAAGREPHSVHTYFLRPGDSRQPVDFEVVDLQEGRTFSARRVTARQDDKILMEAMSSFKVVNSAAAQVVYQPIMPEAPSPESLPWVAPHLAEADEGSRGRWASLRWFERRTIETETVPPARVPMWWRPDGRVPDDPVLTASLVAYMSAVTLTEPAFAARGGVGASAQRDHSVWFHGRAVLSDWLFYDRSSPSSAGSLALASGTMFNRTGELVCTVKQEMYFPPQTA

SEQ ID NO: 3407 - protein, 240 aa, Mycobacterium paratuberculosis
MTHSARFAPKALLFDVQGTVTDFHSTVSSEAQRICGSRNQDVDWSDFVNSWRAAYFSCLEAAKPDRDNWITVHSVYRSSLESLLAEYSITDLTAAEREELTLAWQRLVPWPDVLPGLTLLKKKFIIAALSNADVSALINIAKRGGLPWDAVFAAEMAGVFKPDPAIYHMAARYLGLAPPQIMMVASHKYDIRAAASLGFQTAFVTRPFEFGPLGLADTAYDDAFDVNAADLLDLATQLSC

SEQ ID NO: 3408 - protein, 301 aa, Mycobacterium paratuberculosis
VGVMTRSDITFTSADGTCAAWLYTPSSHSADDRRPVIVMAHGLAGVKEMRLDAFAERFTAAGYVCLVFDYRHFGASSGEPRQLLDIDKQLQDWRSAVAYARTLDGIDPDRVVVWGTSFGGGHTIITAAQDKRIAAAISQCPFTDGFASSFAIPPVSSVKVTALAVRDAIGARLGRPPVMVPSYGPPGSASLMSSPDSVAGVSALIPEGQHVPKEVAARFALDIIRHFPGRQARKVSCPILFAICENDTVAPAKATQKYAAQAPRGEIKLYDAGHFDIYVGADFERNVTDQLDFLSRHVPVS

SEQ ID NO: 3409 - protein, 173 aa, Mycobacterium paratuberculosis
MTRTQQRAAENRRTVIDAAREIIATQGVEALTLEAVAEKADVVVQTIYNRVGGRSALLTAVAEQALEQSRVYMDPAYEADGTVEERMMLAANAYARFARERPHEFRILVEPPNEPEAVARIAELTRAQNARLTAVLREGMAAGLIRADLDPDDVTTALWATFNGLLALAWRPG

SEQ ID NO: 3410 - protein, 342 aa, Mycobacterium paratuberculosis
MSAVAGFAAVDVGGFAYAGGWLRPDSPLTPPRFADRFEHVYGRHDGFRRNHAKGLSATGSFTSTGAGAAICRAAVFREGTVPVVGRFSLGGGLPDQADKPETVRGLGLLFDAGGQQWRTAMVNVPVFTDSTPEGFYERLLATKPVPSTGKPDPQKMAAFLDRHPETAAAMKIIKQSPPSAGFADTTFYGLNAFLFTNSAGATVPVRWSVVPHDGGVAGAPGPTRGKDFLFDDLIRTLAQRPLKWRLILTLGEPGDPTHDATKPWPQSRRTVDAGTVTITAVHTEEEGNARDINFDPLVLPDGITPSDDPLPAARSAVYARSFTRRAEEPKSHSEVNVTRVLP

SEQ ID NO: 3411 - protein, 185 aa, Mycobacterium paratuberculosis; identical to SEQ ID NO: 31

SEQ ID NO: 3412 - protein, 221 aa, Mycobacterium paratuberculosis
MTSDSIDSLNDDRQQNGGIEGVEYGTIGAGTIAQAVARHLVAAGHRVVLSNSRGPSSLNEVVSNLGPLASAGTVTQAARADMVFLAVMWWDIEAALAGLPSWDGRTLVDATNQFAKADPIEVADLGELTGSEWVAALAPGARVIKAFNTLHARYIIPDPRHPAGRQVLFYAGDDAPAKATFHHVTDGLGFAPVDVGPLRDGGRLMQVGGGPLSALHALKQD

SEQ ID NO: 3413 - protein, 406 aa, Mycobacterium paratuberculosis; identical to SEQ ID NO: 1515

SEQ ID NO: 3414 - protein, 223 aa, Mycobacterium paratuberculosis
MFGHSSKGVRPSWRREKPLPRISREQKERNRGRILAAAGEGFKARGIDGVGIDELMKAAGMSHGGFYNHFPSKEDLALEVLHQGFTDSLDTVAAVIDTHAHSGRAALHAIIDTYLSTEHRDHPEHGCASAALAADAGRHGVKAQEAYRRGLQGYIGAFADLLRVSARQRGTKLDARRAREQAIGLFSQMVGAQLIARAVAHADPGLSDEILSSNSKALKRLRM

SEQ ID NO: 3415 - protein, 339 aa, Mycobacterium paratuberculosis
LSHAGHSSGTRSGYVLSSANRNALHLASRGNLVHVFVTGGSGLTGPAVVSELLSAGHRVTGLARSAASADRLARLGAEPFTGSLDDLDRLREGAAAADGVIHMAIGGDSGDLSGITKRDVDAIEAMGAALAGTGKPFVSTSGTMVMAPGRVSEETDAPDPDAFAAYRIPGERACLGYAERGVRSSVIRLAPTVHGPGDYGFVAMLVATARKTGVSAYIGDGTNRWPAVHRLDAATLFRLALEKAPAGTALHGTAESGVPLRDIAEKIGRKLDLPVVSVELDDAPAHFGSAALSSVFAADVPASSARTRALLGWNPSHHTLLEDLEHGDYFTVAEGAGQG

SEQ ID NO: 3416 - protein, 204 aa, Mycobacterium paratuberculosis
VACVAQPVRSDAARNREALIEVATRLFAAAAGGDEPSLRLIAREAGVGVGTLFRHFPTREALVEAVYQDQVRRLTEGADQLLANHPPAQAMRRWMDLFTDWLATKHGMLGTLRAMINNEQLGSGHTRIELLAAIDKILAAGRAAGDIGDHISSEDVAAGLIGIFTVAPTGGNSEQATRLLDIFMNGLSAPQSTVHTTTSTTDNP

SEQ ID NO: 3417 - protein, 151 aa, Mycobacterium paratuberculosis
VAFSHIASKTTAATAALAAAGLLAAAPAFADPQVLQFGQMAEISSNGGTIDYTVSNLQPSGHNDGVWYSDVTAKGVSGNAVPNIADFNARAVNSSTFAVMKGNQTDGLPEGPLPLGTPVTGRLYFDVRNGTNPDSVVYRDAGGTDKVVWKS

SEQ ID NO: 3418 - protein, 214 aa, Mycobacterium paratuberculosis
LTHSIGRRERNPVKTTAHRRSAVVGLAAVALITVGCSNGKSVDASAPPHAAASATSTSANPAQPTEVNLIGESNVEVTLTGPIAAKYASATDDQKKALGKPLTGDRNAGKRESGVVFQQFEGGVITAKNDAPGTPAYITLGKIREAWNVPRGADGTPEITGTNGSAGPLGSPVSDQSSVGDVLVSNFEHGTIQYNPKTDQVAVTVNGKVVPSGL

SEQ ID NO: 3419 - protein, 279 aa, Mycobacterium paratuberculosis
MDLTDKVVAITGGARGIGLATAKAFLAAGAKVALGDLDTELAEKQAVELGGDPAVVGLSLDVSDPASFVAFLDDVEARLGRLDVLVSNAGIMPTGPFVDEPPTMSRRMIDVNVYGVLNGSRLAAARFVPRGAGHIVNIASLAGVTGEPGMATYCGTKHFVVGFTESLHRELRPHRVGVSLVLPGIINTELSAGTKVPGWARPLATAEPEDVAAGIVAAVSKDKPRKTVPATLGALLKSVSLLPDTPRFAVAHAVRFDQLVSGADPNARAAYHRRLAEES

SEQ ID NO: 3420 - protein, 710 aa, Mycobacterium paratuberculosis
LSDSIIGWDKDADGIVTLTIDDPDNSANMLTDAYVEQMGAMIDRLEAEVDETTGVVITSGKSTFFAGADLTQIRSAGPEHAQQLFDGSTAIKRDLRRLETLGKPVVAAINGAALGGGLELALATHHRIAANVAGSVIGLPEVMLGVLPGAGGVARSVRLLGIQNALMQVLLTGNRFKPAKAQQVGLVDELVESVDELVPAAKAWILANPGKHVQPWDVPGFEIPGGSPSTPAFAANLPAFPANLRKQLKGSPMPAPRAIMAAALEGAQVDFDTAQLIETRYFVNLVTGPIAKNMIQAFFFDLQAVQSGTSRPADAPERTIHKVGILGAGMMGAGIAYVTAKAGIDVVLKDVTLQAARKGKAYSENLEQKALAKGRTTEAKSRALLDRITPTADAADFTGVDFVIEAVFENTELKNKVFAEIENIVEPGAVLGSNTSSLPITELAAGVSRPENFVGIHFFSPVEKMDPIEIIRGAKTSDETLARVIDYTLAINKYPIVVNDGRGFFTTRVFSTYLLEAFNMLAEGIDPATIEQAALQAGYPAGPLQVADELSFGTIRKIMDETVQAAKADGVALDESVRVAAEVVTTLMDTFDRTGKRGGAGFYDYVDGTRAGLWDDLRKAFNTTRALSVPFDDLQDRYLFIQAIETQKAYDDGVISSDPDANIGSIFSIGYPPWTGGVRQFVTGYPGGIDAFRRRADELAARYGGRFRWI

SEQ ID NO: 3421 - protein, 403 aa, Mycobacterium paratuberculosis
LTEAYIYEGIRTPRGKGRASGALHSVKPISLVVGLIDELRRRFPDLDEDRISDVVLGVVTPVGDQGMDIARTAVTVAGLPDTVDGVQLNRFCGSGLDAVNVAAKAVRSGFDELVIAGGVESMSRVEMGSDRGAMAYDAATAYDNYFIPQGVAADLLATIEGYTREDVDAYAVRSQRRAAEAWSGGYFAKSVVPVRDINGLTILDHDEHMRPDGTVEDLAKLTPAFAGIGEFGGFDAVAMQRYHWVEAINHVHTGGNSSGIVDGASLVLVGSEQAGAASGLTPRARIVSAATSGADPVLMFGGPIPAVRKALDLAGLTIDDIDLFEMNEAFAAIAIKIQQYFGIPDQKYNVNGGAIAMGHPLGATGAMLLGTVFDELERRGGRYGLITLCVAGGMGVATIIERV

SEQ ID NO: 3422 - protein, 384 aa, Mycobacterium paratuberculosis
LFPDYRPRWETDQHRELRKHAAEFFRKEATPNQERWAAQHAVDREFWNKAGDAGLLGLDLPEEYGGAGGDFAMNVVVQEELAYAYDQGFGFAVHSPIVAHYIWAYGSDEQRRRWLPKIISGEAVLAIAMTEPGTGSDLQSVKTTARRDGDFYVINGSKTFISNGTHCDLLVIVAKTDPSKGAAGVSLIVAETDENLAGFERGRVLAKMGQHAQDTRELFFSDMRVPVANLLGAQEGLGFYQLMEQLARERLIIATICEALAEVAVLEAIKYSREREAFGRPIGKFQHTKFVLAECKTEALAIKTMVDYAVGQYLDGKNDPATASMAKLFAAEKSDQIVDKCLQIFGGYGYMTEYPIANMYTASRVNRIYGGTSEIMKEIISRSL

SEQ ID NO: 3423 - protein, 267 aa, Mycobacterium paratuberculosis
MQPLIGVTVVSLAVNLPGPLAAARLAELGAAVTKVEPTAGDPLAAAAPDWYAHLVEHQDVLTLDIKDAADRAKLDELLAGADLLITSMRPSALHRSGLARPQQKFPRLSLIEIVGHHGERAETPGHDLNYQAVQGTLTPPHMPKVPIADVLGAERAVSSALAALLQAAKAGAGQRYRVVLEEAAARAGDAVRYGLMGEGAVLGGAYPGYGIYASADGYVALGAIEPHFSRARARCSAPTGVTKAWVRRSRPRPPPSWKTLRGIWIFP

SEQ ID NO: 3424 - protein, 195 aa, Mycobacterium paratuberculosis
MTNPRATNEDLTAKARIRNAALDLYAQYGEDRISLRDIASAAGVTLGLVQHHFKTKAGVRDAVDQLVVDYFAHALAQVPAEGSARHVAAARDEAVARMLRDNPPVVNYVRRAVLDPSEDRLHLLDALIELTRREITALRGSGMASTKRPESTQILGVLIRQMGELLLQPMVDAVWDRVAKPTDARKPRLRITVEN

SEQ ID NO: 3425 - protein, 294 aa, Mycobacterium paratuberculosis
LFREPRVAYDATTVATHDGAQLHVRSYGSAFGQPIVLIHGFGCRIEYWNPQINALAAKYRVIAYDQRGLGRSTLGSDGVRPDVLGRDLAAVLDAVLAPGERAVLVGHSFGGITIMAWAQRFAAHAVSAVLLANTIAERFSATTMLLPFADRYRHIRRPLITALAGSTMTLPSIRWSRWPLQRMALSRYADRQAVDFVYEILADCRTDVRAVWGAGLSGLDVTAGLEKLTVPTTVVTGTEDRLTPPAVAHRIAETLQGRGSLHRFARFPRAGHCTNIEVPYAFNAEIEQLADATR

SEQ ID NO: 3426 - protein, 606 aa, Mycobacterium paratuberculosis
MTHAPASRPTTLCEAFQATAAKHPDAVALRTLGDATTITWRQYRDRVRAIAAGLAGLGVGNGDTVALMMSNRPEFHLCDTAVLHTGATPFSVYNTNPPELLAYQFDNADNHVVICEGTFMPQVLAAAQQGGTVEHVVCVDGAANGAIGLDQLEASPAAGFDFERSWRAVGPDDVLTIVYTSGTTGPPKGVELTHTNFIENARITEEVGGITHADRAVSYLPDAHAANRWITHYQNLLYGLQITTVGDFKAVLPALTEVRPTLFLGVPRVWIKAKAGLEAAVDAEPAGKRALAKWAFGVGRARARAVSDGRPVGLAEKLRYAFADRLVLSKVRRRLGMDRLRIGVTGAAPIPREVHEFVLGLGIPVCEGYGMTECTAGATVNRPERIKIGMVGTPVPGTEVTVASDGEVLVRGKNVMRGYRKAPEKTAEAIDSDGWLHTGDIGEIDEDGYLRIVDRKKELIINAAGKNMSPTNIENTIAASCPLAGPVVVIGDARAYNTALITLDPDSVTEYAHAHGLSGSLRELVRNPAVRAEIEKGMAAANRRLSRVEQIKRYTVLADVWEPGSQYLTPTAKLKRKPIATGYAAQIDAMYTEQGKRSAGHSAASD

SEQ ID NO: 3427 - protein, 217 aa, Mycobacterium paratuberculosis
MTTTSSIETIADIAIPDTALVREITEFIRDAEDDLLFHHSRRVFLFGALQGRRRGLQPDLELLYAGAMFHDLGLTERYRDSALRIEVDGANAAREFLLHRGVSKADADKVWLGIALHTTPGVPEFLDPEIALVTAGVETDVVGVGRDDLAPEALAAVIATHPRPDFKTRILQAFNDGMKHRPHSTFGTMNADVLEHFDPTFARDNLVDLILNNGWPE

SEQ ID NO: 3428 - protein, 236 aa, Mycobacterium paratuberculosis
MPSRRVLITGASRGIGRAVADRLAEGGHEPIGLARSAPKDFPGEFYEVDLADPYATAATLDKIVGHAAVHAVVNNVGFARFGRLGSIELDHLFDTYNLNVRAAVQVVQAALPGMLDAEWGRIVNVTSLTTLGTPERTPYAAAKAALEACTRIWAGELASAGITVNAVAPGPTETDMYRERSPVGSAREARFLQSIPLHRVARPREIAHAICFLLDEDAGYITGQILRVDGGGSIAA

SEQ ID NO: 3429 - protein, 145 aa, Mycobacterium paratuberculosis
MAGLDNHLKRCRTALHGAVSAVIVAVVAVLGLAIAPVADAAAPMATLTVEHTWQTGFIARFAITNSSTVPLSDWKLEFDMPAGQSVLHTWNSTLTQSGTHYVLTPANWNRVIAPGGSATGGFRGVLTGTYSPPTNCVLNGQYRCT

SEQ ID NO: 3430 - protein, 250 aa, Mycobacterium paratuberculosis
GVEAADTATALPAARPTPLILGGLHLRASHVRQRRGQAGVQLAVHPLASRALFGLPSAEIPVADYDATAVLGRDIVDLHHRVAEAHRWPDVFALVAQYLIDARRRRDGATVRPEVLHAWHLLQRSRGLMPVTALADAVGVTTRHLATLFRREVGHSPKTVAMLMRFQHATGLIAESARRHGRVDLARVAADTGYSDQAHLSREFVRFAGVPPQRWLAEEFRNIQDGGHSLGSQWEHDCFESDRLVDTASP

SEQ ID NO: 3431 - protein, 133 aa, Mycobacterium paratuberculosis
MTASNPTVWLTLQAHNVPKLIDYYVETFGFVLTARYGDGETVDHAQLNWPEGSGGIMLGSHKPGAEWCREPGTAGGYVVTADPDALYRRVRQHNADIIRPLAETDYGAREFTVRDPEGNLWSFGDYGGANPPN

SEQ ID NO: 3432 - protein, 117 aa, Mycobacterium paratuberculosis
MSPLRCLARVATPLMIGAVLVVGAGIAAATPQDDAYLAQLRAAGLTWPPKTEEALIAEAHDVCYDLTWGWTPQQIADDLHARLDNKGVTLLDVGSLVNAAHNIYCPGNVCDAPSLCT

SEQ ID NO: 3433 - protein, 245 aa, Mycobacterium paratuberculosis
LVPGSHHQPLSQASGCGPTPSGRHTLAVGSHHWPGSQANGCGPTPSGRHTLPVGSHHSPSAQSALLTAGVAIATAAIDANANMATTTSWRTNVFMVGLPSLLPVIEPSPGLRVKAIGQVAGDGPAAKPSDEFVAAHRSAYKHKVGNRMDWYSSSQSTFGADMDAPPGGGFAVNVFLRDGDTVYRTWHTNGRGTEQLSHSFGLIDILPWGRQEEWQDSPHGWPSRPTHSGWPDSPAIARAYGPNDG

SEQ ID NO: 3434 - protein, 431 aa, Mycobacterium paratuberculosis
GIHSRVFVPRRRDRIDFDSMGDVCNHLLRDPETLEFIAGRGPGGKACFVMMDEETQALARQAGLQVMHPPVELRNRLGSKTVMTRLADEAGIPSVPHVMGRAGSYQELLTLAQDAGLGDDLVISIPYGAAGSGTFFVRGQRDWDEHAGDLTAQQEFKVMKRIRNVEVCLEGAVTRHGTVIGPAMTSLVGYPELTPHRGAWCGNDIWREVLPPGQTHAARQMVGKLGDILSREGYRGYFEVDLLHDLDSDELYLGEVNPRLSGASPMTNLTTEAYADMPLFLFHLLEYMDVDYELDIEGINARWERGYGEDEVWGQVILAETSPDVELFTATPRTGVWRIDDDGRVSFSRTANDWATLLDGSEAFYMRVAAPGDLRSEGAQLGVLVTRGHLQTDDYRLTERCQRWVKGMKAKFASTPLAPATPIVSRLVARA

SEQ ID NO: 3435 - protein, 391 aa, Mycobacterium paratuberculosis
VNAPAGISLDNWLSPPYARWSFQHVEDFVPTAVIARGTGPVAAIPAAPSELAEIRVAVTDGTASTVGAVMAGTATDGWAVAHRGAMIAEHYLEGMRRQTRHLLFSVSKSLVAAVVGALHGAGTIELDAPVTKYIPALANCGYAGATVRHLLDMRSGVAFSENYDDPAAQIHLLDQAVGWAPNHRPDAPATLRDFLRTLRQKSVHGGPFEYRSCETDVLGWICEVAADQPMPALMSELLWSRIGAQRDATIAVDPAGTGFFDGGISACLTDMIRFGSLFLREGVSLTGRRVLPEAWIADTLRGGPDSRQAFAASPDDNEMPGGMYRNQMWLPYPGDNVLLCLGMCGQMIYVNRAAEMVAAKVSTQPHSHEPHMLDTMSAFDAIAYRLAGRTD

SEQ ID NO: 3436 - protein, 409 aa, Mycobacterium paratuberculosis
VHMQCCVLLKYGEMVLKGGNRRWFEQWLLTNLDDALSAWPPGHRPAVRRRGGVLVLFTSPALQDELVALARNLIGISLVQPVWRVPRSARAAETAAVELLRDHRTQDGAPTFAVRCHRRDKRFGLSSEQLAARIGARVRADLGWRVDLSHPELELTVEVDRREIFLGTRTHPGQGGLPVGSSGRAVVLLSGGFDSPVAAYRAMRRGLACDFLHCTGAPFTDASSTYKAYALVRQLTRFQPRCRLYVAAVGRAQRTLAASGAGEAQIVAQRRLYLRLACGLAERIGAQAVVTGDSLGQVASQTLPNLAATEQAATLPVLRPLLGFDKQEILAEARRIGTAEIAMLPDQDCCQLFLPRRVATHAAVDQLLPVEARAGVDTLVGNLLDRMQRFDFGTEAAGVESAATASRVG

SEQ ID NO: 3437 - protein, 146 aa, Mycobacterium paratuberculosis
VNMLRFDPFFRDIDRLTQQLWGAVPWGTAAQPALVPMDAWRDGEKFVVEFDLPGVLPESLDVNVEHDVLTVRAERPAIDEDRNGVVSERPRGVFSRQVYLGHGLDTDNIHADYVDGVLRLTIPVAEAAKPRKIEVAAGKHQRAINA

SEQ ID NO: 3438 - protein, 126 aa, Mycobacterium paratuberculosis
LRGDPTPRSARGVYGISVASELSGIPPQTLRHYERRGLLTPARSDGGTRRYSDDDLARLKRISQLVDQGVNLVGVAHILDLESKNDQLKADYSALELLNAKLKTRQNPERAAAPRQCRGEARREAV

SEQ ID NO: 3439 - protein, 142 aa, Mycobacterium paratuberculosis
VNHGVDAYRSVPRPRPVWTQQVLGTAARPAVMPMDAWRDGDQFVVEFDLPGVNADSLDLDVERNVLTVRAERPDLDQNREMVSAERPRGVFSRQLFLGDNLDTDKIEANYHDGVLRLTIPVAEKAKPRRIEINHNHKTAINA

SEQ ID NO: 3440 - protein, 144 aa, Mycobacterium paratuberculosis
LVDRTGDHRRDRGARVIPARAPHPRSGCRPRRKARWLSMTNPYLVLGVSPTATQAEITRAYRRHLRAHHPDTSPPDSATEGSERLSEILAAYALLRDPARRADYDREHRVHQRIRPAVTRVTRIESADEQPPLRAGPVRWHRRY

SEQ ID NO: 3441 - protein, 505 aa, Mycobacterium paratuberculosis
VVTFGTVHNWDPGTGSVISWHATPAAREKARQAPISDVPASYQQLHHLRRFSEHAARGLDMARLNIGVWDISGVCDVAAMTEAINAHLRRHDTYHSWFEHRTDGRIVRHTFADPADIEFAALQRGEMTPTELRAHILATPNPLRWDCFTFGLVQHPDHFTFYMSADHLVIDGMSVGVIFLEIHLTYAALVSGGRPLPLPEPASYHDYCRRQHQHTEALTLQSPQVRAWIRFAQDNGGTLPSFPLPLGDPSVPCGSGVVVAPLMDESQTERFDATCTKAGARFSGGVVACAAFAEYELTGAETYCAITPYDHRSTPAEFVTPGWFASFIPVTVPVAGASFGDAVIAAQASFDSAIGLADVPFDRVLELSSFGGRISKPTGDVHMLSFADARGIPFSGQWDGLNAGIYGDGRSSDQVLMWVNRFDTETTLTVAFPQNPVARDSVERYIRAVRAMCLRVVEHGAAAVPNRRRVVAAVNASAARSTANAADRTDRRLQGAGFGANPVLR

SEQ ID NO: 3442 - protein, 188 aa, Mycobacterium paratuberculosis
VTAVNSVRTFSAAAFAACFTAAAAMLAGAGTAGAADSCPTAAPPSGGTPDWTLTGTTGSVAVTGSTDTAAPVVNVTAPFSVTQTQVHTLRAGDGPAVPGTARVSVCYMGVNGRDGTVFDSSYQRGAPVDFPLGGVVPGFQKAIAGQKVGSTVAVAMTSADGYPDGQPSAGIRPGDTLVFAIKILGATT

SEQ ID NO: 3443 - protein, 253 aa, Mycobacterium paratuberculosis
MGLLDRKTAVITGANSGIGLATAERFLAEGVERVFITGRRQRELEDAARQLGARATAVRGDVGAPRDLDRLYGEVAAAGAGLDIVMANAGTTRVARLGEITDDDLDTLLGTNVKGVVYTVQKALPLLNDGASIILTGSTTADRGRAGLSIYAATKAAVRSLARAWANELAHRNIRVNVLVAGSTATPGSDRLAAQTDPYVSVEEFRAGRIATIPLGRFADPVEIAHAAVFLASDLSSFCTGSTVTADGGFNQV

SEQ ID NO: 3444 - protein, 227 aa, Mycobacterium paratuberculosis
VAALVFALAGLAFLDSLNVLNVGVVSAVIFDSRLSRRSPVPGALSFVAGVFAVTTTFGLCTVLGISFITTALDFHVTPAIRFRGELVLGIALICLAYFPLTAQSSAPGWAMAAMRKRPWLLGFLGLAVGSGQAPTAVPYLTGLAMLAALDPRPPLWPLVIIAYCAIAVSPPLAILALSLRRTPRAMRIQRGLVRALTRYGPMSVRLLFLVFGVGLIADALVNHSALW

SEQ ID NO: 3445 - protein, 255 aa, Mycobacterium paratuberculosis
VTDRQERAMSFGSIAEDYDGLRPQAPPEAVDWLMPPDCGVAVDVGAGTGLFTRALAGRAAHVIAVEPDARMRAVLAHRSPAVRVLEGRGEAIPLPDRCADAVFVSSAWHWMDPQRAVPEIGRVLRDGGRFGLIWTSRDRDVDWVRDLDLLPGDDTSEADAPDRFRRRHENVVLPDPQIFHHVARETFTFVRTMTLDDAVAMLATYSRIITASPADRARRLAKARAVLTERFPGAHAIDIPMQSRCWRADRIARAG

SEQ ID NO: 3446 - protein, 411 aa, Mycobacterium paratuberculosis
VGQTAAMAEADRTWMVDTLLALLQTPSPSGRTDAVMQVIGDILDDFGVPFTLTRRGALTAELPGESATTDRALVVHSDTIGCMVRGLKDNGRLELVPVGTFSARFAAGARVRIFIDDPEEFITGTILPLKSSGHAFGDEIDTQPTGWEHVEVRIDRKVSCRDDLVRLGLQIGDFVALITSPELTADGFVVSRHLDGKAGVAIALALAKNFAENKVVLPHRTTIMVTITEEVGHGASHGLPPDVAELISVDNAVCAPGQHSLEDGVTIPMADMHGPFDYHLTRKLCRLAQDRGIPFARDIFRYYRSDAAAAIEAGANTRAALVGFGLDGSHGWERTHIDSLEAAYNLLHAWLQTPLTFAKWDAKPTGSLRDFPSSKQPAPSERWVPLSRGDYESPGDASPGTHWPPSEGPQS

SEQ ID NO: 3447 - protein, 226 aa, Mycobacterium paratuberculosis
VVRINGLDTEWHDDDLAAVAGSAADGVLVPKVETAQQVQALDRALDTLGAAASLQLWVMMETPRAFLRAEEVASASDRLAGLVVGTNDLVNELHGRHVAGRGPVVPALGLALLGARAAGKVVLDGVFNDITDDAGFRAEAAQGREMGFDGKTLIHPSQIAPANELFGPSQQELADARKVVSAYQQAQAAGTSVITVDGRMIESLHVRDAQRILALADLISERDAAS

SEQ ID NO: 3448 - protein, 307 aa, Mycobacterium paratuberculosis
MSSTGSARTEGDSWDLASSVGATATMVAASRALASRGPDPLLDDRFAEPLVRAVGHPFFVRMLDGQIPLDTDDMPMTLQQRREQITVRTRFFDDFFRSATAAGIRQAVILAAGLDARAYRLSWPAGTVVFEVDQPEVISFKTDTLARLGAQPTAERRTVAVDLRDDWPTALRDNGFDSSARTAWIAEGLLPYLPPHAQDRLLDNITALSAPGSRLATENITDMRVFTDERARAMRSTWRQHGLDIDVAELVWLGERRPAGDHLEATGWSVTRLPTERVYTDYGFELPDNEILREFRQAISYLSAELG

SEQ ID NO: 3449 - protein, 854 aa, Mycobacterium paratuberculosis
LVWGPRRGQPAGIQYPIVGPLTRAGATRQRGDGSIAGVATQKPQTISYPAPEARPRRHHTDPLDPHVIVLFGATGDLAKRKLIPGLAYLDQSELAPDIQIVATSLEDLSNDEFRELAKNAIDSFGTHKLTPDQWRNFADIITYIPQSAGSDALAAAVAEAEAKLGPNVRRLHYLSVPPKAARAVITMLRDAKLVERSRVVMEKPFGTDLASAVALNDFVHQTFEESQIFRIDHFLGKEAAQNILAFRFANGLFEPIWNRNFIDHIQIDIPEALGLDQRASFYEETGAYKDMVVTHLFQVMAFVVMEPPTALEPFAISEEKNKVFRSMLPVKPSNVVRGQYIGYREEDGVAKDSDTETFIALKVGIDNWRWAGVPVYLRTGKRMAEGIRHHLDRVQGGTADHVPARVGGGHAGARPPDVRSCGQFAGVAVVLRQAARPRHETGQAVHAILHPGDRNRGGRAGGLRTAHPGRDARRPHPVHHRRRHRITVGAFRRAAQRPATGQAVPAGDVGPQRNSPVDRAQRVAAAVRARVARSPDPTPEWAAEKCCGSAQFGAEITDGLAEFPEDFVVGQLEAVVGVHPLGGQAGDAPAGGLQVVAGRAALAEPDQFGHVDVQSVLAPGAAHRPGAFVGEHPHVGDVLGGQPAARRAERGDVVQQPVLGVRRQVGQQPLGDPGGTGAAVKAVVAQRCWPVIAQIDGDGAALGGRLRAQPGQGVGLEGDDLGLVDLEHHGARRPGQPVGPRVEPGGQDDGLANAGSGRGAEEIVEKPRPHRDLLAPLLQRHRHVVGVERDLAVQHPDEEGMPDRAHQRFGEPVVEQRVRTARGQRPGGRDHGRGRPHAGGQIPAVALGTCRTGR

SEQ ID NO: 3450 - protein, 323 aa, Mycobacterium paratuberculosis
MATDQPATPPVTWAEAQPLLRPVLRPQSYANRLVNDGAQPWVRPVFPLINEMVVVDLPAVRAMVTPAETGAWGITGDQAFTVARENLTARQQILTPGEKYLLRDTDGDSYIDSMVLATGWLGSLAVPGGPRPLVFFPGDGSLVLGTDAPDGVAELFEVAEQLYLAAEQPVSPQGYTIAGAIIVPFDQAGPHPGRGLALSARSLLAATEYRHQTEYLREHYERERFPQQVAEARLIDTPWGRRTTTVWAQGSAWELPHTDYVTFAAGDPSNAADTFTVPFPTVVDAVGLLPVAGISPVRYRADEWPAADVLAAFRAHAVDLPDR

SEQ ID NO: 3451 - protein, 525 aa, Mycobacterium paratuberculosis
LPQDRGGDAKSLSRTTIRNGGEMRGVRFSERSVRGHAVLVAGAGPTGLMLAGELGLAGVDVALVERRADQQLIGSRAGGLHARTLEILDQRGIVDRFLAEGQVAQVAGFAQIRLDISDFPTRHPYGMALWQNHIERILADWVGELGVPIYRGHRIATCTQDDTGVDVVASDGRTLRGQYLVGCDGGRSVVRKAAGIDFPGWEATTSYLLAEAEMDWRTGQSPQWGIHHDALGVHALSETEPAGGVRVLVTERQLQSAAEPNLDDLRQALIAVYRTDYGIHSPRWISRFTDAARQAARYRDRRVLLAGDAAHIHHPVGGQGLNTGVQDAVNLGWKLALVVGGASPPALLDTYHAERHPVGERVLRNAIAQMALLRPDERTRALRDLVTELLGMDEPRQRFAAMMSGLDVRYDLGPGHPLLGRRMPDLDLVTADGASRVFALLRNARPVLLNFAGAGRRSVAGWADRVRVVDAKCGADWELPVLGRVSAPPAVLIRPDGHVAWAGDPNDPGLHDALTTWCGPPAAGG

SEQ ID NO: 3452 - protein, 1314 aa, Mycobacterium paratuberculosis
VAEPSFPVSGAQLRGRLDGLTIRDAARLGRRLKKLRGAAPDKLRQLADQIAAAEAVVAARHAAVPAVSYPDLPVSERRREIADAIRAHQVVVIAGETGSGKTTQLPKICLEAGRGIRGTIGHTQPRRLAARTVAQRIADELGSPLGGTVGYTVRFADQVSDRTLIKLMTDGILLAEIQRDRRLLRYDTLILDEAHERSLNIDFLLGYLRELLPRRPDLKLIITSATIEPRRFSEHFANAPVIEVSGRTYPVEIRYRPLEIALPSATADDPDDPDHEIVRTETRDEVEAIVDAIAELEAEPPGDVLVFLSGEREIRDTAEALTGLKHTEVLPLYARLPTAEQQKVFAPHTGRRVVLATNVAETSLTVPGIRYVVDPGNARISRYSRRLKVQRLPIEPISQASAAQRAGRCGRVAPGVCIRLYSEADFAARPRYTEPEILRTNLAAVLLQMAALQLGDIENFPFLDPPDRRSVRDGVQLLTELGAFDRQGAITERGRRLARLPVDPRLGRMILAAQTEGCVREMLVLAAALSIPDPRERPSDREEAARQKHARFADEHSDFMSYLNLWRYLREQRKELSGNQFRRLCRAEFLHYLRIREWQDLVGQLRGIAGELGITEESGEPADPARVHAALLAGLLSHVGMRREDSREFAGARNSRFVLAPGSVLSKRPPRWVVVAELIETTRLYGRTAARIQPEAVERVAGDLVQRSHSEPHWDPDRGEVMAYERVTLYGLPLVSRRRVGYARIDPVLARELFIRHALVEGDWHTRHRFFADNARLRGELEELEERARRRDLVVGDDDVYALYDARIPTDVVSARHFDAWWKKQRHQTPDLLTFTRADLLRTEETGDADRPDSWRAGDVTLPLTYRFQPGAADDGVTVHVPIDVLARLGGDEFAWQVPALREELVTALIRSLPKDLRRNFVPAPDTARAVLGAIDPAAEPLLPALQRELRRRSGVSVPIDAFDLDKLPAHLRMTFAVESTDGTELARGKDLRALQERLTTPARQAVADTVGARLQRTGLRGWPDDLDELPRVVQRSLDGRTVRGYPAFVDTGAAVDLRVFATSAEQVRMMGAGLRRLVRLSIPSPAKAIARQLGPRTRLALGGNPDGSLPALLEDCADAATDALVPQPVWTRDEFTALRQRVAKTLGPTTIELVGRVEQVLAAAQQVQLALPATPPPAQADAVADIRAQLDRLLPAGFVTATGGARLGDLTRYLSAIRRRLDGLARAGQADRDRMRRVHAAQHAYDELVDELPEAAKTAADVRDIAWQIEELRVSLWAQQLGTPRPVSEQRIHRAIDAARQRYRVALPPTLNL

SEQ ID NO: 3453 - protein, 365 aa, Mycobacterium paratuberculosis
VSKWQCRTSPYRGVTRRFDGMGRSLPHPSGDKDARPYRLRLRADAGSVFYRTQQARMLRIFLGATIFLYAYGVVFTLFPIRPGLTLSNPAGGIVAVGLGLGALAWLAARPDKPAPATVTAIVATPIVMAFHRVIIAEFVCLIAPMFLAMYLRAFYSPRRGAALVAVLAGLSVAALAVAPTPKLSIDYAIFVIAIIGAAESFGLLTRALVTAACTDPLTGLLNRAGWEIATADLLSRTRSATATVTVVALDIDNFKTLNDTEGHVAGDQYLVRCAAFWRQVAPAGAVLARFGGDEFAVCIADHHPTSAKADQFVASVRRHTPDISVGTASGAGASADIASLYAAADAELYSAKRRRRDPGLRPARG

SEQ ID NO: 3454 - protein, 340 aa, Mycobacterium paratuberculosis
MVGWLDRLQRRNRAVGVIVGVVYKYNDDQGGYLAALITYYALVSLFPLLLLLTTGLGVILAGRPDLQAQVLHSTLSEFPVIGSQLHHPEGLSGGAAGVIVGLAGALYGGLGVGQAVQNAMDSAWAVPKHKRPNPIRSRLRSLLLLLVLGSAAIAATLLAAAGQATAGLGFLGKAGLALASVAINALICLVLFRLTTARALSYRQVWPGAVAAALVWQLLQWFGAGYVAHVVKRASATNSVFALVLGALAFLFLASTVLVVCAEVNVVLVERLYPRALLGAFSDDADLTSADRRTYTKKVKAERVKAFERVSVRFDDAKRSPAKTVGRLNIFGDARRPRTP

SEQ ID NO: 3455 - protein, 257 aa, Mycobacterium paratuberculosis
MSLVTYELHDHVATITLNRPEARNAINGALRQDLNAAWDRFRDDLDAWVGILTANGDVFCAGGDLKDGEGSVGTFGGTFWEKPTINSFESGMELFKPTIAAVHGPCIGYGLTGVLFCDFVIASTEATFCYPEVAIGVPTIVGAIRLPRRVGWGNAMELLLTGKPMSAERAKEIGLVWKLVEPDRLQAEARAWARTLTEAAPLAQRATKEVAWRTADMGWIESVRFGETMRKVAGATEDVAEGIRAWTEKRKPQWRGR

SEQ ID NO: 3456 - protein, 220 aa, Mycobacterium paratuberculosis
MNARRLARLVGISVVTTWALLSAPVGNPVAAADPCSDVSVVFARGTHQEPGLGNIGQAFVDSLTSQLGGRSVDVYAVNYPANDDYHNSANAGADDASAHVQDTVAACPNSRIVLGGYSQGSTVIDLATNAMPPSVADHVAAVALFGEPSSGFSTMLWGGQPLPTINPLYGGKTISLCAPDDPICFGGGNIMAHVSYIDAGMTAQAATFAANHLNQGSPRT

SEQ ID NO: 3457 - protein, 219 aa, Mycobacterium paratuberculosis
VAAALPLVKLLRDTVAVRMSVAVLLGVAVAVVVGNTVGWRFALVGWVVTAGVYVVWTQLILFGMDAEQTRVWATREDPTRWVADAVILSASVASLAGVGYVVAAGSHAGARAVAAAVLGILAVAASWFAVHTLFTVHYARLYYSGQPGGINFHDPEPPRFRDFAYVAFTVGMTYQVSDTEIGLTAIRSTVLRHALLSYLLGAVILAVTINLIAGLGAKL

SEQ ID NO: 3458 - protein, 267 aa, Mycobacterium paratuberculosis
MRVEALLRYPVKSMLGETLDRLAVDEHGAQGDRRLALVDDETGHVASAKNPRLWRDLLTCTARADASGVRISLPDGMDVAADDPGVDELISRLTRRRVRLIARRPDGATLVRPDPEQLLERGLDAEVDGRILRISAATPGHSFTDEAPLHAITTATLQHIGVEALRYRPNLVIATPPGYPPYAENDWAGSEITVGEARLRVLTATSRCVVPTLEHGRLPRAPHALRIPAAENRLDTGGHGPQPCAGAYLAVLAEGVITVGDPVTIES

SEQ ID NO: 3459 - protein, 275 aa, Mycobacterium paratuberculosis
VPGVLPFAGPSTVRRNPVARMPTLRLGRAARVAVLAACIGLAGAPLVAGCGAAPPATTAATASVTTSATKAVAAQDNPSSTTATPGRYGNPAAAARYWAAQSLEDNCGLVSVADVVGEITGTAPSERQMLDLAESTPSGTNPGPIYAPRNDPSHSGPNAGIELADLVVLLDHFGIKSEMVSATEPDRTGLPALEQYLAKNRKIIAFVNSSVILNADDQRTKADHFLVVTGIDTDTQIVHLNDPGIDHADEQVGVATFMTAWETSDQSIVVTAAPI

SEQ ID NO: 3460 - protein, 357 aa, Mycobacterium paratuberculosis
VPPPVVTANRTLLAQLVATNILGQNTPAIATTEAEYAEMWARDAAAMYGYAGAAAAATRLTPFTQPDPTTNSGADQSQAVSKAAATAAGSTRNTVTQQPFSAVPNMLNNLALSPNALGDPSVTDLLGLESDLIAIFLDAPASVVGMGVDAPSATIALPFDIAGALTGFHTDDIVSGWAGVQPWPGTGAVPPSPFPVITNPAGGFGTLASAGLGQANTVGTLSVPPTWTAAAPAIRPAALALPATTVTAAAETAATAAPAGTGSLFGEMAAAGLAGRAMAGTTGLGRERARAEAAKAPREPGQEPGKAPKQEPAAPAVSAGGPITSIAAELRELASLRDAGILTQQEFEEQKKRLLPS

SEQ ID NO: 3461 - protein, 83 aa, Mycobacterium paratuberculosis
MDFAVLPPEVNSARMYAGPGSGPMLAAAMAWDELAATLHSTADSYQAEITALTSGPWVGPSAAAMIAAITPYLTWMRTTGAQA

SEQ ID NO: 3462 - protein, 390 aa, Mycobacterium paratuberculosis
MKIVLAAYGSRGDVEPCAAVARELQGRGHDVRIALSPDQLGLAESAGLRAVAYGPDSREQIDTATDFVHTVQNPISALPQLTERVTAVWAAKSETLAALAAGADLLVAGMNEQRLAANVAQRVGAPLAALHFFPADTLELGWMQSHVTAAAEAAQRLALGLPVDAGQSDRAALEIQAYDELCVPGLAEQWATAGHRRPFVGSLTLGLASGVDDEVLSWIADGTAPVYFGFGSTPVSSPAETVAVISAACARVGERALICSGPNDFTGIPPEDHVKIVPAVNHAAVFPACRAVVHHGGSGTTAAGLRAGVPMLILWLWLDQPVWAEAVSALEVGLARAFSASTLDSLTADLRCVLDGRYHDRAREVATRMTKPGESVAAAADLLEEAARGG

SEQ ID NO: 3463 - protein, 351 aa, Mycobacterium paratuberculosis
VLVQDPPNRSFDPSLLRDAVIRRIYRRTSAEGTIRVPAVPAMIDEYLQLCGNVCATLGVWYAPEQFAQLRSALEVELAKAFKAFPRSDVLISYHAPFGTGVNFHVQADWRTIEADYEQWVAVRPPPLFGTEPDARVLTLAAEADDPATYRVLDVGAGTGRNALALARRGHPVDAVEMTAKFAEAMRADAERESLGVNVIQSDVFTAMENTRDRYQLMVLSEVVPDFRTAHELRGMFELAAECLAPGGRLVFNTFLAHDGYVPDAAAVQFSQQCNSMVFTRDEVMGAAGGLPLALVADDSAYEYEKTHSPAESWPPTGWFEGWAGGLDVFDVERDDSPIELRWIVFAKTRAG

SEQ ID NO: 3464 - protein, 522 aa, Mycobacterium paratuberculosis
LSPRRFFGPGRGISTAVTSLWMSERTERPWAASQLDQGPASADVIVVGAGITGLMTAALLARAGKDVLVLEARTVGACATGNTTAKISLLQGSQLSKVLPRHGREVTRAYVDGNREGQEWVLGHCEAHGVAVQREDAYTYAQSVRGVPSARAEFEACQAVGLPVVWQDDADVPFAYHGGVRLADQAQFDPMPFLDSLAVELLGRGGRLVEHTRVRRVSWRGKGVRVHVNQGSDAAGHDVELHADQLVLATGIPILDRGGYFARVKPSRSYCLAFKVPGNITRPMMISTDSPTRSVRYAPVPDGERLIVGGAGHTVGREKSPSDALDELSAWTRKHFPGAVQTHFWSAQDYTPIDHLPYVGPILPNSETIFVATGFNKWGMTNGAAAALALSSRILGGRMDWARAFASWSPHELSGLATAVQANLEVGFNLTKGWVTPAVRIGRRSPVDGDGGVVSGPPWHLQARCRVDGTEHRVSPVCPHLGGIVNWNDADKAWECPLHGSRFAPDGTLLEGPATRDLTASR

SEQ ID NO: 3465 - protein, 264 aa, Mycobacterium paratuberculosis
MADEDLDTLYWVPPQQFTAERARLAAAASARGDDAAAQRISAARKPTAAAWIVNRLALRHKDARQRLADLGERLRAAHAALDGARIRELSAEQHRLIDELTGAALRAADVRTPSAAVREDLTGTLQAAVADPQVRARLGRLTRPERWSGFGDLGDLADVGDAPSPEPERANRKPARAAAQNRHTQRRRAAVAAAEDAKARADAELSERRARRDAARQRRDAAARELRDAERELRGAEGDCDTAEKASHAAAETLQQASARLRQG

SEQ ID NO: 3466 - protein, 461 aa, Mycobacterium paratuberculosis
MPVGLKTVRPGIPDLQHRAHHRRRVMRKRDSNSVMASKSSDRLVGRILGVRRPRRFLAAVFVVVAVAGAIQLAAAAPCPHGGCPGGAAPKPTGPARVRITPGPGARNVDPVAPVLVKAETGTLAGVEMVNEGGTAVQGVMTPDNLVWKPTVALGYGRNYTLTITSRGTDGVETKQVSTFSTLRPSNQTKVSFTTTSESPLRDGASYGVGTVIVAHFDEQIADRAAAERHLTVTTNPKVTGSWFWVDGQNVHWRPEHYYAPGTTVTAEAKIYGIALGDGLFGQDDSRVSFRIGDAHVSIADDATHQVSVFDNGVLVRTMPTSMGMGGTENIGGRSISLWTPPGVYTVLDKGNPVVMDSSTFGLPKNSRLGYRETINYATKISSDGIYLHELDATVWAQGHQDTSHGCLNLNADNAKWFYDFSVPGDVVEVRNSGGPPLTLAQNGDWTLSWDQWRRGSALKPT

SEQ ID NO: 3467 - protein, 146 aa, Mycobacterium paratuberculosis
VSSTADYADRLRMADLRVTRPRVAVLEVVDANPHADTETIFSAVRMALPDVSRQAVYDVLNALTAVGLVRRIQPLGMVARYESRVGDNHHHVVCRSCGTIADVDCAVGEAPCLTPSDDDNVLDGFVLDEAEVIYWGLCAECSTAGS

SEQ ID NO: 3468 - protein, 748 aa, Mycobacterium paratuberculosis
VSSDTSASRPPQPDTRTASKSESENPAIPSPHPKSNAPLTNRDWWPNQIDVSRLHPHVAEANPLGEDFDYAEEFAKLDVEALKADVISVMTTSQDWWPADYGHYGGLFIRMSWHAAGTYRIHDGRGGGGQGMQRFAPLNSWPDNVSLDKARRLLWPVKKKYGNKISWADLIIFAGNCALESMGFKTFGFAFGREDVWEPEEILWGEEDEWLGTDKRYPGTGERELAQPYGATTMGLIYVNPEGPEGKPDPIAAAIDIRETFGRMAMNDEETAALIVGGHSFGKTHGAGDADLVGPEPEAAPIEQQGLGWKSSHGTGVGKDAITSGLEVVWTPTPTKWDNTFLETLYGYEWELTKSPAGAWQFTAKDGAGAGTIPDPFGGPGRAPTMLVTDISLRESPIYRDITRRWLDHPEELADAFAKAWYKLLHRDMGLVSRFLGPWVPEPQLWQDPVPPVDHPLVDDNDVAALKDKVLASGLSVPQLVKTAWSAAGSYRNTDKRGGANGGRLRLQPQRNWEANEPSELDKVLPVLEKIQQDFNASASGGKKISLADLIVLAGSAAVEKAAKDAGYEISVHFAPGRTDASQESTDVDSFAVLEPRADGFRNFARPGEKAPLEQLLLERAYLLGVTGPEMTVLVGGLRALGANHGGSKHGVFTDRPGALTNDFFVNLLDMGTEWKASETAENVYEGHDRATGALKWTATANDLVFGSNSVLRALAEVYAQDDNQGKFVEDFVAAWVKVMNNDRFDLK

SEQ ID NO: 3469 - protein, 271 aa, Mycobacterium paratuberculosis
VRDSAGPGARGDRRPPSRREVLGYAAGCALAPVLLSLGAVAGAGGPTARAAGLKLIDFAERRIAPEEIKAAGYDGVVNYVSLSRPGADFEAKPLTRDYADALRAAGLHIVSNFQYGKPGWPDPSDFTRGYDGGVADAHTATQLHAAAGGPDSAPIFFSVDDDIDADTWNNVAVQWFRGINSVLGVGRTGIYGHARACGWAIRDGVVGPSSTPGHRWAWQTRSWSHGEREPAAVLYQAVVNSPGSPGPLLGGINVDVDDVLAADYGQWDFAR

SEQ ID NO: 3470 - protein, 416 aa, Mycobacterium paratuberculosis
MRIALLSYRSKTHCGGQGVYVRHLSHGLVELGHDVEVFSGQPYPDLLDPRVRLTEVPSLDLYREPDPFRVPRPSEIRDSIDLLELLTTWTAGFPEPRTFTLRAARLLAGRTADFDVVHDNQSLGTGLLSIAGAGLPVVATVHHPITRDRVLDLAAARWWRKPLVRRWYGFLAMQQEVARHIPDLLTVSSSSAADIISDFGVSPEQLHVVPLGVNTELFKPGSGPRQPGRIIAIASADTPLKGVRTLLHAVARLRTVRDLELRLVAKVEPNGPTHKLIAELGISDIVHITSGLSDAELAALFASAEVACIPSLYEGFSLPAVEAMASGTPIVASRVGALPEVLGTDGACAELVPPADVDALTRALGELLDSPEKRRSLGRAGRTRAVDVFSWEAVAAQTVRVYERAIARNAAGRAPC

SEQ ID NO: 3471 - protein, 252 aa, Mycobacterium paratuberculosis
MLTVDFDRLGIGPSSKVIDVGCGAGRHAFEAYRRGADVVAFDQNEAELRSVDTVLRAMADSGEAPAGASATVVVGDALKLPYADQTFDCVIASEILEHIPHDDAAIAELIRVLKVGGTLAVSVPRWLPERVCWLLSDEYHSNEGGHVRIYRASDLRAKILSGGMTLTHAHHAHALHSPFWWLKCAVGVHNTDHRAVAAYHKLLVWDLMRRPKITQLAESLLNPLVGKSVAMYFVKQQDAKSQATAGYSIASV

SEQ ID NO: 3472 - protein, 356 aa, Mycobacterium paratuberculosis
LHRSSLPAVPGVLTPDQCRQTALSIAAAQEPSGAIPWFDGGHTDPWDHVECAMALTTAGLLEPARAAFDWSRRTQRPDGSWPIQFRAGVIEDANSDSNFCAYIAAGVWHHVLVTGDDSFAAEMWPVVRKAIDFVIDMQVGYGEIAWARSEAGLLPEALLTGCSSVFHSIRCALALAGLVDDPQPEWELALGRLGHAITAHPEAFTEKDRYSMDWYYPILGSAVRGPAAVARIKQRWDDFVVDGLGIRCVGDRPWVTGAETCELVMALEALGRRSEAHRQFAAMQHLREGDGSYWTGLVFADGKRWPEERTTWTGAAMILAADALSDATAGAGIFRGDALPVGLQTDFDCECVASGR

SEQ ID NO: 3473 - protein, 219 aa, Mycobacterium paratuberculosis
MNHVDERLFALAEQVQGFMPAEEGRALYDTALRYLDGGTGVEIGTYCGKSTLFLGAAAQQTGSVLYTVDHHHGSEEHQAGWEYHDASLVDEVTGLFDTLPTFRRTLDAAGLDDHVVAVVGKSPIVARGWRSPLQLLFIDGGHSETAANQDFDGWAKWVTPGGALAIHDVFPDPRDGGRPPYHIYCRAIDSGQFREVSATGSLRVLERIGGRAGEPVQQD

SEQ ID NO: 3474 - protein, 219 aa, Mycobacterium paratuberculosis
VVTAAVAMTAVAMAAALLLPPGTPGAAAPASAANCTPVQVVFARGRNESSGPGVLGNAFISALRSRVNRTVGVYAVQYPADTEVAQGANDMSRHIQDMVNSCPDTRPVLGGYSLGAAVTDVVLAAPIGAFGFDSPLPPGVDQHIAAVALFGNGSQWVGPITNFNPTYNDRTIELCHGADPICNPADPNTWKQNWPQHLAGAYIDAGMADQAADFVAGKL

SEQ ID NO: 3475 - protein, 275 aa, Mycobacterium paratuberculosis
LLMPEIDRRRMIVTTGIGVLAAALPNPRAGASPAPPPAAPSGQSGTYLFQDEFDGPAGSAPDASKWAVAKARETIKDPTYWERPENIGQYRDDRRNVFLDGKSNLVLRAAKNGPTYYSGKVQSLWRGGVGHTWEARIKLDCLTAGAWPAYWLGNDDQGEIDVMEWYGNGNWPSATTVHAKANGGEWKTHNIAVDSAWHTWRCQWDEAGIRFWKDYVDGAQPYFDVPASSLPDWPFNGPGYTVFPVFNLAVAGSGGGDPGPGSYPADMLIDWIRVW

SEQ ID NO: 3476 - protein, 281 aa, Mycobacterium paratuberculosis
MSGPGHTITHVSDTARWTALHRATESARPDAVFRDPLAERLAGDHGRAIVDHVPRTTRNGWWLVARTKIIDDAIAEAIAQGCDRVLNLAAGLDTRPYRLNLPPDLAWVEADLPALLAEKTQVLADEVPRCRLTRTAVDLADAAARDAFLNEALDGATKALVLTEGLLMYLDDSDVSALSAALQRPEVRWWMLDFAGPGLKKMMNKKMAGMLANAPFKFAPDNGLAYFERLGWRTVQVEALYSAARRLRRLPLVMRPLGWLPQPDPRRPGRRAWSAAALLTH

SEQ ID NO: 3477 - protein, 115 aa, Mycobacterium paratuberculosis
MHRVTFDGQLAPVRAPADPDPFALTLDDGTRCLLRNGGAWGGRADGYVGVYGCGGAGSDLAVLWQPSQGRGSCIDRSAPAWTVKVGRLGAPDAVLPPPATRTVTAAWLAGGRAGQ

SEQ ID NO: 3478 - protein, 84 aa, Mycobacterium paratuberculosis
MKIVPASIEEQINRVDRQRSLYIGLGAGAVAAWSVFRLFWLVYLGMTFGWLFGAMVFQVVLWGVIGVVAGIAAIGFLSRYTKGS

SEQ ID NO: 3479 - protein, 512 aa, Mycobacterium paratuberculosis
MLSKCSALSAVGAGHDGSPEDSPEERDQMTVQAVLDDIRKRPGTGDVIAVIDPATEEKITEFTDCGAEAVDEAAARAKASFESGVWSQLPGRERAKILWRIGDLIDEHAEEFAQLDSLNTGMPLLQAQLQMSTCSEFFRYYAGWCSKINGTAYDVKTDGIATDTFVNMHAYTLKEPYSVVGLIFPWNGPIFNANAKLAPALAAGCSLLVKPAEETPLSALLLDRLVHEAGVPEGVVNLLTGYGHTAGAAITAHPDVEKVAFTGSTEVGKEIVRASAGNLKKVTLELGGKSPVLIFDDADLDKAILMASLGIFVHSGQGCVCGSRIFVQRGVYDRVVEGIAMMANTFKLGAPSEEGCVSGPLISQKQLNRVMGFIDEGKNDGVEVVTGGYRLDRKGYFVHPTVLTNVDPGMRLYQQEIFGPVVAILPFDDEDEAVAMANDTTYGLAATAWTENLGRAHRIVKRLQAGSVQVNCQLVFDHDVPFGGYKQSGWGHEFGKEGLEIYLKTKSVWAQL

SEQ ID NO: 3480 - protein, 300 aa, Mycobacterium paratuberculosis
MRGSKILITGPTGQIATPVARALAADNEVWGIARFTDAAARESLEQAGIRCQTVNLAAGDFTGLPSDFDFVLNLAVAKSGSWDKDLAANAESVGVLMAHCRNAKAFLHCSSAAVYDPPGDEPRSERSALGDNHKPLFPTYSISKIAGEVVARSVARIVGLPTTIARLNVPYGDNGGWPFYHMEMMLSGIPIPVPPGEPARYNPIHEDDIIATIPKLLDVASVPATTVNWCGDQTVSLQEWCGYLGSLVGREPVFEPSERALRGNPTTVDRMHELIGGTTVDWRDGMRRMAAKFHPELVGV

SEQ ID NO: 3481 - protein, 394 aa, Mycobacterium paratuberculosis
MTSIADTDDRVVALARGMRDLVQDQAAESERMRTLTPAIVDAMWASGLMSAFNPIEAGGVEPSFTEMIETWIEMAWQDGSFGWVGIANLPSSFAAAAYLPDDGFAEVFTAHDNHVTMGGQFFPNGQGAAVDGGYLVSGAWNFGSGIGHSQYVAAGFLPMDDGEMRWICEGFPEMRVAVIPREQISFDDGWYVQGLKGTGSYDYSARDVFVPAARTFELFTRAPFRGASPATRMGLMPVTAAGHASWALGVAKSMLDDVQELAATKFRMSDMASLASRPTFQKGLAHHRAAWRAARLLVLDAFTTAEAAVAAGQELTPALRADMRVAAVYATDTARGCAEWAHLVAGTSSIREGSRLERAFRDIYTGTQHAFISEKVAIDVAQIWLGIIEDQPGL

SEQ ID NO: 3482 - protein, 126 aa, Mycobacterium paratuberculosis
VRWIVDGMNVIGSRPDGWWKDRDGAMVALVQRLDRWASGRDDDVTVVFERPPAAVVTSSVIGIAHAPRAAANSADDEIVRLVTADPDPPGICVVTSDRTLAERVRNLGARVQGSDSFRDLIEPRHR

SEQ ID NO: 3483 - protein, 320 aa, Mycobacterium paratuberculosis
MSTDAPVPAANRVCRLAHIDIPILGAPMTYIAGAQLAAAVSNAGALGIIETTSDQGRADLRRVRELTAGAVGANIALLFNRDPAMLDLLVANDIRFVTTSAGDPALFTDRLHDAGITVFHVVGTLAAAKKAVDAGVDGLVVEGVEGGGFKNRFGASTMVLLPLVAAHVDVPIVAAGGICDARSMAAAFVLGAEAVQMGTRLLASADSPVHVNLKQAVVAADETATVLLPLDGKRMMRVIRTPAAERLEAAGAAGEGAAALQRVQRLYFEGDLDASVANTGQVAGRIRDLPPAADIIKQMWKGCREVLAATSARLDWADDA

SEQ ID NO: 3484 - protein, 164 aa, Mycobacterium paratuberculosis
MAQITLRGNPINTVGELPSVGSKAPAFSLTGGDLSPVTSDQFSGKPLVLNIIPSIDTPVCATSVRTFNERAAGAGATVLNVSKDLPFAQARFCGAEGIENVKTASAFRDSFGDDYGVTIADGPMAGLLARAIVVVGADGNVAYTELVPEIAQEPNYDAALAAAG

SEQ ID NO: 3485 - protein, 320 aa, Mycobacterium paratuberculosis
MPELVPRQVVIVGFPGVQALDVVGPHDVFSGASLLTGGGYQVVLASVDGQPVTTPAGLGFVATALPDPGRPIDTVVLPGGAGVDAARGDAELIAWIKAVAGRARRMVTVCTGAFLAAEAGLLDGHRVTTHWAFADRLASEFPAVDVDADPIFVRSSDTLWTAAGVTAGIDLALALVEDDHGTEVAQTVARWLVLYLRRPGGQTQFAAPVWMPRARRDSIREVQEIIEAEPGRPHTVDELARRAAMSPRHFTRVFTAEIGEAPGQYVERIRTEAARRQLQETDDTVVTIAARCGFGTAETMRRNFIRRVGISPDQYRNACA

SEQ ID NO: 3486 - protein, 247 aa, Mycobacterium paratuberculosis
MTQIAFLAYPGFTALDMIGPYEVLRNLPGAEVRFVWHETGPITADSGVLVIGATHSLAETPSPDVILVPGGPGTAVHARDDALLDWLRAAHRTATWTTSVCTGSLILAAAGLLDGRRATSHWLTIPALKAFGVTAVPDERIVHEDGIVTSAGVSAGLDLALWLAAQIGGDGRAKAIQLALEYDPQPPFDSGHLSKASASTKAAATALLSRDSLSPTYLKATALLAWDQALDRVRSRRRRRQPDLSPA

SEQ ID NO: 3487 - protein, 158 aa, Mycobacterium paratuberculosis
MGRFTRAEIENAVDNYTRVVEGCSASGDWRPFADLFTEDVVYTEHHYGVFRGREAVRDWIVAVMAPFPHMRFPSGWTAYDEDNDAVVVMIKNLLDHPTDPQGEPFWFPNWTRLVYAGDGLFSSEEDIYNPNRDAPGVIAAWLQAGGRLASSEILQPNP

SEQ ID NO: 3488 - protein, 256 aa, Mycobacterium paratuberculosis
MSVLDLFDLRGRRALVTGASSGIGKQVAQAYLQAGARVAIAARDFEALQRTADELTAGGTGGVVAIRCDVTQPDEVSGMVDRMIAELGGIDIAVCNAGIISVSPMLEMPAAEFQRIQDTNVTGVFLTAQAAARAMMRQGRGGAIITTASMSGHIINVPQQVGHYCASKAAVIQLTKAMAVEFAPHDIRVNSVSPGYIRTELVEPLHEYHRQWEPKIPLGRMGRPDELAGIYLYLASAASSYMTGSDIVIDGGYSCP

SEQ ID NO: 3489 - protein, 241 aa, Mycobacterium paratuberculosis
LIGRVDGTAPARRRWHPGQVGLLIRVAELLILVLPLVGATVAVVRALGAQRRRTDEPAREVDGARPPEARAGADNQAARWRSIRRVLDEHSRTDERWLDYELDVAKLLDFPLMTDMRDPLTIAFHKAKLRADFLRPAKAEDLLDDPDAAAHYLAAVEDYVTAFNAAEAEATRRRRTDFSRTDQQRIARAQSLFRVAADPAAAAHERQRAYDVARRELEGLLVLPPATRANIERAISGEIES

SEQ ID NO: 3490 - protein, 612 aa, Mycobacterium paratuberculosis
MDDALRRDDGVPGLLRIEDCLDADGGVALPPGVNLISLIDRNIANVGDTVAYRYLDYSGSDDGTAHEVTWSQFGVRLEAIGARIQQVASRGERVAVLAPQGIDYVAGFYAAVKAGTIAVPLFAPELPGHTERLDTALRDSQPSVLLTTTVARDAVEQFLAGHPHLHRPRVIAIDEIPDSAAESFAPTELGMDDVSHLQYTSGSTRPPVGVEITHRAVGTNLVQMILSIDLLDRNTHGVSWLPLYHDMGLSMIGFPAVYGGHSTLMSPAAFVRRPQRWIKALSDGSRHGNVVTAAPNFAYEWAAQRGLPGGGEDINLRNVVMIIGSEPVSMDAIRTFNKAFAPYGLPRTAFKPSYGIAEATLFVATIAPQAEATAVYFDRRQLGAGHAVRVPANAPDAVAAVSCGQVARSEWAVIVADGAELPDGQVGEIWLQGNNIGRGYWGMPEETRRVFGATLRSRLPDGSHAAGAAPDGSWLRTGDLGVYLDGELYVTGRIADLVRIDGRNHYPQDIEATVAEASPMVRRGYVTAFSVPAVDDSEAGRLVVVAERAAGTSRQDPRPAIEVIRAAVAQRHELAVADVRLLPAGAIPRTTSGKLARRACRAQYLDGSLGAR

SEQ ID NO: 3491 - protein, 155 aa, Mycobacterium paratuberculosis
MPGRMFSFEVTRTSSAPAATLFRLVADGANWSRWAKPIVLHSSWARQGDPAPGGVGAIRKVGLWPVLVQEETTEYEPDRRHAYKLVGPPSPAKDYTGEVVFTPNPAGGTDIRWTGSFTEGVRGTGPLMRAAMGGAVKFFAGRLVKAAEREAGQAR

SEQ ID NO: 3492 - protein, 387 aa, Mycobacterium paratuberculosis
MGKLRFGYFIAPFHRAGTNPTLALQRDLEFIEHLDALGFDEVWLGEHHSAGSEIISSPEIFIAAAAERAKRIRFGTGVISLSYHNPLWVADRLMLLDHLTHGRIIGGVGPGSLPSDSSMIGLTPTDTRELLETNLDIVVRLLAGETVSAKTATHQLFDAKLQLAPYSDGGIPLAVAAVASPTGARLAGKHGIGLLSIGATLTVEGFNALSYHWGIVEERAAAFGTQVDRTNWSLVGLFHLAETEKQAREEVKFGIEPWFRYFQKVAAFPQMTMPGDQLDEMIDVINENGAGVIGTPERAREQVQRCWDQSGGFGCMLQMGHEWANPAATKRSAELFAAEVMPHFQGQAQPTLDAAARAGQARDSLAQSQLDAVAHMTKKYQDEVESK

SEQ ID NO: 3493 - protein, 153 aa, Mycobacterium paratuberculosis
MRSGPRTTIAVFGGAAMLVLAVGCGGGHKGGPSTTSTTTPTTTPSTSVVPSTTPGGGGTVPGGPTGGGGPGGGGGSIPGGPTGGGGPGGGGGSIPGGPTGGGGPGGGGGSIPGGPTGGGGPGGGGGSIPGVGGGGGGPGGGGGCVGNVCGGYP

SEQ ID NO: 3494 - protein, 762 aa, Mycobacterium paratuberculosis
MAIIDKETQVRPSFDDEVAATQRYFDDPRFARITRLYTARQVAEQRGTIRTDYTVARDAAAAFYERLRELFAQKKSITTFGPYSPGQAVTMKRMGIEGIYLGGWATSAKGSTTEDPGPDLASYPLSQVPDDAAVLVRALLTADRNQQYLRLQMSEQQRAATKEYDYRPFIIADADTGHGGDPHVRNLIRRFVEVGVPGYHIEDQRPGTKKCGHQGGKVLVPSDEQIKRLNAARFQLDIMRVPGIIVARTDAEAANLLDSRADERDQPFLLGATNLDIPSYKACFLAMVRRFYELGVKDLNGHLLYALPEAEYAEATAWLERQGIQGVISDAVNAWRENGQQSIDDLFDQVESRFVAAWEDDAGLMTYGEAVAEVLEFAASEGEPADMSADEWRAFAARASLYSAKAKAKELGFDPGWDCELAKTPEGYYQIRGGIPYAIAKSLAAAPFADILWMETKTADLADAKQFADAIHAEFPDQMLAYNLSPSFNWDTTGMTDEQMKQFPEELGKMGFVFNFITYGGHQIDGVAAEEFATSLQQDGMLALARLQRKMRLVESPYRTPQTLVGGPRSDAALAASSGRTATTKAMGEGSTQHQHLVQTEVPKKLLEEWLAMWSENYHLGEKLRVQLRPRRAGSDVLELGIYGDGDEQLANVVVDPIKDRHGRSILQVRDQNTFAEKLRQKRLMTLIHLWLVHRFKADAVIYVTPTEDNLYQTSKMKSHGIFSEVYQEVGEIIVAEVNRPRIAELLQPDRVALRKLITKEG

SEQ ID NO: 3495 - protein, 237 aa, Mycobacterium paratuberculosis
VHFAWERLTGSVHRCRLPFCDVTVGLICGRSGTLLVDTGTTLTEAAAIDADVHRLARRPVSHIALTHKHFDHVLGSSLFTGAEVYCAPEVVEYLGAATDQIRDDALRHGADAAEVDAAIAALRPVQHGIRDARIDLGDRTVTITHLGAGHTASDLVVVVPAARDGEPTVVFTGDLVEESADPAIDADSDVTAWPATLDRLLALGGPGARYVPGHGRVVDAAFVRRQREWLRARAATR

SEQ ID NO: 3496 - protein, 107 aa, Mycobacterium paratuberculosis
LVVVTGVDRVFLALANPVRRELLQLLARHPLSAGELSERFELSRPAVAEHLKVLREAALVADERRGRQRIYHLTAEPLAELGEWLHPFEKFWRTRLRRLAEVAEELE

SEQ ID NO: 3497 - protein, 135 aa, Mycobacterium paratuberculosis
MTDTSRFATIRVDQFVAAPPAKVWRMLTEPELMKLWWAEGQVAAVVGHRFTLDMPGYGKQPCQVLEVDPPRRFVYTFTAAWTLTWRLEAEGEGTRVFLEHSGFDLDDARMARAFEQMGPGWRDTVLPRLARVAVD

SEQ ID NO: 3498 - protein, 149 aa, Mycobacterium paratuberculosis
MAITDSREVVIEATPEEILDVLFDLESLTEWSPAHQKVEVLERDEENHPIRSRQVVKLVGISDEQELAYTIYDDGVGWTLVSSKQQRAQQGRYTLTPEGDATRVHFELTVDLVMPVPGFLIKKGSKSLMDTATEGLRKRVAEVKKRAAS

SEQ ID NO: 3499 - protein, 100 aa, Mycobacterium paratuberculosis
MEATLVDTSRRIGTIICALALPAGAVGCGGHGHGPTTTPSTPKVTTLGRTAPNAPAGGPLTITSPAFTDGAPIPPRYTCKGEGIAPPLAWSAPTGAALVV

SEQ ID NO: 3500 - protein, 112 aa, Mycobacterium paratuberculosis
VRPWWSTTPTPRGGGGGGPYVHWVVTGIAPGSGSTSAGQTPPGTTTLPNTAGQAGYQGPCPPAGTGTHHYRFTLYQLPNDYQLPAGLAGVQAAQTIGAAATAQAQLTGTFGG

SEQ ID NO: 3501 - protein, 479 aa, Mycobacterium paratuberculosis
VAVFRDLRDYIQTLTDKLGGEEVKTIRGAHWDLEIGCLTELLAEKEGPAPLFDNIEGYPSGYRVFTNFMGTVPRCAVALGLPPWTPAMDIVKAWKDLSKSIDPVAPVLLSTGSVLENVLEGDDVDLNMFPTPRWHDGDGGRYIGTACMVITKDPDTGWVNVGTYRGCVQGKDRLSLWMLGNRHALAIAQKYWHRGQACPIAVVVGCDPILTTAAAIAAPSGVCEYDVAGGLRGSGVEVLAAPGTGLPVPAHAEIVLEGEMPPVEEESVPEGPFGEWTGYFTHAGNETVVRVQRILHRDSPIILGAPPMIPTVPAGDQAVPLYSASVTWDHLEASGVQNIKGVWAYARQLMMVISIEQTGTGDAMHALLAAAGRKRTGGMDRYFVVVDEDIDITDINHVLWALFTRVDPTESIHVLRTPTTAIDPRLSPAKRDAGDLSMGIVLIDACKPFAWKDSYPRANRFDDNYRAAIRDRWQAALPL

SEQ ID NO: 3502 - protein, 207 aa, Mycobacteium paratuberculosis
MSTQPIRIIVGVTGASGAPFAVRLMQTLHGMDDVETHLVMSGWARSSIGIETPYSVQQVSAMADVTYKLEEQGAAISSGSFQTAGMIVVPCSMRTLAAIRYGLADNLVCRAADVVLKEGRRLVLVPRETPLNTIHLENMLALSRMGARIVPPMPAFYNRPESVDDIVDHVVVRVLDQFGINAPQAKRWQGMKSARTTGFGKNSAILA

SEQ ID NO: 3503 - protein, 305 aa, Mycobacteium paratuberculosis
MDLHQLECFIAVAEEGTFTAAAQRIHLAQSGVSAHIKALEREIGQQLFERRPRTVRLTAAGNALLPYARAALDALAAGRASIDGLTGLLHGRLAIGTITSISPRSIDLPELLAAFHHEHPGVDLSLVEDTAAMLNRHISNGALDVAFTSLTDEAVAGVRMRELHREPVIAIFLPSDPLSPCRKLTLADVADRPLITLPEGSGLRWQLNRALRRAGVQAHIAFEAGDPDVLVALVAKGLGVGLVPQSALAQSDHVIGLPVSDHPPGRLGIIWPEGQAASPAARAFVEHATTATTKLRRPAELRQDR

SEQ ID NO: 3504 - protein, 117 aa, Mycobacteium paratuberculosis
VLFAATVLCIVANTLIAIADYVPAGFVLKNSAEVHVPAAALPYLATLKLAGAVGLTLGLVALPRLGVAAGIGLVLFFFGAVGAHVRARVFHNIAFPGAFLLLALAANGYLVHLASGA

SEQ ID NO: 3505 - protein, 430 aa, Mycobacteium paratuberculosis
MPQRLGLAGLCLGTALIIMEANVLNVAIPSIRQALHASPAQSLWIIDAYTLVLAALLLSAGRLGDRIGARRCYLLGLAVFSIASVLCALAASSAELIAARTIQGVGAAVLIPAPLGLISAMFSDLTARAKAVAVWVTIGGVGFAAGPLIGGLLVSTFGWRSIFLINIPAAAIIAVMVRLTVAEASRSPLPFDYVGQALAIVGLSAVVFACVESSALAWMSPFVLLPAVAAALILGLFVIDQRHRGRAGAWVLLPVELLNNRPVNAGLMSGFVYNFTLYGLVLVYSYVFQSARGYSPVQTGLAFAPLTVAALVTSLPAGRFVAAHGARRGIMIGMALSAIGLCALAFDAQRMPFVVLSIAFGIFATGLSLSATGQTMAVMANASDQYKNTASSMLNTARQTGGVIGVAALGAITSRDLLASAPVALTIAAA

SEQ ID NO: 3506 - protein, 225 aa, Mycobacteium paratuberculosis
MADEQADSRERLISGTRELLWDRGYVGTSPTAILQQSGVGQGSLYHHFRGKHDLVLAAEQQAAADMQRSIKEAFAGNRSAHDKIADYLTRQREVLRGCSVGRLTADPVIVGDDQLRAPVAQTFEVLHTCLTRTIREGQRSGEISVELEPHKVAAAISATIQGGYALARAANSVEPFNRAITGILQLIEASTAHRRRTNPAAHDAVPAQRRRTSRSKNPSNHKPAR

SEQ ID NO: 3507 - protein, 208 aa, Mycobacteium paratuberculosis
MRAVAIAARTAAAGLMAAGWAASTVVAGADPDETHGPAPGPAATPSPAPSTSPSPAASPSPSASPAPAPAAPKTTIDKDGIYAVGTDIAPGVYSSGGPVGNGTCYWKRMGNPDGAVIDNAMTKKPQVVQIDPGDKSFKTSGCQPWQLTPDAVPPPSAPPAGVQGTLGILNGLLGGAGQQAPSAPSAPAAPPSGAQPPAAAPAPQAAHP

SEQ ID NO: 3508 - protein, 321 aa, Mycobacteium paratuberculosis
MARNQQIVVIGAGVSGLTSAICLAEAGWPARVWADTMPADTTSAVAGAVWAPPRPAERAAETLRWTEHSLRVFTELARDPDSGVQLAPALAVGELTASEAMSTAASLIPELRPADPADLPPGYRTGFHATVPMIDMPHYLGYLTRRLTAAGCEIEEHRVGSLDEVADHADIVVNCAGLRAGALTGDDTVRPLFGQHVVLTNPGVRQLFMELNDGPEWTCYFPHPQRVVCGGISIAGRWDTTADPAVTERILQRCRRIEPRLGEAEVIEVITGLRPDRPSVRLQAEPLRRARCIHNYGHSSNGVTLSWGCARDVLALVDDAR

SEQ ID NO: 3509 - protein, 129 aa, Mycobacteium paratuberculosis
MGPFVLRAALTGFALWIVTLFVHGLTFVGGDTKLQRVGIIFVVAVIFGLVNAFIKPIVQILSIPLYILTLGLIHIVINALMLWITAWITEHTTHWGLQIDHFWWTAIWAAIVLSIVSWLLSLVIRRTAG

SEQ ID NO: 3510 - protein, 355 aa, Mycobacteium paratuberculosis
MRIIDADGHVAENSSLAIEAIQRWPEHVKPGRHGRLGLMIEGRNYPEDRGPGAGCPPEHGISDAPDINCRSAEGVLGDADRDHIDTMVLYPSLGLCAPSLRDPEFAAGFARLYNRWVADYCAQSGGRLRGVAVTPIEHGQLAIDVMREAKDLGLVATLVPPALQSRNLDHPDLDPFYAAAVELEMPLGVHGAPGIHLPKIGVDRFTNYIQVHCISFPFDQMTAMTAMVSGGVFERHPKLRVAFLEAGAGWVPFFIDRLHEHYEKRGDWVERGWRRDPHEYLKAGNIFVTCEPEEPILPGVIDVLGADFIMFASDYPHWDGEWPESTKHLRTRADISEEAREKIGGLNAQRFYNLN

SEQ ID NO: 3511 - protein, 424 aa, Mycobacteium paratuberculosis
VTKPSPGRKLTADQRNSFIAALLGWTMDAFDYFIVVLVYADIAKTFHHSKAEVAFVTTATLIMRPVGALLFGLWADRVGRRLPLMVDVMFYSVVGFLCAFAPNFTVLVILRLLYGIGMGGEWGLGAALAMEKVPVERRGFFSGLLQEGYAFGYLLASVASLVVMDWLELSWRWLFGLSIVPALISLIIRYRVEESEVWEAAQDQLRLTSTRIRDVLRNGAIIRRFVYLVLLMTAFNWMSHGTQDVYPTFLGAHANHGAGLSSTTVKWIVVVYNVGAIIGGLVFGTLSQRFSRRYTVVFCAMLALPIVPLFAYSRTAAMLGLGSFLMQLFVQGAWGVIPAHLTEMSPDAIRGLYPGVTYQLGNLLAAFNLPIQERLAETHGYPFALAATIVPVLLTVAVLTLIGKDATGIRFATSESAFLPTEMT

SEQ ID NO: 3512 - protein, 434 aa, Mycobacteium paratuberculosis
VPVSARAGIVVTGTEVLTGRVQDANGPWIADRLLELGVELAHITICGDRPHDIEAQLRFLADQGVDLIVTSGGLGPTADDMTVEVVARFCGRELVLDAEVEEKIANILKKLMARNPAIQSALDPGTFESLRAANRKQAMVPAGAQVLDPVGTAPGVVVPGKPAVIVLPGPPRELQPMWHTAIQTPAAQQAIAGRTVYRQEMLRMFGLPESGLAETLREAEAAVPGFGQLEITTCLRRGEIEMVTRYEPTAATAYAQLTKLLRDKHGDQLYSEDGSRVDDLVARLLAGRRIATAESCTAGLLAARLTDRPGSSDYVAGGVVAYSNEAKAELLGVDPALIEAHGAVSEPVAQAMAAGARQRFAADTAVAITGIAGPGGGTEEKPVGTVCFSVQVGPPGATARSDTRTMRLPGNRSDIRERSTTVAMHLLRRLLTDA

SEQ ID NO: 3513 - protein, 101 aa, Mycobacteium paratuberculosis
VSVLVAFSVTPLGVGEGVGEIVAEAVRVVRDSGLPNKTDSMFTVIEGETWEEVMAVVQRAVEAVAARAPRVSTVIKADWRAGVSDAMTHKVASVERYLSDG

SEQ ID NO: 3514 - protein, 143 aa, Mycobacteium paratuberculosis
MRVLVQRVSSAAVTVEGAVVGALRPDSQGLLALVGVTHSDDRDKARRLAEKLWKLRILADERSASDVGAPILVVSQFTLYADTAKGRRPSWNAAAPAAIAEPLVTEFAAALQGLGADVQTGVFGANMQVELVNDGPVTVLLEL

SEQ ID NO: 3515 - protein, 302 aa, Mycobacteium paratuberculosis
MTTPQFGSQRSDDDNWDIVSSVGYTALLVAGWRALHAVSPRPLVRDDYAKTFIAASGDPYLTGVLANPGTSEDELAFPRLYGAQTRFFDDFFDAAGAAGIRQAVIIAAGLDSRAYRLEWPPATTVFEVDLAKVLEFKARVLGEQGAVPKARRVEVAADLRADWSRPLEAAGFDVESPSAWSVEGLLPYLTDEAQHALFTRISGLSAPGSRIAIGALGSRLDHDQLHALEESHPGVDVSGNVDFSALTYEPQSDPAEWLAAHGWVVDPVRNTLDLQAGYGMTPPEVDVKIDGFMRSQYITAAR

SEQ ID NO: 3516 - protein, 341 aa, Mycobacteium paratuberculosis
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPVKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 3517 - protein, 671 aa, Mycobacteium paratuberculosis
LGLRDHHLSDHYLSDHREDIGLMRSRYAGEPFTTSTAEIAAALEDVSIPTLLLSLVHITGDPRFIRDFKQMGIFLNEVQGFMSEEDKARARAEALSVITDYRDRGCPEPEPLSPELIREMMDWAACEHVPDDYLPLICEELDLDGVDPRRPAALPAERAAGLPVLVVGCGESGILAGVRLKQANIPFTIVEKNAGPGGTWWENSYPGARVDVANHFYCYSFEPNNDWTHFFAEQYELQDYFTKVIDQHDLAGQVRWQSEVLAAEWDDGDGTWTVSLRSADGHTETMRARALITAVGQLNRPNIPAFDGAQTFRGPSFHSAAWDHSVELKGKRVALVGAGASGFQIAPAIAADVKRLTVFQRTAQWMFPNPMYHDEVGDGVRWAMRHLPFYGRWYRFLVLWPGSDKGLDAAEADPNYADQEHAVSDVNAAAHLMFSQWITSQVGEDSELLAKVMPDYPACGKRTLQDNGSWLRTLQRDNVELVRTPIDKITPHGIVTVDGAAYDADVIVYATGFRHTDVLWPLKVTGRNGVDLHQMWGSRPYAYLGITVPEFPNFFIIYGPGTHLAHGGSLIFQSELQMRYIDQCLARLCEPGVHSIEPKPDAAIDWHRRTPGPDQEDGVVAPGGQALLFQERRRRDSHGEPMASQRVLVRGARARLVAVHGADERCCATRK

SEQ ID NO: 3518 - protein, 469 aa, Mycobacteium paratuberculosis
MRSIIGREDIQDDYDVLRAVVARIQRHSYDALTNSERIRLLEVLEHQTRRLQVPGHQLINQIEQDATPAEIGGKLAHLLADRLLITRAEAARRIDDARDLGVRRTLTGEPLPPRYAATAAAQRDGRIGASHVAVIRRFFDQLPCWVDAPTRDAAEADLARWAGEHRPESLRKVADRIACYLNPDGVFHDEDRLRHRGLTLGAQQPDGMSQLRGWLTPEARATIEAVLAKLAAAGMCNPDDPAPVVDGQPGQEAIQRDSRSAAQRNHDGLNAALRALLAGGKLGQHNGLPASIIVTTTLRDLESAAGKGLTGGGTLLPMSDVIRLARHAHHYLAVFDNGKPLALYHTKRLASPGQRIVLYAKDRGCSHPGCDVSGYSCEVHHVTGYAKCGRTDIDQLTFACGGHHPLAEQGWITRKNGRGETEWIPPPHLDHGRPRTNAFHHPEKLVADSDNDTGDNTSDAPDDPQPPIP

SEQ ID NO: 3519 - protein, 376 aa, Mycobacteium paratuberculosis
MHTAICDELGIEFPIFAFTHCRDVVVAVSKAGGFGVLGAVGFTPEQLEIELKWIDENIGDHPYGVDIVIPNKYEGMDSHLSAEELAETLRKMVPQEHLDFGKKILADHGVPIEDSDSDSLQLLGWTEATATPQVEVALKHPKVKMIANALGTPPADMIKHIHDAGLKVAALCGSPSQARKHADAGVDIIIAQGGEAGGHCGEVGSIVLWPQVVKEVAPLPVLAAGGIGSGQQIAAALALGAQGAWTGSQWLMVEESSNTPVQQAAYAKAGSRDTVRSRSFTGKPARMLRNDWTEAWEAPGNPKPLGMPLQYMVSGMAVRATNKYPNESVDVAFNPVGQVVGQFTKVEKTATVIERWVQEYLEATNRLDELNEAASV

SEQ ID NO: 3520 - protein, 76 aa, Mycobacteium paratuberculosis
MAFNPKDAVDAARDIATNAVEKASDIVEHASDIIRGDIAGGASGIVQNSIDIGTYAVDRTKEVFTGRHDVDDVDEV

SEQ ID NO: 3521 - protein, 104 aa, Mycobacteium paratuberculosis
MSPAPRERSRTAESGKPLVPRWLRFVLASDRAGSAWYIGTGFFFAPVLAVLSPWPVVTAVLWGVIALAGLWLGLLGIAMAVGLARIMRSGAEIPEDYWRSLVHY

SEQ ID NO: 3522 - protein, 132 aa, Mycobacteium paratuberculosis
MIRELLTAASVAGIAVGVAPVAAAGYDGDVPGMNYQASLGAPCDNYERFIFGRGPSGQAEACHFPPPNQFPAATTGYWVMSYPLYGVQQAGAKCPGPQAAAQSEAGLPMLCLGDRGWQEGWFTGAGFFPPSG

SEQ ID NO: 3523 - protein, 428 aa, Mycobacteium paratuberculosis
MATVEPTTKPVPNLPPGFDFTDPDIYAERLPVEELAEMRRVAPIWWNEQPIGAGGFDDGGFWVVTKHKDVKEVSLRSDVFSSLQKTALPRYKDGTVAEQVERGKFVLLNMDAPQHTRLRKIISRAFTPRAVERLRDDLRERARRIVEAAAAEGSGDFVEQVSCELPLQAIAGLMGVPQEDRKKLFHWSNEMVGDQDPEFASNDAITASVELIMYGMQMAADRAKNPGEDLVTKLVQADIDGHKLSDDEFGFFVILLAVAGNETTRNSITQGMMAFTDFPDQWELFKRERPATAADEIVRWATPVTSFQRTALQDYELSGVKIRKGQRVVMFYRSANFDEDVFDDPFTFNILRDPNPHVGFGGTGAHYCIGANLARMTIDLMFNAIADAMPDLESIGKPERLRSGWLNGIKHWQVDYHTNGSSKCPVAH

SEQ ID NO: 3524 - protein, 337 aa, Mycobacteium paratuberculosis
MPTHQAVQIQSAGAALELVDTETRPPGRDEVRLTVGACGICGTDAHFVNGAFPGLSWPLTPGHEIAGRIAELGEGVEGFAVGQRVAVGWFGGCCYRCDPCRAGLFIHCVNGKVPSWHYPGGYAESVTVPTSALARIPEELTDAEAAPMGCAGVTTYNALRHTKALPGDRVAILGVGGLGHLGVQFAAAMGFETIAINRGTGKADDARKLGAHHYIDSTAEDPAEALRALGGAAVVLATAGNSQAMAATVGGLAPQGELVTIGVTPEPLPISPLQLITPGLSIVGHPSGTAKDVEDTMQFAVLSGVRAWIEELPLSRAADGYAALEGGRAHYRTVLTM

SEQ ID NO: 3525 - protein, 188 aa, Mycobacteium paratuberculosis
VASDNASTIGPADGELLLHTGVTGRAARMGHRLTIAMTRWRAGVSWAGSRPVRAELAVEVDSFEVLRGEGGVKGLSTAEKALVRSNALKSLNASRFPEIRYTSDVIEHTGDGYRLTGTLQIRGAARNHVIDLGAEDLGEAWRLSVETTVRQSDYGIKPFSLLMGSVQVADDVSLSFTAVHAKDRAEDR

SEQ ID NO: 3526 - protein, 383 aa, Mycobacteium paratuberculosis
LDTVLGLSVTPTTVGWVLAEGHGADGTILDHQELALHSGGAVRAASAAEQVVDEVLRVEAAAAGSDRRLRVIGVTWNDEASVPAALVLEALTDAGLHNVVPVRFLQAVETLAQAIAPVIGYEQTAVCVLEHDWTTVVMVDSHDGQTQTATKQVRGGFDGLTRWLTGMFERDGWQPGGIVVVGAHSDIDGLSWQLEKALPVPVFVQSMAQVTIARGAALSAARSTEFTDEQLVARRSEPVTPAPVRHRRLSYAGAMTALTAGAISFVGSVSLAVGIHVGPASATAAAKHATHPPAPQVAEAVKAVTPLPAVPQTKPQIKPPSGPAPAPAGEPAAPDEQPGIGDDRQMESGNRQPYLTRVLEHIPGDTGEPAADSAPRPTLDPQP

SEQ ID NO: 3527 - protein, 194 aa, Mycobacteium paratuberculosis
LSDVVACDRGLTGIYRVSPSNVDRDANESRFRISFRLAGFHLAISPPAAPGGDGCGDTRSAPVQPVSNRRAAKHPGRRGFLRVGQRANRSPVSFRMQFAVEESMHSALPCDPFSGGLSGDSATGLFPTADRALPAFRGPRRLSRSKPMKTALSRVCSGSHEPVYQRFHGARQRVWERSAGPIGAQIWTRYLACR

SEQ ID NO: 3528 - protein, 330 aa, Mycobacteium paratuberculosis
MTDLSEKVRAWGRRLLVGAAAAVTLPGLIGLAGGAATANAFSRPGLPVEYLQVPSAGMGRDIKVQFQSGGNGSPAVYLLDGLRAQDDYNGWDINTPAFEWYYQSGLSVIMPVGGQSSFYADWYQPACGKAGCSTYKWETFLTSELPSYLASNKGVKRTGSAAVGISMSGSSAMILAVNHPDQFIYAGSLSALLDPSQGMGPSLIGLAMGDAGGYKADAMWGPSSDPAWQRNDPSLHIPELVGHNTRLWVYCGNGTPSELGGANMPAEFLENFVRSSNLKFQDAYNAAGGHNAVFNFNANGTHSWEYWGAQLNAMKPDLQGTLGASPGGGG

SEQ ID NO: 3529 - protein, 168 aa, Mycobacteium paratuberculosis
VAKARADTADPLTELVDTAVQRLQLAEPVAAYKWNSHGAVEDPARVAQQLALLGDQAAAENIDRDYVTRVFGDQIRATEAIEYSRFASWKLNPGEAPADAPDLTASRAAIDDLSRTMLTALAADWPLLHSPACAALLADARRAVVGDRRLDTLYQRALTSATQSYCQQ

SEQ ID NO: 3530 - protein, 170 aa, Mycobacteium paratuberculosis
LFSPAEMAVFADRRHISRHFRIGNALATRAEILDMTNLCKLLVKSVVVGGFVAASMASSTGVVSAEPTPNWDAIAQCESGGNWHANTGNGEYGGLQFKPATWARYGGVGNPAAASREQQIAVANRVFAEEGVEPWPKCGAQSGLPIGWYSHPAQGIKQIINGLIQAAVPR

SEQ ID NO: 3531 - protein, 159 aa, Mycobacteium paratuberculosis
LCLDQPMEGSATVHMAAPAAKIWDLIADVRNMGRFSPEVFEAEWLGGATGPALGAKFRGHVRRNEIGPVYWTTCKVTACEPGREFGFTVLLGDREVNNWHYRLAPSGGGTDVTESFRLNPAPWVPVYWVFGGFLRKRRNIRDMTKTLNRIKDVVEADAP

SEQ ID NO: 3532 - protein, 277 aa, Mycobacteium paratuberculosis
VKSIFITGAGSGMGREGAKLFHAKGWRVGAVDRNDDGLATLQQELGDDRLWTRAVDVTDKAALDGALADFCAGNTGGGLDMMWNNAGIGESGWFEDVPYDAAMRVVDVNYKAVLTGAYGALPYLKKSAGSLMFSTSSSSATYGMPRLAVYSSTKHAVKGLTEALSVEWQRHGVRVADVLPGLIDTAILTTTTNHSNDGAAPMTAEELRATAPKKGMLRLMPASSVAEVAWRAYHHPRRLHWYVPRSIRLIDVFKGLSPEFVRRSIVKSLPALMPERQ

SEQ ID NO: 3533 - protein, 140 aa, Mycobacteium paratuberculosis
VQKRLPTVVLVLTAVVAGIAGCSAAQTVPRKAARLTIDGATHTTRPPSCRQDQMYRTINIPDHDGGVEAVVLLSGYRVMPQWVKIRNVDGFTGSYWQGGVGDAHVDLTNDAYTITGSAYGINSANPNKVVTTDFKIVAEC

SEQ ID NO: 3534 - protein, 390 aa, Mycobacteium paratuberculosis
YLTADHALAHELLRSEDFRVLVFGSNLPAPLRWLERRTRDDLLHPLRAPSLLAVEPPEHTRYRKTVSAVFTPRAVAALRDRVERTAAELLDQLTGGPGVVDIVGRYCSQLPVAIISEILGVPEQDRSRVLEFGELAAPSLDIGLPWRQYRSVQRGIAGFSSWLAGHLQQLRSNPSDNLMSQLIQTAESGSAETYLDETELAAIAGLVLAAGFETTVNLLGKGIRMLLDAPEHLDTLRRRPELWPNAVEEILRLESPVQLTARMALNDVEVAGRQLHRGDLVLVYLAAANRDPAVFGDPHRFDIERPNAGRHLAFSGGRHFCLGAALARAEGEVGLRTFFERFPEARAAGAGSRRETRVLRGWSSLPVRLGPARSLAAAEAGGRPDEPTAG

SEQ ID NO: 3535 - protein, 152 aa, Mycobacteium paratuberculosis
MTEVSMIAVEDVVRGLWQALSRRDWDAVKTFLSDDCLYVDMPVPALSARGPDDIVKRLKMGLEQLAGYQNHPGVLVSNGSDVLYEHSETWTFATGEQGVLRFVTVHKVIDGKVTVWKDYWDFNSLVAFAPPNHFEGLANGDTSWVFDASALV

SEQ ID NO: 3536 - protein, 426 aa, Mycobacteium paratuberculosis
MLATIQTAATTQPAAATQSAFDDRIEGRLETLRKVLTKDSVKKLRLAPIKFLSALVSDGDLRNLKFDRNTDPTASGPREQSMEIDTSLRQPVYRISRRTREAMARVQSNLGLDNQDTDWMIDNYFIHELLHNSQGMSGGNHSELSRHAPRVLLDVDYQADALAAVTATALAWLVPREFGFRANRCANENHWTLYERALKAILSQMEIFTLLGYWNTPRAQISLVATGLERILRIATWHYQFHRLRSPFRPKRPLADFQILAQPVLDFRNLAWAAIFEPSTLCKDWPSNERANVAKWLKRKPLRGRLFPLHGRPQLVVTAATPLGTTRFIRHNSTETHYEDAFAGFFDNEPRRSKEFFTTLFMQQQWLRGGAEAGAFNYAWLNLRKDRQVDLLKVTQGLAPDLKPEQRGQVLDQLMTPSRSQILSAL

SEQ ID NO: 3537 - protein, 372 aa, Mycobacteium paratuberculosis
MVSDTDALAEHIGAVSLIDQHVHGCWLTAGGRRRFENALNEANTEPITGSGFDSQLGFAVRAHCAPILGLPRHADPQSYWERRCQLSEHELARLFLPAAGVSNWLVDTGIGHGVVAGVAEMAELAAGPAAELVRLEEVAEQAAQAPGDYAAAFDEVLAARAAGAVGTKSILAYRGGFDGDLSEPSATEVARAAARWRELGGTRLRDRVLLRFGLHRALRLGKPLQLHVGFGDRDCDLHKANPLLLLDFLRHSGDAPIVLLHCYPYEREAGYLAQAFNNVYVDGGLSVNHLGARSPAFLARLLELAPFSKILYSSDGFGPAELHFLGAVLWRRGIHRVLREFVEAGDWGRADAIRVVDLIARENAARLYGLAP

SEQ ID NO: 3538 - protein, 450 aa, Mycobacteium paratuberculosis
MTGTPLAAAAIAQLEAEGVDTVIGTVVNPAGLTLAKTVPIRRTNTFADPGLGASPSWHAFAVDQTGIAFTAEVGVVGDQRLRIDLSALRIVGDGLAWAPAAFFAQDGTPIPSCARGTLKRVEAALADAGIDAAIGHEVEFVLVAPDGQRLPSTLWAQYGLAGVLEHEAFVRDVIGSATRAGIAIEQLHPEYGANQFELSLAPQPPVAAADQLILMRLIIGRAARRHGFRISLSPAPFAGDVGSGAHQHFSLSMAEGPLFSGGAGTAGMTPAGENAVAGVIRGLPEAQGVLCGSIVSGLRIRPGNWAGAYACWGTENREAAVRFIVDGPGSPRGGNVEVKIVDPSANPYLASAAILGLSLDGIKSQAALPPEVTVDPAALSDADRDRDGVVLLTDSAAEAIAALDDSELMRHILGDPVVDMVVAVRRLEQERYGDLDPAQLADRFRMAWSL

SEQ ID NO: 3539 - protein, 293 aa, Mycobacteium paratuberculosis
MKIRFGVGLGADTAPDGLGAIVDHLESTGVDSLWFSELVYSPAVDPVVGMAFALARTHRLKVGTSVAVLPGRHPVLVAKQLASLAALAPKRVLPVFGLRSAIPAEREVFVVPDGERAAVFDESLRLLRAALVEDSATFTGRYFSVTGAAVTPKPAPPLDIWLGGSAPAAFRRIGALADGWLGSFLTPAEARAGREAIERAAAAAGRHIEPDHFGISLAVADGELPPPAIAAVRRRRPDLDPDELIASGWDQLHRKLDAYLDAGLTKFVIRPAGTAPLDGFLDRFVTELVGRQN

SEQ ID NO: 3540 - protein, 164 aa, Mycobacteium paratuberculosis
MSRIGTFADDDLAGWFVKSPDIGAALGAFSQAVYTKNRLPLRTRELARAVIAHRNECVVCVNTRDEDGPAAGVDEELYDHVHEWRTWPGYSEQERLAAEFADRFATDHTGLRDDEDFWSRCAEHFSDELLADLALSCALWVGMGRVLRTLDIGQACKLTIPSRG

SEQ ID NO: 3541 - protein, 689 aa, Mycobacteium paratuberculosis
MTTPRAAVNAPARADTGSGGERISPQRRNLIFVAIVLGMLLAALDQTIVATALPTIVANLGDAGHQSWVVTSYLLASTIVTALVGKLGDLYGRKRVFQAAVLFFVAGSVLCGLAQSMAMLVGARALQGIGGGGITVTASALIGEVVPLRERGRYQGILGAVFGVTTVIGPLLGGYFTDYLSWRWAFWVNVPVSVIVIFVAAAAIPALAASAKPVIDYAGIVFVGLGAAGLTLATSWGGSRYPWGSPTITGLFAAAAVALGVFVVVERRAAEPILPVRLFASPVFTVCCVLSFVVGFAMLGAMTFLPTYMQYVDGVSATTSGLRTLPMVVGMLFTSTGSGTIVGRTGRYKIFPVAGTALMALAFLLMSRMQPSTPAVIQSLYLFILGAGIGLSMQVLILIVQNTSDFEDLGVATSGVRFFRTIGSSFGAAIFGSLFVNFLNRRIGPALAASGAPPGAVSSPGALHRQPHEVAAPIVAAYAESLTEVFFWAAPVALVGFVLALFLREIPLRDIHDSTVDLGDAFGMPTTETPDQMLENAIARMLRGETGMRLRSIAMRPDCRLDVAGLWGVLRINRYTQMYGAARLTDMAEYLRIPFEVLEPTFSRLVTAGYAGSDGDRLWLTPAGAQQVGYVHSLLLAWLVDKLGRSPGFEGRPDRQAVQAALERVAYRVLAQRDWHDEQPTAAITAAAR

SEQ ID NO: 3542 - protein, 159 aa, Mycobacteium paratuberculosis
MQGDPEVLRLLNEQLTSELTAINQYFLHSKMQDNWGFTELAEHTRAESFDEMRHAEAITDRILLLDGLPNYQRLFSLRIGQTLREQFEADLAIEYEVMDRLKPAIILCREKQDSTTATLFEQIVADEEKHIDYLETQLELMDKLGVELYSAQCVSRPPS

SEQ ID NO: 3543 - protein, 61 aa, Mycobacteium paratuberculosis
MYVCLCVGATNQTVSEVVARGATTSKEIAAACGAGGDCGRCRRTLRAILAASAKLETAPSV

SEQ ID NO: 3544 - protein, 249 aa, Mycobacteium paratuberculosis
VTLQIDDDKRVRTLTLNRPEALNAFNEALYDATAEALLAAAEDPEVAVVLLTGAGRGFSAGTDLAEMQARITDPDFTPGKHGFIGLINALSAFPKPLICAVNGVGVGIGATILGYADLAFMSSTARLKCPFTSLGVAPEAASSYLLPQLVGRQNAAWLLMSSEWVDADEALRMGLVWRVCAPDELLPQARHHAEILASRPISSLMAVKHTMMEPVRPQIAAATARENAHFAELMGAQANAAALADFNKR

SEQ ID NO: 3545 - protein, 147 aa, Mycobacteium paratuberculosis
MTTLDDAVALAAAENGLAVISTVRADQTVQASLVNVGRLAHPANGQPVLGFTTYGKVKLANLRARPQLAVTFRNGWQWATVEGRAELVGPDDAQPWLTDADRLRMLLREVFTAAGGSHDDWDEYDRVMARERRAVVLIAPTRVYSNG

SEQ ID NO: 3546 - protein, 233 aa, Mycobacteium paratuberculosis
MEKVIAVLMRADSEEDWCARQRGVVADALLELGLPGLAVNVRDDAVRRSLMTLTTLDPPVAAVVSMWTQQSYGEQVAAALRLLAAECEQLAAYLVTESVPLPAPQTEPASRTPGLANIALLRRPAGMDQETWLTRWQRDHTPVAIETQSTFGYTQNWVVRTLTPGAPEIAGIVEELFPAEAITDLQAFFGAADEQDLQHRLGRMVASTTAFGANENIDTVPTSRYVVKTPFAQ

SEQ ID NO: 3547 - protein, 325 aa, Mycobacteium paratuberculosis
MLPRTLNEVKVIFPTTLIGMSDKTYQPTIAGLRAFVAVAEKRQFSGAATALGVSQSTLSQALAALEAGLGTQLVERSTRRVFLTPQGAELLPHAQAVVEAADAFTAAAAGSADPLRAGMRLGLIPTVAPYVLPTVLAGIAERRPGLTLRVTEDQTERLLAVLREGALDAALIALPAETAGVTAIPIYDEDFVLALPPGHPLAGKRRVPATALADLPLLLDEGHCLRDQALDVCHKAGVRAELANTRAASLATAVQCVTGGLGVTLIPQSAVPVEASRSRLGLAQFAAPRPGRRIGLVFRSSSGRDDSYRELAGLISSQHQVRLVK

SEQ ID NO: 3548 - protein, 195 aa, Mycobacteium paratuberculosis
MPLLTIGDQFPAYELTALIAGDLSKVDAKQPGDYFTTVTSEDHAGKWRVVFFWPKDFTFVCPTEIATFGKLNDEFEDRDAQVLGVSIDSEFVHFNWRAQHEDLKNLPFPMLSDIKRELSLATGVLNADGVADRATFIVDPNNEIQFVSVTAGSVGRNVEEVLRVLDALQSDELCACNWRKGDPTLNATELLKASA

SEQ ID NO: 3549 - protein, 178 aa, Mycobacteium paratuberculosis
MSVENLKEALPEYAKDLKLNLGSITRTTELNEEQLWGTLLASAAATRNTQVLTEIGAEAADTLSAEAYHAALGAASVMAMNNVFYRGRGFLDGKYDDLRAGLRMNIIGNPGVEKANFELWCFAVSAINGCPDCVASHEHTLREAGVSRETIQEALKAAAIISGVAQAIVASQTLATAG

SEQ ID NO: 3550 - protein, 464 aa, Mycobacteium paratuberculosis
VWPKRSSPPRRWRPPADRAVVASVVTGPDWVQHVIWWQVYPLGFVGAYPLPQSSEPPQPEQHRLRRLVDWFDHAIELGASGIALGPIFASRTHGYDTTDHYRIDPRLGDDTDFDHLIAQAHRRGLRVLLDGVFNHVGVDFPRYRAAIDSDDHAAARWFRGSRGRFHTFEGHDGLITLNHDNPEVVDYTVDVMAHWLGRGADGWRLDAAYAVPETFWAATLPRVRDRYPQAWFVGELIHGDYAAVVRAAGFDSATQYELWKAIWSSLNDGNFYELDWALQRHNAFLGRFSPLTFIGNHDVTRIASQLNNPAHLAHALVLLLTVGGVPSVYAGDELGFRGVKEERFGGDDAVRPEFGSPPIPLDDFGTEVWRLHQYLIGLRRRHPWLHGATTTALLLQNRHYVYETRSGDEALLIVLNIGDEPLRVSLRELGGRRGRVIGGSAAPPPEVLDTVVVEPQGWRILSPI

SEQ ID NO: 3551 - protein, 151 aa, Mycobacteium paratuberculosis
MCHRSHMDSAADPFDLKRFVDAQEPVYAAVVDELRAGRKRSHWMWFVFPQLRGLGGSAMADRYGISSLPEARAYLRHELLGPRLHECARLVERVQGRSVGQIFGSPDDLKLCSSMTLFAHATDDNADFLAVLQKYYDGRQDPVTLARLADS

SEQ ID NO: 3552 - protein, 420 aa, Mycobacteium paratuberculosis
VGVQRRVPRVRDLAPLMQFKRPEFNATKRRLRSAHTIEDLRRIAKRRTPKAAFDYTDGAAEDELSIQRARQAFRDIEFHPTILRDVSTVTAGWDVLGGPVALPFGIAPTGFTRLMHTEGEIAGARAAARAGIPFSLSTLGTCAIEDLAAAVPQSRKWFQLYMWKNRERSMALVRRAADAGFDTLLATVDVPVSGARLRDNRNGMTIPPTLTLRTVLDAVPHPKWWFDLLTTEPLAFASLDRWPGTVAEYLSTMFDPSLTFDDLEWIKARWPGKLVVKGIQTLDDARAVVDRGADGIVLSNHGGRQLDRAPVPFHLLSTVARELGKHTEILLDTGIMSGADIVAAIALGARCTLVGRAYLYGLMAGGEAGVTRAIEILAEGVIRTMRLLGVTCLEELSPRHVTPLRRLAPLPPVEPPVTPA

SEQ ID NO: 3553 - protein, 773 aa, Mycobacteium paratuberculosis
MAEAYSVPVLFVTDTIVLPGMVVPIALDDAARAAIDAAQASESGQLLIAPRLEDRYPSHGVIAKIVQVGRIAGGGTAAVVRGERRAQIGAGTSGPGAALWVQATPVPDAAITDEIKTLAAEYKKLLLAMLQRREAWEIIDYVNRLTDPSALADTSGYASYLTSAQKRQLLETVDVAERLRVLIDWTSSHLAEVEVSDKIAEDVREGMEKTQKEFLLRQQLAAIRKELGEGEPDGSDEYRARVEAADLPEKVREAALREVGKLERASDQSPESGWIRTWLDTVLELPWNVRTDDSTDLKAAREILDADHHGLEDVKDRIVEYLAVRTRRAQRGLQVVGGRGSGAVMVLAGPPGVGKTSLGESVARALGRKFVRVALGGVRDEAEIRGHRRTYVGALPGRIVRAIGEAGSMNPVVLLDEIDKVGSDYRGDPSAALLEVLDPAQNHTFRDHYLDLDLDLSDVVFLATANVVENIPSALLDRMELVTIDGYTEDDKVAIARDYLLPRQRERAALTEDEVTVTDAALRKIAADYTREPGVRQFERLLAKALRKVTTKLAEQPGPVTIDEPDLVAYLGRPRFTPESAERTAVPGVATGLAVTGLGGDVLYIEAGATDGEPGLQLTGQLGDVMKESAQIALSYVRSHAAELGVDPKVLDRRIHVHVPAGAVPKDGPSAGVTMVTALVSMATGRQVRSDVGMTGEVTLNGRVLPIGGVKQKLLAAQRAGLSTVFIPARNEPDLDDVPAEVLEALTVTPMTDVADIVAQALEPVTAPAAAAA

SEQ ID NO: 3554 - protein, 132 aa, Mycobacteium paratuberculosis
VSRLNDHVSLKRRVVHRVQRLLVNPVGRQLPMTMLETTGRKSGKPRRTAVGGRVMDNQFWMVSEHGEHSDYVRNIKANPAVRVRVGGRWRTGTAHLLPDDDPVQRLGNLPRLNSAMVRLMGSDLLTIRVDLD

SEQ ID NO: 3555 - protein, 110 aa, Mycobacteium paratuberculosis
MPYDEDLANRIRELLGGQPGIEEKRMFGGLAFLLNGNMSVAASGQGGLLVRVPPEDTDKLAARAHVGPMVMAGRETRGWLRVDAAGVRTKRQLAGWVARGVGYAGSLPPK

SEQ ID NO: 3556 - protein, 222 aa, Mycobacteium paratuberculosis
LPAHAGGTRTGMSNRDQRVRRLLDVAGQTYAAQARIKLSDKPMPLFQLLVLCMLASKPIDAAIAVGAAAELFKAGLRTPKAVLDADRQTMIDAFGRAHYVRYDESSATRLTDMAERVRDDYSGDLRELAARSEHDTASAKRMLKKFKGIGDTGADIFLREVQDVWTWVRPYFDDRATGAAKKLGLPAEPDKLGSLAPQANARLAAALVRASLDDDVRRRVSG

SEQ ID NO: 3557 - protein, 241 aa, Mycobacteium paratuberculosis
VTVRIGTSGWSYDHWADVLYPPGTPSARRLARYIEVFDTVELNASFYRWPKDSTFAGWREQLPDGFTMSVKAHRGLTHYRRLASPEPWIERFERCWELLGDRRGVLLVQLHPEQQRDDARLDSFLERMPASIRVAVELRHPSWNDPAVYALLERRRAAYAVTSGLGLACIPRATTDLVYVRMHGPDPAANYAGSYSDDDLRCWAERITAWDGDGKDVWMYFNNDLGGHAVRNALALRELVG

SEQ ID NO: 3558 - protein, 410 aa, Mycobacteium paratuberculosis
MASATGFVIIGGGLAAAKAVDALRDNNFDGRIIVFADEEHLPYERPPLSKEFLAGKKSLTDFTVQNSDWYRDNDVDLRLNTRVCALDAAGHTVGLADGTTVAYDKLLLATGSAARRPPIPGSDCAGVHYLRTYEDAVALNSFLGEGKSLAVVGAGWIGLEVAAAARQRGVEVTVVEAARQPLTAALGETVGEVFATLHREHRVDLRLETQVREITRADGSATGLRTTDGSAIPADAVLVAVGAQPNIELAEAAGLSLADGGVLVDASLRTSDPDIYAVGDIAAAEHPLLRTRIRTEHWANALKQPAIAVAGMLSRPGEYDELPYFFTDQYDLGMEYVGHAPRFERVVFRGDVAAREFVAFWLDADDRVLAGMNVNIWDVLDDVKALIRSRAPIDADRLGDPGAPLGELLG

SEQ ID NO: 3559 - protein, 707 aa, Mycobacteium paratuberculosis
VHILVTDATGALGRLVAGQLIAAGHTVTGIAELPHPCLDRNVEFVCAPLRDRVLRELTDEADAVIHLAPIDPTAPGNAAMDGLARVTDAAARAGSRLLFVSQAAGRPELYRPAEDLVASSWGPSVVVRIAPPVGRQLDWMVCRTVATVLRTKVSAQPMRVLHLDDLMRFLVTALDTDRTGVVDLASPDTVNLVTAWRMLRATDPRSRLHRVRSWSQLIPDLNVAAAQEDWLFEFGWHALDAVADTARGLVGRRLDTAGAINHGAQLALPVEVLPQRAGNGAHSAAPEGVEGEFDDRIDPRFPVFSATALTEALPGPLTPITLDVQLSGLRTASRVLGRVLALGGAVGEEWDSRAIAVFGHRPYVGVSVNMVAATQLPGWDQDAVARDALVGRPQVGDPLPFGEPALAGGALGSIAKAVAAGRSVALLRHLRANTRDYCAAAVAEQVDAAQLALLPQAALEVRLRLLRDRIHQGWILNALWLLDTGITAATLVRSQAGQSVPGLGMITESGLVAAETAELAAMLAADPPLCALAADGNLASIRALAPKTAAAVDAAVARIGHRGPGDAELASQTFGDDPAMLLSAAAAAAPAEPAAPATLAERLAANARGSKELAHDATMRFTHELRMTLRALGSLRVEADLIDAVDDVYYLTCNELVTMPGDARLRIKRRRTERERLQVQCPPEVIDGRWTPPQHCAEGSPARRPAG

SEQ ID NO: 3560 - protein, 494 aa, Mycobacteium paratuberculosis
MTVDPRTPALIGYGQVNHRDDIDPAVRSVEPVDLMAAAVERAADAAVIEAVDSIRVVNILSAQYRDPGLLLGQRIGARDFGTLYTPVGGNVPQSLVNQACLDIQRGRANVVLLAGAETWRTRRGLRAKGGKLVWTEQDRSVPMAEVSGEDVAMAGEAEIRISLDRPAYVYPLFEQALRVATGESVEDHLTRIGRLWARFNAVAVDNPHAWIRTPHSADDICRAGPHNRMISWPYTKLMNSNNMVDQGAALVLTSVEQARRLKVPPERWVYPLAGTDAHDTASIAERHELHRSAAIRIAGARALQLAGLGIDDVDHVDLYSCFPSAVQVAAAELGLGLDDPARPLTVTGGLTFAGGPWSNYVMHSIATMAELLVANPGRRGLITANGGYLTKHSFGVYGTEPPAEFRWEDTQSAVDREPTTDAAVEWEGVGTVEAWTTPHDREGEPEKAFLAVRTPDGSRALAVVTDRAAAQATVREDIGGAKVAVAADGSATLQ

SEQ ID NO: 3561 - protein, 814 aa, Mycobacteium paratuberculosis
VQMADRLLDAVRVLDLSNGVADAVTRLFADLGADVLKVEPPGGCLGRDALPTLRGASIPFAVHNANKRSTVLDPFDDEDCARFLDLAADADIVVDTGVDERGAMFGTSAEELAARYPHLVVLSITDFGATGPRSSWRATDPVLYAMCGALSRSGPTTGTPVLPPDGIASATAAVQAAWAALAAYYNRLRCGTGDYIDFSWFDAVVMALDPAFGAHGQAAAGIRRSGRWRGRPKNQDAYPIYPCQDGYVRLCVMAPRQWHGLRRWLGEPEDFQDPKYDVIGARFAVWPQISELLQKLFAGQTMKDLVAAGQAHGVPIAAVLTPSQILGSDHFQAVGAITDAELVPGVHTAVPSGYFVVDGRRAGFRAPVPAAGQDEPYWRGAPSVVPSPAGRLGDHPFAGLRILDLGIIVAGGELSRLFGDLGADVIKVESADYPDGLRQARAGEAMSESFAWTHRNNRALGLDLRSAQGKTIFARLVAEADAVFANFKPGTLAALGFSYEQLRAINPRIVLAESSAFGDIGPWSTRMGYGPLVRATTGVTRLWTSDDAREHDDDGRHAFYDATTIFPDHVVGRVTAIAALAALIHRDRAGAGAHVHISQAEVVVNQLDTLYVTQAALAAGVAQIRPDTGLHAVYPCAGDDEWCVISIRSDDEWRRAASVFDHAEWADDPRFGTAEARLAHRRELVELVSAWTRTRTPVRAAELLQAAAVPAGPMNRPPDILEDPQLIARNLYRPMRHPLIDNPLPAETGPAPFRHIPPARQAPAPLPGQDTVAICCDLLGMNTADIRRLIDERVLFGPADPAGPAPGPTARPDS

SEQ ID NO: 3562 - protein, 344 aa, Mycobacteium paratuberculosis
MPGGQAVSARIHPAPLAAAGGRLSSQADPRPVVRWRHPLMTAHLSYVEAVVVGAFQGVTELFPVSSLGHAVLVPALVGGRWAQDLSVSAHRSPYLAFIVGLHVATAAALLVFFWRDWVRILAGFFSSLRHRRIRTPDERLAWLIVVGTIPVGLAGLALEQLFRTTLGKPVPAAAFLLLNGVALYAGEVLRRRVAPVADEPAVPDAEQQHGDEASDNRLAQLPLRRGVLIGAAQILALLPGISRSGITIVAGLWRGLSHEDAARFSFLLATPIILAAGVYKIPELFGPLGAGIGGQVLAGSIASFVCAYLAVRYLTRYFQTRTLTPFAIYCAVAGGASLVWLALR

SEQ ID NO: 3563 - protein, 282 aa, Mycobacteium paratuberculosis
MADTASIGLKVRDKVVVITGGARGIGLATATALHKLGAKVAIGDIDEVRVKESGAALDLDVYGKLDVTDPHSFSDFLDEVERQLGPIDVLVNNAGIMPLGRVVDESDAVTRRILDINVYGVILGSKLALARMIPRGRGHVINVASLAGETYLAGAATYCASKHAVVGFTDAARIEYRRSGVTFSVVKPTFVNTELIAGTSGAKGVRNAEPSDIADAIVKLVAHPRPRVRVTRTAGAIIASQKFMPRALSEGLNRLLGGEHVFTDAVDVEKRQAYEARARGEQ

SEQ ID NO: 3564 - protein, 804 aa, Mycobacteium paratuberculosis
VSLETSTTTPAGSPLSDRELDLIDKYWRAANYLSVGQIYLLDNPLLKEPLSAEHVKPRLLGHWGTTPGLNLVYAHLNRIIRNRDADVIYVTGPGHGGPGLVANAYLEGTYSEVYTGIEEDAEGLRKLFRQFSFPGGIPSHVAAQTPGSIHEGGELGYALVHAYGAAFDNPYLVVACVIGDGEAETGPLAAGWHSNKFLNPVTDGAVLPILALNGYKIANPTVLARIPHTELEALLRGYGYRPITVAGDDPTDVHRQLAAALDEAFDGIAAIQGAARGGGEVQRPVWPMIVLRTPKGWTGPKVVDGKRVEGTWRSHQVPLAETHDNPEHRAQLEEWLRSYGPEQLFDDDGRLRAELRALAPTGDRRMSANPHANGGLLLHDLDLPDFRDYAVPVSRPGSVTHEATRVLGTFLRDVIARNKDRFRMMGPDETASNRLDAVYGATEKVWLSATEPDDEHLAPDGRVMEVLSEHLCQGWLEGYLLTGRHGLFNCYEAFVHIVDSMLNQHAKWLATSRELPWRRPIASLNYLLTSHVWRQDHNGASHQDPGFIDLVANKRAELTRVYLPPDGNTLLSVADHCLRSRDYINVIVAGKQPALAYLDMDAAIAHCTRGLGIWDWASTARSIGAEPDVVLACAGDIPTLETLAAADILRRELPDLAVRVVNVVDLMRLQPDSEHPHGLPDREFDALFTRDRPVIFAYHGYPWLIHRLTYRRANHAQLHVRGFKERGTTTTPFDMVMLNDLDRFHLVIDVLDRVEGLASRAAMLRQRMVDARLAARMYTREHGEDDPAIANWTWEPSERNSRSE

SEQ ID NO: 3565 - protein, 237 aa, Mycobacteium paratuberculosis
MRDATATADLQASQPPGLHRFRIHLDIAVVVVVLVLTNLVAHFTTPWASIGTVPAAAVGLVILMRYRGLGWADLGLGRDHWKSGVGYALAAVAVVAAVIAIGVLLPATRPMFMNNRYATISGAMIASMVVIPVQTVIPEELAFRGVLHGALNRAWGFRGVALAGSLLFGLWHVATSFGLTSGNVGFTRLFGGGMVGMMAGVTGAVLATGAAGFVFSWPRRRSGSLIAPIALHWSLNG

SEQ ID NO: 3566 - protein, 343 aa, Mycobacteium paratuberculosis
VMSSPVTTTAMRAWRVRRPGPMDTHPLEEVTTEVPRPGPSDLLVAVRACGVCRTDLHVTEGDLPVHRDRVTPGHEVAGEVIEVGAEAGDEFGVGDRVGIAWLRHTCGVCKYCRRGDENLCPESRYTGWDADGGYAEFATVPAAFAHPLPGGYSDSELAPLLCAGIIGYRALLRAQLPPGGRLGLYGFGGSAHITAQVALAQGAEVHVMTRGDRARELAIELGAASAQGAADPPPVPLDAAILFAPVGDLVLPALAALDRGGTLAIAGIHLSDIPSLNYQRHLFQERQVRSVTSNTRADARAFLDFAGTHHISVTTPEYPLGQADRALADLSAGRIAGAAVLLV

SEQ ID NO: 3567 - protein, 99 aa, Mycobacteium paratuberculosis
MDVTAATEYLARSTTLTSVGIIGYIIIGGLAGALASKIVRGSGAGILMDIVIGIVGALIGGFILSFFVNTAGGGLIFTFFTALLGSVILLWIVGMVRRT

SEQ ID NO: 3568 - protein, 368 aa, Mycobacteium paratuberculosis
MDQVEATSTRRKGLWTTLAITTVSGASAVAIALPATSHADPEVPTPVPPSTATAPPAAPAPNGQPAPNAQPAPGAPAPNGQPAPAAPAPNDPNAAPPPVGAPPNGAPPPPVDPNAPPPPPADPNAGRIPNAVGGFSYVLPAGWVESDASHLDYGSALLSKVTGPPPMPDQPPPVANDTRIVMGRLDQKLYASAEANNAKAAVRLGSDMGEFFMPYPGTRINQDSTPLNGANGSTGSASYYEVKFSDASKPNGQIWTGVIGSANGGNAQRWFVVWLGTSNDPVDKVAAKALAESIQAWTPPAAPPAAPGGPGAPAPGAPGTPAAPGAPAAPAPAAPGAPAAPGAPAPGQAPAVEVSPTPTPTPQQTLSA

SEQ ID NO: 3569 - protein, 371 aa, Mycobacteium paratuberculosis
MSELQLRAVVSQRRFEVEFSVAAGEVLAVLGPNGAGKSTALHVIAGLLRPDRGLVRLGDRVLTDTAAGIDVPTHDRRVGLLLQDALLFPHMSVAANVAFGPHSRRPMWRRGRRAEKATALCWLREVDAETLADRKPRQLSGGQAQRVAIARALAAEPDVLLLDEPLAGLDVAAAAAIRSVLRRVVTRIGCAAMLVTHDLLDVFTLADRVLVLESGRIAEIGPVADVLTAPRSHFAARVAGVNLVNGTAEGDGALLARSGARWYAAPAAPAGPLASGQRAVAVFPPTAVAVYREQPHGSPRNTVEVTVAEMDVRGAAVLVRGAQQPDGAPGLAAEITVDAASELRLTPGDRVWFSVKAHEVVLYPATAAAER

SEQ ID NO: 3570 - protein, 258 aa, Mycobacteium paratuberculosis
LPRWVYLPAAAGTMFVVLPLLAIAVKVDWPHFWWLITSPSSRTALLLSLRTAAASTALCVALGVPMALVLARGGTRLVRLLRPLILVPLVLPPVVGGIALLYAFGRLGLLGHYLEAAGISVAFSTTAVVLAQTFVSLPFLVISLEGAARTAGADFEVVAATLGARPTTVWWRVTLPLLLPGVVSGAVLAFARSLGEFGATLTFAGSRQGVTRTLPLEIYLQRVTDADAAVALSILLVVVAAVVVLGLGARRLTGTDAR

SEQ ID NO: 3571 - protein, 357 aa, Mycobacteium paratuberculosis
MQTTFDPELVVPDEARVTEFTGDNSLSRKDLSQHPIPPGSLTWKYWGRLDVIFFGSGVVGTIAGAWPQMAKATSSSVLFTGDSSFGARSKIYKVRRQRSREYIYGTVYDAPEDAKKYGLKTRNMHKSIKGTLQDGTFHALNADTFYFGHVTFFYHLLLKVVEQLYFDGAMPRAMKEQIFEESKEWYSMWGVDDSPQPATYDDFERYLDNIERNHLVNSQVTQVMLEQFMERRVPPRWWPPVMKKFVWPWVAGRRQVVVNSFPPHVQELFNLEWTPEDEEIARRFMRMYRRLYAILERVVPLKFLYLPIAVEGFKREGVDPRKITLESAQQALRENRARRAARENASADETNGVLASG

SEQ ID NO: 3572 - protein, 255 aa, Mycobacteium paratuberculosis
MRRIGILTGLLSVVLIAGMTGCGSKSQPPPTAGKLMVFAAASLRPAFTQIAERFKAQNPGTGIEFEFAGSSELATQLTQGATADVFASADTAQMDVVAKAGLLAADPTNFASNTLVIVTAPGNPKRIGSFADLTRPGLTVVTCQRPVPCGAAAHRVEDSTGVHLNPVSEEPSVTDALTKVTSGQADAALVYVTDARTAGSKVATVNFPEAAGAVNVYPIGVLKQAPLATQARNFVDLVTSPPGQQILAQAGFAKP

SEQ ID NO: 3573 - protein, 225 aa, Mycobacteium paratuberculosis
MAVEVLVTGGDTELGRAVAEGFRDDGHKVTLVGARKSDLEIAAKELEAEAIVCDTTDPAALEQARPLFPHHLDTIVHVPAPSWEAGDPRTYSIADTASAWRNALDATVLSAVLTVQTVGDHLRSGGSIISVVPENPPAGSAQAAVKAALSNWTTGQASVFGTRGITVNAVASGRGAQPGYDGLSRSPAPVAAEVARLALFLTSPAARHITGQTLHVSHGALAHFA

SEQ ID NO: 3574 - protein, 305 aa, Mycobacteium paratuberculosis
VAIRLGLQIPNFSYGTGTEQLFPTVIAQAREAESAGFDSVFVMDHFYQLPMLGSPDQPMLEAYTALGALATATERVQLGTLVTGNTYRNPTLLAKVITTLDVVSQGRAILGIGTGWFQLEHDQLGFEFGTFTDRFNRLDEALEIILPMIRGERATFEGKWYRASDAFANPRYRDRIPLMIGGSGEKKTIPLAARHFDHLNVIAGFDELPRKLDAVRRACEEVGRDPATLETSTLTTVMIDDNASLDQIPAEMTQRMVVGNPDSVADQIKTKVIDAGIDSVIINLPFHTPGIVQAAGEALRPLVGA

SEQ ID NO: 3575 - protein, 127 aa, Mycobacteium paratuberculosis
MTKRASAAAIAVGVAFAPTAVAHADNNGIAMAISDSTGHISIADGAASQGAAEKAAMDTCRKSISDCRLLASGQGGCMALVLNASKSKYFGAWGPTREEAEAAALARVPGGTVQEGHDHCAGEGSPQ

SEQ ID NO: 3576 - protein, 461 aa, Mycobacteium paratuberculosis
MSPHSGSTAGPERRHQVVIIGSGFGGLNAAKKLKHANVDIKLIARTTHHLFQPLLYQVATGIVSEGDIAPPTRVVLRRQRNVQVLLGDVTHIDLAGKFVVSDLLGHTYETPYDTLIVAAGAGQSYFGNDHFAEFAPGMKSIDDALEVRGRILSAFEQAERSRDPERRAKLLTFTVIGAGPTGVEMAGQIAELATYTLKGSFRHIDPTKARVILLDAAPAVLPPFGDKLGKRAADRLEKMGVEIQLGAMVTDVDRNGITVKDSDGTVRRIESACKVWSAGVSASPLGRDLAEQSTVELDRAGRVKVLPDLSIPGHPNVFVIGDLAAVEGVPGVAQGAIQGAKYVANTIKAELGGADPAEREPFQYFDKGSMATVSRFSAVAKIGPLEFSGLFAWFAWLVLHLVYLVGFKTKVSTLLSWTVTFLSTRRGQLTITEQQAFARTRLEQLAVLAAETKRPAARRAS

SEQ ID NO: 3577 - protein, 140 aa, Mycobacteium paratuberculosis
VSEPQEAIIPPDFSAPFDREIGLQFTELSPDGARARLEVTPKLLQPMGLVHGGVYCSMIESMASVAAYTWLATRGGGNVVGVNNNTDFLRSIGSGTVYGVVEPIHRGRSQQLWLVTITDDDDRVVARGQVRLQNLEVRNT

SEQ ID NO: 3578 - protein, 139 aa, Mycobacteium paratuberculosis
MAKLTRLGDLERAVMDHLWSTPEPQTVRQVHEALSAQRDLAYTTIMTVLQRLAKKNLVSQIRDDRAHRYAPVHGRDELVAGLMVDALAQAEDSGSRQAALVHFVERVGADEAEALRRALAELEANQRNNPASAGAGPEG

SEQ ID NO: 3579 - protein, 316 aa, Mycobacteium paratuberculosis
VSALAFTILAVLLTGPVPAMLARARWPLRAPRAAMVLWQAVALAAVLSAFSAGIAIATRVLVPGPDGRPTTSILGAEGRLGWPLWTAYIGVFALTVLVGARLMVAVVRVAIANRRRRAHHRMVVDLVGMGHGAALSQPCSRTRDLRVLDVPQPLAYCLPGVRSRVVVSEGTLSTLADAEVSAILTHERAHLRARHDLVLEAFTAVHAAFPRLVRSANALGAVQLLVELLADDAAVRAAGRAPLARALVACASGRAPSGALAAGGPSTVVRVRRLGGRGNSPLLSAAAYLAAAAVFVVPTVALAVPWLTELERLLNL

SEQ ID NO: 3580 - protein, 489 aa, Mycobacteium paratuberculosis
MSSSVTPSRPTTGTAQIGVTGLAVMGSNIARNFARHGYTVALHNRSIAKTDALLKEHGDEGKFVRCETIAEFLDALEKPRRVLIMVKAGDPTDAVINELADAMEPGDIIIDGGNALYTDTIRREQAMRERGLHFVGAGISGGEEGALNGPSIMPGGPAESYRSLGPLLEEISAHVDGVPCCTHIGPDGAGHFVKMVHNGIEYSDMQLIGEAYQLLRDALGKTAEQIADVFDEWNSGDLDSFLVEITAQVLRQTDAKTGKPLVDLILDEAEQKGTGRWTVKSALDLGVPVTGIAEAVFARALSGSVAQRRATTGLASGRFGEKPSDAAQFTEDIRQALYASKIIAYAQGFNQIQAGSAEYGWDITPGDLATIWRGGCIIRAKFLNRIKDAFDENPDLPTLIVAPYFRSAIEAAIDGWRRVVVTATRLGIPIPGFSSALSYYDALRTERLPAALTQGLRDFFGAHTYGRIDEDPDKRFHTLWSADRREVPA

SEQ ID NO: 3581 - protein, 478 aa, Mycobacteium paratuberculosis
MRFLDGHRPGYDLTYNDVFIMPNRSEVPSRFDVDLSTGDGSGTTIPVVVANMTAVAGRRMAETVARRGGLVILPQDLPITAVQQTVQFVKSRDLVLDTPVLLEPDDSVSDAMALIHKRAHGVAVVAFEGRPLGLLSESSCLGVDRFTRVRDVAMTDFVVAPVGTEPRKIFDLLEQAPIGVAVVTNTDGTLAGVLTRTGAVRAGLYTPAVDAQGRLRVGAAIGINGDVGAKARSLVEAGIDLLVIDTAHGHQVKTLEAIRTVASLELGVPLVAGNVVSADGTRDLLGAGANIVKVGVGPGAMCTTRMMTGVGRPQFSAVVECASAARELGGHVWADGGIRHPRDVALALAAGASNVMIGSWFAGTYESPGDLMRDREDQPYKESYGMASKRAVVARSGAETAFDRARKSLFEEGISTSRMGLDPARGGVEDLIDHITSGVRSTCTYVGAATLAQLYERVVVGVQSTAGFAEGHPLPLGW

SEQ ID NO: 3582 - protein, 89 aa, Mycobacteium paratuberculosis
MPAGSPENHVSAELLGILRDDLNVDVSRVTPDARLVDDVGLDSVAFAVGMVAIEERLGVTLTEEELLSCETVGDLQAAIAAEPRETRDE

SEQ ID NO: 3583 - protein, 521 aa, Mycobacteium paratuberculosis
MSELAAALTAAMRTGGSDLVVFDRESAAWRRHRWPEVHGLAEGIAAWLLDRDRPAALGLVGEPTLEFVAAIVGAWLAGAGVSILPGPVRGAEGRRWADTTLTRFAGIGVRTVLSHGSHLDALQALDPSRPDEMVVEDLAVAANTGRRCPEPPAPHANPAILQGTAGSTGTPKTAALSPDAVLANLRGLNARLGVTPADVGCSWLPLYHDMGLSFLLASALGGMSLWLAPTSAFTASPFRWLAWLSESRATITAAPNFAYNLVGKYARRVSGVDLGALRVAINGGEPVDCAGFERFTTAMAPFGFDAGAATPSYGLAEATCAVSVPAPGTGLRFADVSDETGTRRHAVLGAPIPGTEIRISPRHDAPDGIGEIEIRGASMMDGYLGHAPIDHQNWFPTGDLGFFSDDGLVVCGRAKELITLAGRNIFPTEIETVAAQVPGVREGAVVALGTGENSARPGLIIAAEFAGRDRAGARAEVIQRVASVCGVVPSDVIFMAPGSLPRTSSGKLRRLDVRRSLEAVD

SEQ ID NO: 3584 - protein, 388 aa, Mycobacteium paratuberculosis
LSAATTADIDHYRTVLAGAFDDQVLEWTREAEARQRFPRELIEHLGARGVFSEKWCGGMLPDVGKLVELARALGRLSSAGIGVGVSLHDSAIAVLRRFGKSDYLRDICERAIAGQAVLCIGASEESGGSDLQIVRTEMSSRDGGFDIRGVKKFVSLSPIADHIMVVARSIDHDSASKHGNVALIAVPTSQASVQRPYAKVGAGPLDTAAVHIDTWVPADALVARAGTGLAAISWGLAHERMSIAGQIAASCQRAIGITLARMMTRRQFGRTLFEHQALRLRMADLQARVDLLQHGLNGIAAQGRLDLRAAAGVKVTAARLGEEVMSECMHIFGGAGYLVEETPLGRWWRDMKLARVGGGTDEVLWELVAAGMAADHGGYRSVVGASSA

SEQ ID NO: 3585 - protein, 111 aa, Mycobacteium paratuberculosis
VLISPTSNYIGAAKDLISRYYDAEPYDLGLHAAIADVKLVNRGLGPMLLPRIVASVFATEPRCRRVMFDPDHRNTTARRLCEYAGCRFLGEHDTTNRRMALYALDAPTTDR

SEQ ID NO: 3586 - protein, 454 aa, Mycobacteium paratuberculosis
MNVTVTVVSIVAIAVLIFGNAVFVAAEFSLTTLDRSTVEANARTGGRRDRWIRRAHHRLSFQLSGAQLGISATTLAAGYLTDPMVEDLPHPWLDAVGIPDRVGDAIMAFLALLIVTSVSMVFGELVPKYLAVARPMSTARAVVAAQLLFSALLTPAIRLTNGAANWIVRRLGVEPAEELRSARSPQELLSLVRSSARSGALDAATAALVRRSLQFGTLSAEELMTPRSKIVALQTDDTVADLVTAAAESGFSRFPIVDGDLDETVGIVHVKQVFAIPRAARAHTLLTTVAQPVPVVPSTLDGDAVMAEIRANSLQTALVVDEYGGTAGMVTVEDLIEEIVGDVRDEHDDATPDVVPAGTGWRVSGLLRIDEVAAATGFRAPEGPYETIGGLVLREIGHIPAAGETVKLPALDPDGLLDPVLRWQARVIRMDGRRIDVLELTEIDAHAEAPGGRR

SEQ ID NO: 3587 - protein, 346 aa, Mycobacteium paratuberculosis
MSDTMGVLLACLLIGVNAFFVGAEFSLISARRDRLEALAEQGRAAAVTVIRASEQLPSMLAGAQLGVTAASLLLGRIGESAVSNLLRTVLGLTRIHPALLHTLSLAIALAIVVTLHVLLGEMVPKNIALAGPERTAMLLVPPYLAYVRAARPFIAFYNRCASVVVRALGVEPKEELEITVSPVELSEMIAESESEGLLDREEHTRLTRALQLRHRVVGDVAVPLARVHAVPVAAPGSGPTVGAVEQALAQTGYSRFPVTNPTGDFIGYLHIKDVLTLDDDPATVINLAKVRPLPRLPRSLPLADGLSRMRRSNSHLALVTDQGGAVVAMVAMEDLVEDLVGTMREA

SEQ ID NO: 3588 - protein, 734 aa, Mycobacteium paratuberculosis
MTDRVSAGNLRVARVLYDFVNDEALPGTDIDPDSFWAGVDKVVTDLTPRNQELLRRRDELQAQIDKWHRQRVIEPLDIDAYRDFLIEIGYLLPEPEDFTITTSGVDDEITTTAGPQLVVPVLNARFALNAANARWGSLYDALYGTDVIPETDGAEKGSSYNKVRGDKVIAYARNFLDQAVPLESGSWADATGLSVEDGRLQVATADGSVGLAEPAKFAGYTGQLGSPDWSVLLVNHGLHIEILIDPQSPVGKTDRAGIKDVVLESAVTTIMDFEDSVAAVDADDKVLGYRNWLGLNKGDLSEEVSKDGKTFTRVLNADRTYTTPDGQGELTLPGRSLLFVRNVGHLMTNDAIVWSDGDEEKEVFEGIMDALFTGLTAIHGLKTGEANGPLQNSRTGSIYIVKPKMHGPDEVAFTCELFSRVEDVLGLPQGTLKIGIMDEERRTTVNLKACIKAAADRVVFINTGFLDRTGDEIHTSMEAGPMIRKGAMKNTTWIKAYEDANVDIGLAAGFKGKAQIGKGMWAMTELMADMVEQKIGQPKAGATTAWVPSPTAATLHAMHYHYVDVGAVQEELAGKKRTTIEQLLTIPLAKELAWAPEEIREEVDNNCQSILGYVVRWVAQGVGCSKVPDIHDVALMEDRATLRISSQLLANWLRHGVITEEDVRASLERMAPLVDAQNAKDAAYQPMAPNFDDSLAFLAAQDLILTGTQQPNGYTEPILHRRRREVKARAAQSN

SEQ ID NO: 3589 - protein, 683 aa, Mycobacteium paratuberculosis
MGRHSAPDPDDFLDEPSPDHPVDERDDAYAFDAQGAPDEGYYPDERRYPDADFVADDDYAPEEFAPGEDLVDEDPDDYPEFPSRRPATSGPQESPASAPSLRARRLDWRGGHRSEGGRRGVSIGVIVALVAVVVVVGSVILWRFFGDALSKRSHTAAGRCVGGQEQVPVVADPSIADAIGQFAESFNKSAGPIGDHCMVVSVKPAGSDAVLNGFIGKWPAELGGQPALWIPGSSVSAARLAGATAQKTITESHSLASSPVVLAVRPELLPALSGQNWAALPGLQTNPNALAGLNLPAWGSLRLALPMTGNGDAAFLAGEAVAAASVPPGAPVTQGTGAVRTLLSAQPKLADNSLTEAMNTLLKPGDSASAPVHAVVTTEQQLFQRGQSLPDAKGALASWLPPGAAAVADYPTVLLSGSWLTREQASAASEFSRFMHKSDQLAKLAKAGFRVNGGKPPSSPVTTFPALPSTLSVGDDAMRATLAEAMASPSTGQATTIMLDQSMPGQEGGKSRLANVIGALQDKIKALPASAVVGLWTFDGHEGRSEVTSGPLADPVNGQPRSAALSAALDKQYSSSGGAVSFTTLRMIYQDMQSNYHAGQTNSILVITAGPHTDQTLDGPGLQDFIRKSADPAKPIAVNVIDFGADPDRTTWEAVAQLSGGGYQNLATSASPDLATAVNAFLS

SEQ ID NO: 3590 - protein, 295 aa, Mycobacteium paratuberculosis
LAEDVRWFAGSPLAAAFGRLALDQVAHREIAAAVDRSGRFADNFTDRGIRSAAFTALAAFGDSSDVEASRADLKRLHRDVRGTGKGAFSDTRYSALDPELWTWVAVSGLNLLYQAYLRVCGHRLSTDEKEVVYQTLRRELQFLELPSKQGKLPATLDEMLDYYDTVAAKHLADNEFLQFASRSFVAPPVPGLLPRQLRPVLRLVWPVLTSLAARPVVVCSAAVAHPTMRRLLGVRWGAREQAEFAVYVAALQLGWRWLPRRLTLEPLAYNRYQYERLRDRYRSVLLDSFAAPGRG

SEQ ID NO: 3591 - protein, 229 aa, Mycobacteium paratuberculosis
MSPDTASRPRSAGGQMVDPAMLLGLLPDSLATLDPTARTIVTAARTCFTERGFSNTTMQDIADAAGVGVATVYRRFRHKRNLVRLTIIDESVRLSTLISDVAGRAASAEEGIAEVFAAFVHEASAPKLLTRSIRESPAAGELSAFLTDEHLIAISRTYIASWLRRWQERGELADDLDTEVVGEMIGRLIISLIETPKSVIPVYNLAKARDFARRYLVPLVLPAPAALPG

SEQ ID NO: 3592 - protein, 941 aa, Mycobacteium paratuberculosis
VPDHTTFAARHIGPDPQAVAAMLDVIGVGSLDELAAKAVPAGIRDRLSADGIAPGLDRLPPPASETEALAELRGLAEANTVAVSMIGQGYYDTLTPPVLLRNILENPAWYTAYTPYQPEISQGRLEALLNFQTMVADLTGLEIANASMLDEGTAAAEAMTLMRRASRGKSNRLAVDADVFAQTAAIVATRARPLGIEIVTADLRDGLPDGDFFGVIAQLPGASGAITDWAALVAQAHERGALVALGADLLALTLITPPGEIGADVAFGTTQRFGVPMGFGGPHAGYLAVHANHARQLPGRLVGVSLDADGSPAYRLALQTREQHIRRDKATSNICTAQVLLAVMAAMYASYHGAEGLTAIARRVHGHAEAIAAALGTAVVHDRYFDTVLARVPGRADEVIAAAKARGINLWRVDDDHVSVACDEATTDEHVAAVLEAFGVAPAEPVASEIATRTAEFLTHPAFTQYRTETAMMRYLRTLADKDIALDRSMIPLGSCTMKLNAAAEMEPITWPEFARQHPFAPASDTPGLRRLIGDLENWLVAITGYDAVSLQPNAGSQGEYAGLLAIHDYHASRGEPHRDICLIPSSAHGTNAASAALAGMRVVVVGCHDNGDVDLDDLRAKVTEHRDRLSTLMITYPSTHGVYEHDIAEICAAVHDAGGQVYVDGANLNALVGLARPGKFGGDVSHLNLHKTFCIPHGGGGPGVGPVAVRSHLAPFLPGHPHAPELPQGHPVSSAPYGSASILPISWAYIRMMGADGLRAASLTAITSANYIARRLDEYFPVLYTGENGMVAHECILDLRPITKATGVTVDDVAKRLADYGFHAPTMSFPVAGTLMVEPTESETLTEVDAFCDAMIAIRGEIDRVGAGEWPVEDNPLRGAPHTAECLVTTDWDHPYSREQAAYPLGKDFRPKVWPPVRRIDGAYGDRNLVCSCPPVEAFA

SEQ ID NO: 3593 - protein, 81 aa, Mycobacteium paratuberculosis
VGGRRGRVNWAAHRIRAGEFRDGQSRTPKEQHLSVNLSGTRTARNMMPLESGAGPRARTRRWGKAAATASAAESLRRPANG

SEQ ID NO: 3594 - protein, 225 aa, Mycobacteium paratuberculosis
LETQPPTRARSREGTTVSEQPRQEQLNLAEDGNAGTGERSVTAAAAPVQPGLFPDDSVPDELVGYRGPSACQIAGITYRQLDYWARTSLVVPSIRSAAGSGSQRLYSFKDILVLKIVKRLLDTGISLHNIRVAVDHLRQRGVEDLANITLFSDGTTVYECTSAEEVVDLLQGGQGVFGIAVSGAMRELTGVIADFPGERADGGESIAEPEDELASRRKHRDRKIG

SEQ ID NO: 3595 - protein, 164 aa, Mycobacteium paratuberculosis
MGEVRVVGIRVEQPQNQPVLLLRETNGDRYLPIWIGQSEAAAIALEQQGVEPPRPLTHDLIRDVIAALGHSLKEVRIVDLQEGTFYADLVFDRNITVSARPSDSVAIALRVGVPIYVEEAVLAQAGLLIPDESDEEGGTAVREDEVEKFKEFLDSVSPDDFKAT

SEQ ID NO: 3596 - protein, 250 aa, Mycobacteium paratuberculosis
VSAPDSSALAGMSIGAVLELLRPDFPDVTISKIRFLEAEGLVTPQRAASGYRRFTAYDCARLRFILTAQRDHYLPLKVIRAQLDAQPDGELPAFNTPYTAPRLVSVAGTDAGANAGLGSDTSAVAPAHVRLSREELLRRAGVDDELLTALLKAGIITAGPAGFFDEHAVVILQCSRALSDYGVEPRHLRAFRSAADRQSDLIAQIAGPVGKAGKAGARDRADDLAREVAALAITLHTSLIKSAVRDVLDR

SEQ ID NO: 3597 - protein, 159 aa, Mycobacteium paratuberculosis
VTDMDSGSQDQNGDEVTVETTSVFRADFLNELDAPAQAGTESAVSGVEGLPAGSALLVVKRGPNAGSRFLLDQATTSAGRHPDSDIFLDDVTVSRRHAEFRLENNEFSVVDVGSLNGTYVNREPVDSAVLANGDEVQIGKFRLVFLTGPKQGEDGGSSG

SEQ ID NO: 3598 - protein, 132 aa, Mycobacteium paratuberculosis
VSDIPPDLHYTAEHEWVRRSGDDTVRVGITDFAQSALGDVVFVQLPEVGAQLTAGESFGEVESTKSVSDLYAPVSGTVTAVNTDLEGSPQLVNSDPYGAGWLLDVQVSDAAALESAITALLDAEAYRGTLTE

SEQ ID NO: 3599 - protein, 279 aa, Mycobacteium paratuberculosis
VNMSQDPPDRPADPPDQGAAHGRHELPGKQPRPAIGPLRRTGLSGVLRGGRSRFGFGTLAVLLCLLLGIAIVTQVRQTESGDSLETARPADLLVLLDSLRQREGTLSAEVSELQNTLNSLQASGNNDQAAIQSAQSRLAALSILVGAVGATGPGVTVTIDDPAPGVSPEALLDVVNELRAAGAEALEVNDAHQSVRVGVDTWVAGTPGSLTIDSKTLSPSYSILAIGDPPTLAAAMNIPGGAQDTVKRVGGRMSVQQADRVDVTTLRQPKPHQYAQPVK

SEQ ID NO: 3600 - protein, 110 aa, Mycobacteium paratuberculosis
MIGIAALAIGIVLGLVFHPSVPEVVQPYLPIAVVAALDAVFGGLRAYLERIFDPKVFVISFVFNVFVAALIVYVGDQLGVGTQLSTAIIVVLGIRIFGNAAALRRRLFGA

SEQ ID NO: 3601 - protein, 308 aa, Mycobacteium paratuberculosis
MADVDRALGGYDPNAGHSAHLAARPQRIPVPSLLRALLSEHLDPGYAAAAAKRGAVDETRNRRPRVSGWLWQALAALLIATVFAAAVAQARSVAPGVRSAQQLLLGNVRATEGSAAKLAQRRNELSAKVDDVQRHALADDAEGQRLLKRLDALGLAAASTAVIGPGLKVTVTDPGAGPNLSDVSKQRVSGSRQIILDRDLQLVVNSLWAGGAEAVSVGGVRIGPTVTIRQAGGAILVDNNPTSSPYTILAIGPPHALRDAFDTSPGMQRLRLLQISYGVVVTVDVADGLTLPAGSVRDVKFAKQIGPQ

SEQ ID NO: 3602 - protein, 213 aa, Mycobacteium paratuberculosis
MSRHMEPVLPPNRVLTVPNALSAIRLALVPVFVYALLVAHANGWAVAILMFSGASDWADGKIARLLNQSSRLGVLLDPAVDRLYMVVVPVVLALSGIVPWWFVVVLLVRDGLLAATLPLLWSRGLSALPVTYIGKAAMFALMSGFPLVLLGTWDALWSRVVGACGWAFLIWGLYAYLWAFAQYAVQMTLVVRRMPKVDRAARPSTMAKVVDHG

SEQ ID NO: 3603 - protein, 777 aa, Mycobacterium paratuberculosis
VPKTNRAQPGRLSSRFWRLLGASTEKNRSRSLTLVTDSSEYDDEAAGLTDEQLRKAAGLLNLEDLAESEDIPQFLAIAREAAERATGLRPFDVQLLGALRMLAGDVIEMATGEGKTLAGAIAAAGYVLAGRHVHVVTINDYLARRDAEWMGPLIEAMGLTVGWITAESSSEERRAAYGCDVTYASVNEIGFDVLRDQLVTDVADLVSPNPDVALIDEADSVLVDEALVPLVLAGTTHRETPRLEIIKLVGELEAGTDYDTDADSRNVHLTDVGARKVEKALGGIDLYSEEHVGTTLTEVNVALHAHVLLQRDVHYIVRDDAVHLINASRGRIAQLQRWPDGLQAAVEAKEGIETTETGEVLDTITVQALINRYATVCGMTGTALAAGEQLRQFYKLGVSPIPPNKPNIREDEADRVYITAAAKNDAIVEHIIEVHETGQPVLVGTRDVAESEELHERLLRRGVPAVVLNAKNDAEEAQVIAEAGKFGVVTVSTQMAGRGTDIRLGGSDEADHDRVAELGGLHVVGTGRHHTERLDNQLRGRAGRQGDPGSSVFFSSWEDDVVAANLDRNKLPMETDPETGDGRIVSPKAAGLLDHAQRVAEGRMLDVHANTWRYNQLIAQQRAIIVDRRNTLLRTATAREELAELAPKRYRELADEIPEERLETICRHIMLYHLDRGWADHLAYLADIRESIHLRALGRQNPLDEFHRLAVDAFASLAADAIEAAQQTFETANVLEDEPGLDLSKLARPTSTWTYMVNDNPLSDDTLSTLSLPGVFR

SEQ ID NO: 3604 - protein, 335 aa, Mycobacterium paratuberculosis
VIMAGTNVWWGHGEAALLRLAEELAIPVLMNGMARGAVPADHPLAFSRVRGKALGEADVALIVGVPMDFRLGFGAVFGPHTRLIVADRVAPERKHPRPVEAQLYGDLMTILAALATAGGGDHPDWIDELRTAETAARAAERAELADDRVPLHPMRVYAELAPMLDRDAIVVIDAGDFGSYAGRVIDSYRPGCWLDSGPFGCLGSGPGYALAAKLARPERQVVLLQGDGAFGFSGMEWDTLVRHRVPVVSVIGNNGIWALEKHPMEQLYGYSVVAELRPGTRYDEVARALGGHGELVAAPGELRPALERAFASGLPAVVNVLTDPTVAYPRRSNLA

SEQ ID NO: 3605 - protein, 212 aa, Mycobacterium paratuberculosis
MTSDATPAPTLHAGRLVARRLRAGGVDTVFTLSGGHLFSIYDGCRDEGIRLIDTRHEQTATFAAEGWSKVTRLPGVAALTAGPGVTNGMSAMAAAQQNSSPLVVLGGRAPAQRWGMGSLQEIDHVPFVAPLARFAATAQSAADAGRLVDDALRAAVGAPSGVGFVDFPMDHVFSMAADDGRPGALIDLPREPEPDGAALGRAAGLLSGAKRR

SEQ ID NO: 3606 - protein, 639 aa, Mycobacterium paratuberculosis
MGAKPFKPSIDWSAAFVDSLRWLAIAWVISAVCLFGVLLAFRFLTPWGRQFWRITRGYFVGAHSVRVWLMLGVLLLSVLLSVRLSVLLSFQSNDLYTALQKAFEGIASGNDAVKHSGIHGFWVSLGIFCLLAALWVTRFMADVYLTQRFIIAWRMWLTANLTDDWLAGRAYYRDLFIDNTIDNPDQRIQQDIDIFTANAGGTPNVPSNGTGSTLLFGAVNAVASVISFTAILWKLSGDLNLFGLVLPRAMFWTVLVYVFIATVVAVWLGRPLIWLSFNNEKLNAAFRYALVRLRDAAEAVGFYRGERVERAQLWQRFTPIIANYRRYVRRTIIFNGWNWSVTQIIVPLPLAIQAPRLFAGEIAFGDVTQTATAFNNIHDSLSFFRNNYDAFAAFRAAIIRLHGLVDANSKGRALPAILVKPSEETAVELRGIEVRTPEGDQLVDSLDIQLDEGDTLVITGRSGAGKTTLLRSLAELWPYASGTLCRPDGDNATMFLSQLPYVPLGTLRTVVCYPNSPDSIADSQLHEVLTKVALAPLISRLDEDQDWAKVLSPGEQQRVAFARVLLTRPKAVFLDEATSALDEGLEYALYQLVRAELPGCVMVSVSHRPTVEQHHDQQLHLLGGGPWQLSPVEKEPARV

SEQ ID NO: 3607 - protein, 497 aa, Mycobacterium paratuberculosis
MSTEIPATVSAHDVTSWSDDVDVVVIGFGIAGGCAAVSAAADGARVLVLERAAAAGGTTSLAGGHFYLGGGTAVQQATGHDDSAEEMYKYLVAVSREPELDKIRAYCEGSVEHFNWLEDLGFQFERSYYPGKVVVPPGTEGLSYTGNEKVWPFCEQAKPAPRGHSVPVPGELGGAAMVIDLLVKRAEALGVQIRYETGATNLIVDDDGAVVGVAWKHFTETGAVKADAVILAAGGFAMNPQMVAEHTPALGQPRRTKHHGLVAPYILGNPHDDGLAIRMGVSAGGATKHMDELFITAAAYPPEVLLTGIIVNKEGKRFVAEDSYHSRTSAFVLEQPEQTAYLIVDEAHTEMPEMPLIRFLDGYETIAEMEAALGIPAGNLAATLERYNKFATAGEDPDFHKQPEYLAAQDNGPWAVFDLSLGRAMYSGFTIGGLAVSVDGEVQRADGSVVPGLYAAGACASNLAQDGKGYASGTQLGEGSFFGRRAGAHAARRAAKA

SEQ ID NO: 3608 - protein, 127 aa, Mycobacterium paratuberculosis
VHFAANACSYRGKPADFVASISLSYLGDMQLELIQPVRGENIYSDFLSDGGPGLHHICVEADSPEQLAEALARAGERGAPVVQQGVMPGGIHFAYVSAPQAGVPFVEFAYIAPEMRAFYDYIKQQQR

SEQ ID NO: 3609 - protein, 233 aa, Mycobacterium paratuberculosis
LCQTDRVGKRQQSREQIEARIIELGRRQLVDRGAAGLSVRAIARDLGMVSSAVYRYVSSRDELLTLLLVDAYSDLADTVDRARETAGEQWSDDVIAIARATRRWAVEHPACWALLYGSPVPGYHAPPERTVAAGTRVVAALFDAVAAGITTGDIRLTNDPAPQPMSSDFERIRHEFGFPGDDLVIAKCFLLWAGVLGAISLEVFGQYGADTLTDVEAVFDAQLRLLVDVLTRH

SEQ ID NO: 3610 - protein, 172 aa, Mycobacterium paratuberculosis
VAACSKWRAPLSGIAPGFAERTAPMSTRYEEPNRAARAANVVVRWLADAGVSIAGTRALRVRGRKTGKLRAVVVNLLTVAGTDYLVSPRGDTQWARNVRAASVVELGPRWRRRRMRVSEVDDAAKPQLLRRYLDRWYWQVKDYVAGLTPDSSDEQFRAAAPTIPVFALTKAG

SEQ ID NO: 3611 - protein, 225 aa, Mycobacterium paratuberculosis
MVHRLATRAFAASITVTALAATLPASAAKADVMVYPGMEIRQDNRVCTLGYVDPGLKIAFTAGHCRGGGGVVTDRGGTVIGRMAAFRDNTPSGTTVSTSQVINDYEAIVLDNGVTANNILPGGRPLVSDPGLALTPGQPVCHFGVITGETCGTVESVNNGWFTMSHGVQSHNGDSGGPVYLAPSGGPGQIVGIFNSVWGEYPAAVSWQATSEEVREDLGVRDNAR

SEQ ID NO: 3612 - protein, 294 aa, Mycobacterium paratuberculosis
LRDPVLVAIPFFLLLLTLEWTAARKLEHLTARPAPGAHQTRDSLTSISMGLVSVATTAGWKTLALFGYAAIYAYLAPWHLPATRWYTWAIAILGVDLLYYAYHRIAHRVRLIWATHQAHHSSEYYNFATALRQKWNNSGEILMWLPLPLLGIPPWMVFFSFSVNLIYQFWIHTERIDKLPRPFEFVFNTPSHHRVHHGMDKVYLDKNYGGILIVWDRLFGTFQAELFRPHYGLTKHVDTFNVWTLQTRESVAIARDWRSASRLRDRLGYVFGPPGWAPRSAGRTAAGAPVVTSL

SEQ ID NO: 3613 - protein, 239 aa, Mycobacterium paratuberculosis
VETLSAVDFLLRLGVGVGCGALIGLERQWRARRAGLRTNALVAAGATLFVLYAAATSDTSPTRVASYVVSGIGFLGGGVILREGVNVRGLNTAATLWCSAAIGVLAASGHLVFAAIGTGTVIGIHLLGRPLGRLIDRDSSADEDESLLPFLVQVVCRPKHEKYARAQIVQHAGGNDITLRGIHTGHPADDELTLTAHLLMNGDAPARLERLVAELSLQPGVRAVQWYAGDEAQASDDRR

SEQ ID NO: 3614 - protein, 106 aa, Mycobacterium paratuberculosis
MKRVLALLGIGAAALGYTAPARAEPQGDDAAFLASLDQSGITYSSPVQVIASAKAVCGLMGRGETGLQVVTDIKDQNPGMTMDGAAQFAALASNAYCPHHLAPKGG

SEQ ID NO: 3615 - protein, 461 aa, Mycobacterium paratuberculosis
MNFALQPPEITSAQLYTGPGAGPMLTAAAAWDALAAELQSAASSYAAVVNGLADEAWAGPSAAAMAAAAAPYVAWLSATSAQARTAAEQATAAASAFESAFAAVVPPAEVATNRARLAMLLASNVFGQNSAAIAAAEAEYGQMWAQDAAAMFGYASASAAATRLAPFTEPPKTTNDAGIAAQAAALGEATGRGAGTVAADATAPPSGIISQLLEALGNASRGYMDFWDQVLNTLTGSPLAGTTWQNTFGILADIGRFSTVANDSMSPINLAMTEFKMFYKLPVEGLDIPKSALGAGLGLRSAGAGLTGAVSVGVGEANTVGRLSVPPTWASATPAIRLASGLTPATAAAAAPAAGIPAGLLGQMALGSVTGGALGAVAPHVGSGRGVRVRAAKPAEPVKLDDVIAKLQRQPEAVQHWNVDKAGLDDLLDRLSKKPGIHAVHVSSGGKPTVTLPGAGPAGSA

SEQ ID NO: 3616 - protein, 414 aa, Mycobacterium paratuberculosis
VDFGALPPEVNSGRMYVGAGSGPLLAAAAAWDALGAELYSFAAAYTSTIAGLTVGSWLGPAATSMSAAAAPFIAWATTTAGRAEQVATQARLAAAAYETAFAATVPPPVIAANRSLLMTLIATNILGQNTAAIAAAEAEYAEMWAQDAAAMYAYAAASAAATELTPFTEPPRTTESSAAARQSAAVAQSAASDLPAQLSTLIDVTPTMLQGLATTPSAAAATPAASIIEAIYPITAALRPFFAAVTGAYSPIGAIILPGGWWLLSLQALGLAQNAPGVAELLGGGKAIAGGLSPLAPLRGGYVSAVTPDAGGVAGSMGRSTLVGSLSVPPGWTTAAPVLRTVTSVLPAASSATAAALPASGGAVFGEMAAASLAGRALAGAGVRTVGNGTTGAATAAAADGAATTATIIVVPAD

SEQ ID NO: 3617 - protein, 112 aa, Mycobacterium paratuberculosis
VMKRLLAALGASAMIGATIGLAAPAHADPPPVPDGDDGGFVAALQQAGFSFSSPGSAVAAGRAVCSCLNNGEPGLEVVHDVKTHNPGMDMEMASNFALLSAKYYCPHQLSKA

SEQ ID NO: 3618 - protein, 467 aa, Mycobacterium paratuberculosis
MFYGAFPPEFNSGRMYSGPGAGSFVAAATAWQNLAAELQSAAASYSTVLSGLTAGPWVGPSSLAMASAAAPYVAWMQQTAAQAAETAAQATAAATAYETAFAAHVPPAVITENRALLAQLVATNIFGQNTAAIAANEAQYGEFWAQDATAMDTYFAASATAANKLTEFGPAPKTTNEAAQPMQAAAVSSAASTPAANVAQTAASAASTTLPYSGPFSGPANLAYLYQTFMTNLFNTVPGGASFYTSMYNAVKVPLGLTTQFNDVGLLVNFPLSQWLKFAPPIGYGALPKDALGAGLGALGFGRGTLYSAISPVAGMGNAGTLVGKLSIPPSWATATPSIRTVAAALSAAGAEAVPAAALGEGSLFSSMGLAGMLGSAVGSGGPTMVRGGVRNRMTAIKDLKDKQSPEQLKRLVAQISEQPESVQHHNVDQENLDALLEQLAKKPGIHAVHLKKGDKSKVLPADAQLG

SEQ ID NO: 3619 - protein, 419 aa, Mycobacterium paratuberculosis
MLDFGAYPPEYNSGRMYVGAGSGPLLAAAAAWDELAAELQSVGASYGSTVETLTTGPWTGPSSIAMAAAAAPYVAWLQATGAQAEQAGAQAKLAAAAYETAFAATVPPPVIAANRALLATLVATNMLGQNTPAIAATEAHYMEMWAQDAAAMYAYAASSASAAQLTPFTEPPRTTNESAGPLQSAAVAQSAAQSGSNTAAHLSQLSATAQPAAQAAGNAASTTTASTQLTTPSFITNWNEFWSVVTGVYSPQSWSTIPGGPFLSFGQAYAWGQNGQGAAAYLAGPKAISGALAPLASGGNAVKPMLSSAVGAGQVSGSMGKAALVGSMSVPQGWTEAAPAIRTLAQVLPGNMAAAPAAMAGEEGVFSQMALSSLAGRAVAAAATRPVGGAAAAANSLGGVAAEADPAAATIIVIPCIEE

SEQ ID NO: 3620 - protein, 118 aa, Mycobacterium paratuberculosis
VRTGGRDMRTLALLAGAAALVGMAIPAHADSDDDAFLAALNKAGITYPDPTRAIRAGQKVCDLAGSGTTELDIIRDVHELNPAFSTAKAALFVQAAAGAYCPDRLSISDGGTNPHSNS

SEQ ID NO: 3621 - protein, 404 aa, Mycobacterium paratuberculosis
MSIYAGLPPEVNSARMYSGPGSESMLAAAAAWNALSSELRSAATDYESAIATLTGEGWFGPSAAKMSAAVTPYLEWLHTTATQAEQAGAQANAAAAAYQAAFAATVPPAVVAANRTQLANLVAGNIFGQNAGLIAANEAQYGDMWAQDAAAMTGYASASNAATQQLTPFTPPRPDTAANGIAAQANTVAQAANDAGSGDPSGGLLAWLGLAPNTNGPGQPGLAGLMNFLDGSDGNVLGSFLNNASVANLSNAFTTSGLLNPTSFVDAAVNMNSINSLNAVDSTTSGLGVLAAGLGGTANLASAAAPGAAAAAGVGQASLVGALSVPPTWGATGAAITPLAATTQVGLGAYHGFGSATPMVMEEAGAVGMPGVPLAGLPGAHEDEFSEPMYGFRPRIIGRPPAAG

SEQ ID NO: 3622 - protein, 376 aa, Mycobacterium paratuberculosis
VIDFAALPPEINSARIYAGPGSAPMMSAAAAWNTMAAEMRSAAASYGAVISELNSADWFGPSSMSMLAAVTPYLAWLTDTATRAEEAAAQANSAATAYEAAFAMTVPPAVVAANRAQLAMLVATNVFGQNTPAIATTEAEYGQMWAQDAAAMNGYAVASTAATRLTPMTAPRSNTSPEGVAAQATSVTNAAQAPAGTVQSTVSSSGLAGLLSGSDNSAFGTFTNGNFFSTAVVNGSLAGGAFNPQFIISSVQGVLAAQHATTLGGLGDFAADAEGAATADLAASTGGSVPVAAGMGRAQLVGSLSVPQGWANAATINPGQAAVPATGVTGLTDAAPAAGGPGGVAGPVGGTGRRLRRAIPKYGFRPVVMPRPPAAG

SEQ ID NO: 3623 - protein, 99 aa, Mycobacterium paratuberculosis
MMYVTAQPEAMNAAADRLQQIGTALAAQTGANSAPMTGVVPAAADPVSLLAAARFAQHGQAFQAVSAEAAAIHEMFVTTLQTSAGSYAATEAANAAAAR

SEQ ID NO: 3624 - protein, 610 aa, Mycobacterium paratuberculosis
MTRPQSTAEGARNAMVAGLLASGVSVNGLQPSHNPQVAAQMFTTATNLDPTMCDAWLARILAGEQSLDVLAGAWSSIRTFGWETRRLGVTELQFRPEVSDGLFLQLAVTSVESLACAYAVVLAEAKHYAEAAKLIDGVEPRQPVDGELLSYVRGVLYFRTGRWPDVLNQFPEGKGWRQPELKAAGAAMATTALASLGVFEEALRRGQEAIEGDRVPGAANIALYTQGMCLRHLGREDEAVELLRRVYSRDPKFTPAREALDNPTYRLVLTDPETIEARTDPWDPDSAPTRAEAEAARHAEEAAKYLAEGDAELNAMLGMERAKREIKLIKSTTKVNLARAKMGLPVPVTSRHTLLLGPPGTGKTSVARAFTKQLCGLTVLRKPLVVETSRTKLLGRYMADAEKNTEEMLEGALGGAVFFDEMHTLHEKGYQQGDPYGNAIINTLLLYMENHRDELVVFGAGYAKAMDKMLEVNQGLRRRFSTVIEFFSYTPDELVALTRLMGQENEDVITDEAAQALLPSYTKFYLDESYSEDGDLIRGIDTLGNAGFVRNVVEKARDHRSFRLDDEDLDAVLASDGTEFSERQLLRFKELTREDLAEGLSAAVAEKKTT

SEQ ID NO: 3625 - protein, 402 aa, Mycobacterium paratuberculosis
MKAQRRLGLSLTWPRLTTVFLVDIVIMVVASHCPESWQGTYRIAFWVGVGLAVLVTLLSLVTYHGITVASGLATWLWDWSADPGSALAAGCTPALDHQRRFGRDKVGVREYKGQLVSVIAVNGGEDETGSRHRHRAASPTLLVAAVASGLRQFDIHLDDIDIVSVKVRRGGPDARSAELSKLDNFGPEEWDVVGDEPTSYIRRTWLVLRMNPQRNVAAVAARDSLASTLVAATERLAQDLDGLTCAARPLTAEEIAEVDRAVLADLEPTWSRPGWRRLKHFNGFVTSLWLSPSDITTDKLEELWDDDTFATVLTIRLTARAGRPHVSAWVRYHTEKRLRRNISSGLNRLTGRQLAAVRASLPVPTARPLLEVPSRPLRADDDELSLSLAAPRESAAGVPVAQ

SEQ ID NO: 3626 - protein, 608 aa, Mycobacterium paratuberculosis
MQRSATAEANVWRGRASAAALAALLLASGALAGLPPAAAISPPTIDPAAVPPDGPPGPGAPMKQNSYCTEVGVLPGTDFRLQPKYMDMLNLQEAWQFGRGAGQKVAVIDTGVTPHPRFPHLIPGGDYIMSGDGLSDCDAHGTLVASMIGAASADGAGVPPAAPRKPVTIPTTEPPPKAPPPQTVTLSPLPQTVTMVPPPPSQEQQQPPPGPFGAPPPPPAAGPAPAGPPPGPPQGGQAPAGNHGGGTVTIPGHAGAARVTNVDNLRGPRPLDPPPAPPKPGPDAFSGVAPDVDIIAIRQSSQAFGLKDAYTGDEDPQTQAKIDNVQTMARAIVHAANMGASVINISDVTCMSARNIIDQRALGAAVRYAAVDKNAVIVAAAGDTSKKDCKQNPPHDPLQPNDPRNWNSVTTVVTPSWFSDYVLTVGAVDTEGHPLSQGNQGQASTSVAGPWVGIAAPGTDVVGLSPRDDGLINAIDGPDNTLLVPSGTSFSAAIVSGVAALVRAKYPQLSAYQVINRLTRTARAPARGVDNQVGHGIVDPVAALTWDVPDGPVKPPQQLSAPLTIPKPVPHRDMVPIWVAAGGLFGALLIGGAVFGTAMLMKRSRRQQ

SEQ ID NO: 3627 - protein, 503 aa, Mycobacterium paratuberculosis
MTAVVEVPQPDVEGISQPQAVVVGVMAGAGVQIGVLLDANAPVSVMTEPLLKVVNSRLRELGETPLEATGRVRWALCLVDGSPLRATQSLSEQDVYDGDRLWIRFIPDTEHRSQVIEHISTAVAANLSKRFAAIDPVVAVQVGATMVAVGVTAASGLLGWWRWHHNSWLPTVYAGVIGVLMLGVSVLLLMRATTQQERRVGDTLLLSSLAPVSVAAAAAPPGGVGSPQAVLGFGVLTIAAVLALRFTGRRLAIYTAIVTVSAIAALAALARMVAMTGAVTLLTCVVLVSVLIYQSAPAISRRLAGIRLPVFPSATSRWVFEARPDLPTTVVRSDGGPPVLEGPASVRDVLTQAERARSFLSGLLIGLGVLMVVSLTALSDPRTGQRWLPVLLAGFCAGFLLLRGRSYVDRWQAITLAGTAVLIVGAVVVRYALVLQSPLAVSISAAILVLVPVAGLTSAAVVPNTVYSPLFRKFVEWIEYLCLMPIFPLALWLMNVYAAIRYR

SEQ ID NO: 3628 - protein, 300 aa, Mycobacterium paratuberculosis
MDQQSTRTDITVNVDGFWMLQALLDIRHVAPELRCRPYVSTDSNDWLNDHPGMAVMREQGIVEGDQVNEQVAARMRVLAAPDLEVIALLSRGKLAYGVIDDQNQPPGSRDIPDNEFRVVLARRGQHWVSAVRVGGEITVDDVAVADSASIASLVIDALESIHHAEPAAINAVNVPLEEMLEATKSWQESGFNVFSGGDLRRMGISAATVAALGQALSDPAAEVAVYARQYQDDAKGPSASVLSLKDGSGGRIALYQQARTAGSGEAWLAICPATPQLVQVGVKTVLDTLPYGEWKTHSRV

SEQ ID NO: 3629 - protein, 98 aa, Mycobacterium paratuberculosis; identical to SEQ ID NO: 2370

SEQ ID NO: 3630 - protein, 99 aa, Mycobacterium paratuberculosis
MSFVTTQPEALAAAAGNLQAIGWTLSAQNAAAAAPTTGVVPAAADEVSALTAAQFAAYAQMYQAVSAQAAAIHEAFVNTLSTSSVSYAATEAANAAAAL

SEQ ID NO: 3631 - protein, 407 aa, Mycobacterium paratuberculosis
MLDYGAFPPEFNSARIYSGPGSGSLVAAASAWSSLAAELNAAALSYDKVVTALASEEWLGSASASMASAVAPYVGWMSTTAAQAEEAASQARAAAAAFEAALAASVPPPVIAANRMQVSQLQATNVLGQNTPLIAQFEAQYGEYWAQDAAAMYSYAGQSASASKVTPFQKAPQVTNPSGQVAQSAAVSTATANSTSTNTTKALQSLAQPASSSTTATKAATTAASTTSTDPLSEIWFLLTGQTTLPTSLGSAVNGYSPFASLFYNTEGLPYFSTGMANTFTQIAKSVGAIGGAAPAAAKALPGLGGLGGMLGGGGAAAAHPVAALGGAGSIGGKLSVPVAWSGAPAAPALGHAIPVSSISAAPEAAGGPGNLLGGMPLAGAGAGGHGAAGPKYGFRPTVMARPPFAG

SEQ ID NO: 3632 - protein, 421 aa, Mycobacterium paratuberculosis
VFDFGALPPEINSGRMYAGPGSGPLMAAAAAWDEVAAELGIAASGYHSVIAELTSGPWVGPASLSMVSAITPYVGWLSAVAAQAEETASQGRAAAAAFEAAFAMTVPPPVIAANRVLLATLVATNFFGQNTPAIAATEAQYMEMWAQDAAAMYGYAAASQTASTLSPFAAPPNTTAPEGESDQAAVVAQAAAEPAGNSAQTAANTSSQLATPQALSAGTSQAATQASSSSASQTGPFTWLTSALQNLQQSGLPTPTNNYLGLSPTFYTVMLKQTSGLGYFSNGITAFWSQLAQQLVSGPGGSTAGAGGAWYPTPQFAKLGLGNLGSVGGASHVSATSAGAGRVGALSVPQQWATLTSAVSPAVSEEGSAVQAAAGGAPGGAANGLLRGMPVGALGRRGAAAGYVNKYGFRYSVLTRPPSAG

SEQ ID NO: 3633 - protein, 64 aa, Mycobacterium paratuberculosis
VRVRLEQSKCVGHAQCYAVDPDLFPIDESGYSILAEHEVKPEDEQATRDGVASCPEMALILEED

SEQ ID NO: 3634 - protein, 364 aa, Mycobacterium paratuberculosis
MSEGQYGTFHLPRLDFATLPMSVDRGLGWKTLRDAGPVVFMNGHYYLTRREDVLAALRNPKVFSSTVLQPPGHPLPVLPLAFDPPQHTRYRKILQPYFSPHALGKSRPVLERHAAEMIAALADRGECEVMADFAHLYPFQVFMDLYGLPLQDRDRLLDWKNAVVGEKPFVTESDVEKSEQLLAYLADAIAQRRQHPGTDMLSQVMTGEGNFTDIELLGMSHLLILAGLDTVTAAIGFSLFELARRPQLRKELRDNPKQTRVFIEEIVRLEPSAPVAPRITTEYVEVGGMTLPPGTSVRLCMAAVNRDDSDSMSTNELNMDGKVHRHWGFGGGPHRCLGSHLARIELTVVVAEWLTQIPDFELPD

SEQ ID NO: 3635 - protein, 1389 aa, Mycobacterium paratuberculosis
VKRGFARPTPEKPPVIKPENIVLPTPLSIPPPEGKPWWLVVVGVLVVGLLIGMVGMTFASGSHVFGGAGAIFPIFMIGGVAMMMFGGRFGGQQQMSRPKLDSMRAQFMLMLDMLRETAHESADSMDANYRWFHPAPTTLAAAVGSPRMWERKPDGKDLNFGVVRVGVGMTRPEVTWGEPQNMPTDIELEPVTGKALQEFGRYQSVVYNLPKMISLLVEPWYSLAGDREQVLGLMRAIICQLTFSHGPDHVRMIVVSSDLDEWDWVKWLPHFGDPRRQDAAGNARMVYSSVREFAAEQAELFAGRGSFTPRHASSSAQTPTPHTVIIADAVDPQWEYVISAEGVDGVTFFDLTGSSMWSSVPERTLRFDDKGVIEALPRDRDTWMVIDEKPWFFALTDHLSVAEAEEFAQKLARWRLAEAYEEIGQRVAHIGARDILSYYGIEDPGNIDFDALWGGRTDTMGRSRLRAPFGVRSDNGELLFLDMKSLDEGGDGPHGVMSGTTGSGKSTLVRTVIESLMLSHPPEELQFVLADLKGGSAVKPFAGVPHVSRIITDLEEDQALMERFLDALWGEIARRKAICDSAGVDDAKEYNAVRARMRARGQDMPPLPMLVVVIDEFYEWFRIMPTAVDVLDSIGRQGRAYWIHLMMASQTIESRAEKLMENMGYRLVLKARTAGAAQAAGVPNAVNLPAQAGLGYFRRSLEDIVRFQAEFLWRDYFPRGISDDGEEAPALVHSIDYVRPQLFTNSFTPLEVSVGGPDVTVPAIPAAGADMPEIEGPDDDDVEGIRTPKVGTVIIDQLRKIDFQPYRLWQPPLDQPIAIDELVNRFLGHPWQQDYGTARDLVFPIGIIDRPFKHDQPPWTVDTSGPGANVLILGAGGSGKTTALQTLICSAALTHTPEQVQFYCLAYSSTALTTVARLPHVGEVVGPTDPYGVRRTVAELLALVRERKRSFLEYGIPSMEVFRRRKFGGEPGPVPNDGFGDVYLVVDNYRALAEENEVLIEQVNVIINQGPSFGVHVVVTADRESELRPPVRSGFGSRVELRLAAVEDAKLVRSRFAKDVPVKPGRGMVAVNYVRLDADPQSGLHTLVARPALASTPDNRFESDSVVEAVSRLATGQAPPVRRLPATFGLDQLRELAAQDTRQGVGAGGIAWAISELDLSPVYLNFDENAHLMVTGRRECGRTTTLATIMKEIGRLYAPGASSAPTPPAGQPSAQVWLVDPRRQLLTTLGSDYVEKFAYNLDGVQAMMGELAAALAGREPPPGLSAEELLSRNWWSGPEIFLIVDDIQQLPAGFDSPLHKAAPWVTRAADVGLHVIVTRTFGGWSSAGSDPMLRALAQANAPLLVMDADPDEGFIRGKMKGGPLPRGRGLLMAEDTGVFVQVAATEFRK

SEQ ID NO: 3636 - protein, 505 aa, Mycobacterium paratuberculosis
VAEESRGQRGSGYGLGLSTRTQVTGYQFLARRTAMALTRWRVRMEVEPGRRQNLAVVASVSAALVICLGALLWSFISPAGQVGDSPIIADRDSGALYVRVGDRLYPALNLASARLITGRPDNPHLVKSNQIASLPRGPMVGIPGAPSNFHPTGPSTSSWLVCDTVSNSTGAGAPSGVTVTVIDAAPDLSNHRKVLTGSDAVVLNYGGDAWVIRDGRRSRIDATNRSVLLPLGLTPEQVSMAKPMSRALYDALPVGPELTVPQIQNAGGAASFPGAPGPIGTVLVTPQISGPQQYSLVLADGVQTLPPLVAQILQNAGPGNTKPVTVEPSALAKMPVVNKLDLSSYPDAPLNVMDIRENPATCWWWQKTSGENRARVQVVSGATIPVAQKDVNKVVSLVKADTTGREADQVFFGPDYANFVAVTGNDPGAKTTESLWWLTDAGARFGVDDTRDVREALGLKTKPSVAPWVALRLLPQGPTLSRADALVQHDTLPMDMSPAELAVPK

SEQ ID NO: 3637 - protein, 713 aa, Mycobacterium paratuberculosis
MTELAPSLIELARRYGIATDYEDWTGRRVRVPETTLTAVLAALGVAAGTEQERNDALTAKLRAYWARRLPATIVGRTGEQIRFWGHVTHGDPAEVWVRLEDGTVRDGVEQVDNFTPPFDLDGRWVGEASFVLPTDLPLGYHRVWLRSGGSEASAALIVTPDWLGLPERLGARRAWGLAVQLYSVRSRQSWGVGDLTDLTDLAVWSAFRHGADYLLVNPLHAAGFSGPANRMEPSPYLPTSRRFVNPIYLHVEAIPEFAELTKRSRVRRLRADVQTHAAGLDAVDRDSSWAAKRTALQWLHQQPRSAGRQLCYAAFRDREGRALDDFATWCALAEEYGPDWHSWPETLQHPDAPGVADFVEKHSEAVDFHRWLQWQLDEQLAAAQSQAIRAGMSLGIMHDLAVGVHPNGADAWALQDVMALGVTAGAPPDEFNQLGQDWSQPPWRPDRLDEHEYRPFRALIRAVLRHAGGVRIDHIIGLFRLWWIPRGSAPTEGTYVRYDHEAMIGIVALEAHRAGAVVVGEDLGTVEPWVRDYLLLRGLLGTSILWFELDRDGNGGPLPAERWREYCLSSVTTHDLPPTAGYLAADHVRLRDSLGLLTRPVADELESDRADLAAWMAELRRVGLLADGETDSEQVILALYRYLGRTPSRLLGVALTDAVGDRRTQNQPGTTDEYPNWRVPLTGPDGRPVLLEDVFTDRRAAALAEAVRAAIAP

SEQ ID NO: 3638 - protein, 292 aa, Mycobacterium paratuberculosis
VAPVADGVTADPDWMVAFARHLEACGFESIVAVEHTVLLTRYDSVYPYDSSGRVGLAPDCPIPDPLDLLAFLAGHTTRLGLATGVLVLPNHHPVVLAKRVATLDALSGGRLRLCVGVGWLQEELRACGADFDNRGRRADEQLAVLRALWAHRPDGASFHGEFFTFDNVMCYPKPVAAERFPVHIGGHSRAAARRAGRFGDGFQPLGVTGARLASLIGLMRDEAVAAGRDPAALEVSLGHSVSKIDAERAARLADQGADRLVLAMPPTSDIEQAKDMLSACAQRLSLRPVSGP

SEQ ID NO: 3639 - protein, 169 aa, Mycobacterium paratuberculosis
VRAAAVAAPGERAVTLSADDRGALSDLVHRYAAGVDDRRFDAVAELFTADAELVVPAPPAELRPVHTHRGRAAITAAVAAVAAVARTEHAIVGEVYDATTPPGAARGRIACVAHHWSERGDELVDVVWHLRYDDSYQPTGDGWRISRRALTVTAIETHPARRLLPHDPA

SEQ ID NO: 3640 - protein, 661 aa, Mycobacterium paratuberculosis
MTGVRLAGAANPAGAGANFARPRAARRTPRPAAPRAARSFPDPIQFIQVRSCIFGRVTNTVDSAGTGGGRAAPGGSASALAVGTPLTSIPDYRNEIHTAEDVIDVEAYGGGFDLTRRATAPKLRVGRDRWFNLLWLIPIGFALLIAGVAVGKGLHNMPAVQSFIQRYPGTDSAGVPPGLPAWIGWTHFFNLFMMMFIIRTGIQILCDHPRLYFSRNATPGKDEWLRVGPPVPDDELWTANADTVALPPQFGLPGFRHSIGLARWWHLGVDVLWLLNGAVFYVLLFATGQWRHIVPTSWDVFPNAASVAVQYLSLDWPTDNGWVAYNGLQLLSYFTTVFIAAPAALITGLGMSPALSQRVHWLSKRLSIQHARSLHFLVLVYFLFFILVHVTMVLTTSALRNLNHMFAARDDNSWIGFGIFSAAMVLTAIAWVWATPFTIRHPRVVQRVGYALVGPFQRMLEQLDPKPGAFTEKDISPHHWRNGRLPETVEYKELEANDFKDWRLKVYGLVEHPMEFSLEDLMALPYHEQISQHFCIQAWSGVAKWGGVQMKTIMDIVKPLPEAKWAVFYSMGLGATGGIYYNAHHIGQMDHHMTMLAYKMNDQQLPYMHGRPLRLRNELQHGFKLVKWIKGIEFVADYRDIGSGYGGYSEDHKYFGRHQTL

SEQ ID NO: 3641 - protein, 96 aa, Mycobacterium paratuberculosis
MRHSPVQHARIVGRGQPIRYPSARDAAPTSGLAAVGVAAVAFVVCVANFALGHAGAGVTAAIVAMLAFGAGLAWLAMDRRRIRQEQRDWTISRPAR

SEQ ID NO: 3642 - protein, 151 aa, Mycobacterium paratuberculosis
LARVDVSVSSELEPETAWKLASDLDRFGEWMTIFAGWRGPVPDTIGEGTRVASCVKVKGFRNVIHWTVTRYDEPKSIELQGRGRGGIRLTVAMTVTDDHPGSVFHLTADIDGGVLSGPIGGLVARVLRSDVHKSVHNLAALQPSGPSAPGG

SEQ ID NO: 3643 - protein, 186 aa, Mycobacterium paratuberculosis
MSNHDYVTYEEFGRRFFEVAVTPERVAAAFADIAGSEFAMEPIAQGPGKIAKVSANVKIHEPRVTRRLGDTITFVIHIPLSIDLLVDLWLDKQRFVVSGDIALRATARAAEPLLLIVDVAKPRPSDITVNVSSKSIRGEVLRILAGVDGEIRRFIAQYVADEIDAPHSQAAQVIDVAQQLEQAWPG

SEQ ID NO: 3644 - protein, 616 aa, Mycobacterium paratuberculosis
MPQDVTEPRPGPARVAGVLIWLGGGEAGGPGERHERSAHAVAGAVVLLGSALAWLLAGLAAAGRWPLPALVPATLVFGLLLGAIVRGTAAPAAGANHPVARGAVAAAVGVVVGELAALVILSDPIDQRLDERASRTADSAPAVVTASATLRQAEEARAALDGAVAQARDRQDRALVVARCEYHPTPGCPQTRITGVPGPGPETRTANELLADAQRELDEALAARDSRAPELDAAVSRAQRAVADARRAAMADAGRGPGARWIAMNDVTAGNAGALALRLLTIGGCVLLYLTPLILGLWRGETSHDRRAAARARRERAELDADTAIAIKRAEVRREAEIMWAEHQLTQARLAIEAQTEIDREHQRRRVLDAVADPPPPRAFEPTSELTSELTSEPARDDVYLPIAAEAEAASRAITQAPQPRVECDPGPQQLPSSPPPNDAVEQDRSTPLIPSIPDATKAAARWIRPLAPPLVARMMDTTTHRLTHPLRTARQVFEGVVEETEEITFALRRTRKVTVNSQATQTASADPTEDTEDTESRAAGPDFVTSTRQQPGPRAHRRMTGRDTRSSLPRSSAPDAGKLSVPSAADDRAELTQRDGPAELQPPDGPRQLPPAPPH

SEQ ID NO: 3645 - protein, 95 aa, Mycobacterium paratuberculosis
MTSNWVPTQTSCGPHSGRILDTARGILIGLRRCPSEAALDELHSAALRHKVPVFAMAWALVHLAGAGQQTPSFVDAQSAARREWGPLFESAAVPC

SEQ ID NO: 3646 - protein, 55 aa, Mycobacterium paratuberculosis
VDTSCGALPNPPPEAAGEEFLRYASSRPQTSKAPCAMICRSVAICQTTTGIDMRL

SEQ ID NO: 3647 - protein, 149 aa, Mycobacterium paratuberculosis
VFLQPDKYWAGFCRRIGLAELADDARFVPSSNLIANAAAATELLANTFARHDLSHWQTVLADEPGVWGALATPRETLNDPQVEPSGYVVTNVDDHGEKYRIVAAPVQFDETPPAPARAPEHGQHTEEILLELDVDWDDIAKAKALKAIL

SEQ ID NO: 3648 - protein, 293 aa, Mycobacterium paratuberculosis
MSGVHGGVLRGVRVVELASWTYVPSAGAALADWGADVIKVEGVSSGDPGRALVVGGFTREAARPDADFILELGNRGKRSIANDIKSETGRELFGRLLASADVFLTNWLPGALERARLTVADIRSFNPRIIVARGTGLGVRGPDRDRGGFDAATYLARGGVAYTLTPFGSETPAVQGPGFGDLQAGATLAGGVCAALFHRERTGEPTIVDSSLLAQAMWSIAPSISAADSSTSTASRGRRRAWPSTRWSTGTGPKTAGGSSWCSCSRTSTGRASAGASAWPNWPTTRVSSRRAT

SEQ ID NO: 3649 - protein, 290 aa, Mycobacterium paratuberculosis
MGRVTGKVAVISGAARGQGRSHARMLAAEGADIIAVDLCADIETNEYPLARPEDLDETARLVEKEGQRAITAVADVRDRVALSAAIDAGVAEFGHLDIVVANAGICPLTAGLPPQAFADAVDVDLGGVLNLVHASLKHLRAGASIIVIGSNAAFMSSLNTSGAGSGIGGPGGAGYAFAKLAAAHYVNDFALALAPFSIRMNAVHPTNVDTDMLHSPPMYRAFRPDLPAPTREDAEPVFPLVQAMPVPYVEPEDISEAVLFLASDAARYITGQQLRVDAGGFLKVKPWSVG

SEQ ID NO: 3650 - protein, 330 aa, Mycobacterium paratuberculosis
MTQSAKTSPDIHRRLYALMVLMKTADDRLSRGIGTGEFLCVYWPSRGQEAIAAAMGVTLRPDDQLVTTYRGLHDLIGKGVGLEEIYGEMMGRTIGAGRGKGGTMHIAKPEVGVMLSTGIVGAGPPVAVGLAMAARRKGLDRVTVVSFGDGATNTGSFHEAANMAALWDLPIVFVCQNNRYAEMTPTTDTMKLEHVADRAAGYGMPGVRVDGNDPLAVTAALEEALRRARAGSGPTFLECETFRFRGHYFGDRMPYIPADQLQAALAADPVPRFRRRLAETGVCGEAELARIDDDAAATVEAALRTVLGADSPAADELDRDVYAAPIPFPT

SEQ ID NO: 3651 - protein, 336 aa, Mycobacterium paratuberculosis
MADQEMTMREALNLALDQALAADERVFLLGEDIADPGASGPTAGLSTKYGRDRVLDTPISEAAIVGAAIGAAIDGLLPVAEIMIMDFIGIAADQLINNAAKLRFMTAGRTSAPLTVRTQVYAGLSTGATHSQSLEAWFMHIPGLKVIVPATPRDGKGLLSSAIFDPDPCLFIETIRLQGKKGLVPVDPGFRIPLGQADIKRPGTDVSLIGYGRPVHDALAAAAMLGDQGVSAEVVDLRTLVPLDVDTVVASVRRTRRAVIVHDAVQFAGPGAEVAAILHSRLFSELAAPVERVAARFVPNPAAAALEAQVYPSPERIAVAALKTLGRTLTGATAHG

SEQ ID NO: 3652 - protein, 78 aa, Mycobacterium paratuberculosis
MADFIIRIPRVSVAVSEAELTGLLVGAGEHVEAGTPIYVIATEKVEQEIEAGASGTVRWTGQVGTTYQIGAEIGVITS

SEQ ID NO: 3653 - protein, 290 aa, Mycobacterium paratuberculosis
MDLNETRERIIYQKEGPIARVTLNWPEKANAQDQKLAEEVDAALADADRDYDIKVLIMKANGKGFCSGHAIGNNAVDYPAFVEGAKVMGTPWKPQTDLFVKPILNLWEFSKPTIAQVHGYCVGGGTHYGLTTDIVIAAEDAYFSYPPLQGFGMPSGECSIEPWIFMNWRRAAYYLYLAEVIDARKALEVGLVNEVVPRDQLDERVEAIARHIAQAPMTTLLATKANLKRAWELMGMRVHWQSSNDLVALASISKDVQELIQTVFKDKVLPSEQARRQAAAAAQTDGAATT

SEQ ID NO: 3654 - protein, 416 aa, Mycobacterium paratuberculosis
VNIAEHALAAAQSPALITDGGTISYGELHDRSRRVAAALHELGLRRGDGVALVLPNRPEFLEITWGCQLSGLYYTPVNTHFTADEVVYVIDDSDATAVFVDASLPGIAARLRSANPAVHIGVGGKLPGWRDYEGVLGAAGDAPPVSDGSEMLYSSGTTGRPKAVRRPLPQDGNGSWAQSVLELALIHKYGMTQRSVYLSPAPLYHAAGVNYTMAVNRVGAASIIMRKFDAETVLRLIETHRVTHAQFVPTMFVRMLKLPEAVRDRYDVSSLRCVIHAAAPCPVDVKHRMMRWFGPVIHEYYGGTEGFAGTTIGPQEWLAHPGSVGVPLAPVPCSTRTGGKSRSARPVSCISKAGPTSSTSRTPSKPRRCTTSAAGARWATWAISMRTATSTSPTARRSRSCPAGSTSIRRKSRTCS

SEQ ID NO: 3655 - protein, 175 aa, Mycobacterium paratuberculosis
VLDEDGREVPVGQTGELYFEGGPDFEYFKDPVKTASVYNERGWRSLGDMGHLDEDGYLYLTDRSTFTIVSGGVNIYPQEVENLLVMHPKLLDAAVFGVPNDEFGEEVKAVVQPADGVPPGPDLAAELIAYCRAHLAGYKCPRTVEFDTLPRDPNGKLYKRRIRERYWQGRESRIV

SEQ ID NO: 3656 - protein, 461 aa, Mycobacterium paratuberculosis
MAVETSKPHTGVNATPVPVPWAVQTPDRIPKQRYYDPEFYALEKEMFWPRVWQMACRLEEIPKPGDFVEYEIHDESVIVVRLDSQTVRAYHNACRHRGVKLVEGNGNRRTFVCPFHGWCWSLDGRNTFVLRPETFAQENLAAADLRLVSVRCELWGGCAWINLDDDAPALRDWMEPFASTYDAWRVESLRVEWWQSCRLPVNWKLATAAFMEGYHVPQTHPQLLPGAQTGEPSAAVHPVVASSLYFMRTLGEGMAGMTHQNDIRIAEGLQTMRLPSDPAAAMAAWRSALNDAVVDWHRARGSGMPDLNELDRRGITDAIGFAFPHHFILPTYSSASSYRIRPLGPEETLFEIWSLTRLPGDASAGKPTPPEPMAPDDPRWPPIPAQDFSNLPRQQKGLHSKSFEFMRLSDRIEGLISNFERVIDGFLAGLRYDALLPAIHKTNTTIDVPIVDLGFGAVEAR

SEQ ID NO: 3657 - protein, 581 aa, Mycobacterium paratuberculosis
MSVTWDRSVDLLIAGSGGGGMVAGLAALDSGLEPLIVEKQSLVGGSTGLSGGIVWLPNNPLMRAEGVADSHQDGLAYLADVVGDIGAASSPERREMFLTAGHEMINFLTRRGVALIRCAGWSDYYPNHKGGNASGRAVEAVPFDAAKLGSWSGRVQPPLARNYGYVVLTNELRSVQYFNRSARTFAVAARVFARTAAARMRRRQLLTNGASLIAHMLKALLDLSDGQPPLWSDAALTELVVEDGRVVGARVVRDGRACAVEARKGVLLAAGGFGHNKQMRRRYSGDQPNEGQWSIANAGDTGEVLEAAMRLGAKTDLMDEAWWLPSVFIANGGAVAASLGSGRQRPGAIYVDSTGRRFCNESNSYVEVGKAMYANKAVPCWMIFDDGYVRRYVTSANPLKTLRRHQPLPAELIESGAVKRAATIARLAGETDLPADELARTVERFNRFAAKGLDPDFGRGQSAYNDCLGDPGYRPNAAIGPLDTAPYYATRVFPADVGTCGGVITNEYAQVLDQHDRVIEGLYATGNTTATVMGRTYPGAGASIANSMVFGYVAARHAAGRRIAGTPPRAIAGVPPRRVCD

SEQ ID NO: 3658 - protein, 301 aa, Mycobacterium paratuberculosis
VSSAKPISAGPVSGNVCLMERRVLEAVIYEREPPIARIVLNRVDKANTKDAVLVTEVDDCLHEADRDKDIKVVIIKANGKGFCGGHVARWGPDENPYPDFGETFEDLYKGTADLFLWPTLYLWEFPKPTISQIHGYCMGGGIYLGLLTDFCVASEDAYFQMPLAQSLGEPGGHTMIEPWLMMNWHRTMDWLLLAPTLSAQQALDWGLLNKVVARDDLEDTVEEMARKIARIPLTTLMAVKNNVKRAWELMGMRVHLQVSHILTNMVGAASDVQARRAELMRSGMKPREFVDKPDEKGSPPT

SEQ ID NO: 3659 - protein, 497 aa, Mycobacterium paratuberculosis
MIRASRTGLSRGDRFCQPAISPPRAGPRDVLVSHPVLPERHRKVTTPKTFADLGVPARIVDALTARGITSPFPIQAETLPDTLAGRDVLGRGKTGSGKTLAFSIPLVGRLSTGNRRPARPTGLVLAPTRELATQITATLEPLAAACGLRVSTIFGGVSQHRQVTALKAGVDIVVACPGRLEDLMRQRLITLEAVRVTVIDEADHMADLGFLPGVTRILAATPNDGQRLLFSATLDNGVDKLVTRFLRDAVLHSVDEANSPVSEMTHHVFHVDSVQAKKELVHRLASGTGRRILFLRTKHQARKVARQLTESGVPSVDLHGNLSQPARERNLAMFAAGSARVLVATDIAARGVHVDEVELVVHIDPPSEHKSYLHRSGRTARAGSAGDVVTVVLPEQREHTRALMRKAGIDVAPQRVTAGSQAVHALVGPIAPPKPPAAAGVPSHPAGPHRPAAAGQRRRRSGRSARTTAAHAVPHRPAAPVRRPDRRRASRAQGSAG

SEQ ID NO: 3660 - protein, 193 aa, Mycobacterium paratuberculosis
MRMGEADRHRWDERYAANGPPPLSSVAPPGVFARHADVFPAAGRALDLACGQGTAAVWLALRGLRVLGLDVSPVAIGQARDLARRAGVGERCRFDVADLDRGLPVGPPADVIVCCKFRDRRLDRAIVERLAPGGLLAIAVLSEVGAGPGPFRAAPGELTAAFADLQPIAAGEADGQAWLLARPSQSEPVVERR

SEQ ID NO: 3661 - protein, 198 aa, Mycobacterium paratuberculosis
MRHRRSSPAAPPTGPARRSDRRPGQTIRKVLDAGLQELRESSYAGLTMRAVATRAGVSPASAYTYFPSKSALVAAVYLRFLRDLPVHTDVNETAQRRVSATLRDMAVVVADEPELTAACGAALMADDPAVKPLREQIGEEVSRRIAAALGPGWPRAVKSTLQMTFSGALMTARFVSFAEISGQLDEAVDLILGAARAS

SEQ ID NO: 3662 - protein, 597 aa, Mycobacterium paratuberculosis
VPAGQKGRPMGYDTVITNGRWFDGTGGPSAMRDIGVRDGRVVTIAAGPLDTAGATVIDASGQWVIPGIIDIHTHYDVEILCEPELSESLRHGVTTVLLGSCSLSTVYLDNVDAGDIFGRVEAIPRRYVIEHLEAARSWTNPKEYVAELERRNLGPNVAAFIGHSDMRAATMGLDRATRKDVRPSAAELARMEAMLNEALDEGFVGMSSQQLLFDKLDGEVCRSRTLPSTYAAPRELRRLNAILRRRDKILQSGPDITNPLSVLSQLMTSLGFGRPRLKTSLLSAADIKAIPFVIHVMDRLARVVNALGGDFRWQHLPVPFEVYADGISLVVFEEFGSGAAALHLQTEIERNRLMRDEGYRRRFRKDYDSRFGPRVWHRDFFDAEIVACPEQAVVGKSFGQVGLERGGLHPVDAFLDLVVEHGERLRWRTTISNHRPEVLRKMAQSPTVQMGFSDAGAHLRNMAFYNSGLRLLRHAHDAQKAGKPFISMEHAVHRLTGELGRWYGIDAGTLRVGDRADIVVIDPARLDESLDRYAEHPVASYGGLSRMVNRNDDTVTAVLVAGKLAFGSGRAAPQLGRQRYGQFLRAGRPSRTLVSTG

SEQ ID NO: 3663 - protein, 224 aa, Mycobacterium paratuberculosis
MRSHGWAGNTPASDAEAIERILDAADRIIAERGSALRIADVARALGVTRQTVYRYFPGTQALLVASAMRSADGFLDRMAAHLDGVTDPVVAITEGMAFAVEELACDHQVEFVLNQRHRGGQKVSIISDTALAFGRSMLHRYDIDWESYGFDEAGLEELNEFSLRVLHSFLTDPGRPPRTGADLRRYLTRWIGPAIAYPQLLRAMDALGAAEPQQRPRRRASKAS

SEQ ID NO: 3664 - protein, 234 aa, Mycobacterium paratuberculosis
VLWQDRDVKARPLAGLSCAVLSPFWALLLGPALVGPAAPAAADSCPDVEVVFARGTSEPPGVGRIGQSFVDTLRSRLGAKSVGVYPVNYPATTDFPTAADGISDAGAHVQQMAANCPRTKMVLGGYSQGAAVMGFVTESAVPDGVQLVQSLQPMPAAVANHVAAVALFGKPSAQFMSIINEPPVTIGPLYAAKTIELCVPGDPICSGAVNPAAHRQYVEAGMVDQAVDFTTDRV

SEQ ID NO: 3665 - protein, 299 aa, Mycobacterium paratuberculosis
VAAVSGADALLSGRGAVVSGGSRGIGRAVAELLAGLGAGVVVNGRDPQAVQETVAAITAAGGRATAVVGAADDERIARSLVDECIGAFGRLDALINCAGIAEPAGSSILNITADEFDHLIGAHLGTAFHTCRAAAPVMVEQRHGSIVNTSSVAFLGDYGGTGYPAGKGAVNALTMAIAAELKAYGVRANVVCPGARTRLSTGADYERHIEDLHRRGLLDDMTRQASLDSAPPVFVAPVYGYLVSDLARDVTGQILVAAGGFVGSFDRQTPRLLGYRDHHRAGPWSIEEVHTMIGAAATP

SEQ ID NO: 3666 - protein, 269 aa, Mycobacterium paratuberculosis
MTNAIAPTPTAARPTSQSDDSYEDVVEMFLELRRMPAESHEYRRQRERIVARCLPLADHVASHFARRGEGLDDLVQVARLGLMNAVNRFDPAKGPSFIGFAVPTMMGEVRRYFRDYSWGMRVPRRLRELHVQISRTTADLAQQLGRAPNAGELSQVLEVPREEIVECLVAGDAYRLDSLDAPQGADSSGTPRSVADSVGDIDPQIEHITNREALRVLVATLPHREREVLRMRFFESMTQSQIAERIGVSQMQVSRILANTLRCLRDQLE

SEQ ID NO: 3667 - protein, 201 aa, Mycobacterium paratuberculosis
VAATTALAVSVAGCGSNNKSQPSTSKTGSATSSTSATSPAAAPPSSPAPATPNEYAKLLIQASDINAPVPFTGAPPTDNPNGQPGVSTTFKDEDGSHAIKITIGIYDDPGAATNALNAAKGQQGAVVKDPSTQPSNIGSGGTTLMGNAPDRSKGVVVLLFTEGKALATLEFDGPTDTLAPPEFVNDVGQKQDAAIKKGLGG

SEQ ID NO: 3668 - protein, 163 aa, Mycobacterium paratuberculosis
VNVINGMPAHALLVHFVLVLVPLTALLDIVCGLWPAARRGQLMLLTVILAVVTMALTPITIDAGGWLYDQRADPSPILQEHATLGSAMTYFSAALLAVAIVLALLGLIERRSDKRRLLTRGVVAVLALGIGIASMVQIYRVGDAGAQSVWGGEIAHLKKAHPG

SEQ ID NO: 3669 - protein, 141 aa, Mycobacterium paratuberculosis
MGHGRPIVEGVEALLRFATKGRLGVLDLAGLPNVRITVSGRKTGLARSATVQYVPFRDGLLLVGSNWGRRRHPSWSANLKAAQRVTVRRRGHRFVAAVQLLSGQERDAAWAAALAHWPNYGLAQELAGARRFRLFLLTPTG

SEQ ID NO: 3670 - protein, 239 aa, Mycobacterium paratuberculosis
MTAERIARSDRSTGTREAILSAAEVLFAERGMYAVSNRQISEAAGQGNNAAACYHFGTRVDLLRAIEGKHREPIEKLRAQMLAAVGDSTELRDWVGALVRPLTDHLSALDTPSWYARFAAQAMADPSYRHVVTKDALSSPLLVRTLDGINRCLPELPRRVRAERMVMVRNLLMHTCAEHEGALAEHGPRSRSAWPVAAEGLIDAIVGLWRAPVHVAAAAGPTAQTTAPATGQTDHRGAP

SEQ ID NO: 3671 - protein, 409 aa, Mycobacterium paratuberculosis
MTQPSTDADTDIPDFPMTRAPGCPFAPPPKVLQLNADKQLSRVRIWDGSTPWLVHGYQAIRALFADARTSVDDRLPGYPHWNEGMLATVHKRPRSVFTSDAEEHTRFRRMLSKPFTFKRVEALRPAVQKITDDHIDALLRGPNPGDIVSTVSLPVPSLVISELLGVPYEDAEFFQTQAQRGMGRYATEEDTAQGAASLAKYLANLVRAKMQSPSEDLVSDLAERVNAEEISVREAAQLATGVLIAGHETTANMISLSVAALLEHPDQRALLCDTDDPKVIATAVEELMRYLSIIQTGQRRIAIEDIEIGGETIRAGEGIILDVAPANWDARQFPNPDRLDLRREDGPHVGFGYGRHQCVGQQLARMELQIVLPTLLRRVPTLRLAAPLDELPFKHDALAYGLYELPVTW

SEQ ID NO: 3672 - protein, 315 aa, Mycobacterium paratuberculosis
MVKPNLTLEIPDLRGKFAVVTGANSGLGFGLAKRLAAAGAEVVLAVRDPAKGDQAVAAIRREVPQAKLTIRQLDLSSLRSVAALGEQLTAEGRPIDILINNAGVMAPPRRQQTSDGFELQFGTNHLGHFALTGRLLALLRAADSARVVTVSSIAATQRKLDFADVNAEHGYQPMYSYGVAKLAQLMFAVELDRRSRLGGWGLMSNAAHPGLAKTNLLSGASYGRSAPTLQARLTRLTWRLLPFMWLDIDEAVKPTLYAAVSPDAQGARYYGPRGFYETARGGVTFARVPPLARSEPEMARLWRLSEQLSGVDYPG

SEQ ID NO: 3673 - protein, 389 aa, Mycobacterium paratuberculosis
MRAETGARLRGAMADHGVDALILLMNGYVGYATGASWPLLDAGLSHVERPVAVVLADDEHPHLFMPFRSGASAESPVPDDHLHGPAYLEFDHGVQDFARTLADLVPLRGRIAVDELTGAMRRGAATLFPSGPPTDAATVLGAAQLVKTRDELSCLHRAARITEEAIVDVQRALRPGVRQIDLSATFVRRAFELGATTNMLEAIWQVMPSSREAGVWTTHGDLALPLLPTERELAAGDVLWTDISITYAGYCSDFGRTWVVGREPTPREQDQFHCWRDILDAVLAVTKAGVTSGDLARAAIAANGGRKPWLPHFYLGHGIGPYPADAPMIGTDLGEEFDDNFVFPPGMVLVLEPVVWEDGTGGYRSEEIVVITEDGYLPITDYPYAPYGD

SEQ ID NO: 3674 - protein, 376 aa, Mycobacterium paratuberculosis
MATEVLPDAPALRLARRQRALAAMDEHGLDMLVLGRQANIRYVTGAPQLWIAGTRPFGPMCVLVRATGDIYLNSTDDEGVPEEIDHDHLYGLAWNPVTLIDVLRKVEGAESARRVGTDALTPTFAALLPEAFPNAELVDAEPAMRAARRIKTPDEMAAMGAALRVAERGLAAALAELAPGVAERTLAGAMMEAMAAGGVSTPATQDAAWVTSRERPWRRAGSGVVRPGDLVAFAAGALADGYVAEVGRTWPAGDTVGGQVRALFGRSNALYDRMLAACRPGASTGDLLAAYRAVDEPVPPMPVAHGLGLGFDPPVVSETLGAAGERDCLEAGMVLAITGYVWQRGIGAVFRRDTVHITEGGVQVLTASPTWTGQLP

SEQ ID NO: 3675 - protein, 484 aa, Mycobacterium paratuberculosis
MGCSSREEIVKVFDALDAAVDRLGELSFDALTPRECLSLLQRCETVRRRLPVPEHPLINALARDASPAELGGRLSHAIAEATLISRAEAARRVHTAADLGPRVGLTGEPLPPLLAATAAAQRAGLLGLEQVAVIRKFCHQLPGWIDQATRERAETDLANQGGQYRPEQLAALAGTLADCLNPDGLYRDEDRARRRSLTLGNQQADGMSELRGWLSPELRATLEAVLAKLAAPGMCNSLDESPCVEGTPSQHAIDGDARSAAQRNHDGLLAGLRALLASGNLGQHNGLPASIIVTTTLADLETAAGRRLTGGGTLLPMSDVIRLSRHAHHYLAIFDQGKALALLYHTKRLASPAQRIVLYAKDRGCTAPGCTAPGCTAPGCTVPGYYSEVHHCTDYATCHTTDINDLTFACGPHHRLLQPGAWTTHKNAKGETEWIPPPHLDRNQPRTNTFHHPEKLLRGENDNGEDDGDEEEDDDSGDDDDAAA

SEQ ID NO: 3676 - protein, 539 aa, Mycobacterium paratuberculosis
MIETVQQLLRQRRHDDTPAVAYGDKTWTWREHLAEAEAEAAALIARADPARPLHVGAALGNSPAMLRAMAAAGLGGYVLCGLNTTRRGSALLSDIHRSDCQILLVDDEHLPLLDRLDLNGIQVLEVGSPAYADAVAAAPPLIPHREVTAADPFMMIFTSGTSGNPKAVRFAHGMAIMCGASLIFQYDVTADDVCYLAMPLFHSNGVAAGWAVAVGSGALMVPAKFSPSRFLDDVRRYRVTYLNYVGKPLALILSTPERPDDADNTLRVAFGNEATDRDIAEFARRFGCRVVDSFGSSEFAVIVVREDGTPPGSIGRPYPGVSIYNPTTLKECVVTQFDEHGALTNFEEAVGELVNTQGAGPFVGYYNDPEATAERMRHGMYWSGDLAYRDADGWIYLAGRTADWMRVDGENLAAAPIERILARLPDISQVAVYAVPDERVGDQVMAALVLRAGAQLSPEEFGRFLASQPDLSPKAWPRYVRINDRLPTTATNKILKRALISAGVTAHDGVLWSRAPRGTRYAVAGENADGPAASVIAGQ

SEQ ID NO: 3677 - protein, 552 aa, Mycobacterium paratuberculosis
LPARRPGLRRVVASGAPRGPSMTDVSDVLVIGAGFGGLYAVHRAASSGLSVTALEAAPDVGGTWYWNRYPGARCDVESVDYSYSFDEELQRSWQWTERFAAQPEILAYLRHVADRFDLRRHYRFGADVVDAAFEHGRWRVGTSNGQTFAARFLICATGCLSAVNRPDIPGAQDFSGEVYFTAAWPREDPDLRGKRVGLIGTGSSGIQATPIIAAQAESLVVFQRSANYTIPMPNRPFSAEEQQRIQEQYPERRRRSAYATSGTPHGMYHKNAVDTDPAERAEALWKRWREGGVLFAKTFPDQTSDPAANDIARTFAEERIREIVTDPDVAADLIPVDHPIGTKRICTDDGYYATFNRDNVRLVNLRREPIEAITADGMRTSTTTYPCDVLIFATGFDALTGALTRINPTGPRGDRLRDIWADGPLTFLGMMVPGLPNLFSISGPGSPSVLANMVLHAEVQVDWVVDLLCATRRLGVTEVEPRRDAAVAWTRYVAEVAERTLFPKAASSWYLGANIEGKKRVFMPYIGGFGTYRRHCEQVADRGYAGLVLTTR

SEQ ID NO: 3678 - protein, 400 aa, Mycobacterium paratuberculosis
VTGLRGEAAIVGIAELPAERRPTGPPRFTLDQYALLAKLVIEDAGVDPGRVNGLLTHGVAESAMFAPATLCEYLGLACDFGERVDLGGASSAGMVWRAAAAVELGICEAALAVVPGSASVPHSARRPPPESNWYGASSNNYGSPQAEFEIPYGNVGQNAPYAQIAQRYAAEFGYDPAALAKIAVDQRTNACAHPGAVFFGTPITAADVLDSPMIADPIHMLETVMRVHGGAAVLIANADLARRGRHRPVWIKGFGEHIAFKTPTYAEDLLSTPIARAAERAFAMAGLDRPDVDVASIYDCYTITVLMSLEDAGFCAKGQGMQWIGDHDLTHRGDFPLNTAGGQLSFGQAGMAGGMHHVVDGARQIMGRAGDAQVPGCHTAFVTGNGGIMSEQVALLLQGE

SEQ ID NO: 3679 - protein, 145 aa, Mycobacterium paratuberculosis
MTELCYDDVSVGDHIPTLTVTVDETQMFFFSAATYNGHRIHYDKEWARAEGYDDVLVHGALQAALLARALGDWIGGRGRLVSFSVQNRAVAYPGEPLSFGGRVTGKRLDESGSGLVDLDIAGRRDDTVLMPGTATVQLPRREARS

SEQ ID NO: 3680 - protein, 161 aa, Mycobacterium paratuberculosis
LVDAESAARVGTVAASATGEVNQRDWQRWAAAVGDHNPLYFDSDYARANGFRDIICPPLFLQYAILGVSRLDSLRPDGSSGAVSGSLAFPRAPKRMAGGESFTFHLPAYHRDRVDMVRTIASIVEKQGRSGRFVLVTWHTVYRNQHDELLAEASTSMIARP

SEQ ID NO: 3681 - protein, 378 aa, Mycobacterium paratuberculosis
MKLTPTAEQRDFAASLRALLAAENPLHLVRALNEPDADRRTPALWKALSGAGVFGLAIAEEYGGSGGSLDDLAVFYTEAGRALCPTTVHNSVQAALAVDRLGSRDAKARWLPPLVSGSLRATTALWNARDAALVSPVLRADRVEAPASQWRVNGTVDYVADADVADLVVASAAAAGRTLVFLVDPHTEGVSLAPLDMAGGHRAFAVRFDDVAIGDDAVLDAVAAGVIPTALRRLANTAVALGSLDLVGVGQAVLDRTVDYTKLRHQFGRSIASFQAAQHVVANMHIALAAARLAAHAAVFWLGRGRTASRETAVARMHAATAARLITLDAHQLHGGMGYVTETDLHLWSERARLGSTLGGGADVAASWLEQTWEEIGE

SEQ ID NO: 3682 - protein, 392 aa, Mycobacterium paratuberculosis
MDFELDAGQRAWLAEIREFLRDNVTEELRAELAQHDLEFPDGEVARFRRKIGAKGWFGLNWPREYGGLGLGAVHLHLLMSEFEYWGVPGPDLTVTSVAPMIMRHGTERNKTEWLPLIAKGEMICAVGYSEPDAGTDLANLRTSAVRDGEEWVINGTKIWNSGAQRATHEWLCVRTDPTGTRHRGISVVIVPIDSPGIDIRPLYAWSGYRTNEVHFHDVRVPVTNLIGEVNHGWTYITGALDLERGALTNAGDLRRAVEELHELARRPRRDRTVPADDPWLCRRLAQAEADVAVATLMGYEAASILDSGVIPTVEVSVEKIFTSELRQRIADLALDLLGVDGLLAHRSENAPLAGKFERLYRAAPLMRFGGGANEVLRDIIAQRGHAMPSYGR

SEQ ID NO: 3683 - protein, 106 aa, Mycobacterium paratuberculosis
LTPRLLMRCQAPVKTPRHARGSVRGLGGFSDRLVGADQTPPGRGTRRTRGEVMPTVEMRLREDLRNYAVELRQLAYTLPLGVGEHDLLQLSDRMRAAADQLVRKGA

SEQ ID NO: 3684 - protein, 854 aa, Mycobacterium paratuberculosis
LVLMSPPATPALTVRYDGAERTFAAGNDVVIGRDLRADLRVAHPLISRTHLIVRYEQGRWVAIDNGSLNGLYVNNRRVPMVDINDGTRVNMGNPDGPALSFEVGRHQGSAGRPPLTTSIPIVSTPSGPMTGAAQGQPPGTQRISQPQQPASSSFRQPVQPPTGAQPSHPPSGPTRYPPSGPQHAPQIYRAPSGHAAPPTTAQPAPAQTGRIGGDSSNLATSMMKILRPGRAGLESTPGAVKIGRANDNDIVIPEVLASRHHATLIPTPAGTEIHDNRSINGTFVNGVRVDSAVLRDGDVVTIGNIDLVFHGGTLARRDQTAAATRTGGLDVRGVTWTIESNKTLLDNISLTALPGTLTAIIGPSGAGKSTFARLVAGYTHPTTGTVAFEGHNVHAEYASLRSRIGMVPQDDVVHGQLTVQQALMYAAELRLPPDTTKEDRAQVVARVLEELEMTQHLHTRVDKLSGGQRKRASVALELLTGPSLLILDEPTSGLDPALDRQVMTMLRQLADAGRVVLVVTHSLTYLDVCDQVLLLAPGGKTAFCGPPGQIGPAMGTTNWADIFSTVAGDPDGSRARYLARTGPRPPPPPAEQPAELGDPAHTSLVRQFSTIARRQMRLIVSDRGYFVFLALLPFIMGSLSMSVPGDVGFGIPNPMGAAPNEPGQILVLLNVGAVFMGTALTIRDLIGERAIFLREQAVGLSTSAYLLAKVCIYTVFAIVQSAIVTTIAVLGKGAPTQGAVALGKPALELFADVALTCVASAMLGLALSAVAKSNEQIMPLLVVAVMSQLVFSGGMIPVTGRVGLDQMAWATPARWGFAASASTADLTKLVPGPLTPKDSHWRHARAPGGSTWAC

SEQ ID NO: 3685 - protein, 364 aa, Mycobacterium paratuberculosis
VTGIRCRLRRLMQMVSTADPSHMSPRRVLPSVATTRRVHHRHSPQSVAVSLASRLIVKNAVRAWALTPNLHWPLEYVDSFAGLVPRLGSAGTTHPVRLEHCAAEWVRAPGVSGERAILYLHGGAFLTCGLNTHRPMVTRLSKAADAAVLAVAYRKLPAHQITDAIDDGLDGLRWLQDRGFDGDRVVVAGDSAGGYLAFMTTLLAIQNEVMEPAGIATVSPFTDTDPARKLKHRNARKCSMFTCRAFSRFAEYLSNAQVLEGHGDSTVASPVDADLSSLPPVTIHASSDELLVADAELMAKRLEASGIHCDLHLWDGQIHDFPLAADVLPEGRRAIKYLGDFVKDVTAAGTRFSNVRRLRTAAAG

SEQ ID NO: 3686 - protein, 198 aa, Mycobacterium paratuberculosis
VLDRYGRIDVLVNNVGHWLRHPGGFADTDPQLWDELYRINLHHVFLVTHAFLPTMIDRGAGAIVNVSSVEGLRGYPEDPVYAAFKAAVIGFTRSLAVQVGNHGVRVNAVAPDVTESLQVPYSQWLSAEEQSQWPRWVPVGRMGLPEDQARVILFLASDCSSFITGHTIPTDGGTTAAGGWFRSSRRPGREWTNRPADP

SEQ ID NO: 3687 - protein, 298 aa, Mycobacterium paratuberculosis
MTEPGAAQSVDTARCLISHPPAVGHQQVAVAAAMVQPDVGDDGEVGPDPRLAGPQLGEQHVGDVVAHNRFDADAAGDTAQEGRDRRSAAQRLEAPDFEDPVAAEGLREVVDPARVAGPVVARQGVSDLLAGDQLPHFHRRDSSLSIPNSVSARAGARCGEAGRHRLDRDAMTSILMHSKGIGGRPGGIGVRLWCRLLLADVLRRRRLAITGVDTYDTEGGRMSDKSGPEEAIEGVVEGVKGKVKEVAGAVAGRDDLMREGQAQQDKAEAQREAAQKEAEAESARKAAEINEARQKAEQ

SEQ ID NO: 3688 - protein, 513 aa, Mycobacterium paratuberculosis
LPNAPQRLQTSRRTSGSRPPRWPHPRDGSGMTAGHVTTGHGRETQRQADMQRLSGLDAFFLYLESPTQLLNICCVMELDPATMPGGYTFERFRAALSRQLEAVPEFRLKLADTPLNLDHPVWVDDDRFDLGRHLHRVALPSPGGPKELAEICGHVAGLPLDRDHPLWEMWVVEGRHGNDTLSVVLKAHHAVVDGVGGANLLAQLCGTAPDAPPPEPAARAGTANRLQIAAGGLIGAALRPWRLARVLPTTALTLAETVLRARGGGQTMAAPFAAPATPFNGTFTRRRNVALAGVDLENVKAVKRHFGVTVNDVVTAICAGALRQFLADRDALPEVPLVASVPVSVHGKSSRPGRNQTTWMLCRLETHIDDPVHRLTTIAEKNAAAKEHAAAMGPTLLQDWTQVAGQTVFGVARKLLPRIPLPDKPPHNLVLSNVAGPRHQLYFLGCRLDGMYPLGPIIAGAALNITVMSLGGRLGVGILSCPDLVPDLWDLADAFPAALKDLTNCVRSGRART

SEQ ID NO: 3689 - protein, 300 aa, Mycobacterium paratuberculosis
VIPVADTPGRTGITEQDLREISTEKGALRYYDTGGDTGGPDSAAVLLFLHGSGPGVTGWRNFRGILPAFAAHYRCLVLEFPGFGASDDFGGHPMVTAFGTVAPFLDALGVEKVHIIGNSMGGGVGINFATHNADRVGRLVTIGGIGTNIFSPSPSEGIRLLQEFVEDPTRQRLVDWLKSMVYDQALITEQLIEERWALATDPDTLAAARRMYGKAAFSAMNAALNASDRPLPWAVMHKLTAPTLLTWGRDDRVSPPDMALIPMRTIPNAELHIFPNSGHWAMIEAKEAFESTVLAFLSRG

SEQ ID NO: 3690 - protein, 282 aa, Mycobacterium paratuberculosis
MPQVSAAGRLAGKVALITGAARGIGRAQAVRFAQEGADIVALDLCGPVDTVMVPPSTPDDLDHTASLVGEVGGRMHAELVDVRDLDGVQAATERGARRFGGLDVVCATAGITSRAMTVEMDESVWRTMLDVNLTGVWHTCRAAAPHLIARGAGSMILTNSIAGLRGLVGVAHYTAAKHGVVGLMQSLAHELAPHRVRVNCVHPTNVDTPLIQNDTVRSAFRPDLDRPPTRAEFAEAARAMNLLQVPWVDPVDVANAALFLASDEARYITAVTLPVDAGATQR

SEQ ID NO: 3691 - protein, 541 aa, Mycobacterium paratuberculosis
VTSGSDRRATPDVDVVVVGAGFAGLYALHKLRSNGLRVRVFEAGPDVGGTWYFNRYPGARCDVESVDYCYSFSDALQREWDWSEKYATQPEILAYINWVADRLDLRRDITLNARVNSAVLDEAQLRWTVTTEAGERVTARFCVMATGPLSAAMTPPFPGLDTFAGQVYHTAAWPHEPVDFTGKRVAVIGTGSSGIQSIPIIAEAASQLYVFQRTPNYSVPAGNRPLSDSDRAEVKAHYAERRRMSWRSGGGSPHVAHPKLTMEATPEERREAFEKRWELGGVLFSKTFADQMIDPVANEEARKFYEEKVRAVIDDPALADLLIPNDHPIGTKRICTDSNYFQTFNRPNVKLISVRKTPIMSIDATGINTTDAHYDLDAIVLATGFDAMTGALAKIDIVGRDGRRLSDDWSGGPRTYLGLGVDGFPNLFLVSGPGAPAVLANMVLHAEANVNWIADCIAYLDAHDYTAVEATTDAVDDWGAECARRADATLFTKADSWYLGANVPGKPRVFMLFVGGFGVYLDICAEVANAGYKGFSLVKAR

SEQ ID NO: 3692 - protein, 268 aa, Mycobacterium paratuberculosis
MSGLSGRVVLVTGAGRGIGRSHCQRFAEEGADVIAVDVPAAAPDLAQTAAAVQQRGVRAATALADVSDFAALAAAVDEAVGRLGRLDVLVGNAGIHPAAAPAWEITPQNWQQTLDVNLTGVWHTVKAGVPHMSRTARGGSIVIISSTSGIRGTPGAAPYSASKHAVVGLARTLANELGPQGIRVNTVHPGAVATAMVLNEATFRRLRPDLDNATADDAAEALSARHLLPVPWVEPVDVSNAVVFLASDQARYITGTQIVVDAGLLARA

SEQ ID NO: 3693 - protein, 394 aa, Mycobacterium paratuberculosis
MSERVIDRVMAMADQLRDQAAEAEQLGRLTDDTVKLMKGAGLIRLLQTKQYQGFEVHPREFAETVMATAALDPAAGWIVGVVGVHPYQLAYADPKVAAEVWADDVDTWMASPYAPQGVAKPVDGGYIFNGRWQFSSGTDHCDWIILGAMLGDEQGVPLMPPQMLHMILPRKDYEIVEDSWNVVGLRGTGSKDVIVKDAFVPSYRTMDATKVMDGTAQREAGMTEPLYLMPWSTMFPLGISAATIGIAEGALAAHLDYQRSRVGATGTAIKDDPYVMYAIGEAAADINAARQELLANADRIYDIVASGKEVSFADRAAGRRTQVRAVWRAVSAVDEIFARSGGNAARMDKPLQRYWRDVHVGQMHAIHVPGTTYHASALSSIGIDPPEGPLRALI

SEQ ID NO: 3694 - protein, 330 aa, Mycobacterium paratuberculosis
MSDLKSLGYITVSTADIERWRHFAFGVLGFAEGKGPDESALYLRMDERAARIIVVPGDVDRVVTVGWEVRDHQALQRVKATLEGAGVAFKELSLQEADARRVEEVITFEDPAGTTLEVFHGAVLDHSPVITPFGAKFVTGDQGLGHVVVPATDPNGLFDFYTEVLGFRSRGAFRVPLPAEFGPIRVRFLGINARHHSLAICPAAQQRDPGLVHVMVEVDSLDAVGQALDRVNADGFTVASTLGRHTNDKMVSFYVRARPATGTSNSAPTGCGSTKPITPQRKSPPTATGATSGFRNHPRRCACEYRRHTDTRVVDHLLGPRGRRRHRRLR

SEQ ID NO: 3695 - protein, 491 aa, Mycobacterium paratuberculosis
VNTDVTPIPASSITSWDHEADVVIAGYGVAGAAAAVEAARAGADVLVLERTGSWGGAAAMAGGFIYLGGGTPIQKACGFTDSVDNMAAFLNVAMGPGADADRIADYCAGSLAHFEWLVGCGVPFKAEFFGEPGWEPMGDQGLMYSGGENSYPFNTIASPAPRGHVPQMQNKKQGEASAGYMLMKPLVETATAAGARALYDVRVQRLITESDGRVVGMRARKYGTEMNIRARTGVVLATGSFAYNDSMVARYAPRIAGRPAASIEQHDGQAIRMAQALGADLAHMDATEVAIFIDPQQLVRGILVNGRGQRYVAEDTYPGRIGQLTLYQQDNTAYLIIDGDAQDEAMASWSPKLMLRPATWVADTVADLERDMALPPGSLQDTVAAYNAGATRGEDPLLHKKPEWIRPIGSPVGAVDLRESTGGFTLGGLATTLDAEVLHVSGQPIPGLFAAGRCTAGLAAWGYASGISLGDGSFYGRRAGASAAGRRLPRV

SEQ ID NO: 3696 - protein, 278 aa, Mycobacterium paratuberculosis
MPAPAETPTAVIDRISLVLDAFDGPGRLTLAQIVRRTGLPRSSAHRMLERLVQLRWLRRSGRDYELGMRLVELGSLAVHQDRLVRAATPLLVELHRATGLVVHLAVLDGPDVVYLEKVGDRLNSVIPSRVGGRQPAHCTAVGKAILAYRDEATDLDLGARPTKYSISSAPQLAAELAKVRAHGVAFEREESLLEFGCVAAPIGGPGEAAAAVSVCGPLQRMALDQRLAAPVRMTAMGVWRNVEGGPQRVAPTLQRLRPLPPMRPQHPVPKPRPALQYA

SEQ ID NO: 3697 - protein, 307 aa, Mycobacterium paratuberculosis
VSLEPQIAAIIEQLDSGFPPVQQMSGAEARALIRSRLVPPAQPEPVAEVADRLVEGPGGPLRIRVYRPEAAAPLPVVVYAHGGGFVFCDLDSHDGLCRNLANLVPAVVVSVDYRLAPENAWPAAAEDVYAVTCWARDHADALGADPARLVVGGDSAGGNLAAVTTVMCRDRGGPAPAAQLLIYPVIAADFDTESYRLFGQGYYNPAPALRWYWDCYVPSTRDRAHPYATPLNADLRGLPPAVVVVAGHDPLRDEGLAFGAALEAAGVPTVQLRYEGGIHGFMTMPMLDIAHRARNEAAAALADLLQW

SEQ ID NO: 3698 - protein, 132 aa, Mycobacterium paratuberculosis
VVGSRPRCVPRVSYGRLMADGAVFVIDRVVTRPGCARRFVDTYLAEYAPGARERGMTLRDVLVSPPIWFDASEGQVNTVTITWTLPNGWEMTWQGRPDPAVGEWWSRIGELVAERSRSFAARAADVDVLCDV

SEQ ID NO: 3699 - protein, 191 aa, Mycobacterium paratuberculosis
MAAALRRAASDAGALHWVVGPTLPGSRNGGDLLVHVRFASKRQWDCTAPCFAAILGDPAVGRVNGATYSGTPVHAGQKPGAVYRTLLLAVSPDTAEDTVARFEADLRLMPRYVRTITGWQLSRVEEATGASAWTHVFEQLFTNVDGLMGPYLMHPIHWAVVDRWFDPECPDVIVRDRVCHSFCISTDPVLT

SEQ ID NO: 3700 - protein, 295 aa, Mycobacterium paratuberculosis
MSRLLSGKTALVTGSSRGIGRAVAQRLAAAGATVAVTARSHSSSLSTRAGTATALPGTIGETIELIEAAGGSAFGIAADLEDADQRDGLVDAVLDRTGRIDILVNNAGFADYSLVEDMSLETFDRTVEHYLRVPFVLTKCAVPHMRKQGAGWIVNIGSVTGVAPVRPYREYNKASGDVVYAAMKAALHRFTQGVAAELLDASIAVNCVGPSTAVRTPGAAQLIPESFPTEPVEYLAETVLAMCHLPAAERTGLVAFSLHYPWSQQLPVHSLDGANLLPPLRPPANANPNILPAGV

SEQ ID NO: 3701 - protein, 646 aa, Mycobacterium paratuberculosis
MSTGMAVTTESAGAAGPDPYDVGELRANLRQADPGVLVAVLAQLTGDPAVVDRFAPKITHVPDPPEQAGVTDPETAAQLVDEIVTALRTPRRADAVPADDLDLFARVAPVALGGEVGPEYLGLLVEQGGFQPSQPVLPRTAKLPAGFRVVIIGAGIAGITAALACADAGIEYQIIERNDEVGGTWYTTRYPGIGVDTPSAYYSLSRDINGDWSSYYPQGAEYQAYLVSVADKNDLRKHTRFGTEVEALWWQERRRQWQIHSVGPDGTRDVSYANVVIPAAGYLNRPRWPELAGRETFSGISIHSAHWDPELDLTGKRVAIIGAGCTAVQIVDACVDQVAHLTVFQRQPHWVAPRRRASDDVSTYQRWLGTRLPYYANWIRIKSYWGTADNNYPVILHDPQWAAEHLSVSPANDVLLRMCLDYIDRVFGAGSELARKVTPDFAPYGKRIIRDPGGYYAALAREHVDVEASEPARVNQAGIVTADGRQIDLDVIIYATGYYLDFLSTVDIRGRDGKKLTDEWGDAPRAYRGGMVPGFPNMFISSAPNYSPGHGAGHNFGVEVMVHYVMECLQLMALRRATTVEVTQRAYEEYVADIDALMAGTVWCHTPSAHTYYRSGGGRIVTAFPYRLVDFWRDHRAPSEEDLELR

SEQ ID NO: 3702 - protein, 171 aa, Mycobacterium paratuberculosis
VLATARSELTDGMSDDITLPELQEFIGAFWYHYDEAHYDELAASYAEDVHYLTRSDSGASPFEELMSPKLSGRDAVMEWLSEHRKQSPYPLRHHATNVHRIGSDGDITRARFYLFVNHIANFVPFAVSSAVVNVGVRRGAHGLEFSEMDVTLDTTNSVLLSELHAESGVGS

SEQ ID NO: 3703 - protein, 256 aa, Mycobacterium paratuberculosis
MTVVLADIDGDAVAALRDELAAGGGAAHDAACDVRDPAAVQDLADRAYDIGPVRLLVNNAGIEQFGYLWDTPVVNWQHVMDVNVSGVFYGVRAFLPKMMAAGQQAWVWNIASVGAVVAMPLQAPYIVSKHAVLALTECLHLEVQATGHDDHVHVQAVLPGPVRSNIFESAGGVDPDAASDAAAAEAHRSAMLGIKAASMDALEAAEMIFRQSTEGHFYLHTHPDSVGAAMRERAKVLAAQQAPPLRTETRFDSAPH

SEQ ID NO: 3704 - protein, 327 aa, Mycobacterium paratuberculosis
MTSPPLDPDAAARIASFGETAPMRQRGLPAVRAGLESAPRPATMPEMASVTEALVPSAAGGIPVRIYRPTTDSGVAVLVYLHGGGLVMGSNRSFEPLARELASASAATVVAVDYRLAPESPPPAQFDDAYAATEWVSRKAGELGVDADRLAVIGDSAGGSLAAAVALAARDRRGPPICAQVLLYPGLDRDMSVASIAAMPDAPLLIRDDIDYMHALVDGDAGPPTDPYLVPAYAADLSGLPPAIVVTAGCDPIRDWGERYADRLRDAGVQTTVTRYPGMYHGFLMRSDATARGRLAIAEIGGLLRAKFSHPLRFDVPITGRHSTATR

SEQ ID NO: 3705 - protein, 328 aa, Mycobacterium paratuberculosis
MRERLLNVVHTHGPWRLIIAQHFASADELMATMSGAFPEGFTPSLDLFLTPTFRGYLANYGTVLYPELHDCFYNAAFLEHAKRYWNAEYAKPEMMLFNINGPCANRDPGHLDSPSFRGVRHENAPTWLCSVMGKSGLFSDYLIKMAQVITWFCLDTGSGFTYWPDGPLKAPARVLPPINNRGVVVQNEMMVHRGEANGPLEQQIPSGLAFDTVFAGDPSDRDHWLLKNGEDVIARHHTDELRFLVHWSAEVFSDYDELKKNMEGSDDITIDRAIDMMLDDLHAKGIKLDAPSEPLHDPEFIAALNAAYDVGGPTSYPDQAPLSAFQPA

SEQ ID NO: 3706 - protein, 260 aa, Mycobacterium paratuberculosis
MDRFAGRRAIVTGAGSGIGAATAARLLDEGATVVAYDISAEGLARTRAAADDAGTGKRLTTAVLDISVEGDVIAAVDGAVADLGGLEVLVNVAAIQTCSHTHQTTLADWNRTLAVNLTGTFLMTRQALPALLDSGRGVVVNFTSTAASFAHPYMAAYAASKGGILSFTHSLALEYAKQGLRAVNIQPGGVSTALANSTLDKMPDGYDVGLWAKQTPLLHGKDSEILGDPSAVASVIAMVASDDGAFITGTEIRVDGGAHA

SEQ ID NO: 3707 - protein, 237 aa, Mycobacterium paratuberculosis
VYATSRTIGDTPSGVVPVRVDHRDDAAVSDLFDRVRRESGRLDLLVNNAATISDNLVSSKPFWEKPLDLADVLDVGLRSSYVASWYAAPLLVAGGRGLIAFTSSPGSVCYMHGPAYGAQKAGVDKMAADMAVDFRGTGVATVSIWMGILLTEKLRAAFGADPAALAATAEHAETPEFTGYVIDALFDDPGLAELSGQTLIGAELAQRYGITDEGGRRPPSHRDMLGSPRTPSSVVVR

SEQ ID NO: 3708 - protein, 372 aa, Mycobacterium paratuberculosis
VRMHDTDEIRLIEAQAVPTRFARGWHCLGLIRDFGDGKPHPIDAFGQKLVVFRGGDGAINVLDGYCRHMGGDLSRGEVKGNEIACPFHDWRWGGDGRCKQVPYSRRTPRLARTRAWTTLQQDGMLFVWNDPEGNPPPPEVTIPRIEGAGSDEWTDWHWYSTVVQSNCREIIDNVVDMAHFFYIHGSLPKQFKNIFEGHVATQYMNSAGRPDIGGEGARMLGTTSVASYWGPSFMIDDLTYHYEDADHQTVLINCHYPIDANSFVLQYGIIVKKSDALPDDLAMQTAIALGDFVKLGFEQDVEIWRHKARIDNPLLVEEDGPVYQLRRWYQQFYVDVADVQPDMVDRFEFELDTTRPYAAWMKEVEANLAARA

SEQ ID NO: 3709 - protein, 581 aa, Mycobacterium paratuberculosis
VTTHSATIPAGLPVADTAVDLLVVGSGTGMAAALAARELGLSVLIVEKSSYVGGSTARSGGALWLPASPVLDEANAGDTAERAGTYLDSVVAGSAPPQRSAAFVAQVSATVEMLRRTTPLRLFWARDYSDYHPEEPGGSAAGRTCECRPFDTSLLGEYRTRLEPGLMEVTVPMPTTGADYRWMNLVARLPRKGIPVYAKRLAQGVGGRMLGRRYAAGGQGLMAGLFTGVLRAGIPIWTGTTLTRLTRRGERVSGAVVEHGGREVTISARRGVVLATGGFDHRMEMRWKFQSESLGADLSLGAAANTGDGIRAGQEIGAAIDLMDQAWWFPAVAPLPGKAPAVMLAERSLPGCLIVDQHGRRFVNEATDYMSFGQRLLELERSGSPVESMWIVFDQQYRNSYVFGAELFPRMRIPQAWYDAGIAVRADNLAELGAGIGVPVPEFVETMTRFNQNAAAGEDPDFGRGRSAYDRYYGDPTVKPNPNLRPLVNGPFYAVRMVLSDLGTCGGLKTDERARVLREDGGPIAGLYAIGNTAANAFGTTYPGAGATIAQGLVYGYIAAQEAARPSAAQEAARPSASQPD

SEQ ID NO: 3710 - protein, 496 aa, Mycobacterium paratuberculosis
LVSVVTLPGFLSVPPDSLRGMSSDRGAVSAAFDVIDAALDDLLDCDYVALATREKLALLTRCERLRRRLPAVEHPLINALARDASPAELGGRLSHAIAEATLISRAEAARRVHTAADLGPRVGLTGEPLPPLLAATAAAQRAGLLGLEQVAVIRKFCHQLPGWIDQATRERAETDLANQGGQYRPEQLAALAGTLADCLNPDGLYRDEDRARRRSLTLGNQQADGMSELRGWLSPELRATLEAVLAKLAAPGMCNSLDESPCVEGTPSQHAIDGDARSAAQRNHDGLLAGLRALLASGNLGQHNGLPASIIVTTTLADLETAAGRRLTGGGTLLPMSDVIRLSRHAHHYLAIFDQGKALALLYHTKRLASPAQRIVLYAKDRGCTAPGCTAPGCTAPGCTVPGYYSEVHHCTDYATCHTTDINDLTFACGPHHRLLQPGAWTTHKNAKGETEWIPPPHLDRNQPRTNTFHHPEKLLRGENDDGEDEDEDEDSDDAG

SEQ ID NO: 3711 - protein, 226 aa, Mycobacterium paratuberculosis
MASETDPASQKPALAATSWALLGMMSYEEEVSGYDLKKWIDWSVDLYYWSPSYSQIYTELKKLEALGLVTSRVERDEGTRSRRLYKITPAGMDAVTQWTNHAPVDPPVLKHSVLLRVTFGHLSNPGRLKELLQEHVAYAEARHRKAMEDAEGAEAEPAWAYSVLALRWAAKYYAAEREFALEMIKEIDEVDAILQRTAKGGYGKPRPTPGYWREVEKQVQAKREAE

SEQ ID NO: 3712 - protein, 296 aa, Mycobacterium paratuberculosis
MRLKAIAQPWEAAVTGPEQRRMMQCADRWGYDMIAVPEHLVIPVDQVELSGSHYLHSTTAQAFIAGATERVAINSCVTILPLQHPIVLAKALATADWMSGGRMMVTFGVGWLAREFELLDVPFGERGRIADEYLAAIVELWTTDTPRFDGRYVSFADIAFEPKPVQKPHLPVWIGGDADAALRRAARFGSGWWPFLTPPEQIAEKLDYIKSQPCYDGRPFEVMHGLGTNRVGEGHVARRDVRDRPGMSAGQIVDRLGWLAEQGVTVTAVPVPAVGGADEYLDYAQWVIEEIKPQLA

SEQ ID NO: 3713 - protein, 292 aa, Mycobacterium paratuberculosis
LIVSRRSVRPPAAAPAPPRVGALLRAAVRASAPRPAAARRAAKDFEKDLLPAVRAEIRWAFTPPRTWLMGVVANVIAAAAWLLVQPLTLGRHHDWVILVGTYFSSWVLADVTTTTNFLGADHYRILRGLADGVPFGRILLVKNLALLTIVGLPTLAAAMALTLWLETPARLAITVPTVAVPILSWLGVGNLISVLHPVSVEPLIRRWRQRADLRRTRSWLLALALPYALYYVADPMNGVEHRVLWQQLPALIWPVFGRDTKSVVHLAIAVSVWIAGSLAAVSWVRRRGLQIR

SEQ ID NO: 3714 - protein, 383 aa, Mycobacterium paratuberculosis
MNRKRVVVAGLGDVGVLAAIRLSRNADVVGISAKPALVSGQELGVRLSRPHDWARDYWIPFDRFRRLDGVRTVQATLTGVDLAARTVFGRGDDGAPVAEPYDALVICTGVSNGFWRRPTLQSAAEIGADLRDAHERLAAAGSVIVVGGGAAAVSSALNMARTWPDKRIDLYFPGETALRGHHPRAWRRLHARLTRLGVGVHPGHRAVLPDGFAGDELTSRPVQWSTGQPPAAADAVLWAIGRVRPNTGWLPAELLDERGFVRVTPQLRVPGHPGVFAVGDVAATDPLRSSARNRGDALVARNVVAEFTGRPLRGFRAPRRRWGSLVGIQPDGLEVFLPSGHTVRFPSWSVQRVVMPLIVRWGMYGGVRRNDPLGRETATPPTL

SEQ ID NO: 3715 - protein, 481 aa, Mycobacterium paratuberculosis
MVAVTRRDFCKWGGIAALAACAGPPHGKADYTLRIATGTVELAPGRVVSTLTYNGQFPGPLLRFMQGRRTWVDVYNDTDAPEQLHWHGQHIGADVDGAAEEGTPYVPAHGMRRISFVPGPAGFRFYHTHVVPRADLSRGQYSGLVGPVHIASKDDDAGAFDHEIFLTLKEFEPSLSRGGDMAVDFLAGAQEPDLRERGESSMAASRGRGEQPGYEVGYRAFAINGRMLGHGDPIRVRTGQLVLLHVLNASATETRSLALPGHAFTVVALDGNPVPNRAPVPVLWLGAGERVSALVSMTNPGVWVLGDLSDDDREHGLGVVVEYAGRAGEPQWVPPPPFTWDYRLFAGPHPAPVAPHDHTIDLLIEKRNAADNGFNVWTVNGTPFAMDSNQPVLDVERGRRYRLRLRNASDDLHPMHLHRHTFEITRFAGTPTAGVRKDVAMLGGYQSMEIDFVADQPGLSLLHCHQQIHMDYGLMLLLNGV

SEQ ID NO: 3716 - protein, 211 aa, Mycobacterium paratuberculosis
MAAAQRRLGWLSPCCQTIRHTGRPRRGATAGRCGWFRDGPTGKTEQMADPRTDPFEKLVALLNYPMFVVTTQSDGTPAGCLVGFASQASIHPPRFLVGLSRRNHTFRTARDATHLAVHVFDHDHLDVAELFGSQTSDKVHKFDRCSWHPGPHRLPILDDAAAWFAGEILDRFSLGDHVGHLLAPVDGSPPRQLESWVSFGDLRHLEPGHEA

SEQ ID NO: 3717 - protein, 227 aa, Mycobacterium paratuberculosis
VPGIIELAPFYADPPDGVRANMIFSADGAAAFGGRAGPLSCRTDQRLLRILRGLADVVLVGAGTARAENYGPVRLTDAARARRLHEGRAAPPPIAVVSRSGELPARLFSDPEQPPILVTCARTAARPDLDAQHVLVAGEETVDVARAVAMLREAGMHRILCEGGPTLLDELVEADALTELCVTLAPKLAASQPLGYRVHPARLTAPVGLHLAHALVCDDYLFLRYRR

SEQ ID NO: 3718 - protein, 152 aa, Mycobacterium paratuberculosis
MPGSKRDRIASRDITFQLIQLTAAQRPRNPCPQKRIAGQVSSSDHDRDYRNLAVNRLRPSEIQWALNHDAVHGIAYAFKNPVAVAEATEDPGDDRKTYLIRVKRDDLANALDKINEWILDNPGPSGMQAYGLVRALSREGLTDRAIGDDDPS

SEQ ID NO: 3719 - protein, 466 aa, Mycobacterium paratuberculosis
VIGLGGVWVLDGLEVTMVGNVSARLMEPGSGIALNPAQIGMAAAIYIAGACSGALFFGHLTDRFGRRNLFILTLALYLIATVATAFAFAPWYFFLTRFFTGAGIGGEYAAINSAIDELIPARVRGRVDLVINGTYWLGSAAGAGGALILLDTSNFAADLGWRLAFGIGAILGIFVLLVRRNVPESPRWLFIHGREEEAEHIVGEIEEAVQQQTGRPLPEPQGKALRIRQRTAISFREIAAVAFKLYPRRAVLGLALFIGQAFLYNGVTFNLGTLLSQFYAVPSGMVPVFFVLWALSNFAGPLLLGHLFDTVGRKQMITLTYIGSAVVVVALALVFLTQAGGVWAFIGVLIVAFFLASAGASAAYLTVGEIFPMETRALAIAFFYAMGTAIGGITGPLLFGQLIDSGQRDHVVWSFLIGAVVMAAAGLVELWLGIAAEQRPLEDLALPLTVDDAEDTEPQGDSAPVD

SEQ ID NO: 3720 - protein, 595 aa, Mycobacterium paratuberculosis
MTDPAEDHPSEAITLGLHDASPPEMVDAMAKDVELELGWGRLIFGQTFANSQELVEALRREGPGRRDICIYARESHVVVAEAPTELFIDPSHTYRLRFTGKEKSLAPTPLGVTVRTLNDPIDADAMNRVYVRCGMVPAGVDVIWENHQHVPAVKYLLAVRDEDGAVVGTVTGVDHELLFNDPEHGSSLWTLAVDPAAGLPGVGGALTRALAEHFRSAGCAYMDLSVAHDNAAAISLYEKLGFRRVPVLAIKRKNAINEPLFSPPPETVDDLNPYARIIADEALRRGIWVEVLDAETGEMRLTHGGRSVITRESLSEYTSAVAMCRCDDKRLTRRLVSEAGITVPRARLATFDEGDFAFLKEVGEVVVKPTRGEQGKGITVGVTAENGPDDLSAALARARAQYPDVLIEQRVPGDDLRLVVIDGRVVAAALRLPPEVIGTGEHSVRDLIAAESRRRSAATGGESRIPLDELTEATVAEAGWKLDDVLPQGTRLRVRRTANLHQGGTIHDVTAQVNSELCRVAVTAAEAIGIPVTGIDLLVPDVTGADYAFIEANERPGLANHEPQPTAAAFIDFLFPGHPGQPQAWTPEESRFARG

SEQ ID NO: 3721 - protein, 600 aa, Mycobacterium paratuberculosis
VCGVTGEVRLDGRAPDVAAVSAMAAVLTPRGPDAGGAWSQGRVALGHRRLKIIDLTEAGAQPMVDSELGLSIAWNGCIYNYKELRSELSGYGYRFFSHSDTEVLIKAYHRWGDDFVSHLFGMFAFAIVERDSGRVLLGRDRLGIKPLYLTEDSHRVRFASTLPALLAGGGVDTRIDPVALHHYMSFHSVVPAPATILRGVRKVPPASLVAIEPDGKRTVTTYWAPDFTRHADRADWSERDWEDAVLSTLRLAVKRRLVADVPVGCLLSGGVDSSLIVGLLAEAGQHGLSTFSIGFESAGGVKGDEFQYSDIVAQRFETNHHQIRIDSDRMLPALDGAIGAMSEPMVSHDCVAFYLLSQEVARHVKVVQSGQGADEVFAGYHWYPPMGEPAAATLDGAVAQYRRAFFDRDTAGVAQLVGPGILAPGDPSLRFVTEHFAQAGAETGIDRALRLDTTVMLIDDPVKRVDNMTMAWGLEGRVPFLDHELVELAATCPPEYKIAHEGKGVLKQAARRVIPSEVIDRPKGYFPVPALTHLEGPYLDMDRDALYAPTAKERGLFNTDAVDALLANPNGKLTPLRGNELWQIALLELWLQRHGVTGPV

SEQ ID NO: 3722 - protein, 6384 aa, Mycobacterium paratuberculosis
VKRGDRAYPVTRGQLDIWLAEQTGHLDVAWQLGVLVRIDGAIDPALLHQTMRHVVGEAESLRASFFEADGQVFQKAVEYSDVDLTFYDLSGSSDPEREVREMTASIQRTPMPLTGPMIKFALFRTGSAEYYWFTTCHHIAIDGMGIALVGRRIAAVYTALASGKPIPPAFFGSLQDLVGGELEYEASAKFLEDKDYWLAHRPGDGTAGHPPRPADDGRDPYSPSPPVQLDESVIGSVKELSKALGIRRSSVLTAACALLVRGWCADGSDEVVLDFPVSRRVDPKSKTHPGMLAGVVPLVLHAPAAATFADFCRHVDQRSREALRHQQFPTRTLDGEGDFSGPRQAPNRVVVNFVPARLTLSLADVPATATYTSFGPVGHFGLFFLGFGDQQFLSTVGTGQPLANFDATDLAERLQRILAAMAADPARLLSSLDVLRDPEHAQLEALGNTAVLTRTPGPAVSVPELFATQVARAPQDVALVCEGRSLTYRQLDEASNRLAHLLAGLGAGPGQSVALLFSRSAEAVASILAVLKTGAAYLPIDPAAPETRIGFMLADAKPVAALSTAELAGRLEGHGMTVIDVNDPRIQDRPATALPVPAADGVAYVIYTSGTTGVPKGVAVTHRNVTQLLGSLDAGLPPAGVWSQCHSYAFDVSVWEIFGALLRGGRLVVVPEDVTRAPEELHDVLVNEQVSVLTQTPSAVAMLSPQGLESVSLVVVGEACPAEVVDRWSPGRVMVNAYGPTETTMCVAISAPLAPGMGSPPIGVPVDGAGLFVLDAWLRPVPPGVVGELYVGGAGVACGYWRRGGLTASWFVACPFGAPGARMYRTGDLVCWRSDGQLDYRGRADEQVKVRGYRIELGEVQAALAALDDVDQAVVIAREDRPGGKRLVGYITGTADPAEVRTALAQRLPVYMVPAAVVALDAIPLTPNGKLDTRALPTPEYTGSRYRAPSNAVEETVAGIYAHVLGVERVGVDDSFFDLGGDSISALQVVARARAAGLTCRPRDVFVEQTVARLARVVGSGDRAAEVADEGVGPVPPTPIMRWLQAAERAGGATDQFNQTVLVQAPAGVTETEVAIVLQALVDRHAMLRLRVTDDGADGWSFEVPEAGSVQARDCLRSVDALSDEALLAARARLNPAAGTMLAALWVEATGQLAVIIHHLAVDAVSWWILLEDLNIAWALHRAGQPVELAPAGTSFARWARLLDEHARDPEVVGQLDRWKTVTSTPAALPAPRPDVDTYASAGRLSVELDAETTAMLLGEVPAAFHAGIHDILLIAFGLAWTEFLGEPGAPIGIDVEGHGRHEELGADIDLSRTVGWFTAKYPVSLDVAGLRWPQVAAGDPALGPVLKRAKEQLRTLPEPLTYGLLRYLNTDVDLAGADPPIAFNYLGRQGAASDSAADGWRISQDMSLLGAAAAVPMPLMHAVELNAGTIDTGAGPHLHAEWTWAPSVLGAEQITRVSRLWFEALAGVCAHVRSGGGGGLTPSDIAPARLTQQQIDELQSRHRIADILPLTPLQQGLLFHSSTAQGNDGMDDMYAVQLDFTLTGPLDADRLREAVRTVVHRHPHLAALFCDQYDEPVQIIPADPAVEWRYVELDGTGAADADDLIEQLCAAERAAVADLAGQPVFRTALVRTGGDRHRFVLTSHHILLDGWSLPILLREIFAGYYGQRLPAAGSYRAFLTWLAERDLDAARRAWGEVLSGFDTPTLVAPEGRLGQGRRGFEKSCVPEQTTRALGELARSCHTTLSTVLQAAWAVVLTSLTGRHDVVFGTPRSRVGQLEVDDAEQMVGLLINTVPVRAEITATTTTAQLLAQLQNSHNDTLEHQHLALNEIHRVTGHDQLFDTLFVYENYPIDSGMTLGADGLAIAEFTNREYNHYPLTVEALPGPELGLHIEFDTDVFDTASIESLVQRLQRVLVAMSTDPDRRLSSLDLLDRGERELVLSTMSGAGVSAPIGVAPQLLAAAVAADPDAPAIVDGARELSYRELDDWSTRLARKLIQHGVGPEHAAGVAIERCAELVVAWWAVTKVGGVYAPVNLDHPVERIASVLDTVNAVCVLTCGTDEVAGAGPRPILRIDGLDLSGHSTEPITDADRRSPLRADDTAYLIFTSGSTGVPKGVAVSHTGLLGWAAAQRELFGLGADARVLMVASPTFDASVGELLLAAGSGAALIVAPPQVYAGEALTALLHNQRVGTAILTPTVISTLDRGRLDGLHTLVAVGEACLPELVDGWAPGRQMFNGYGPSETTIWVTCARLTAGHPVRIGAPIPGVCARVLDGWLKPVPVGVVGELYLSGPALGHGYLGRVDLTAERFVANPFGGPGERMYRTGDLVRWTPEGTLDYLGRADNQIKLRGQRIELGEIENTLLACPQVTQAAVTVQDSAAGSQLVAYVTLDHGPSDADVRHDTDDADDVAQWRHLYDDLYGADLAATFGEDFRGWNSSYTGEPIPLQEMAEWRSATVDRIMSLRPRRVLEIGAGSGLLLSQIAPRCDRYVATDFSAVAIDNLARSMEQLQLPWRDRVELLTQPAHVTDGLPPGHFDTIVINSVVQYFPNAGYLADVIDNALELLAPGGSLFIGDVRNHALQGAFQTGIALARGGGADAAEIRQRVRHAMLGETELLLAPEFFTNWADSRPAAAGLDIQLKRGLSDNELNRYRYDVVIHKAPAPVRSVAAAPTWSWTDCTDCAGLRDQLAARRPAVVRVTDIPQAGVIDDVRVEAALAAGLPVADALAAAGSDTAAAVAEELHRVGEATGYRVAVTWGAQPGTLSAVFVQDGDQAAEPLTDLYLPPAGARQRTRHANDPRANTKIAQVRERLNAWLPEYMVPTHIVALDEFPMTTSGKLDRKALPAPDYQDADRYRAPSTAVEEILVGIYGQVLGLERVGVDDSFFDLGGDSLSAMRLIAAVNASLNTDLGVRTVFEAPTAAELALRVGSEADRPEPLVAGERPAVIPLSFAQTRLWFIDQFQGPSPMYNITVALRLSGRLDADALRAALADVVARHESLRTVFATADGTPQQVVIPADRIGFACDVVDARGWPEDRLREAMSAAARYTFDLSAESPLHTELFARGDDEHVLVVAVHHIAADGWSITPFARDLGVAYASRCAGRDPDWAPLPVQYADYTLWQRAHLGDVDDPGSRIAAQLDFWTDALAGLPERLQLPTDRPYPAVADHRGARLAVDWPAELQQQLRRVAREHDATSFMVVQAAFAALLAKVSASSDVAVGFPIAGRPEPVLDELIGFFVNTLVLRVDLNELGGDPTFAELLAQVRRRSLAAFEHQDVPFELLVERLNPTRSMSHHPLVQVLLGWENFPGEVTAPAAGLALGDLQVTPMPLHTNTARMDLTFSLAERFTESGQRAGIAVTAEYRTDVFDGRTVEGLIERLQRLLTAVTADPQRRLSAVDLLDANEHARLEKWGNTAVLARPATPVSVPARFAAQAARTPDAVALTCDGRSMTYRELDEAANRLAHFMIHHGAGPGERVALLFPRSAEAIVAILAALKSGAAYLPIDPALPAARVEFMLTDAAPIVAVTTAALAERLHGFDLTVIDVADPAVATQPATAPPVPDPDDVAHIIYTSGTTGVPKGVAVTQYNVAQLFDDLRIGIELSPRQVWTQFHSYAFDFSVWEIWGALLHGGRLVVVPETVSRSPNEFHDLLVREHVTVLTQTPSAVGLLRTDGLDGTALVIGAEPCPPELVDRWAPGRTMVNVYGPTETTMWACKSAPLTAGSGFPPIGAPVTRAAFFVLDDWLRPVPPGVVGELYLAGDGVGVGYWRRPGLTAARFLACPFGEPGTRMYRTGDLVCWGPDGQLRYLGRADEQVKVRGYRIELGEIQAALSALDGVEQAVVVAREDNPGDKRLVGYVTGSVAPAKARAALAERLPAYMVPAAVVVLDSLPMTVNGKLDTRALPAPDYWHTGGYRAPESPTEEILAGIYAEVLGVQRVGVDDSFFDLGGDSLTTMRLITAINSALDTDLPVRTVFEAPTIAQLAPRIAQSAGGLAPLVAAGRPDVVPLSFAQNRLWFIDQSQGPSPLYNMAAALRLRGRLDAGALGAALGDVVARHESLRTVFPSHQGTPRQLVVPAERAEFGWDVIDATDWPADRLDDAVQDVTRHTFDLAAEIPIRAKLFAVSEDEHVLVIVVHHIAADGMSLTPLGVDLSQAYASRCAGHAPGWADLPVQYCDYTLWQRAQFGDLNDPDSRIGTQLAYWEDALAGMPERLALPTDRPYPAAADQRGDSVAVDWPAELQQQVRRIAREHNATSFMVVQAALAVLLSKIGASSDVAVGFPIAGRRDPALDQLVGFFVNTLVLRIDLTGDPSFAELLALVQARSLAAFEHQDVPFEVLVERLNPTRSLTHHPLVQVMLAWQNFAGHDDPAAALALGDLDVTSVPVHDQSARMDLVFSLAERWNPDGEFAGIGGRVEFRTDVFDAATIETLIERLRRVLEAMTGDPGRPLSAVDLLDDAERAYLEEVGNTAILTRPASGRVSVPELFATQVARVPETVALVCDDLSVTYRQLDEASNRLAHRLAAAGAGPGQTVALLFSRSAEAVAAILAVLKTGAAYLPIDPSAPQTRVEFMLGDAEPIAAVTTAELAQRLAGRPVTVVDVDDPGIDTLPNTALPLPDPDGIAYLIYTSGTTGAPKGVAVTHHNVTQLLGSLDAGLPSPGVWSQCHSLAFDVSVWEIFGALLRGGRVVVMPEAVARSPHDLHDALIARHVTVLTQTPSAVAMLSPQGLESVSLVLAGEACPPEVVDQWAPGRVMVNGYGPTETSMCVSISAPLTAGSGIPPIGSPVDGAALFVLDESLRPVPPGVVGELYVAGSGVAAGYLGRPSLTAARFVACPFGAPGARMYRTGDLVRWRADGQLDYLGRADEQVKVRGYRIELGEIQAALSALDGVEQAVVVAREDNPGDKRLVGYITGTADPAEARARLGERLPAYMVPAAVLGLDAIPLTPNGKLDARALPAPDYAAGEYRAPESPTEEILAGIYAEVLGVQRVGVDDSFFDLGGDSISAMRLIAAVNAALNADLPVRTVFEAPTVAALAPRIGEGGSGLEPLTAGERPTVVPLSFAQNRLWFLDQLQGPSPVYNMAAALRLDGPLDTEALGAALGDVVARHESLRTLFAAPEGRPQQVVLPAERADFGWEVVDASGWSADQLDEAIGATARYTFDLAAQIPLRAELFRLRDDRHVLVAVVHHIAADGMSITPLVRDLGAAYARRCDGRGPDWTPLPVQYVDYTLWQRAQFGELADSGSRIAAQLAYWQDALAGMPERLALPTDRPYPLVADQRGATVEIDWPAELQQRIGDVAHRHNATSFMVIQTALTVLLAKLGANPDVAVGFPIAGRRDPALDDLVGFFVNTLVLRVDAAGDPSFTELLARVRTRSLEAFEHQDVPFEVLVERLNPTRSLTHHPLVQVMLAWQNFAGQDTGPAAGLSLGDVEITPIPVDTHTARMDLTFSVGERWCESGEPGGIGGTVEFRTDVFDPDSIQTLIGRLRRVLEAMTDDPTQSVWSVDLLDAGEHARLDTLGNRAALTGPPPRFDSLPTLFAEQAARTPDAVALVCGGRRMTYRELDEAANRVAHLLRVRGAGPGHTVALLFSRSAEAIVAILGVLKSGAAYLPIDPALPGERIGFMLADAAPMVAISTAELAPRLHGQHDVPVIDVHDPAIEAAPSSALPPPGADDIAYLIYTSGTTGVPKGVAVSHRNVTQLLTADSGLPREGVWSQWHSLAFDVSVWEIFGALLHGGRLVVIPDSVVRSPDDFHALLLDEQVSVLSQTPSAAGTLSPEGLEDLTLVVAGEACPAELVDRWAPGRTMINAYGPTEATVYTAISAPLQPGSPAGVPIGFPVPGAGLFVLDESLRPVPPGVVGELYVGGAGVACGYWRRGGLTASWFVACPFGAPGARMYRTGDLVCWRSDGQLDYRGRADEQVKVRGYRIELGEVQAALAGLDDVEQAVVIAREDRPGGKRLVGYITGTADPAEVRTALAQRLPVYMVPAAVVALDAIPLTPNGKLDTRALPTPEYTGSRYRAPSNAVEETVAGIYAHVLGVERVGVDDSFFDLGGDSISAMRVITAINASLGVELAVRTLFEAPTVASLSWRAQTDTARGGQAEEIVPVQTLKEGTGAPLFCIHAAGGLSWSYQVLGNHLDCPIIGIQQAEPQHAAPRSIREMAQSYADRIQETYPDGPYHLVGWSFGGVVAHELAIELQRRGCAIARLVLLDAQPGLDGSVTAPDAALAEQHMMEEALRSHLAAADHDQPHAHRQFNQLVREAGAEGMSRHKRLFDVLFGNARNNIERSKIHEPGVFLGDVTIFSAVRDHEDRSAFLAENWRPYVAGDIVIHEIDCTHDEILNADVVDSYGQRLGQLLGAQRRRELTPPQRFGADPGDDEPPVR

SEQ ID NO: 3723 - protein, 72 aa, Mycobacterium paratuberculosis
MQLNPFDDDGGRFFVLVNNEEQHSLWPTFADIPPGWRVVFGEADRTACLQYIEESWPDIRAKSLRDTLSAGL

SEQ ID NO: 3724 - protein, 261 aa, Mycobacterium paratuberculosis
MWGSVLGLGMLAALNPVRLGLALLMISRPRPGSSLLAYWIGGLTVCVPELLIPVLLLNFTPMFGHPSHASPSTGLALGKIQIGLGVVGLSIAAVLTVRFAARQRAAAPPPDDRTSELSAAPGATIAMPRLLTRAQDVSPDDRSVLRRLLGRMHSAWESGASWVAWVIGVISVPVDGVLFIVAIIAASGASVTAQVSASVAFVVLMYAVVEVILVGYLATPGKTQSLLLVLHDWVRTYHRQILVALFTVVGVSQLAQGLHLV

SEQ ID NO: 3725 - protein, 144 aa, Mycobacterium paratuberculosis
VRWSVAQVGLLVICVVHVIQAVVGLVMNPSFATGPNAPTVQLLGMDYNGWHAVAGLALFAPGLVFAARKSWSVLYLLLAAIAGALPGIWAFFSHQVAFLFTFPNNITDAVVHLVTAAVMVAVAAVQVRMDGGLRNSLADLRRAR

SEQ ID NO: 3726 - protein, 221 aa, Mycobacterium paratuberculosis
MPSEPAPPPPKSAPGWYPDPAVGHGLKRYFDGTSWTGEWAFFTEQRKNGTSGKAALALAALGVVVLLLIFAKSWAFDPEKAARATATSAATGSTEPAPPTPAGPKKPDGVTFTTAAAPDGDVVDARFAIRDNYSEEMIRDGARSDTIQILKYAHATYPNASAVNVQGTFPMTDPYGNTSTQVAIDLTYSRATLNKINFDGVRANTIWEIRDSGTVLPAFQP

SEQ ID NO: 3727 - protein, 466 aa, Mycobacterium paratuberculosis
VTHDGTWSDESDWEAVEFELDEAAHAPPAPVVAVVGRPNVGKSTLVNRILGRREAVVQDVPGVTRDRVSYDALWTGRRFVVQDTGGWEPDAKGLQQLVAEQASVAMRTADAVILVVDALVGATTADEAAARILLRSGKPVFLAANKVDSDKAEADAAMLWSLGLGEPHPISAMHGRGVADLLDEVLAALPEVSEVAPRPGGPRRVALVGKPNVGKSSLLNKLAGDQRSVVHDVAGTTVDPVDSLIELGDRVWRFVDTAGLRRKVGQASGHEFYASVRTHSAIDAAEVVIVLIDASAPLTEQDQRVLSMVIEAGRALVLAFNKWDLVDEDRRELLEREIDRELVQLRWAQRVNISAKTGRAVAKLVPAMETALASWDTRIATGPLNSWLKEVVAATPPPVRGGKQPRILFATQAAARPPTFVLFTTGFLEAGYRRFLERRLREAFGFEGTPIRINVRVREKRGARRR

SEQ ID NO: 3728 - protein, 228 aa, Mycobacterium paratuberculosis
VSSDVVVAIDGPAGTGKSSVSKGLARALGARYLDTGGMYRMVTLAVLRAGIDPADAEAVGRAAQAVRMSVDYHPDGDRYFLGGEDVSTEIRGDKVTAAVSAVSSVPAVRTRLVGLQREMASGPGSIVVEGRDIGTVVLPDAPVKIFLTASAETRARRRNDQNVAAGLADDYEAVLADVRRRDHLDSTRRVSPLRAAPDAVVVDTSDMTEAQVIDHLRDLVRQRSEVAR

SEQ ID NO: 3729 - protein, 247 aa, Mycobacterium paratuberculosis
MVEAQGIRLQKVLSQAGIASRRAAEKLIVDGRVEVDGQVVTELGTRVDPDAAVIRVDGARVVLDESQVYLALNKPRGVHSTMSDDRGRPCIGDLIERRVRGNKNLFHVGRLDAETEGLILLTNDGELAHRLMHPSHEVPKTYLATVTGSIPRGLGKTLRAGIELDDGMARVDEFAVVDPIPGKTLVRVTLHEGRNRIVRRLLAAAGFPVESLVRTDIGPISLGKQRPGSIRALGRDEVGRLYQAVGL

SEQ ID NO: 3730 - protein, 235 aa, Mycobacterium paratuberculosis
VSENAPDVDLDSELEAGIPEIAEAAPMESGELGSVLEALLLVVDTPVTAEALAAATQQPVYRIATKLQEMADELTARDSGIDLRKTSEGWRMYTRARFAPYVEKLLLDGARSKLTRAALETLAVVAYRQPVARARVSAVRGVNVDAVMRTLLARGLITEAGVDEDTGATTFATTDLFLERLGLTSLADLPDIAPLLPDVDTIEDLSESLDSEPRFVKLSGGQASDAALTFDVDQD

SEQ ID NO: 3731 - protein, 272 aa, Mycobacterium paratuberculosis
VNATANGEAQPQTGFQVRLTNFEGPFDLLLQLIFAHRLDVTEVALHQVTDDFIAYTREIGPKLELEETTAFLVVAATLLDLKAARLLPAGQVDDDEDLALLEVRDLLFARLLQYRAFKHVAEMFAELEASALRSYPRAVSLEDRFTQLLPEVMLGVDAERFAQIAAVAFSPRPVPTVSVGHLHEVKVSVPEQARKLLAILEARGSGQWATFSELVADCEGSMEVVGRFLALLELYRSRAVAFEQSEPLGVLQISWTGERPVGETLVEVRDEL

SEQ ID NO: 3732 - protein, 313 aa, Mycobacterium paratuberculosis
LPAGRRVSRDEPVRLSDDVHLPNTPAMTERPDNGVELGLTGRPPRAIPEPQPRTSHGPAKVVAMCNQKGGVGKTTSTINLGAALAEYGRRVLLVDMDPQGALSAGLGVPHYELEKTIHNVLVGPRVSIDDVLLQTRVKHMDLVPSNIDLSAAEIQLVNEVGREQTLGRALHPVLDRYDYVLIDCQPSLGLLTVNGLACSDGVVIPTECEYFSLRGLALLTDTVDKVRDRLNPKLEISGILLTRYDPRTVNAREVMARVVERFGDLVFDTVITRTVRFPETSVAGEPITTWAPRSTGAIAYRALAREFIDRFGA

SEQ ID NO: 3733 - protein, 234 aa, Mycobacterium paratuberculosis
MAAGVQNITTTGQIGDGREAAAVEYVLRNARAGDIDDVLATIDRFAYQKSMLINVGDEKGLILDAAVRRADPDVALELGTYCGYGALRIARAAPGARVFSVELADANAANARRIWAHAGVADRVTCVVGTIGDGGRTLDVLANEHGFAAGTLDFVFLDHDKDAYLADLKSIMDRGWLHPGSIVVADNIRWPGSPKYREYMHVQQGKRFDTVEHKTHAEYQTMLSDLMLESEYLG

SEQ ID NO: 3734 - protein, 313 aa, Mycobacterium paratuberculosis
MTTVALETQLQGYLDHLTIERGVAANTLSSYRRDLRRYTKHLSDRGISDLAKVGEDDVSEFLVALRRGDPDTGAAALSAVSAARALIAVRGLHRFLAAEGLAELDVARAVRPPTPGRRLPKSLTIDQVLALLEAAGGESPADGPLTLRNRALLELLYSTGARISEAVGLDVDDVDTQARSVLLRGKGGKQRLVPIGRPAVAALDAYLVRGRWELARRGRGTPAIFLNVRGGRLSRQSAWQVLQDAAERAGITSGVSPHMLRHSFATHLLEGGADVRVVQELLGHASVTTTQIYTMVTVHALREVWAEAHPRAR

SEQ ID NO: 3735 - protein, 207 aa, Mycobacterium paratuberculosis
VAEHVFETASSETLYTGKIFALRRDQVRMPGGKVVTREIVEHFGAVAVVAMDDDGNIPMVYQYRHAFGRRLWELPAGLLDVHGEAAHLTAARELMEEAGLKAETWAVLVDLNSTPGFSDESVRVYLATGLTRVDRPEAHDEEADMTLEWYPLADAARKVLSGEIVNAIAVAGILAAHAVTTGFERPRPVDSPWQDRPTAFPARKAGR

SEQ ID NO: 3736 - protein, 583 aa, Mycobacterium paratuberculosis
VRKHPQTATKHLFVSGGVASSLGKGLTASSLGQLLTARGLYVTMQKLDPYLNVDPGTMNPFQHGEVFVTEDGAETDLDVGHYERFLDRDLSGSANVTTGQVYSTVIAKERRGEYLGDTVQVIPHITDEIKGRILAMAQPDAQGNRPDVVITEIGGTVGDIESQPFLEAARQVRHDLGRENVFFLHVSLVPYLAPSGELKTKPTQHSVAALRSIGITPDALILRCDRDVPEALKNKIALMCDVDIDGVISTPDAPSIYDIPKVLHREELDAYVVRRLNLPFRDVDWTEWDDLLRRVHEPHETVRIALVGKYVELSDAYLSVTEALRAGGFFHHAKVEMVWVASDDCESASGAAAALGEVHGVLIPGGFGIRGIEGKIGAIHYARTRGLPVLGLCLGLQCIVIEAARAAGLAGANSAEFDPDTPDPVISTMADQVDIVAGAADLGGTMRLGAYPAVLEEDSIVARAYGTTQVSERHRHRYEVNNAYRDKIAESGLRFSGTSPDGHLVEFVEYPPDVHPFIVGTQAHPELKSRPTRPHPLFVAFVGAAMDYKAGELLPVEIPEQSSNGIQHRDSAARPIPEPAARG

SEQ ID NO: 3737 - protein, 317 aa, Mycobacterium paratuberculosis
MISLRQHALSLAAVFLALAVGVVLGSGFLSDTLLSSLRDEKRDLHTQINGLNDQKNVLNEKLSAANNFDTQLAGRMLHDALGGKSVVVFRTPDAKDDDVAGVSKFIAQAGGTVTTTVALTQEFVEANSAEKLQTVVNSSVLPAGQQLSTKLVDQGSQAGDLMGIALLTNATPAGPPPPEVSETQRNTVLAALRDTGFITYQGGDHLGAANAALVVTGGALPQDAGNQGVSVARFSAALAPHGSATLLAGRDGSATGSAAVAVTRADSGMNSAVSTVDNVDAAPGRITAVLGLHDLMNGGHPGQYGTGHGATSITVAQ

SEQ ID NO: 3738 - protein, 393 aa, Mycobacterium paratuberculosis
MKMSGLLSRNTDRPGIVGTARVDRNIDRLLRRVCPGDIVVLDVLDLDRITADALVEADIAAVVNASPSVSGRYPNLGPEVLVNNGVTLIDEAGPDIFKKVKDGAKIRLYDGGVYAGDRRLVRGTERTEHDIADLMREAKSGLAAHLEAFAGNTIEFIKSESPLLIDGIGIPDIDVDLRRRHVVIVADEPSAEEDLKSLKPFIKEYQPALIGVGTGADVLRKAGYRPQIIVGDPDQISADALKCGAQVVLPADADGHAPGLERIQDLGVGAMTFPAAGSAIDLALLLADHHGAALLVTAGHTANIETFFDRTRAHSNPSTFLTRLRVGEKVVDAKAVATLYRNHISAGAIALLALTMLIAVIVALWVSRTDGVVLHWITDYWNHFSLMVQKWVT

SEQ ID NO: 3739 - protein, 589 aa, Mycobacterium paratuberculosis
MLTEIRIESLGAISAAVGEFDRGLTVLTGETGTGKTMVVTGLHLLGGARADATRVRSGADRAIVEGRFTTTDLDETLVVRLDEMLDASGAERDEDGSVIALRSVNRDGPSRAYLGGRSVPAKSLGDFTAELLTLHGQNDQLRLMRPEEQCGALDRFAKAGPALERYTKLRDAWLSARRDLADRRNRMRELALEADRLTFALGEIDAVDPQPGEDDALVAEIMRLSELDTLREAAAAARAALSADDADGSGLSAVDTLGKARAALESTDDPKLLALAGQIGEVLTVVVDAAGELAGFLEELPVDASALEAKLARQSELRGLTRKYAADIDGVLAWARESRERLAQLDVSEEGLSALAARVEELGRELAGAAADLSTIRRKAAKRLAKEVTAELSGLAMADAQFSIDVSTDVVPAGSGSDDAAVLTLPSGERVRAGADGIDQVEFGFAAHRGMDRLPLAKSASGGELSRVMLALEVVLAASRKETVGTTMVFDEVDAGVGGRAAVQIGRRLARLARTHQVIVVTHLPQVAAYADVHLVVHGAGPRGTSVVRRVTGDERVAELARMLAGLGESDSGRAHARELLDAAQKDEI

SEQ ID NO: 3740 - protein, 308 aa, Mycobacterium paratuberculosis
VTPAERTVLMVVHTGREEATETARRVQKVLGDNGIALRVLSAEAVDRGPLHLAPDDMRAMGVEIEVVDADPLAARGCELVLVLGGDGTFLRAAELARNADIPVLGVNLGRIGFLAEAEAEAIDKVLEHVVARDYRVENRMTLDVVVRHQGTVSDHGWALNEVSLEKGPRLGVLGVVVEIDGRPVSAFGCDGVLVSTPTGSTAYAFSAGGPVLWPDLEAILVVPNNAHALFGRPMVTSPAATIAIEIEADGHDALVFCDGRREMLIPAGSRIEVKRCDTAVKWARLDSAPFTDRLVRKFRLPVTGWRGN

SEQ ID NO: 3741 - protein, 269 aa, Mycobacterium paratuberculosis
MSRRARVDAELVRRGLARSRQQAAELIGAGKVSIDGMPARKPGTAVAVTAALTVAADGERGWVSRGAHKLLGALDAFEIAVAGRRCLDAGASTGGFTEVLLDRGAAEVVAVDVGYGQLAWSLRSDARVVVVERTNVRDLTPEAIGGPADLVVADLSFISLCTVLPALAGCAAPHADIVPMVKPQFEVGKGQVGPGGVVNDPELRAQAVLSVARRADELGWHPVDVTASPLPGPSGNVEYFLRLRARTDRPLAGDALCRAVRRAVESGPQ

SEQ ID NO: 3742 - protein, 61 aa, Mycobacterium paratuberculosis
MSIDPDQIRAEIDALLARLPQPGDTEDPDKAPSLDELEEIARRLSEAHDVLLAALESAEKG

SEQ ID NO: 3743 - protein, 337 aa, Mycobacterium paratuberculosis
VKTLAQQHDCLLIDLDGTAFRGRSPTEGAVQALARLPGRALFVTNNASRSAAEVAAHLTELGFTATADDVATSAQSAAHLLAGQLPAGAPVLIVGTEALAGEIAAVGLRPVRRYDDGPVAVVQGLSMTIGWPDLAEAALAIRAGAVWVAANIDLTLPTERGLLPGNGSLVAAVAAATGATPQVAGKPAPALLRDAAARGDFRAPLVIGDRLDTDIEGANAAGLPSLLVLTGVNSARDAVYAKPARRPTYIGHDLRALHQDAAALAVAPQPGWRVDVGDTAITVSGDGRDDGSGDGLSVVRAVASAVWGSPDAGTLPIRAGDDRARAALARWSLVRTD

SEQ ID NO: 3744 - protein, 264 aa, Mycobacterium paratuberculosis
VVDDRHPHRGERRTRPASWSGPGRARPAQPQTPARRGAPPDRAAADGPPIPPGVEAKQLAPDIRRELSTLDRATADAVARHLVAAGELLDEDPEAALRHARAARARSSRIAAIREAVGIAAYHCGDWAQALAELRAARRMGSKSALLALIADCERGLGRPERAIELARGPEAAELSGDDADELRIVAAGARADLGQLEQALTILSTPQLDSTRTGSTAARLFYAYADTLLALGRNDEALQWFLHAAAADLDGVTDAEDRVSELA

SEQ ID NO: 3745 - protein, 122 aa, Mycobacterium paratuberculosis
VVTVIFARRVRLTGLIVGVLAGLAALAGTLSAPIRADMLGNAFLSALTNAGIAYTQPTSTMAMGQSVCPMLFEPGGSFDAVTADMAQRAGMSYETAGRFTIVAIATYCPAVIAPLLGNRLAS

SEQ ID NO: 3746 - protein, 421 aa, Mycobacterium paratuberculosis
MSSGILDELGWRGLIAQSTDLDALAAEARPMTVYAGFDPTAPSLHAGHLVPLLALRRFQRAGHRPIVLAGGATGMIGDPRDVGERTLNEADTVAEWTERIRGQLERFVDFDESDTGAVVVNNLDWTRQLSAIEFLRDLGKHFSVNVMLDRDTVRRRLEGDGISYTEFSYMLLQANDYVELHRRYGCVLQIGGSDQWGNIIAGVRLVRQKLGATVHALTVPLVTAADGTKFGKSTGGGSLWLDPALTTPYAWYQYFFNTADADVIRYLRWFTFLSADELGELERATAERPQQRAAQRRLARELTVLVHGEAATEAVKHASRALFGQGELERLDAATLAAALRETSVAELKPGAPDGIVDLLVASGLSESRKAARRTLGEGGVSVNNVRIDREDWAPQPSDFLHGKWLVLRRGKRTIAGVEKL

SEQ ID NO: 3747 - protein, 205 aa, Mycobacterium paratuberculosis
LRDAAEQLLVDPVEAARRLLGATLTGRGVSGVIVEVEAYGGVPDGPWPDAAAHSYKGLRARNFVMFGPPGRLYTYRSHGIHVCANVSCGPDGTAAAVLLRAAALEDGTDVARGRRGELVHTAALARGPGNLCAAMGITMADNGIDLFDPDSPVTLRLHEPLTAVCGPRVGVSQAADRPWRLWLPGRPEVSAYRRSPRAPAPGTSD

SEQ ID NO: 3748 - protein, 425 aa, Mycobacterium paratuberculosis
MHGIDPAATAWLLASTALVLLMTPGLAIFYGGMVRTTGVLNMIMMSFISIPLVTVAWLLVGYTMAFSQDGMSGLVGNLRHFGMLGITPDTTHGAVPELLYATFQLTFAIITAALVSGAIADRAKFAAWMVFVPVWTVAVYSVVAQWVWGPGGWLARLGVLDYAGGLVVEIVSGSSALALALVLGPRIGFKKDAMRPHNLPLLFVGVGLLWFGWFGFNAGSALAANGTAAAIFLNTLVAGCLGMLGWLSVEQIRDGRPTTFGAASGVVAGLVAITPSCGTVNTLGATVVGLAAGVVCSFAAGAKLRFNYDDSLDVVGVHFVGGVVGVSLIGLFATAVMTAGPQGLFYGGGVAQLGKQALAIAVVALYAFTVSFLLAKVIDRVMGFRVSAEDETTGVDLTQHAETAYAEGVHGHLPQRRPGPGDRLK

SEQ ID NO: 3749 - protein, 253 aa, Mycobacterium paratuberculosis
MMSSSGDELIGGAEPAVRIEHLRVVRGKRPALHDFSVQIAKGSITGLLGPSGCGKTTLIRCIVGTQILTKGRVTVLGKPAGSAELRHRVGYLPQDPTIYNDLRVVDNVRYFAALYGFDGQAADAAIDRVGLTDHRIALCGNLSGGQRTRVSLACALVCRPDLLVLDEPTVGLDPVLRADLWDQFAALARGGTTLLVSSHVMDEADHCGDLLLMREGRLVAHTTPNRLREDTGCTSLEDAFLSIIKRSTMREAG

SEQ ID NO: 3750 - protein, 226 aa, Mycobacterium paratuberculosis
MILLVPVLVITLMFFMFENAPHRPGGPTPFNNACLVLLGLFPLFVMFIITAITMQRERASGTLERILTTPLRRLDLLIAYGTAFSIAAAAQAILACTVSFWLLGFDTAGSPVWVFVIAIVNAVLGVGLGLLCSAFARTEFQAVQFIPLVMVPQLLLAGIIVPRALMPHWLQWISNVLPASYALEALQQVGTHPELTFIAVRDIVVVLGFALAALCLAAATLRRRTP

SEQ ID NO: 3751 - protein, 207 aa, Mycobacterium paratuberculosis
VTTTGTPRRRRGRPAGSSGSRERILASARELFARNGIRNTSIRAVAAAAGVDSALVHHYFGTKEKLFAAAVQIPIDPMQVIGPLREVPVDDLGYALPSMLLPLWDSEVGAAFIATLRSILAGEEISLFRTFIQDVIGVEVGPRVDNPAGSGVIRIQFVASQLVGVVMARYILELEPFASLPPEQIAATIAPNLQRYLTGDLPDGLAP

SEQ ID NO: 3752 - protein, 71 aa, Mycobacterium paratuberculosis
MIDEALLNILVCPADRGPLVLVGQELLYNPRLRRAYRIEDGIPVLLMDEARDVDDEEHARLMAQVRPADPR

SEQ ID NO: 3753 - protein, 968 aa, Mycobacterium paratuberculosis
LETGTVASPSQIVESVRMYKLRRYFPPDSRPGQPPVGPPVLMVHPMMMSADMWDVTRDEGAVGILHAHGLDPWVIDFGEPDKVEGGMRRTLTDHIVALSQAIDTVKDVTGADIHLVGYSQGGMWCYQVAAYRRSKSLASIVTFGSPVDTLAALPMGIPANFAAPAANFMADHVFSRLAIPSWMARTGFQMLDPLKTAKARVDFLRQLHDREALLPREQQRRFLEREGWIAWSGPAISELLKQFIAHNRMMTGGFAVNGQMVTLTDITCPVLAFVGEVDDIGQPASVRGIRRAAPDAEVYECTIRTGHFGLVVGSKAAQHSWPTVAAWVKWLSTGGDKPTGIDPMADQPAEHTDSGVALSSRIAHELGEASEAAIGLVRGAANAVVTANKSVRTLAVETARTLPRLVRLGQINDHTRISLGRIIEEQAHDAPQGEFLLFDGRVHTYEAVNRRINNVVRGLIEVGVRQGDRVGVLMETRPSALVAIAALSRLGAIAVVMRPDADLAASVRLGGATEILTDPTNLESVLASDRQLLRQVLVLGGGEARDLHLPEDSAEQPYVIDMEKIDPDAVELPGWYRPNPGLARDLAFIAFSAAGGELVAKQITNYRWAVSAFGTASTAALDRRDTVYCLTPLHHESALLVSLGGAVVGGTRIALSRGLDRDRFVQEVRQYGVTVVSYTWAMLREIVDDPAFVLHGNHPVRLFIGSGMPTGLWGRVVEAFAPAHVVEFFATTDGQAVLANVSGAKVGSKGRPLPGAGRIELGAYDTEHDLILENDRGFVQIAEPHQVGVLLAASNGPIDPSASVKRGVFAAGDTWISTEYLFYRDDDGDYWLAGRRGSVVHTPRGVVYAEPVTDALGCINGVDLAVTYNVPVGGHEVAVSAVTLLPGASITAADLTEACAKIPIGLGPDIVCVVPEMNLSATYRPTVSALRAAGIPKAGRQVWYFDAESGQYRRLTPAARAELSGGRS

SEQ ID NO: 3754 - protein, 131 aa, Mycobacterium paratuberculosis
MSRFRIVNAMIAGALLSGGVAAAGLGLGAGAAHATKGPFTWCPGQSMEWPSGPNSSRGHLNYVWDINVCHTWYVVPDGWGNVPRIALNGQQTLQSSNAWDGDNPPGDNPGNVQCGLMWCPNPGGQDPGFHG

SEQ ID NO: 3755 - protein, 244 aa, Mycobacterium paratuberculosis
LKLTAGRSPVLWAASAAVTDGAGAGGCVRSIPAEARRRHDDTGFSRPPSPRHHPRGRAVIAAHRRVTGRHHASEKGRHMLLLGNGGRRRAAGGDGLGEVQQLAERALYDVAHGRFERSLSGLTAMAALVTTAEIYFEHYKASFGNKWMWSPIVVTPPVVVAGIGGVFSRRWAKVWLPITAAVYTANGLMGEYLHARGVARKPGGWKHASYNVPMGPPIAAPGLMCMVGGMGLLASILRRERFRR

SEQ ID NO: 3756 - protein, 248 aa, Mycobacterium paratuberculosis
MADTSRPDHLPNLRDDGKPPHPSWLPRQRRGTTPQMIGRYPDFDVLETAGHWDEATRNVVLARLEPPGPLRFFGPEEEPCLRAFCDTVLAQDVEPRVPVAESVDAKLADGRLDGYQYADMPDDRDTWRLVLRGLDETASRRYGAGSFAAAEPQTREAIIEEFSRGELHGGSWDSLNVKRAWSVCMRMTLSGFYSHPWAWNEIGFGGPAYPRGFMRLGGATGPAAAREPYETRGATDEDPVQVVQNGEL

SEQ ID NO: 3757 - protein, 566 aa, Mycobacterium paratuberculosis
VMGDFWRGLLKGAVGPRDNDSRFLLDVHSRDLPGERTMRRYADDDEVDLVVVGAGAGGSVLAQRLARAGWRVVVLEAGPFWHPDEDWVSDEAGSHPLYWTQKRIIGGADPIELGKNNSGRGVGGSMIHYAGYTPRFHPSDFATYTLDRVGADWPIRYEDLRRHYEQVELELPVAGQNWPWGDPHRYSFAPHPISGAAAKLWEGALKLGIEMRVGPVGIVNGTFGNRPHCIYRGYCLQGCKVNAKASPYVTHLPDALAHDVEIRANCMAARVELDGSGAARGVVYYDEAGGTERLQRAKVVAIAGYSIETPRLLLNSVSDRFPNGLGNNDDQVGRYVMVQGATQSAGRWSEEVRMYKAPPPEVTSEQFYETDSSRGFARGFSIQTVSPMPIGWAEHVLADGHWGRALREYMRDYNHWATIGVLNELLPQPDNRVTLADEKDPYGIPVARFDYTLCDNDKANMAYSTNVIGDILRAADAQDVLTIERFAHLIGGARMGTRPDNSVVDSDHRVWGVPNLLVADGSVCPTQGSANPALTIMALASRLAERLAAGKIDTAAGRRSKAAARG

SEQ ID NO: 3758 - protein, 598 aa, Mycobacterium paratuberculosis
VAEQTVDAGTVFAPRVLREYALLADGERGALIGPQGDVAWMCAPRWESDAVFSNLVGGGGVYAITPTDVRHVWGGYYEPGTLIWRNRWITRDGIVECREALAFPGSPERVVLLRRLVACRGTVRVRVLLAPAAEFGKHGPGRPRLDDDGVWSGRSGRLRWRWLAGCDARPVDSAGHGAGELLGCEITLDEGGRHDLVLELSERTLPERLPDPGLAWDATAAAWQRSVPALNCTIAPRDGRHAYAVLRGLTSSSGGMVAAATLGLPERAHTNQNYDYRYAWIRDQVYAGMAAAAVGTTELLDRAVGFIGARLLEDGADLKPAYTVTGGAVPGEETLDLPGYPGGTDKVGNWVNQQFQLDVFGEALQLLAVAGAADRLDAEGWRAAQAAIRAIEKRWREPDYGVWEIQDERWTQSRLACVAGLRAVAKLAGAGPELTACASLADAILADTASESLHPHGYWQRSPRLPGVDASLLLPPVRGAVPADDPRTRATLDAVRRDLTDDGFVYRFRHDERDLGEAEGAFLLCGFMMALAEHQLGHTHCAMRWFERNRAACGPPGLFCEEYDVRQRQLRGNLPQAFAHALMLECTATLAEDAVHHD

SEQ ID NO: 3759 - protein, 340 aa, Mycobacterium paratuberculosis
MTQSTQTVVITGASAGIGRATAKEFGRRGANVALLARGAAGLQGAARDVEAGGGKALALPTDVADHAAVVAAADETEAAFGPIDVWVNVAFTSVFAPFSEISAEEFKRVTEVTYLGYVHGTMAALAKMRPRDRGTIVQVGSALSQRSIPLQSAYCGAKHAVNGFTESVRCELLHEGSRVRITLVQMPAVNTPQFSWVLSRLPRHPQPVPPIYQPEVAARGVLYAADHPGRKQYWVGDSTMVTLLAQKFAAPLLDRYLGRTGYDSQQTEQPVGGDRPHNLWQPLDQEPGSDHGAHGEFDDTSHAHSPQLWASQHPVISGTGALGAAGLGTWLAARARRWTR

SEQ ID NO: 3760 - protein, 400 aa, Mycobacterium paratuberculosis
VGLPTSGNQRHRRARRRRAGHLAGGAGPPVDAMTPDPAIDEVTARVYQIPTDAPEADGTLSWSSTTLVLAEVAAGGRRGIGYTYGDGACAQLITGALAGSVTGHSALDVAARWQAMVRAMRNNGRPGLVSCAISAVDTALWDLKGKLLGLPVCRLLGMAHDSVPIYGSGGFTSYDDNATRAQLERWVHEWRIPRVKIKIGESWGSHERRDLDRIALARTVIGPDTELYVDANGGYRRKQAIRMAHAMAGHDVTWFEEPVSSDDLAGLREVRDQVSADVTAGEYGYDLAYFHRMLAADAVDCLQIDVTRCGGITDWLRAAAVAAAHNVDVSGHCAPNLHAHVATAVANLRHLEYFHDHHRIEQMFFDGALSPQGGVLRPDQQRPGFGLEFKQRDADRYRMR

SEQ ID NO: 3761 - protein, 256 aa, Mycobacterium paratuberculosis
VRGLQGKTFIVAGGSTGIGAATAERLASEGAAVTVGDINIEGANATVGRITQSGGRAIAVEFDLADEASVRNLVQKTIGEFGALHGLHNVGSDLSAENLGRDTTLLDTDFDVWRRTLDVNLLGYVRTSRAVLAHLLQQGSGSIVNTSSGGSLGTDPMHVAYNAAKAAVNQLTRHIANNWGAQGVRCNGVMPGLVMGETQKQQNDIQLQQMFLQAAKVTRLGEPRDIAAITAFLLSDEAEWINGQVWYIGGASHMRQ

SEQ ID NO: 3762 - protein, 270 aa, Mycobacterium paratuberculosis
LADNKVALITGAARGQGRAHAVRLSAGGADIIAVDIAGRLPESVPYESPTRDDLAETARLVEANGRRAITAAIDVRDAEKLSAAVGHAVAELGRLDIIVANAGICCPAPWDQITGQAFRDTIDTNVIGTWNTVMAGAHHIIAGRRGGSIILIGSAAGVKMQAFMVHYTASKHAITGMARAFAAELGRYNIRVNSLHPGAVDTPMGTGRMRDALESAAATYPHLEGLHKPLLPDGIAQPEDIADAVAWLASDQSRFVTASGISVDLGVAYC

SEQ ID NO: 3763 - protein, 354 aa, Mycobacterium paratuberculosis
MAIDLTGGIDPSRELVFAERPENPEMRDSVSFWVVDDRGEIGLPRIGIEAVAANWDAHDIQVNVAYPDGRVYRLRANGPSLPAAGPDGRPTVLGAGGLAFRCVEPFHTWTMTYEGKAVQTSSADLVSGRKDGPLVDVAFEVEAAMAVPPWVQGALRNDAGQQLKSSIEGNLMGGPRYEQLFRAAGSVTVDGSERRFSGSGLRIRRQGVRKLAGFWGHAWQSAVFPSGKAFGYIAYPPRLDGQPTFNEGYVFTGDGPLIPARVVQAPWLTRLQALGEDVSLVLETGHGVVAVEGETVFSTHDIHHDDDSYSVHAMKKEMPSFPALQQAGVRYRWDGEETYGMLERSNPLDKIHRD

SEQ ID NO: 3764 - protein, 234 aa, Mycobacterium paratuberculosis
VPTDANGPMECHELMALSFASHLFQSLAQVPTYSAWLVADADLTSALAYERRVLKLLAWGEPTRPWRLKCPSHVLWLDRLAAVFPDAKFVMTHRDPTDVILSVADLYADIIGQFTDDIDRPYIGRLNVEHWSLGMARTLQFRAAGNDNRFYDIDFRAMQADPIGEVTGLYRWLGEQVSDEFEGRMNSWWAQAATEREPSSHADPVQFGIDLDSIRPLFADYITAAADWTAHADI

SEQ ID NO: 3765 - protein, 262 aa, Mycobacterium paratuberculosis
LMDLSGKKAVVTGAGGDGLGQAIANRLGGLGADIALIGRTLEKVQRRGREVEERWGVKTVAISADMSDWDQVHNAVREAHWQLGGLDIMVNNPVMVAGGLFETQTKEQIDFTVLGSLSMMMYGAHAALQFLLPQGSGKIINIGSVGGRIQQRGLVVYNACKAGVIGFTRNLAHEVALRGVNVLGVAPGIMLNPQLKQYVLDPQDDQERAGRAAIIEAITQQVQLGRASLPEEAANMVAFLATEAADYLCGQTIDVAGGQWMG

SEQ ID NO: 3766 - protein, 317 aa, Mycobacterium paratuberculosis
VDTHRLKYFLRIAEQGSITGAAASLGIAQPALSRQIRLLEEDLGVALFRRTRRGVQLTEEGERLRASTAAPLRQLELAMQYAGSPIARLARGVRLGILDTTVDVFAAHLLSSLAAAFPKVTFSVETGSTDQLVEAMLKGAVDVAVINPVPDDRIFYRDLLTEDLVVVGAATSDLDSGQMMPFTELVELPLVVPRSHTGIGNVIENAALRRKVKISWRIATDSLALTKRLVAAGLVYGVLPLSACLNEIDSNQLRYTPLTEPPLTHRVGVAATSNLELPREVTAKVGNILREETAHLIKTGRWPARLLSPQPWDPAVT

SEQ ID NO: 3767 - protein, 377 aa, Mycobacterium paratuberculosis
VRATTSTNACFRLAGNLDHTLSAPQHEQVWKRAKRGIDMSTSPSGLHGRDRAAMTVNSNDETVPCAEPLGSDVVEGDGDLSAVERVLGLGEPQRVGRFRFFLDGHRWEWSDAVARMHGYRPGQVQPSTELLLQHKHPDDRERVAAVLDQVMRGKPFSSRHRIIDTAGRTHWVVVAGDRMLDDSGALAGTSGFYVDVTDSLHSDITNVLSAVADSRARIEQAKGGADGRLWHLRRAGVRHPGVALAGNQPQAARRRRPVSGRGGQQGVPGNAAPGRPRPADPGMTAQGRIARLLLRPSPAGIVAAQGRIARLLLRPSPAGIVAALGSGRWRTYWELRPYTWNTRHRWSSSRSRSGSTTAPASASSGATATANPACCGC

SEQ ID NO: 3768 - protein, 591 aa, Mycobacterium paratuberculosis
VAHLLGAEAVHLEYPTQVVFESITLGVNDGARIGIVGRNGDGKSSLLRLLTGEQQPDTGRVTRRSGLRVGALSQADTLDPDHSVGWTLVGDAAEHQWAGDPRVRDVVAGLVSDIDWRASVSTLSGGQRRRVQLARLLIGEWDVIALDEPTNHLDIEGITWLAGHLRQRWARNTGGLLLVTHDRWFLDEVATTTWEVHDGIVEPFDGGYAAYVLQRVERDQMAAAAEAKRQNLMRKELAWLRRGAPARTSKPKFRIEAANQLIADVPPLRNSVELAKLATARLGKDVVDLLDVSVSFDGRPVLRDVEWRIAPGERTGIVGANGAGKSTLLGLIDGTVRPDSGRVKRGKTVQLGVLDQRGAELAAIADDRISDVLGRLRAGYRVDGREVTPAQLLERLGFGRGQLAARVGDLSGGQRRRLQLMLTLLSEPNVLLLDEPTNDVDTDTLAAMEDLLDSWPGTLIVVSHDRYLLERVTDQQYAVLDGRLRHLPGGVGEYLRLAAQRRDAAPPAGPTSVAPQAMSGAQRRAAEKELAAADRRLARLAEQIKDKHEELAGHDQSDHVGITRLTRELRALEDEVAAAESRWLELSELLE

SEQ ID NO: 3769 - protein, 427 aa, Mycobacterium paratuberculosis
VRYRPGEALLALYRRRGPVIDAGAGRHGYTLLLGAEANKFVFANADAFSWRATFENLALVDGPTALIVSDGDDHRRRRSVVAPGLRHRQIQDYVTTMVSCIDRVIDGWRPGQRLDVYQHCRAAVRRSTAESLFGPRLAVHSDALGEHLQPLLDLTHQPPQLVGLQRRINAPAWRRAMAARQRINNLVDTLIADARAAPNPNDHMLTMLIDGRGDEGYTLSDNEIRDAIVSLVTAGYETTSGALAWAVYLLLSQPGAWATAAGEVRRVLAGLPPAAADLSGLTYLNGVVHETLRLYPPGVISARRVMRDLRFKGRRIRSGRLLIFSPYVTHRLHEIWPEPRRFAPERWNPDAPGYRRAAPHEFIPFSAGLHRCVGAAMATTEMTVMLARLLARTRLRLPAQRLRAANVAALRPTPGLTVEVIDSVPAQ

SEQ ID NO: 3770 - protein, 353 aa, Mycobacterium paratuberculosis
MSVIAGVFGAVPPHRYSQREITDEIVKFPALREHEEVVRRLHAAAKVNSRHFVLPLQQYHSLTDFGEVNEIFIDKAVQIGCDALLGALDEAGLRPQDIDTIATTTVTGVAVPSLDARIAGRLGLRPDVRRVPLFGLGCAAGAAGVGRLHDYLRGAPDGVAALVSVELCSLTFPTVKPTVSGLVGTAMFGDGAAAVVAVGDRRAERLGATGPDILDSRSRLYPETLHIMGWNIGSAGMQLVMSPELPAVVEKHLADDVTGFLAAHGLTTGVVGAWITHPAGPKVITAIAATLDLPAEAHELTWRSLGEVANLSSASVLHILRDTIAKPPPAGTPALMLAVGPGFGSELVLLRWH
